United States Patent 12,642,819 (COMPOSITIONS AND METHODS FOR TREATING INFLAMMATORY BOWEL DISEASE) - sequence listing, part 106

SEQ ID NO: 55 - DNA, 3014040 bp, Ruminococcus torques (residues 1-1,507,020 of 3,014,040)
aagtcatgctttttcatgcaagcaagaaacgcatgaccttttgacccttgtatcatacaaatagccactgctcacatagattctgcaaacagtgacacttgttgttctcattgttagatttaatcctcggatgctcttcttaaattagactcaaacagacgattatatccaagccattctgttcctgtttttcctttgaacagttctgtcaatgtctgaagctttgcatctgttgaatctgccatattcagtgccactgcctctgccagtgccggtttctttggagaaccgtattccagttcaccgtgatgtgccacgatacaatgcttgagttcatgagcaagcttcaccggaaagtccgggatagaacgaatcgcatcatcgatcatctcgacaccgatcacgatatgtccgatcagctgtccctcatctgtataatcattgtccggaaaatcagaaagttctttcacttttccaatatcatggagaattgcagagctaaggagcagatctctattcaaaatagagtagcttgttgcaaaataatcacacatacgagttacactgagtgtatgttcaagcaatcctccggaaaatccgtgatgtactgtctttgctgcggaatgtgccttgaattttttgataaatgcttcatcttttatatagtagaattccaacacctgtcttaaatatttgttagagatctgacgaatataagctgtcagttcctcgtacattccgtctacactcttatctgttgtcggcatatagtctgccggattgtattctccctcttccgcctttctgatctgacggatgttcaactgaagatttccgttataattgatcacatctccaaaaacttcgataaagtccttctcatcataatctgcgattccctgggagttcggatcccatacttttccatccaatgttcctgttttatcctgaagaatcagattatcatacggctttccatttcttgtctctgcggaacgttttcctttacaaagatatacattcctgattgtttctccctcgcataatccatctataaatctcattttctgcctctttcacttgttattctttactttcaatcgtaacatcaaatttaatatctacatatccttcagatcctcggcgtttcccttctactttgatctgatctcctactttcagtgtcaacatcagtttacggtaagcactcatgcttacaattttctctccattcacagaacagatcacatctccactctgtatgcccgctgccattgcaggtgaatctgctgccacgtcaatcacatagactcctgacggcatgccctcttctttctgaattccacttgtcactgctgttcctgacacaccgatataaggtacacttgcaccgttcgctaacagctggataaccaacttcagatctgagatcgcataagcattcgcagtacgtattccacgttctttccagatatcagaagaaatcattccgatcacttctccatccagattgaataaaatacctgttccttcggatgcactgctcatatcggtcgcaatcacactatactctccgtcgcgtccgatttctttatagtttgacgaactgacaattccgtaaccgcttcctccggcataaccgaaaatatttcccagtgcgaatataacatcaccctgttctgtcagattcgaattaccaagtgatgctacacttgaagcactccatgtggcatctgaaaggctttttttatctaccgcaaatattgcaaatccactatttttatccttttttttcaggcttgccttatattctgatttatctgaaaatgtaacgcaccactcttttgcatcttcgcagatcgaagcataggacaaaatcagtatctccggtccgttatccgcaacgatcacaccagatacgctctcatcaattccggtcgcttctgcattccagttctcctgttctgctcctttcgtaacagataccacactcttcttcgctgtcagtgctttctcatatgctttggacatcatctgtacataactgatctcctgctgattctgcgcgtcattctgctctatcgtgtcgccaccttctgctaaatcttcctctgattgattgtcctcctggattgtcacaacttgtgtcttttcaggaaataaatgctgtgcaagcgggcgcaatgcaaagaatcccaggcatgcagagcctcctaaaaccagtccgcatattgcaatccggatgagctgtttcattccttgctgtctgctgatcttctttggttttatcgtctcttcgagaaatgcaaaagattcctttttctctgactgttctaaatttttcccgtcaggaccctcttccggaacctgaccattacttttcttttctgacattgacatgaacctcattcgtgactgttcacttccgtgtcaactacaaaatcaaccgacacggacatttccattacttagtataactgattcatatagattgttcaatatctataaaagccttttatttaatgaaataataaggtacaataagactcggaaatagttattgttcacatgtattgtgaacagctacatgattaaaaaattagtattaagttgaaatgacagaggaaaataaatgaatcaaaaaacattatttaaactggaatatgataagatcattgctcttcttgaaaaagaagcgacatctttccgtggaggacagctctgccgtcgtttgaagccaatgaccgaccttcataagatcaacacttatcaggaacagactgctgccgcttatacacgaatcgtgcaaaaaggacgtatctcgtttggtgacgctgcaccggttgaagagtccatgaagcgtctggagattggtggctcactcagcagcacagaacttctccgtatttcccgcctgcttgtaaatgcagccagggtaaaggcctacggaagacatgatacacaagaggacgcttgcgactgcctggatgaatattttaacctgcttgaaccactgacaccactttcaaatgaaatcgaccgctgtattatcggcgaagatgaatacagtgatgatgccagttccacactgaagcaaattcgtcgaagcattaataacatcaatgacaaagtacacgccactttaactacactggtcaacggttcccttcgcacttatctgcaggatgcaatcattaccatgcgtggagaccgctattgtgtacctgttaaagcggaatatcgtggacaggtacagggactcattcacgatcagtcttcaacaggttctactctttttattgaacctatggcaatcgtaaaactgaacaatgacttaaaagaactttatgcaaaggagcaggaagagattcaggtgattcttgcaaatctaagtgaagaagccgcacaatatatcgaggaaatccgtgtggattaccgttctctgacggatcttgacttcatttttgcacgaggtgctctggcaatgtccatgcgcgccagccggccgcttctgaatgaagagggacgcatccgtatccgtgagggacgtcacccactgctcgatccgaaaaaagttgttccgatcaccgtgacacttggggaggacttcacactgctgatcatcaccggaccaaataccggcggtaaaactgtttctttgaaaacggtcggcttgttctgtctgatgggacaatccggacttcacattcctgccggagaccgcagtgaactggctgtatttcatcagatttatgcagatatcggagatgaacagagtattgagcagagccttagtacattctcttctcatatgaccaatattgtctctttccttaagaaagtagatgaacgttcgctggttctctttgatgaacttggagccggtacagatccgacggaaggtgccgcacttgcaatttctattctgtcccatcttcaccagagaggaatccgtacaatggctaccacacactacagcgagttaaaagtctatgcactttccactccgggtgtggagaatgcctgttgtgaattcgatgtagaaagtcttcgtccgacttaccgtctgctgatcggtattcctggtaaaagtaatgcatttgcaatctccgggaaattaggtctgccggattatattattgaagatgcaaagaaacggctcagtgaacaggacgtttcctttgaagatcttcttactgatcttgagacaagcaaacggacgattgaaaaggaacaggaagaaatcgcacgattgaagaaagaagcggaagacctgaaagcccaggcgaaacagcgccaggagaaattagatgatcagcgcgaccgcattttacgcgaggcaaatgaaaaagcaaacgccattctgcgtgaagcaaaagaaattgcagacaagacgatcaaggatttccgtaaattcggcaaggaaaacatttctgctgccgagatggaaaaggaacgcgaaaagctgcgtaagaagatcaaagatacagcatctgcgtctgcaatgaaagcacagaaaccaaagaaagagcataaagcatctgacttcaagctcggagaatctgtcaaagttctcagcatgaacctgacaggaaccgtaagctctctacctgatgccaaagggaatcttaccgtacgtatgggaatcctcagttcccaggtcaacatttctgatctggagattatcgaggaagtctctccatatgcaccgaagaaaatgaaccgtacttcaaaaggcaaaatcaaaatgggaaaatctctttctgtccgtcctgagatcaatctgctcggacatactgtcgacgaagccgttgctgagctggataaatacctggatgacgcaatccttgctcacctgaatactgtccgtgtagttcacggaaaaggaaccggagcactcagaaagggaattcatgaatatctgcgtcgtcagaaacatgtaaaatcctatcaccttgccgaatttggtgaaggtgacgcaggtgtaacaattgtagaacttggctaattattttaaacagttaccaactaccttatcatggttaatgggggaaaaagaatgtttggaaaacagaaaatcctaatcgtagatgatgatgagaatatcgctgaactgatttctctttatctcacaaaagaatgttttgatacaaaattagtatatgatggagaagatgcgcttgcagcttttgacagctatcaaccaaatctgattcttcttgatctgatgcttccgggaattgacgggtatcaggtttgtcgtgagattcgttccaaagctgccacaccgatcatcatgctttctgcaaaaagtgaagtatttgacaaagttctcggactggaactcggagcggatgattatatcatgaagccatttgaccctaaggaaatggttgcccgcgtaagagctgtcctgagaagatatcaggttggacaacagaatgatacttctgttgaaaaaacaaaatgtgcagagtttgacggattgacgatcaatcttacaaactactctgttgtgtgtgacggacatcctgttgatatgccgccaaaagaattagaactcctttattgtcttgctgcatcaccgaatcaggtattcacaagagagcagctcttagaccgtatctggggctatgaatatatcggagacactcgtaccgttgatgttcatattaaacgtctgcgcgaaaagattaaagaccaccctcactggaatatcagtactgtatggggaattggttacaaatttgagacaaaatagatttaaatcatcggtcctggatactgtaaacagcatctggtggccgatgagtacttagggagaaattatgaaagcagttctgcatttaaaatttattgtactttatattattttcgggtttttatgtgttttcacaacagcaacattaaccacagaactgatcaccgaacgtctggaaaaagatacttcgcagacattatacagagaagcaaccatgattgcggataattatctgccttcctatttttcaaacgaatcttccagctgggctgttcattctcagttatctgctatgaagacgtatcttaattcttctctgtggtttgttgaaaaagatggtacaatgatcacctctgccaacctgaaggatactactgcgccacaatccgtcaataattttgatccggccgaaatcgggagcaaccagtacatgatcggaacctaccataattattttcaggaagatatgattactgtaatggctcctgtcacacagggattttatacaaagggatatctgatcattcacagcccggtctctctgatcaacgaaagatgccgcacgctgatggttccggtttatatttctcttggagttattttcctgttgtccttcatcttcctgcttgggttccatttcttcgtccatcgaccattgttgctgatcacagaagctgcgaagcaatatgccatgggcaatctggattacgagattccggtaaacaggcatgatgagatcggatatttatccgcatcactgaattatatggctacacaactgaaggactctgatgattatcagaaaaagatcgtagcaaatgtatcccacgatttccgttccccgttgacttcaattagggggtatgtagaagcaatggcagacggaacaatcccaccagagcttcatgagaaatacctaaatatcattctcttcgaaacggaacgactgactgacctgacaacggatcttcttactttgaacgaatttgatacaaaagagctcctgctcaataagacttcctttgatattcaggagatgatcaaacatactgcccagtctttcgagggtgtctgtactcagaagcatatatccattaagctctttctactgtctgaacagatcaatgtaatggcggaccgacgcaaaatccaacaggttctttataatcttctggataatgcgattaaattcagtgagaatgactcttctattacagtagaagtaacaacgaaaaatgataaaatctttgtttccgtaaaggatcatggaatcggaatctcaagaaaggaaatcaataagatttgggagcgtttctacaaatcagatctttcccgtggaaaggataagaaaggaaccggacttggactttcgatcgtaaaagaaatcatacaggctcacgatgaacatatcaatgtgatcagtacagaaggggttggcaccgaatttattttttctttaagcaaagcttaaaggacaacgtgaacagaacaaagaatgtgccttggcacattcttacgcctgcggcggtcgcttgcgacacctaccttgtacgccgcagtgcgcatcctgaaagtcatgctttttcatgcaagcaagaaacgcatgaccttttgacccttgtatcaaatcatttaagtaagaagaatgccgggagcattcttcttacgtaatcaggtagaaatagaatagcatatttcagggaaaagaacaagtgttcttttttacattccgtccttcagtacattgtgatcacgcagtaccttttcaatcacatttccttttacgagtttcagaagaggtttcttcaatgcgttcagcggtccaggcagctggatctcaagtggagattttccgtccataagttttacagagctgtcgagaagctcgcggatatcataaacacttccccatacttcaggcacaccacggtctactttgagaagtccataaacagcttccatagcagtacgtacagaatactctgttgtgaaaacagtatctcttggagtttcagcaaactgtccgaggaaagcgaagttgacacatccatccggaataacatccgggcggtcaccttttgtacgtggcatgaagaatgctgtgatgtaaggcatcattgtcggtacacagattgcactgttttctgccagatccatgatctgatcttccggaacaccaaggtgatagagccattctgctgtgatttcttttccggtacagtctttcataggcttcttgatatagtcaccaggcacatcagtaaataatccataaacccagacacataccttatctttatcctggtctttgaactgtccctgacgattgatcgtccagcttaacagccagctggaatcctggcagctgacgataccgccggttacaacatttccggtgcgagggtcacgtttgcaaatgtctgtgatataaggaatgatcttgtcatccagagttgtaactgttgcagattcccagtttgtcttggcaatgtcggaacagaatttttccggatgtccgaaggatggatcctgacgggcaatgtttttccaaaggttccatacaccgcttgtacggacttcggcatccccgtttggtgcatggttctgatctccgtaaatggttccctctgtacagcttccgtttgtgacaaatacgaggtcgttttctgtcaggacgatacctctttcctgtccgtttactttacattcaattgcagatgcaatctttttgtctccttcgaatttgaatacaacatttgtgacttctgtattgaactggaagtccacaccggcatcttcgaggtatctctgcatcggaagaatgagggattcatactgattatatttggtaaatttcaacgcactgaaatcaggcagtccggcaatatggtggataaatctctggaaatataatttcatttccaaagcactgtgccagttttcaaatgcaaacattgttctccaatagagccagaaagtagaatcaaatacttcttcatcaaaaacatcttcgatggttttatcgtagagatcttcgtcttttgtcatgaagagtttcatgatttccatacagcccttctgactgaggttgaattttccgtctgtatgtgcgtctttgccacgatttacagttgcacggcaaagggaatagttcgggtcatgcttattgagccagtaatattcatcaagtacagaaacaccaggtgtctcgatggatggaatgctgcggaagagatcccacagacattcgaaatgattttccatctcacgtccaccgcgcattacataacctcgggaagtatcatagattccatcacatgcaccaccggcaatatccattgcttctaaaatgtggatctggcatccaggcatctgtgcatcacggacaaggaaacatgccgctgccagagaggcaagtccgcttcctacgatgtaagcatttttctgatttacaccttccggtttctcgggatgtgcaaatgcttcgtagtttccgctggaataatagatgcctttgctgttgcggtcatattttccgcgttcagtgttacgatagttatctggaacggaagaatcggcaacagtactcttcttaaaaatagaattaccggattctgaattaccagattctttttttgccttctgtgcgagataaattgcagttcctgttcctgctgctactgcagagattacaccaagtttagatttcttatttgacataataaaaccacctttctgaaaaaacggattcatgtctcgttttgagatcatctcatcataattactctaaataacgagatatgaagtatagttgttatagttatagtatggacatttttaaagattttcaatttacaaaaagaggcaagtgataaaaaacttatcatttgcctctttttgtaaagtataggtttagtatatttgtgttatgaattttctttttctgaaagtgatgagaaattttcaatagaatgcgtaaggcttccgcggatggtaatactgatcttatgtgccagatcgacataatcgtctttcattccctgtttgatccagtcgagcataagaccgacaaagctgtatttataaaaatcggcaataaagcgccggtcttcttcagaaatactggtgccttctgctttttcctctacaacattcatcagtaaatcggaagtcagatgaaaaaggaaactttcaatctgatcccggctgatgcagcggtaagcatttaatataaatggcttattttcatacacagcatcaaaaatctgtaccagtccttcagaccaggtgtcgtaagtttttttgccggcaagagcacgtgttgcatcttccaggcaggaccattcgaccagatcataaatatctttaaagtgatagtagaaagccatacggctgatgtcgcagtcttcggttaaatcgcggatggttatcttatcgagcggcttttgaagcattaattttttcagagattcttccaatatttgttttgtctggtttatcatagagggtccctccgtttgttacgaaaattaagtgtgactataatttatagtatcacattttccaaaacagatagcaagtattacaccatttttaaaaatcctctggtgatgtattttaattatgggaaaacaaaggagattctgttataatctttaaataaagtaaaagtaaggttataaagatatgaaagaaaagaaaatcacacggattctgcgtattttcatgatgcttcttacctgtatcctgattgcattattctttggaattatgatattggtcagcgatatgcaagggacggctcgtgtagtgaattatgccggacttgtgcgtggaaagacgcagcagatcatcaaactggaaaatgcacagagaccacaggatgaaatgatcagggaagtggatgcgtatattgatgggttacgtcatggcagcgatgaactgaaccttgtccgtctggatgataaagcatttcaggataagatggaagtgcaggaacaattttttgaacaactaaaggaagaaatctataaggctcgagaagaaggatatgagaatacacagattataaataaaagtgaaacattttttacaatctgtgatgagacaacagggcttgcggaaagttattcgcagaagctggcatcttccttaaaccgtctggagaaaattgttgtcgtggatattattggaattgtgtgtctgttgggatatgagcttttcaaggcattacggtacgcggcgcaaaaccgtgtgcttcgtcagaaggtttatctggatgaggcaacaggacttccgaataagaataagtgcgaggagattctggcatctgaagagccgcttacggatagggaatcaacagcggtaatggtgtttgatttaaataatctgagaattattaatgaccggcagggacatgaaagaggcgatcaatatatcagatcatttgcagaacaactgcgggcagcacttccggagaaatattttgtcggaagagacggtggagacgagtttattgcagtgttaaagcaggtggatcataagcaggtgaaagactgtctgcagatgatacgggaacagacggagcgttattccaagaatcatccggatatgttacttagctatgcagtgggatatgcattgtctacagattttccgggaagtaatatgaaagacctgttccgatatgcggataagaacatgtatgtagacaagaatcgggcgaagatgaaagaagcagctgacaagcggagaattaggagtcggctgttacaatctgtaaaagaaaaaggatttcattttacagattgtctgtactgtgatgcgattgtggatcagtatgttgttcttcgcgcaagctcagaatttttccttgcagatgatggtagttattctggtgcagtagagcagattatacaggagctggcggaggaagagaaacgcagggaactttgggagaaacttcagctgtcggaaatccgggaaacactgacagaggaacatcagatagaggaatatttttattgtcacaaagatggtgacagagttttgcgtggccggattacacttttactgcctgactttgctgaaaatggaaatctgcatcattttcttgttgggtttgatgtttatcaggacagggacagattgatcgtaaatgagaaaaagcaactgacacagttctatgaacagctgacgcagtccattttggaaaacggaaactatatagaagcattgatggatacagcagaaataatccaaagtgttaatctgacacagaatttattagaaaagatattttggcaaaacagggaaaacaggcagattccagacataaaacttccatgtccttatgatacgtattgtaagacctgtcagccgttcgtgacaaaagagacgagagaaaattatcgtatcacagaaaatccggcacagctgatcgaacgttttaaagcaggcgaaaagcaggtgactgtggaatatcaggtagagcaaagtgatggaagcagatgctggtggcaggagacagtcctgatgtcacaggagatggtttatgaaagtaagacgaagcagacaagtactgtgatcggtgcaattattttgttcaaggatatttcagagttccatgagcaggaagacagagaaagagaacgtctgcaggttgcatacgaaaaagcggatctcgagagccgtgcgaagacagaattcatgaatcggatgagtcatgatatccgtacaccgatcaatggtattctcggaatgatccagatgatccgtaagaactataaggatcaggaaaagatagaagagtgtgttgataaaatggatctgtctgtccaacatctgagtgaactggtcaatgatgtacttgatatgagtaaaatagagtcaggatatttagagttgcagaatgatacgtttgatctgaatacgttgatagatcaggtagaagttgtggtcagtgcacaggtagaggcaatggaaatcagctatgagagccatcgggaaaaggtgaatcatatgatgctgagcggagatacgctgcagatcagaagaattatgctgaatctgttcagtaatgcaatcaaatataataagcgtggaggaaggatagacacttatgtaaaagaactttcttttgatggaatgtgtgcggcattcgaatttcgtattacggatacaggtgtcgggatgagcagagaatatataaaagaagaattgtttaagccttttacacaggaaataaatgatgcaagaacgcagtataaaggaacggggctgggaatgtcaattgtaaaaggactggtcgaaaagatgggtggaacaattcgggtgagcagtacgcccggcgttggaacggagttccgtttttatttgagttttccagtagttcagccggaaaaggaaagccagaataaagaatgtgtgcagagaacaaaacaggatatgaaagaggataaaccgctcagaggatatcatattcttcttgctgaagataatgagatcaatatggagattgcagagttttatctggaagaagctggtgcacaggtgacaaaggcatggaatggacgggaagctgcggaactatttaaacagtcggggctaagagaatatgatgctgttcttatggatatcatgatgccggagttggatggaaaagaggcatcacgaaagatccgctctatggcagaccaaagggaagatgcagccgagattccgattttggcaatgacagcacaggcgtctaccgaaagtatacatcagtgtaagtcagccggaatgaatgagtgtatctttaaacctgtgaacgcaaaagaactgatcagattacttcaggatatagttgcaaaaatataaattgagagggaaggaaaatgcacgaattaggtgttgttttttatgttgtaaaagatgtaaagaaggttgcggaggaaaatcatgtggagaaggtttctgccgtgacactggagattggggaagtgtcaggaatactacatgattatctgacggattgctggaattgggcgaagaagaaagaaccgcttatggaagaagccgaactgaaaatcgagcagatagaagcagtaacattttgtgaagaatgccagaaagaatatccaacggtagaacatgggaaaatctgtccgtactgtggaagtgaaaatacctatctacttcgtggaaatgaatttttaataaaagagatagaagtatcggactgaaaaatcagcgtcttacctattgtcaaccgctttgatagatgatacaatacgagagacttaaaagaatcacaggtgttgctgatcacagcagcccgtaaacatttcttacagtttctagtaatacacgagttaagcgaggaaaagaattatgcgtcagattatctatgataaagtgaaatacattgcagacaaatacaaaggatacattgatacggaagatttgatgaaggaaggacttacaaatcgtcagatcggtctgttgacagcagaaggaaagcttgagaaggtagcacatggacattattggatcattagtccagagttttccaaaccggaagattataaggcagtggaagtggcacgagtaaatagaaaagcggtgatctgcgcagacagtgcatgctattacatgggcctgattgataaagagccggagattctttcaattgcaacaagaagaagtgaccgtcacaagatgaagatgaattttgaagtcagcagacattacttctcagagcaggcttttgaggatgagaagcatgtgtttgatacaaagtacggttcttacaatgtatatggaattgacagaagcgtgtgcgactgcatccgtttccgtgaagacattgataaagatatctttgaacttgttattgagaactacagaaagtacgataagaagaatgaagaacgtctcatggcatatgcaaaagcaatgcgtatcggaagacaggtagagagaatcggattggatagatagtctataataatgatataagagagtctgtcattttgacaggctctctttaattaaaataagagaaaggaaagagcacattatgaagacattacttgcatatctgaaagattataaaaaagaatccatacttgctccgttgttcaagatgctggaagcatcttttgagctgtttgttccgttggtaatggcggcaattattgacgtgggaattgcaaatcaggataagccatatattgtgaaaatgtgttttgtactgatcgcgctgggaatcatcggacttgtctgttccattacagcacagtattttgcagcgaaggcagcaacaggagtcggaacgggaataagacatggattatttgaacatatccagaaatttacatttacggaaatggaccaattaggaacatctacattgatcacacgaatgacaagtgatatcaatcagatccagtcaggtgtgaatcttgttttacgattgttcttgcgttcgccgttcattgtatttggtgcaatgatcatggcatttacagtagatgtgaaagcagcacttgtatttgttgtgacgattccgcttctttcacttattgtgtttggaattatgcttgtgacgatgccgatgtataagaaagtgcaggcagatcttgatcaggtacttcttgcaacgagggaaaatctgacaggagcaagagttatccgtgcattcaataaagaagaggatgagacgaagcggtttgaaaatgcgaatcaaattcttacagatgcgcagaaatatgtgggacgcatttccggaatgatgaatccgctgacatatattattgtaaacggagcaatcatagcattgatctatgtcggtgcagtccgtgttgatatcggagatctgacccagggacaggttgtggcacttattaattatatgtcacagattcttgttgaacttgtgaagttagcgaacttgatcatttccgtgacgaaggcagcagcatgtctgaaccgtgtggagagtgtgcttgctgtgaaaccagatatgaatgagggcgatgtaagatggaagagcaattcttccgaaacagattgggatttgaaaaataaaattccggtcgtagaattctctcacgtatctttgacctataaaggaacttcagatacatccttatctgatataaatttctgtgccaagaaaggacagacgataggaattatcgggggaacaggttcaggaaaatcgtctcttgtgaatctgattccgagattttatgatgcaacagacggtacagtgaagatcaatggacgtgatatcaaagaatatcagacagagaacctaagagaacatatcggtgtcgttcttcagaaagcagtgcttttcaaagggagtattgcggacaatctccgctggggaaaggaagatgcaacagagcaggaaatgtatgaagcattggacatttctcaggcaagagaatttgttgatacgaaacaaggtggattagaatttcagattgaacaggggggaagaaatctttccggaggtcagaaacagagaatgacgattgcgcgcgcactggttcggaaaccggagatcctgattcttgatgacagtgcatcagcgttggattttgctacagatgcggcacttcgcaagtcaatcaaagagatgaaaaaccagccgaccgtatttatcgtatctcagagagcagcatctattcagcatgcagaccagatcattgtgttggatgatggagcaatggcaggaatcggaacacatgaagaactgttgaaggattgtccaatctatcaggaaatctattattcacaatttccaaaggaggcggtaatcaatggctgataaaagaaagacaagtagtgagaaaaaacagaaaagtcaggcggcaacattgaaagaagtaatctgccgacttggaagatacagaatttttctcgtattttcaattctgcttgcgactgtgtccgttgcgcttacattatatattccaaagctgacaggacatgcagttgattatgtgattggaaaaggcaaagtgaattttccgggagtaattcaggtgatgattcagattggtgtgtgcacactgatcacagcattggcacagtggctgatgaatgtgtgtaataacaagatgacctatcaaatggttcaggatatcagaaatgaagcatttgataaaatagagcagctaccgttgaaatatattgatggacatccgtatggtgaagtcgtaagccgtgtaattgcggatgttgaccagttttcagatggactactgatgggatttacacagctttttaccggtattgcaacgattgtcggaacattttgttttatgttatccgtaaatgtatcgattacatttgttgtggttcttatcacaccggtatcattctttgtagcaaattttattgcaaagagaacatttcgtatgttccgcctgcaatctgaaatacgtggagagcagacaggattgattgatgaaatgatcggaaaccagaaagtggttcaggcatttgggcgcggagaagatgcaacagagcatttcgacgaagtgaataaaagattgcaggaggcatccttgcgggcaacatttttctcatccatcacgaacccggcgacacgatttgttaacagtctggtttacacaggagttggaattaccggagcatttgcagttgtacgcggtgcaatgagcgtaggacaattgtccagtttcttgagctatgcaaatcagtacacaaagccatttaatgagatttccggagtcgtgacagaatttcagaatgcgattgcatgtgcgcagagagtatttacattgattgatgaagaaccgcagataccggaaccggaacatgcagttcatctgacggatattgatggaaatgtgaaagtagaggatgtttcattctcttatctgccaggtcagcatctgattgaagattttaatctggaagttaagccaggacagcgtattgcgattgtcggaccgaccggatgtggaaagacaaccttgatcaatctgctgatgcgtttctatgatgtgaatgcaggaagtattaaagtagaagatatagatattcgcgaaatgacaagaaaaagtctacgtgcagggtacggaatggtgcttcaggagacctggttaaaaacgggtacaatccgtgaaaatattgctatgggaagaccggatgcaacggaagaagagattgtcgaggcagcgaaagcttctcatatccataattatatccgtcgtctgccaaaaggatatgatacatggatcacagaagatggtggcgggctttcacagggacagaagcagctgctttgtattgcaagagttatgttatgcagaccaccgatgttgattcttgatgaagcaacatcatccatcgatacaagaacggagatcaagattcagcaggcatttgcaaaactgatggaaggaagaacaactttcattgttgcacaccgtctgtcaaccatccgtgaggcggatgtgattctcgtaatgaaagatggaaaaatcattgaacagggaaatcatgaagtactgatgaagaaggaaggtttctatcatcacctgtatgagagccagttttcaatgtaggataaggtatgatgcgagatagtgagatacgttgtaggtcgcatgaaatgtaaatagtaacgaaatgaaaaaggaaggctattaactacgataacagtataaagcgtagttgatagccttcttcttttcgcttcaataaattatatttacggtagaaggaatgtatacattactataaagtgacagatgcttccgcccattacgaacagatgaaagatttcatggcttccgaaattcttatgcttgctgttgaaaatcgggagcttcagtgcgtagatgacaccgccaacagtatagatgataccaccggctaaaagccatccgaaagcagcagctgacagattatcaaggattgtagaaaatgcaagcacgcaagtccatcccatgccaatgtataaaacggaagatacccatttcggacagaatacccagaaggctttgataaggatgccgacaatcgcgaatgcccatacaatacatagcagtgtgatacctttgcgtccgccgattactaacaggcagacaggtgtgtagcttccggcaatcagaacggagatcatcatgtgatcgatctttttcagaacagtgtttactttttctgaaatatcaaatgtatgatatgttgtacttgccgcataaagcaagataaggctggctgcgtaaattgtaagcgatacaatataaagtttgctcggttcacgagctgctctgtatagaagtggtattgcagcgataattgccatgatcattccaataaaatgtgtaattgcgcttccaggttctttgatataaagtcttttttccataatatatacctccaattcatctatataacaatatatagtttttaatactacatctcgaatatgtatatactatagcacacatttctaaaaaatcaagagatattttgaaattaaaagtatcttattccacaaaaaaacaggatgaaagaaatctgtgatggaaagtaaaaaacaggccgtgatttcacaaaattaaaatgtgaaatcacagcctgttccaggttatgtttctaataagttcaatctgtcaatttattcgattactgttccggtcttaccattcaaagcatcagcaactttatcaaaggaagtaatgtaagctttgcggccttcgtgtccttctacgaattcaactgctgcacggaattttggaagcatgttataaattccaaaatgtccctcttccatgtaagtttttgcctgatcaacagtaattgtatccagaggctcctcattcggtttgccaaggttgatacatactttctcaacatttgtaagaatgatgagaagatcagcattaattccttctgcaagctttccggctgcgaggtctttctcgataacagcacttgcgccacgtaaatgattatcctgctcaagtaccggaataccgccgccacctgctgcgataacaatctgatctgcatcaagaagagctttcactgcgtcgagttcaacaatcttgaccggattcggagcagaaacagcacggcggaaacctttacctggttcttccactacgaagttacctttcttgcgttcttcatttgcttcctcagcgttcatgtaacgaccaagaacttttgttggtgtgtagaaagcatcatcataaggatctacgatcacctgagtaaggactgtgctgactgtacggtagataccacggttgagaagttcttcgcggattccgttctgaaggtcatatccgatatatccctggctcatggcagtacatacagacattggggatgttgtatagtccggatggttctttgcaaattcattcattgcagtgtggatcataccaacctgcggagcattactgtgtgtgatagcaacctgatagcctgcttcgatcagatcagcgatacatttggcagtgcttttaacggctactttctgttctggaagtgtagttccaagtgcacggtgtcccagtgcaacaacgactctttttttcataatatttccctttcttctaagctgtaatagtttgtcagggggaacaggttcatactgtattagaaaaaatcgaaacagcaaaaccaaccttactgataattaagattttactatttttcatcagtaaaatcaatattggattatgccggacagcagatcaaatataaaaactgttgtcagaaggatacagatcaaaattctcatccatttctttaatttcatgaagagattgttccagcgcggagcaaagtaatagaaaaatgcacagccaagaagtgcaaatactgccccatcaccaagatatgcttctccattcatgaaagcaagataagaatgatatttcggaagctcaattccaaagccaagatcaagaaacagctggataagataatcaagaactgtatacacaataaagttgataataaacatagtagccggttttttgatatatttctttaacagcaacagtataagcagaccacagattccgtacaacgggagccatggaagcgtacgaagggttaaattttccagtgtgccgcaactgagcagttcggaaatgatttccaaaagccatccgaaaatagaaaaggcatggaataaaaatacacaggacagaaagtcataattctgcgccggattgaccggtgattttactgcggcaataggtggttgcacagaaaaaagaaataccggatactgatacggtgcaaaataagagatctttgtgtaaggaccttcagaatcgtcataaagtgctttactgatcagaagctcatcttcagaaggaacatgctcaagataagaatcattgagctgctcatatttaggagctcttgaaagcacatagtttcttcgtaaaaacagatataaggatgctttacagttcattttgtacgggcggacataaaggatgtccagaattccaagtgtaaagagagataaaagctcccagccgaggaaagaacaatctaacaaaaagagcttccatttatttccccttgtaagctgtttagagagaaaaaaggcatttttttgactgatttttggattctctgcgaggatatatggaatcatgctatattcataatgcttaataattccaccgataattgttaaatcccaaagtttctgaaaaagcgtgtagcagaacatcacccaggaaggatttgccaggtaacgcaacttatataaaaagaatattttagaaatattcgtatcttcatagttataagattcaacaaaaaaacgtttctcaccgataatcaaaagattgctgataaaaaacttatataaaagtgaaagaatgaccccaagtgtaagaaacgaagtgacaataaagtccggacgcttcaggtaattttgaaccgtatgcaaaaaggcagcggctatgaaattatcaggaataaaatcgagaaatgcactgctgaagctttcagcagaaataaaaacaggtaaaataagcgctgtctttgtctgaatcttatcaggaaaataattcaaaaataaagagcgggaaattggatacgaagctgtgagcattgcaatcagaaagcagacagatacacttcgccaatagtttgattttattaaaatacgcgcctttttcttgagatcttttcttgaccacataaataatatcccccattgaatcgttgctgcggttcacatgcgtgcaatcagcaacgcatcgtttccatagataacatcattataatttagttgcgcacagtttacaagttaaggttcagctcataaagaaatatgttatactgtagttactggtcgcacaccgtgtaaacagtaacatactataatttacgcgagcaacgagccaaagtccgtgcttgcacgagaccttggcgactgccgcgatttaaaatggcgagatgcgttgctggtcgcacatcgtgtgaacagtaacgagaaactttttcgtatcaatatggagataagacagagagagggaggaaaattcaggtgaaaaagagaagaatacttgcagttcttttgattgttgcacttgcagttgcttctttttccggttgtggaaagaagaaagaaaaggaagagccaaagaaagagacaaagcaggtagtacaagaggaagaagagccggaagaagtagaagaagagccggaagttaatcaggagacatttgctatttttggagttgactccagggaaaataatcttggtaagggaacaagatcagactccctgatggtggtaaatgtagataatacaaataaaaaagtgtatattgcttctgtctatagagattgttatgtacagattgaaggtcatggtctggataagatcacacatgcacactctttcggaggaccggagcttgcaatggatacattaaatacaaactttgatctggatattcagaaatatattacagttaactttatgaatgttgcagaactggttgatgatatgggtggaatcgagcaggacattacagaagaagaaacaaagtatatcaacggttatattgatgaacttaatggaatccgaggaacatcttctgcacacattacagaagccggtacttatacattagacggaacacaggcggttgcatttagccgtatccgttatacagaaggaggagattataagagaagtgaaagacagagaacagttctctttaagattttctcaaaagcacaggagcttgacaaagcgaaaaagatcgatattgccaagagcatgcttgataaaattaatacaaactatttagagagcgaagtgcttcgtcttttaagtacaatcacagaatacaaggtggaagcaatggatgcatttccaaaggtattctattccggtaagattgatggtgtgttctatgaagttccggttacactgaatgacatgagtacacagatgcatacatttttgtatccgacagaaacgtatacaccttctgagacagttcagtcgatcagtgctcaggaaagcgcagtagcgccgacagcgaataatgattttacacagcagtaagagctggagttaaaccgatttttgaaaagagttgtgagaaatagaggataatctcgttttttacagctcttttttgtatatgaaaaagtcacgttctggttactgttctgatatagaaaaacatctactcgggttgcaattactttcaattttataaaatgtgtgttatcctagcattggatgttatttgaacgtttaactaagataagaaaaaggtagataaggggtaagaaatgaaatacgagaagatgaataatctcttcctgcgtcagtcctatctggattcctgggaagattatgaaagaagtttaaagaaaaaaagctttatcaaatgggattatattatattgacagcatcaaatgaagcacaggcaacggcttatcggaatcagatcgagaaccgtctggaaaaaggtcttcttccggaagagacaacgtatgcggttcttccggatccggagggaaaacgtgtgggatcaggaggagctacatttcaggtgatgcgttatattgcagaacaggaaccggagagagagaatccttttaagaatcgtagaattcttgtgattcattcaggtggtgacagcaagagagtgccgcagtattctgcaatcggcaagcttttctcaccggttccaagagaattgccggatggaagaagttccactttatttgatgagtttattgtgggaatgtcaggagttccatccagaatccaggagggaatgcttgttttgtcaggtgatgtattgcttctgtttaatccactccagattgatgcgcagtttgacggagcagcagcaatttccattaaagagccggtagctacaggaaaaaatcatggcgtatttctgaatgacggacatgattatgtaaagtgctttcttcataaacagacggaagagcgtctgcgagagatgggagctgttaataaagcaggaaatgtagatcttgatacaggtgcggtattgtttggcagcgcactgttgcaggcactgttccgtctgatttcaacagggggcaaagtagacgagaagaaattcaggcagttttgtaatgaagaagcaaggatcagcttttatggggattttttatatccgcttgcaaatgattctacattagaagatttctataaagaggcagcagaaggacagctcaatgaggcactgcatgaatgcaggacacagatctggaatgcgatccatcatttctcaatgaagctgttgtgtctgtcaccggcggaatttattcatttcgggacaacaagggaattgagaagccttgtaacaaaaaatgtgcaggattacgagttcctggattggaagatgcaggtgaattcagcggtgcaaaaagaaggatttgcagcgcataatgcttatgtaggaagccgtgcaaagataggaaaagaagcatatctggagaattgttatattcttggtaattctgaggtcggcgacggaaccgttctttcccatgtgcgcattatggaccggaagattccagaacagattgttatgcacggaattgaactgacaggtgggaaaaaagtaattaggatttatggtgtaccagataatccgaaaggaaaatatccgggagaggtttcatttctcggcacgacattgaatcagtttatggctcagaataaagtgacgaaagaagaactctggaaaggagaagagacctatctgtggtttgcagatctttatccggtgtgtgatgactgggaagatgcacttgatatggctgaaatcatttacaagatggcacatggtactgcaacaaaagaagagatttccagatggcgtgagactgaacgtatgagcctctattccagttttaatgcagcagatattgaggcatcctgtgatcaggagaggtttcttgaaaaccgtattcttgcaaggtgtttcatcagaaaactggagcagggaatgtattatgcggatgcactcaagatatttggaaagcgtggaatatcgaaagaaatctttaagttactgatggaagatgcggcagaagcagatttctcattgaagattcgaatctatcatgcagtctcctgttatatgaaaaagacaagaacgatttatgatgatctgcattatgatgcacttgagaatgactgttttggaacaatccaggaggtaatttatgaagaagcagagaagaaacttccggatagtgcaggatatagaattgtaaaagatcaggttgatatcgcccttccggttcgcgtgaactggggcggaggctggacggatacaccaccacattgtaatgaaaagggtggagtagttcttaatgctgcaatgaaattaagaggaatttatccggtacagatcacggtgaagagattagatgagcttcatgtggaatttgaaagtaaggatatcggagtctatacaactgtagacagtgcagctgagatccaggattgtcataatccatatgattcatttgcactgcataaagcagctttgatcgcctgtggaattatcccggtcagggaagaagcagatcttcaggagattttaaagcggatgggaggaggaatctatctttctacccaggtttatggagtaccgaaaggatcaggacttggaacaagcagtatcttatcaggagcgtgcgtaaagggaatctttgaatttcttggtcaggagcgtacagatgcagagatctatgatgttgtccttggtatggagcagatcatgagtaccggaggaggatggcaggatcaggttggcggactgacagaaggaattaaactgatctcaacaaaaccggggattgctcagaatcttgttgtagagaagatagaaatgccggaagagggaaagaaagaactgaaagaacgtttcgcattgatttatactggtcagaggcgtctcgcaagaaatttgctgcgtgatgtggttggtggctatatcggaagcagaccagaatcattgaaggcattaaaggagatgaaggcagtcgccgtgttaatgcgttttgcactggagcagggagatattgacgaatttgctgagcttttaaaccaacattggaaattatcctgtatgttggatgccggtacaaccaatacctgtatcgatcagatccttcttgtatgtgaagacctgatcgatgggaagtttatatcaggagccggtggaggcggattcattcaggtgattctaaagaaagatgtgacaaaggagcagctgcatgaacgtctgcatggcgtgttccaggacagtggcgtagatgtatgggattgcgaattacttgtttaacgtataagtaagacaagaaatgaaatttgacaaagaatttctacatggtataatgagcgaaaaagaaagcagtatatcagttaggagtagatttttgaagagcaataagaaaacgaatagagcgaagaacaggaaattgacgatgatctcatttttgccggcaatcatttggctgatccttcttctggttttgtcaagccagaatggaccacagacagcggcaaccagtctgccgatggcagaatggatccaacagcacttttttccacaggacagtgtggattatgtgcatatgtatctgagaaaatgggcacactttatcgtttatttcatagaatcaggattattggttctggcaatgaagaatgtgatgaaagcctggaaagcggcgtgtgcggtattcggactttgtacgatcctggcaattgcagatgaggcacacaaggttctgatcgtaggaagacactgtcagtgggatgaagcaggaatcaatattgtcggtgtgatcatgggagtgttgctgacctggagtattctatggctgattcgttgggcaaggggaacacttgaagattagaaggaatattttcgcagaaagcttcatataatgacatcaggaagacaagcggtgaaaggggaaatcgaaaggtggttcttggatatattgtctgttttctcggtggtctgattctgggcgtagtccttatgtgtttgcttcagataaagagatgatttgtgagagaggttgagaggcctctctttttttgtatatcaggaaagtattttcctgatatacaaaaaatactccgtttaggatctgcacaaatccgaaaaacacccgttgttgttttacataaacttaacatttggttgatttcagactttacatttcttacgtaacatatgtactgtgcttgagggaagcataaatgactgcagaaaataaaaaaaagaaaatgcagtgggattagaaatgtgtatgaaatgtaaaggagataattgacatgaaaatgaaaaagtttattgcattacttacagtagcaggtatgacagcaacaatggcagttggatgtggaagttcatcaaacgaaacttcagataatgcagcagatacaaatacagagagcagtgacagctcattaagcggaacaatcacagcagccggttcatcagcactgaaaccacttgctgatgatgcagcagattcgtttctaaatgatcatccggatgtatctatcacaattgatgcaggcggttcaggagaaggactgaagcaggtatcagaaggaactgtagatatcggtaactctgatgtggcagcagaagataaactggatgagacagcagcaaaagagcttgtagatcatcaggtatgtgttgtaactatggcaccgatcgtaaacaaagatgttgcagaagcaggtgttaagagtcttacaaaagagcagttgatctccatcttcacaggaaagacaacaaactggaaagatgttggaggaccggatgaggatatcgttcttgtaacacgtcctgagtcttcaggaacaagagcaacattccagaaatatgcactggacggaaacgaagaagcttctaacacatccatggaaacagatgattccggagttcttcttacaaatgtaaagagtacaaacggagcaatcggttatgtagcactttcttatctgacaggagatgcaggtgttgagacagtagcaattgatgatgttgagccaacacttgagaatacttacagcggaaaatatcctgtatggacattcgagcatatgtacacaaagggtgaaccaaatgaagtgacaaaagcattccttgattatattacaggtgatgaatatggcgctcagatggagaaacttggttatggtgttgcatctaagatgactgcaacagagcactaatagcataaagtgaaaagctatgaaatgtactgtgtgttccgagaaaattcagaacagcagtacatttcactgataaaaggtgaaaatatgaagaaacaaaacatgtttacaaaagagtatgcatggagaggactgatgacagcgggcggtttgcttgttattgccatcacaatctgtatcggagcctttcttatatataagggatccggtacatttacgatatttggtcattccatatttgaattcttaggatcgacagactggaacccggaagataatgcacaggggggtggaactgtcggagcattgatctttatcgtgggttctctatgtacatgtggtctggcacttctgatcgcgactccatttgcagtaggttctgcaatctttatgattgagatcgcgccgaaattcggagaaaagttttacagaccaatcgttgaaattttcgcaggaattccatcagttgtttatggatgggttggacttacagtcctgattccggcaattaagaaagtatttcatttacaagttggacattcagttcttgcggcagggattgttttggcactgatgatcttcccaaccatcagtaatgtggcagcagattccattcattctgtgccaaaagattaccgtatggcagcctacggactgggttctacaagatggcagtccatttataaagttgtcattccggcagcaggttcaggaattctttcaggaattattctcggacttgcgagagcattcggtgaggcacttgcggttgcaatggtaattggacagacaacagctcttccaaagggattattctccacaacaaagagtttgactacagaaatcgcagcacagatgggaaatgcaacggagggcggtgagatgaagacagcactctggacaatggcattgttattgttcttattatctctgttattcatcctgctgatccattatttttcaagaccgaagaaagacaaagagtaagggggagcaaatagatgaatcgagtacaacgtgcgcgtggaataaatcaaataatgaccggcgtgttttatctgatcgcagtgttcttctttacattattgattggatttgcatcttatgtaattatcaaaggatttacaggagcaacaccggagatgtttgcctttgcgagaaaaggaagcatcggaaaccagttgttcaatacaatttatctagtatttatttcgttgttattctccattccgcttggagtgacagccggaatctatctggcaatgtatgcgaagaaaggatttcttacaaaatttctaagaatctgtattgagacactttcttcgcttccgtccattgttgttggattgtttggatatctggtatttcttgtgtttttcggacttggaaaaagtcttctcgcaggagcattatcagtttccattctggcgatcccagttatcacaacaacgacagaggacgcgatcaatggtctgccgggacattacctgcaggcaagtcttggacttggagcaacaagatggcagtccatttatcatgtgttgatcccggcgtgtatcccaagaatcatgacaggtgtcatcctggcagcaggaagaggatttggtgaggcggcagcacttctgtatacaacaggatcaggaacagatctgcgctggaacaactggaatctgacatccccaacctgcccgctgaatattttccgtccggcagagacattgtcattgcagatctggggacttcagatcaatggacaggatccgaatcttgcaaacctgtcagcagcaatcctgatgattcttgttctgctgttcagcattggcgcaaatgcattgagccgacacattaataagaagaattcaggaaactaaagacagaaaatgaaagaggaagccaactgataatttctatgtcaatcatttcgttgactggcatgtagaaaggataattaataaaaatggaagcaaaaaaagcaaatgattataaatttgatatcagccatctgaatcttcattatggagacttccatgcactcaaagatgtgaatatgaagatcgaggcgaataagatcactgcatttatcggaccttccggatgtggaaaatctacatttctgaagacactgaaccgtatgaatgatctggtggaaaattgtaagattgatggaaatgttctgctcgacggtaaggacattttcaaggaaatggacgagatcacactgcgtcatcgtgttggaatggtatttcagcagccaaatccatttccaaagagtgtgtatgacaatgtggcttacggaccgagaattgccggaatcaagaaaaaatctcagctggatgagatcgttgagcgaagccttcgtcaggcagcgatttgggatgaactcaaagaccgtctgaataaaagtgcgctcggactttccggtggacagcagcagagactttgtatcgcaagaacactggcagttgagccggaagtaattctgatggatgagccgacatccgcactggatccaatctcaacatctaagattgaagaccttgcgatggaactgaaaaaagattatactatcgttatggtaacgcataatatgcagcaggcagtccgtgtatcggataacacagcatttttcctcttaggagaagtgattgagtataatgacactgagaaattgttctccattcctgaagataagagaacagaggattacatcacagggaggtttggttgatttatgcgtaacagatatgatatgcagctgcatcttttggatacacagcttacacatatgggtgagttgtgtgaaacagcaattgcaaaggtaactcaggcattaaaggaaggtaacacggaacaggctaagattgtgatcaaagaagatgaagagatcgatcagattgaaaaagatatcgagagactttgtctgaagcttctgctccagcagcagccggtcgcaagagacctcagaagaatctcagcagcacttaagatgatcacagatatggagcgaatcggagatcagacttctgatatcgcagagatcatcatttcctccaagtgggagaagatggatgagaatcttgacaagctgacagcgatggcaacaggcgtaagcaaaatggttcgcaacagtgtaacagcatatgttgagaaagatctggagcttgcacgtacagtcatgaatgatgatgatgagattgatgattattttgatgagatccgggatcagatcatccagctgatccgtgagggtgatggtcgtgatggaagaaaactctttgattttatcatggttacaaagtatcttgagcgaatcggagaccatgcgacaaatattgccgagtgggtagaatttgcaattaccggagtgcataaggatagtgctgtaatgcattagaaggagaaagaaatatatgattttttgtgtagaagatgacgataacattcgcgaacttgtaatctacactctggagacaaccggactggaagccagaggattcgcagacgggacagcatttatggaggctttggcgtttgacacgccagagcttgttttgcttgatattatgcttccaggggaagatggacttgagattcttaagaaactgaaaaattcatcaaagacaaaggatatccctgtgatcatggtgacagcgaaaggttcagagtatgataaagtagtaggacttgattcaggggcggatgattacgtgacaaaaccattcggtatgatggagctgatctccagaatcaaagcggtattaagaagaagtggaaaacagcaggataagacgaaacttactgtcggtgaaatcagcttagatacgaagaagcatgaagtgaaagtagacggtgagaatgtcgtgttgacattgaaagagtttgaacttcttgaaaaactgatgcgtaatcagggaatcgtgctgacaagagaccagcttctgacagagatctggggctatgattttgacggcgagacaagaacggttgatgttcatatccggacactccgccagaagttaggtgagcagggcagtctggtcaagacagttcgtggtgttggatatcggatcggtggagaagcgtaatacaagtctggaggatatgagaaagtgagaaaacgaattcagaaaagcatgatgtttatactgattgcaattttagttccgatatatctgatcatgtctgttgttgtgtatcagcggaacctgaagatccttgagggtgagatcaaacaggaagcagcgtatatcaaacgggcagtcgatctgtcaggaacagagtatcttgcacagctggatgatgtggatcagggaacgcgagtgacgctgatcgcatctacgggagatgttctgtatgattccagaaatgatggaagtacgatggagaatcataagaccagagccgaagtacagcaggctttgaagaatggaacaggcgagaaaatccgtatgtcagataccgtaagcaaagaattgtattattatgcggttcttctggatgatgggaacgttctccgtgtttcaaaatcaatggatagtctgatgtggacttcattaaatattttgccggtggttatagggattggaatcattggacttgtacttgcctggtttcttgcaaaatggcagacaaacagactgatggaacctgtaattcatctggatttggaaaacccattggataatgttgtatatgaggagatgaccccgcttttgaaagctatggataagcagaataaagaaaaagaagctgtggccaatatgcgtaaagaattctctgcaaatgtatcccatgagctgaaaactccgctcacttcgatttccggatacgcagagatcatgatgaatggactcgtgcgtccggaggatattccgagattttctgagacaatttataaggaggcacgtcggcttttgacattgattgaagatattattaaaatatcaaagctagatgacgaatctgttgagcttgagaaagaagatgtagatttatttgaactgacgagagaaattgtcagtcgtctttctcttacagcggcccagcggaatattcatatggaactgacaggagaatctgtgaaaatacatggaatccgtcagattctggatgaaatgatctataacattacagaaaatgctgtaaagtataataaagaaaacggaaatataactatttgggtaggaaatacactggaaggaccgaaagtccgcgtgagtgatacagggatcggaattccaaaagaacatcaggatagaatctttgaacgattctacagagttgataagagtcattcgaaagaacggggtggaacaggacttggactgtcgattgtgaagcatggagcaattctgcacggggcgaaagttcaggtggatagtgagtacggaaaaggaacaagaatggagattatatttcctgagaaataaaatagtgctgttttacgcaggagaagaggaagaaaaccttccttttcttctgcgtttttgcttgaatcaaacaagaggttgtgctaggatagatataacaagtggaaaatatcccctgcggctgattttacgttactgttcactcccgtgtcaatcacttcgctgattgacacggaggatgcgtgttttgacttgaatgcatctcgccccatcgcgcgatttaaaatggcgagatgcgttgctggtcgcacatcgtgtgaacagtaacgaataagaagatagaagaggcgataattatgttaaacattgtactttatgagccggaaattccggcaaataccggaaatatcggaagaacctgtgtggcaacagggacaagacttcatttaatcgagccgcttggattcagattaaatgagaaatcattaaagcgcgccggtatggattactggaaagatctggatgtgacgacatatattgattatcaagatttccttgaaaagaatccgggagctaaaatctatatggcaacgacaaaagcacacaaggtctacacagaagtagattatgagtcagattgctatattatgttcggaaaagagagcgcaggaattccggaggagattcttgtagagcatgaggaagactgtatgagaatcccgatgaatggagatatccgctcattgaatcttggtaattcggtggcaattgtgttgtatgaagcactgcggcagaatggattcgcagggatgaatttaagtggagagctgcacgaacttcattggaaataaagtgaaaaaaatattggaatatatagaagcaggagatggaattgaaagtcagaaaagattcttttctcttgcttttggttatgtgtgagaaaaatatgtaaaaaagaataatgtcttggattgaagaatgattaatttttgtgctattctttagtggtggtgttatgaaacaaatgaattgtgtatgaggaacaggaggtaagagatgtatagagtaagaatttagtataaatattaagaatcgcttggaaaggagaaaacaatggaagaattttcaatgagtgaaaacgcaaaagatttgattcagcaagaaatagatcggaatccatttcttgtattaagtaaacttgtatatcagcaaatataccgtgaaataattaacggaaatttattgccacagcatcgtatcgtggaatcaaaaattgcaaaagaattgaatgtttcccgctctccggtgaaaatggctttggccgagatgacagaaaagggaatactggaaaaagtaaagggcaaagaattaagagtaaagaaaataagttatgaggagtgtctgtggatttatgaagccagaatgatgctggaaccagaagctgcatatctggctgcaaagcggatacaggaaaaggaacttgaagtattaaaaaaattagttttccgctttgaaaaaatcgaccagacacacgaccatttagagtataaaaatgctgataaaatgtttcatgaaactattgtgaaggcttcgagaaacaggtatttaatggatatgtataaatcaattgaatctccattagcaatgtatcgtaatcagttaaaccagcttgcttatgaggaatgttttcagcaacatggtatggaaaaggggtctgaatatcacagggcaatttatagaatgcttgagcaacgctatccaatgatggctaaagatgaaatgaaaaatgatgtacagcgaatgtatggtacgatgtcaagactcagaggatgtgacataaaaggctaaaacgaaaggaggtgattggacaaaatcacctcctttttatcgaattttggttaaaaaatagacatatgtacaaaagtaaaacaaaaatacttctgttaaaaagaaaaatgcactctaaaatgaacaaaacaagtacaaaaaatgtcaaaaagcataaaaattgactcaataaacagcaaggctatacaatttaaccaattcaaacgagaactatgaataaaggaggaacaaaatggagtacataacgatgaggaatggtacgaaagtaccaatgctgggattaggctgttataagtctgaagaacaagaaggtgtagaagctgtaaagagcgcaattgaaattggctacagacatattgatacagcaaatttttatgagaacgaaaagtatgtcggacggggaatccgggaaagtggaattgatcgtgaaaaattgtttgttgtaagtaagatatggccgacaagtttcaagactccggaagtagcaattgaatatagtatgagagcgttaaatattgactatattgatatgtatctgcttcattggccgagtcagaatgaatatgcaagaaaccatgcttttgaaacacttttgaaatataaagaaaaagggtattttaaagaagttggtgtatcgaattttaagaaagagcatcttgaaaagctgaaagagacatttgggttctatccgatgatgaatcagattgaaatttcaccatggcttcagaaaaaggaagattacgcattctgccaggaaaacgatattgtaatgacagcctgtgtaccatttgcaaagggaaatatcttaaatgatccaaagcttgttgaaattgcagaaaaacatggaaaaaatgtcggacaggtgattttaagatggaatatccagagaggcaattgcgtaataccgaaatcttcaaaaccacatagaattgctgataactttaatatttttgattttgaactggatgcagatgatatggctgtgatcggaacaatggaaaatggaaattcttattgtagtgattcttctgtgtttaccggagatttttggaatattgaagatcatttgttgaaccgtgaataggaggaaattatgaagaaaagattatttgcaatattagtttctgtttcacttctttcaacgatggtattaagtggttgtggacagaattcaacggatgaaaaggttacgagtggagtaatcagaattgcctataataacatagagaattatccgcattataaaggacttgagcgtgcagcacaggagattgaagacaggtctgacggaagatttacagtaaagatctattcgaacggaacacttggagatcagagagcggccttggagcttacgcagaacaatgcagtgcagatgtgtgttgccaatgcgacaatggtagagagttacaatcatgatttttcggttttgagtatgccttatctgtttgaggacagtgatcatcagagagaagcctatacaaacggtatgttagatgaattgtttgattctacagaagaatatgactttaagattgtcggggcattcggatctggatcaagaaatatcttctgtgagaaagctgtcagaacacctgaggatctgaagggattaaaaattcgtgttatgcagtcagataatatggtaaagatgcttcagctgatgggtggaacaggagtgccaatgtctgcttctgaacagtattcagctatgcagcagggagttgtcgatggtgccgagtcaaatgaaattgactatgtaggaaaaaaatattatgaagtggcaccagtattttccagaactgaacattgctttagtactgattttgttgtagcaagtacaaagttcatgaattcacttacagatgaggatcggaaaatgatagaagatgcaatggctataggtgtagaggccgaatttgacagctggagtgagatggtagacgagagtattgccgaagcagaggagaaaggaattgaatttgtagaggatgtagataaagaagcttttgcagcaaactttaaagaatttcaggagcagattgctaatgagagtactgtgacaagaaaagtttacgatgagattaaagcactcagagaggagggctcaaatgaatagtattagaaagattctagataaaatattagaggttgcctgtatcttgatttttggtattatgacgattcttgttgtgtatcaggttgtgacaagatatgtatttcagagtcctagctcatggagtgagtctgtggtgacctatggatttatctggctggcaatgcttggtggtgcttatgtttttggaaaaagagatcatatggcaatgacttttgtgttagataaatttcatggaagagtaaagacaataattgagatgatcaacgagctgattatagtgctttttggaatcggagtccttctgatcggaggatatgccggagctatgaaacagatgacacaggcagattctattcttcctattacaatgggagttatctatattgcgattccaatcgcaggggtggcaatgattttatattttttatgcaatgaatatgatctgattaaaaagctgaatcagccagaaacagaaggtggaaaggagatggaataaaatggatgtagcaattacagcaacaatagtaatggtagtagcacttgttattatcttattgatgggagctccgattgcagttgcgattggcatgtcctcggcgatggcaatggtagttattcttcctacaaatgtagcacttgtaacttgtgcgcagaagatgtttacaggtttgaattcattccctcttcttgcaattccgttttttgttcttgcaggtaatttgatgaataatggtggtattgctatcaggattataaggcttgcagaggctttgtgtggaagacttccaggtgctcttgcggaaagtaatgttcttgcgaacatgttctttggagctatcagtggaagtggaaatgctgcagcagcagccatgggtggaacaatcgggccaatcgaggctgaaaggggatattcaaaggaattctcagcggcagttaacattgcatcagcacctacaggaatgttgataccgccaagtaacgctcttatcgttttttcaacagtaggagggtcaatttctgtagcagcactgtttatgggaggatatattccaggaatcctttggggcttagcggtcatgattgttgcaggatacatggcgaaaaaacgaggatatatcaatacaaatcatgttgatgcagcaacaaaagtgaaatattttgtagatgcaattcctagtcttttcttgattgtaattattattggagggattttgagtggaatctttacagcaacagaggcatctggagtgtctgttgcatatgctttgattcttggctttatttataaaagtatcaaagcaaaggatcttcctaaaatcattctggattctgcaagaacaacggttatcattgtatttctgattggtgtatcttcaatcatgtcttggattatggcatatacagagattcctacaattatttctaatgcaatgttgacattgacaaacagtaaagtaattactcttttaatcatcaacgtagtacttttgtttgtaggtacttttatggatccaactccggcaattttgatctttactccaattttcctgccgatttgcacaggatttggaatgagctcattacagtttggtattatgattgtttataatctgtgtatcggagcaattacaccacctgttggaagtgttctgtttacaggatgtaaagtaggaaaagtaactattgagcaggttattaagacattgctgccattctttgtcgcaattattcttgtgctgatgattgtgacatatgtgccggcagtttcagaattcttgccacggctcaatggttacatataggaggtactacatgaaggattgttattattgcgagaaaggtgaaaaacttaatcagttgatgacacatattgcagatatggggaatgcttctatttacctttttcgtgatcagacacataaaggaaaatgtattgtagtgtttaatacagatcacagaacagaatggtatcagcttaatcaagaggaacagtcagaactgatttatgcagtagcgaaaacagcggaagcacttcataacgtttttaatccggataagattaattatgcaacgtatggagataaagtctcacatcttcatgttcatgttgttccgaaatatgaaaacggaccggactggggtggtccgtttaaagatgatagaacccctgtgattctgtccgaagaagaatatatcagaagagtagagcagataagagaacatttgacataaaagtccccctaagagtctgccgtaccagtttggtacggcagattttttgatgtttatttaggaaaaggatttctaaataaataaaatttatgtcattttatgtgaaaaatctggttaaaaaaaagacatttgcataaaacaccgacaaaataataatggaaacggataaaaatgtactttaaaaagtacaaaatgagtgaaaaacaaacaaacaaggacgaaaattgactcaatttataagcaaaatatacaatatggctaaatcaaaacaaaagcagttgaacttactgagaaacaggaggcgaaaagaaaaaaatgaaagcaatcgtagtagacaaaaattcagcggatggattggattattccatccagaaaaagatttttgaggaaaatggaattgaatttgttttggaggattgtcagacagaagatgaaattatcgaaaaatgcaaagatgcagatgcgcttttggttatttatagacagattactccaagaataatggatgccttagaacattgcaaagttattttacgatacggaatcggttatgacgtaattgatgtaaaggcagctacagagcgggggattaaagtttgtaatagtccggtacattgcctggatgaagtggcaacacatactattgcaatgattcttgcaatggagagacagcttgttttttacaacgatcttgtaaagcgagggcaatggctggcaaatgccggatttaaaccacacagactatctagtcagacactgggctttgtcggatttggtcatattgccagaagggcagcagagtttgcaaagggattcggttttagaatgatagcgtatgatccatttcttccagaagaggttgtgaaggcatcaggagcagagaaggtcgagctggatcaattgtttgctgaagcagatatcgtatcattacatacaccattaatggacagtacattccatttgattgataaagaagcaattaccaagatgaaagatggtgtaatgattgtcaatacatctaggggtcctattattgcaattgatgatttgatggaggctgtgaaagaaggaaaagttaaatcagcagcacttgatgttgtagagggagaaccaattacagtagcaaatcatcctttatttgaaactggaagaattatctgttctccacatgcagcatataattcagttgaagcagaacagcagatgatggaagtgcttgcacagacagcaacagatgtgctgaatggaaagaatccggcaaacatcgtaaataaaaaagaacttggacttgtataagtaataggtcatttccaattttcctaaaatagatattcccgggtcagcctgctatataagatccgggaagaaaagaaagaggtaagtatatgaagaatttattaagagaaaaaattatgaacggcgagaaaacagtaggaacatttttcgaggcaggaaatgcaagtgtagctgaagctcttgcattgacagatctggattatatgttaattgatacagagcatggaccttttgatgtagagagtgtaatgcttatgttaagaggagcagaactccatggtacaacggcacttgtcagagtaaaggattctaacagaaattcaattcttaaaatgctcgatatcggggcaggtgggcttattattccgcaggtacattctcttgaggaaattaaaaagattgtggaatacggaaaatatttcccggtaggacagagaggtgttgcatttgcaagaggagcaggttatggatatcttgagcatgccaagggagacattaatgattattttgcaacgtgtaaccgtgaaactcttctgattccacagtgtgagacaaagggatgtcttgagaatattgaagaaatcgcaaaagtagatggaatcgatggaatctttgtaggaccatatgatctgtctgtagcaatgggaatcccaacacagtttgacaaaccggaattcaaagcagcactggagagaattctgaaagctgtaaaagatgcaggtaaatttacaattatctattgtgcagactttaatgttgctaatacaagactgaaacagggatttgacagtgttacagtcggacaggatgtaaacttctatattgatgcaattaatgaaatggtacattcaattgagaaatagaaatggaggataggaacatgacggtaaatgaactgaaaaaatttgcaaccgatgtcagaattgagacagtaaaatgcctggaggcacgtacattcggacatatcggaggctgtctgtctatcgcagatgtccttactgttttgtataatggagaactgaaaaatattgatccggctgatccgaagaaactggatagagatatgctggtcgtatctaagggacatgcaggtccggcagtatttgcaacgcttgcattgaaaggatatttccctcttgactggctgccgactctttgcgagggagggacaagacttccaagtcattgtgacagaatcagaacacctggaattgatgcatctacaggatcacttggacagggactctctcttgcaaatggatttgcgcatgctgcgaagattaaaaatctgaaaaacagaatttactgtctgatgggagatggtgagattcaggaaggtcagatatgggaagctgcaatgtatgcacaccagtataaattgaacaatttgatcggaattgtcgactggaataaaaagcagattgatggaacaattgatgaatgtatttctcttctggatattgcagaaaagtttagagcttttggttggtatgcagtaacagtaaagggtgatgatatcgaagcaattcaggaagccttcaaacaggtcagggaaaatcagagtgataagccaggagttctcgttctggatggtgtaaaaggcagtggagtaaaatgtattgaaaaaatgaaatttaatcacatgattcctgtagataaagaactggcagatcggtgcctggctgaactggaagcagtgaagaacagtctgtaaggaggatgagaagaatggcaaagataatctataatggcgaatacgaaaaaaaggcaattacggatcagttcgtagaaaatcttggtggtatgctggaaaaggatcctgatgtgatttatctggatgcggacttgatgtttgcgttcggagcaggtctgtgggatctgggcgataaatatccggaacgagtaatccgctgtggtatcgctgaggcaaatatggttggaacagcagctgcaatgtcagtgatgggcatgaaaccgattattcacagttttgcatcttttatcacaagaagagcatttgaccagattttcctttcgggtgcttatggaagaaaaacattaaacattattggaagtgagccaggatacaaacagacatactggggtggaacacatatggcatttgaagatattgctatgatgcgtaccgtgccaaatgcacatatttttgatattgtggatggggttcagtttaataagctgattagtaagactgttgatatgaaaggaatttattattatagaaccccgcttgcagataatattgctgtttatgatgaggatacagaattcgaaataggaaaaggaattgtcctgagggaaggaaatgatgcttctatcatagcctgcgggcgtcttgtgacaatttccctccaggcagcagaacttcttgaggaagaaggaattcatgtacgggtagttgatatgtttacgattaagccattggatgaagcacttgttttaaaatgtgcacaggagacgggagcaattgtgacagccgaaaatcattctgtttacggtggacttggtgcagcagttgcagaattccttggtgagaatgatccaacagttgtagagagaattggaacaagagacgagttcggagaagttggatcagaggcttatttaagagaaagatttggatttactccagaaaagattgctgaacgtgtaaaagaggcaatcgcaaagaagaaagactgattgtaaagatcgaggtgatagatgatgttacaaaaaagagattacaagttctggttctgtccggggtcagttgatctgtatggggatgaagaaattcgaattgtgacagaacacagcagaaagattgtagatgagatgaatcagtcaggactggttccatatgaaattgtattgaaaccgacgctcttgacaaatgaaaacattcgtaaaacttttaatgcagcaaatgaagatgaaaactgcgctggtgtgattgcttggatgcatatgttctcacctgcaaagtcatggatgttgggattgaaagatttaagaaaaccattgcttcatcttcacacacaatttaacgaagagattccgtacgatacactggatatgggctttatcaatatcaatcagtcagctcatggtgacagagagtttgcttatatgcttgcaagaatgaagaaagagcataagattgttgtaggtcattggaaatcagaacgtgtgcagaaaaaaatcggagactggatgataacggcaattggacttgtagaaagcaatcatttacgggtagcacgttttgcggacaatatgcttaatgtagcagatactgaaggtgataaagttgaggcacagttgaaatttggatgggaagtcgatacttatacaatcgtagacgcagcagatgcggtaaatgcagtgtcgcagagtgacatcaatatattgacagatgaatactatgataaatatggaattcttctggaaggacgagatccacaggagtttaggagacatgtagaagaacaggcaagaattgagattggatttgaacgcttccttgaagaaaaaaaatatcaggctgtggttactcattttggacaacttggaggattaaaacagctgccaggactggcaatgcagagactgatgggaaaaggttatggatttgctgcagaaggtgactggaaaacagctgcgatgttacgaattgtgaaattgatgacagctggagttaaggatgcaaagggaacttcttttatggaggattacacctataatcttgttccaggaaaagaaggggttctcgagacacatatgttagaaatctgtccttcaattgcagaaggagatattaatatccgtgtaaatccacttggacttggaaacagagaagatccggcaaggcttgtatttacagcgaaagaaggagatgcaattgcctcctccttgattgatatgggagatcatttccgtcttgtgatcaatgatatcacatgcaagaaaacagaacgtccaatgccgaatctcccggtagcgacagcattctggacaccaaaaccagatttcttgacaggtgtggaagcatggctgatgacaggtggggcacatcacacagttatgacatacgatctgacagcggaacagcttggcgattggggagatgcgatgggcattgaggttgtatatattgatgaaaatacaacaattcgtcagttgaaaaaagaattaaaaggctgaaaatatggaaaaatgaagattggtaataaaaagaggaggagaaaaattgaacaagataggagttcactttggatatttcaacagagattggaatacggattttatcaaacggattgagcaggtaaagaaaataggattagatattctagaggtagctccggcccctcttcttgcactgacaaaatttcagagagatgagattgcagctgccgcaaaggcgaatgatattgaattgactttttcagttggtttatctgcgaatcaagatttagcatcagaagatgaagagattcgaaaaaatggaattaaatttacaacggatactttccaaattatgtctgaaatgggcggaaaaacttattcgggagtggatattgcagcgtggaataagacatttatggaaggtattacagataaaagtgctacctgggagagaagtatttcagcagtgaaagagattatgaaagttgcagaagataagggaattacttttgcagttgaagttgtaaatcgttatgagtcatctcttgttaatacagcagaagaagcagtaaagtatgtagatgaagttggaagtccgaactgcaagattcttctggacacatatcatatgaatattgaggaggacagttttgcaggagcaattaaattagttggtaatcgccttggtcattttcatgtgggagagagtaatagaagaccaccatgtgaaaatgggaaaatgccgtggaatgaaattacaaacgcattaaaagaaatcgattatcaaggggcaatagtcatggaaccatttattaaaatgggtggagaagtaggacgtgatataaaagtatggcgcgatattagtgaaggagcttctgaaagtgaaatggaacaacttcttgcagatgctgcaatgatgttgagaaaaaagatgcagcgttaacacgaaaaaaatatgttttcaaagtaattcatgggaatggataagaagttgtaaaaggacattttcttatctattccttttttaaaaaagaataatcagatatttatacaaatacacaaaaaacgtttaataaactacaaaaaatagaaagaatatttagtaatctaaaaaatttttataaaaatctaataaaaagtttgattattacgacaaaatatgatatgtttaaaataacatcgttgtgcgaaagttacaaacagaaagagaatagggatgaaaagtatggtaataatatattaatacatgctgcgaacagcgtaatccttagatattaatgtgcagtaacaacatacaacgaagaaatcttattgttcaaaatcacataagaacaataaaaagggggagacaggaaaggtggtgtagatactatggtggatgagacaatccggtcaattaaagaagcagaacagcaggcagaagagattcttgtaaaagcgcaggaacaaaaagaacagattctgaaagatgcatctcttcaggcaaagcagattcatgaagaacttatagaagaggcaaaaagaactgccggtagactggatgagaaagccagagaagaggcgaaaaatcaggaagataaagaagcagagaagctcaaagatgtgatcgaagagctgaaggtttctgcaagagagaaaaaggatgcagcagtgcagctagttctttctgaattaatctgatccatgtggtcgtaacaaaaaaggagggataagattatggcggtacttaagatgcagaaaatcagcatctgtgccctgaagaaagatcgaaaagcaatcctggaacagttacagcatcttggagttcttgaagttgacagggacaaagaagaggatgcattcttccaaaagatggacacaaccggacagcggatgaaatttgaaaaagcggcaacggcagcagatcaggcactggggattctggatgcttacgttccggagaaaaagtcattactttcttcgctggaaggaaaagaactgatcgatcgcgagttggaagaaaaggttcagatatctggaccggaattgatcaagacagcccgcggaatttatgatcttgatcgcgagtatgctgagcttagagcaggcatagcaaagatcgagaatcagattgaaagtctgatgccgtggatggcattagatgttccgcttcaggaagggaagacaaaaaggacagctttgatcctgggaacaatgccgggagagcttactcttgagaacatttattccattctacttgagaagactccggaagtgatggagaaaacaggggtcgatgtacatttagtttcagcagaatctaatatgatctgcattgcagtcatctgtttgaaagaacaactccagacagtggaagaagcacttcggagtgcaggatttgcaagaccgtcccagaactggagcaagacaccaaaagagcagaaggaagtactggaagctgagatagcagcgtcaagagagcggatgacgcagtgcgaggcagaacttaagagcctggcttccaaaagaaaagaacttcaggccgtagcagattattacagagtccgagcagataagtatgcagttctcggagatcttcttcagtcaaagcgtacatttgtgatcagtggatatataccggcatgtgagtcaggtccggtagagaaatctttgacagagaaatataactgtatggtagatattgaagacattgaagaaggtgaagaagcaccggttattttaaagaataacccattctctacaaacatggaaggcattgtagaatcttacggattaccgcatgccggagagatcgatccgacaacgatcatgtcattcttctatgtatttttcttcggaatgatgttgtcagatgcagcgtatggagcagttgttgcaattgtgtgtgcgattcttgtgaagaaatatccaagaatgtcacagagcatggcaaaatctttgaaactgttcttctactgtggagtatctacacttgtatggggcgttctatttggaggatattttggaaatatcgtagacattgtttcagaaaaattcttcggacatacggtaacagttccggcactttggtttgttccattgaatgatccaatgaaacttctggtttattctttgttatttggaacaattcatttgttcgtaggacttggaattaaaggttatctgtgtttaaaagatggtaaggttgtagattttatctgtgacgttgtactttggtttgtgatgctgattgggttgatcctgatgctgcttccaagtgacattttcgcatcgatcgcacagactacgatcgtgttcccggcagctttgaacactgctgcaaaagtgatggctgcgggtggagcaatcggtattgtgctgatgtcaggaagagcaaacaagaatccggcgcttcggcttgcgcttggagcgtatgatttgtataacgtgacaggatggctcagtgacgcattgtcctattcaagacttcttgcacttggacttgcaacaggagttatcgcatccgttatcaatcagatgggagcgatgcttccaaacaatgtgatcggtgtgattcttttcattgtgatcttcattgtgggacacgtattgaacctggcgatcaatctgctgggagcttatgtacacacaaaccgtttacagtttgtggaattcttcggaaaattttatgaaggcggcggaaaagcattcgagccttttaaagaaaatacgaaatatgttgatgttaaggaggaaacaacattatgaatatagcaggtgaacttggagttgtatatggattattaggcgcagcaatcgcagtattattcgcaggtgcaggatctgcgttaggtgtaggtatcgcaggacaggcagcatcaggtgttgtaacagaagacccgagcaaattcgctaaagtacttattatgcagctgctcccaggtacacagggactgtatggactgcttgttggatttattacactttctaaaattggtattctcggcggtggtggagtagaagttagcgttcagtcaggacttatgatccttgcagcttgtctcccaatcggtattgttggattgatttcaggtattgcacagggcaagacagcagcggcttctatcggaatcgtagcaaagaagccagagcagtttggtaaagcaatgctgttcccggcaatggttgagacatatgcgatcctagctcttctgatttccttcctcgcagtaagtggtatccagctgtaagaaataaataaaaaggagagcgtggagatgagtggacttgacaaaatgaaagcgcagataatcgcagaggcgcaggacaatgcaaaagagatactcgcacaggcacacgcacaggcggattctataattggggaagcaaaagcacaggcagagaaagatgcacggaagattgtcgcacaggcagaagccagagcagaagattctgtgaaacgcctggcctcttcatcagatatgagaaagcgcaaggcagtacttgaggcgaaacaggaagtgatcagtgaagttcttgaagatgcttacaaagcagtcggagagcttgatgatgcagcttattttgcaatgcttgaaaaggttcttgagaagtatgtacttccggaagaaggaaccatctgctttacagagaaagacagaaaacgtatgcctcaagggtatatggaaaaagtatatgaaacagcgaagaagaaaggcggaagcctggaacttacagagacagtgccggacggaatggatgggggatttatcctgacctatggcggcatcgaagaaaattgtacgatcaaagcgttgtttgatgcaagaagagaagagttatcagataaagtgaaccggcagctgtttacagcagtgtagccgcaaggagggataatcttgagtaagacaaaatatacctatgcggttgccagaatccgtgcactggaagtctctcttttaacgaatgcagtgatcgaacagcttcttgcgtgcaagagtgcagaacaggctctacagcttctggttgaaaagggctggggagatctgacagcaggaacgttggatgcagatgaagttctgaataaggaagaagagaagatgtggcagacaatccgtgaggtggcaccggatatgcatgtattcgatgttctgtcacttccaaaactttatcataatctgaaagcagcgatcaaagaagtgtgtacggaagtagagaataaaaacattttttacgatgactgtgagattcctggagaagagatgtttgcacttgtccagaacaaagaatttgataagctgccgggtaatatgccagcaacagcaagagaagcatttgacactctgcttcacacaagagacggacagctgtgcgatcttattattgatcacgcaacactggaagctatgttggaagcagggaaaaaatcaggtgagaagatcattgaagagtatgcacagacagcagttgcaatcgctgatattaagattgcagtaagatctcagaagacaggaaaaaatgcagaatttatgaagaaagcaatggtaaattgttccgagatcaatgtgaatcagctgacacaggcagcattggccggtgcggaggagatcgcacagtatctggaaggaacatcttatcgtgaaggtgccgatgcactgcgtatatcaccgtctgcatttgaacgctggtgtgataataaaatgacagattctatgaggtcacagaaatatgaatcattttccgttggaccgcttctggcgtatctgttagccagacaaaatgagatcaagacagtacggattatactgaccggaaagcagaatgaatttccggatgaagcaatccgggaaaggataagggagatgtatgtataagattgcagtaatgggcgattatgacagtatctatggatttgccaccctcggtcttagcatctgccctgtgaaggaccgggatgaggcgaagacaaagcttcgccagcttgcagaaggaaattacggcattatctatattacagaggctgtggctgcacagattccgtcagagatcaacaagtacggtgagcagacatttccggcgattattcagatcccgggtgtgtcggggaatacaggagccggagttgaaggcgtgaagaagacagttgagcaggccgtcggatcagatattctgtttggaggagtaagcgaatgagcacaggagtgattaaaaaagtcgcaggacctcttgttatcgcagagggaatgcgtgatgcgaatatgtttgacgttgtccgtgtatcggaacagcgtctgatcggagaaatcattgagatgcacggtgacgaggcatccatccaggtatatgaagagacatcaggtctcggacctggagaaccggttgaatctatggatgttccaatgtctgtagaattaggacctggtctgatcgcaagtatttatgacggaatccagagaccactggatgatattatgaagatttccggaaacaacctgaaaagaggagttgaagttccgtctcttaagagaaatctgaaatgggagtttgttcctactgtaaaggttggagatgaagtagagacaggagatgtgatcggtacagttcaggaaacagttcttgtacagcagaagatcatggttccttacggaattaaaggaacaatcaaggaaatcaaagaaggaacatttacagtagaagatattgtagcagttgttgaaacagaaaaaggcgaaaaagaattaactatgatgcagaagtggccggttcgtcgcggtcgtccgtataagaagaaacttccaccggagatgccacttgtaacaggacagcgtgttatcgatacattcttcccaatcgccaagggcggtgttgcggccgttccgggacctttcggaagtggaaagacagtaatccagcatcagcttgcaaaatgggctgaggcagatattgttgtctacatcggatgtggagagcgtggaaatgagatgacagacgttctgaacgagttccctgaactgaaggacccgaagacaggacagcctttgatgcagagaactgttctgatcgcaaatacatcggatatgccggttgcagctcgtgaggcatccatttacacaggaattacaatagcagagtatttccgtgatatgggatattctgtagcacttatggcagactcaacatcccgttgggctgaggcacttcgtgagatgtcaggacgtctggaagagatgcctggtgaagaaggatatccggcttatcttggaagtcgtctggctcagttttatgagcgtgccggacatgtagtttctcttggaaaagaaggaagagaaggagcactttccgttatcggagcagtatctcctccgggtggtgatacatctgagccggtatcacaggcaacacttcgtatcgtcaaagtgttctggggactggatgcatccctggcatacaagagacatttcccggcaatcaactggttgaagagttactccctgtatctggatgatatggaaaaatggtttaacggacaggttgccgaagactggatggaaggccgtcagaagatgatgacactgcttcaggaagaagcagaactggaagagatcgttaagatggtaggtatggacgcactttcaccgtccgaccgtctgaagatggaagctgcaagatcgattcgtgaggacttcctgcatcagaactctttccatgaagtagatacgtatacgtcattgaagaaacagcacatgatgatggttctcgttaacgaattctttgacagagcaaccgatgcattaaaagatggtgcatcacttcagaagctgatctcaatgccggtcagagagcagatcggacgttttaaatatgtgacagaagataagcttgacgaagaatttaagcaggttgatgagacattaagtgctcagatcgcagcagcatttgtaaaggaggaaggttaaatgccaaaagaatatagaaccattcaggaagtggccggacctctgatgctggtgcatggagtagaaggcgtaacatatgatgagcttggagagatcgagctggcgagcggagagactagaagatgtaaagttctggaagtgaacggaagtgatgttcttgtacagctgtttgaaagttcaacaggtattaacctttccaacagcaaggtgcgattccttggaagaagcatggaacttggtgtgtcagaagatatgcttggacgcgtctttgacggacttggtaatccgattgatgaaggtccgcagatccttccggatgccagaatggatatcaatggtctgccgatgaatccggcagccaggtgttatccggaggagtttatccagacaggagtgtctgcgatcgacggactgaatacactggttcgtggacagaagcttccaatcttctcagcatctggtctgccgcatgcacagctggcagcacagattgcccgtcaggcaaaggtacttggaacaaatgaaaactttgcggttgtatttgctgctatgggtattactttcgaggagtctaacttctttatcgaaagtttccgtgagacaggagccctcgacagaacagtattgttcgtcaaccttgcaaatgacccggcgattgagcgtatcgcaacaccacgtatggcgctgacagcagcggagtatcttgcatttgaaaaggatatgcatgtccttgttattctgacagatatcacaaactacgcagatgcattgcgtgaggtatccgcagccagaaaggaagttcctggacgtcgtggatatccgggatatctgtacacagaccttgcaacactgtatgaaagagcagggcgtcagaatggcaagaagggaagtatcacaatgatcccgatcctgacaatgcctgaggatgacaagactcatccaatccctgacctgacaggatatatcacggaaggacagatcatcttaagccgtgagctttacagaaaaggagtaacacctccaattgatgttcttccatctctgtcccgtctgaaagataaaggaatcggagcaggtaagacaagagcagatcatgccaatacgatgaatcagttgtttgccgcttatgcgcgtggtaaagatgcaaaagagctgatggttatcctgggagaagcagcactgacagaaattgacctgaaatatgcacgtttcgcagatgcatttgagaaagaatatgtatctcagggatatcagacagaccgaagcattgaggaaacattgaatatcggatggaagctgcttcgcatgctgccgcgtaccgaactcaaacgaattgacgataaatatctggatgaatattacgacaaagagtaagaacagacagaataatcgaagatagaaagaggaggtggcggtattggctgcgaaacaagtgaatccaacccgtatggaactaacccgtttgaagaaaaagcggattacagccattcgtggtcacaagcttttgaaagataagcgtgatgagctgatgcgccagtatctggatcttgtccgagaaaatatggaagtgagacttcgtgtagaagaaggaattctctctgcgaaccgtaattttgttattgcccgggccggaatgtcagaggcagcactgaatactgcattgatggctccgaagcaggaagttggacttatagttgatgagaagaatgttatgagtgttgagattccgaccttcacatccaaaacaagaacagcggatgaaaatgatatctattcttatggatttgcatttacttccagtgatcttgatggagcagtgaagtctttatcagatatcctcccagatatgatccgacttgcagaatgtgaaaaagcatgtcagctgatggcggcagagattgagaagacaagacgtcgtgtaaatgcactggagcatgttatcattccagagacagaggaaagtatcaaatacattacgatgaaactggatgagaatgagcgtagtacacagatccgactgatgaaagtgaaagatatgatgcttgaagaggcgcatcattacaaagaaaaagaggcgtaactattaaaaataaaaaagaacatgaccagagaataaaagcttctgtttaagaagtcttgaaactgtggggcatgttctttttcatgtttaaatctaaaaatacaagcattttacatctttttttgaaattttgcttggctctgaacagttacaaatgcaaaacattatacaagaattttggattgcagaagatctgttaaaagttgtcttgctccggcctgaacctgttctaacggtacttttgatgtataagactcactgataaatccgaacagaccaaagcagatgaatccggcaatctgtcttgcagaatattttaaagaataagaagctttcagcttatctgtatgagattctaccgtgtctaagaggatccgataaaatcgaaaagccaggtaaggatttgtttccggtacgacatgctggaaaaaatcataacgttcatagtaaagagacaaaatactgtccaaaacgttcagatatccctgtgtgagattgttttcaggattgttttcctcttgtctgcgatggtatccttcttttccaataatcagcatatcattgaaaatgtcgtcaaggagggcaaatttatccttataatgtgtgtagaaagtgatccggctgacattggcaatcttacataattcagtaattgaaattacatcaaaagcctgtgtggttaaaagctccaaaagagcagactttaaagcacgttttgttttggtgatacgcttatcctccattgcggatattctcctttctgtgttctgtggcagatcatacgaatgctgtgattacttatctgtaaagttattttaacacctgtaaagaaaatggtcaaatacagatgagagtgattcattgttgaactcgtgttagtgtgaacagtagtacaggatagtaagtaacagaaatgtaatatttttcgaataattcttaatgaatcattactacatatttaagaagtatggtttataataaatataaccatatggatattgtatgctaaagatgatggaaatggtgatgtcagcaatatccgtaagaaaaagaggactctttgcagtaatgcaaagggaatgggagaaagaatgcagcaaaagataaaggaaatgttgataaagataaaagatgtactggtgagtgtctggcatagttataaaagaatgcgtcaggagaacaatatttatttcaacatactggtaggtcttgtgttttttgcgattgtcggaacaggtgtatgtatggtggcaaatgcgcgggaagcagcagctttacgtcaggtagaaatacagaaagagaaagaagcacaagagaagaaaaaagccgaagaagaggcgaaaaaagcagaagaggcagcaaaggcagaaagagataagtccatgtctcttcagccgggagttgcagttggaaccatggatccgcaggatgatgagaaagtcgtttatctgacatttgatgatggtccgtctgcaaatacgcagcgtgtgcttgatattctggatcagtatgatgcgaaagcaacctttttcattaccgcccagcagccggattatttccctatgatcaagaaggtttatgatgagggacatacaattggacttcacagctatacgcatgaatatgatcaggtctatgcatctgtggatgcttattttgatgatcttgagaaaataggagaggtggcaaaggaacagcttggatttgttccatgctttatccgttttccgggaggcgcatcgaattctatttcaaaaaaatattcggcaggaatcatgacacagttgacacaacaggtgttggataagggataccagtattatgactggaatgtgagcagtggagacggaggaacggttacggcagatcagatcatcgcacagtcagagacggatgagtataccaaagtaatgctcctgttccatgacacagaggcgaaggaatctaccattcaggcacttccgacggtaatagagtactataaaaatctgggatattcttttaaggcaatcgatcgggaaagcctggttgtgcatcatgaagtgaataattagaagataacagagaaagaaaagcaggagttggctgtaaagaagagcagtcgactccttttctttcctatggtataattgaaaaacgagaaaacaatgaaaggggcagattttatggggaataactcagaaaataagccagacagatatataaatataggtattgtagcgcatgtggatgccggaaagacgacattgtcagaaagcatgctctatcatgccggagcaatcaggaagcttggcagagtggattataaagatgcgtttctagatacagatcagatggaaagagaacgtgggatcactattttttccaagcaggcagtattccggtggaaggatcgcacgatcacacttcttgatacaccgggacatgtggacttttctgcggagatggaacgcgttctgcaggttctggattgcgcggtgcttgttgtcagtggagcagatggtgtgcaaggacatacacagacattatggaagttattaaaaagatatcacattccaacatttctttttgtgaataaaatggatcaggaaggaacggatggtgaaaaacttctgaaagaactccgcaagcgtttgggggaaaatgtcgttccatttgtggatatcatgacagaatccgactgcccgggtggaaaagtatatttacatacgaaagagggcgcagtggaagaggtgctggaagagctggctgtctgtgaagatgatatgatggaagaatatctggaagagggaagaatcactctggataaagtgcaaaaagcagttgcagaccgtcaggtgtttccatgttattttggttcggcactacattctcaaggcgtggaagaacttttggatggacttgatctgtatataaaagataagacttatccggcagagtttggggcaaaggtttataagattgcaagggataatcagggaaaccgtctgacctatctgaaagtgacaggtggaagactgaaagtaaaagatgtagtggaaggactgaatgaaaagatcaatcagatccggatctactccggtgagaaatttgaggctgtccaggaagtagaagccggaagagtatgtgcagtgacaggattggaaaatacaagacccgggcagggaatcggagcagaagaagagtcggatttaccggtattagagccggtgttgacataccagatccttcttccggatgactgcgatgtacataagacgcttttgaacttaaagattttagaggaagaagaaccagaacttcatattgtatgggaagaacagacttctgagattcatgtacagttgatgggagatgtgcagattgagattttacagcggatgataaaggaacgttttggtgtgctggtagaattcggtgaagggagtattgtttacaaagagacaatcacagcaccggtagaaggtgtgggacactttgaaccattacgtcattatgcagaagtgcatctgcgtctggaaccgggagaacgtggatccggaatgcagtttgcagcagagtgcagtgaagatattctggacagaaactggcagcggcttgttctgacacatctggaagagaaggaacacaaaggtgtgctgacaggttcaccgatcacggatatgaagattacgctgacttccggacatgcacatcagaaacatacggaaggcggagattttcgtcaggcaacttatcgtgcagtgcgtcagggattaaagaaagcagacagtattcttctggagccatattatgaatttcgaatggaacttccatcagaaaatgtaggacgagctatgacagatatccaaaatatgtccggtaaattcggaacaccgatgatagaagaagagacaaccgtgctgacaggaagtgcaccggtgtccctgatgcgtggatatcagaaagaattcactgcctatacaggtggacgtggaagaatggcagtttcgttgaaaggttatgatgtctgtcataatcaggaagaagttctggcagcgttaacctatgattcagaggcagatctggcgaatccgacaggttctgtattctgtgcacatggagcaggatttgttgtagattgggatgaagttgaagaatatatgcatatggaacatacattggaatcaggaaatgatgatgaaatggatgtaatggaggtgacacttccaaaacgcaggcactccagtattgaactgacacaggaagagttggatgcgatctatgtccgtacaccggatccgaagaagaatcgttctacaggtcctgtaactgtccgggcaaaggaaaagacaagagagccgggaagcgcttaccaggatccgaagtgggaagcacgccggagagcgaaagccggaacagaagaataccttctggtagatggttataatataattttttcatgggaagaactgaaagaactttcagaaagagatattggtgcagcaagaggaaagcttgcagatattctaagtaactatcagggattccgcaaatgtaccctgatccttgtgtatgatgcttataaagtagaggggaatccgggtgaagtgatgaaatatcataacatttatatcgtctatacgaaagaagcagaaacagcagatcaatatattgagaagacagtccgcaggattgcgaagaatgcagatgtaacagtagccacatcagatggacttgagcaggtgatcatcatggggcagggggctcacagaatgtctgcgccaggtctgaaagaagaggttgagttagcattaaaagaactcagaggagagcatctgggcaggcaggtaaatctgaaaaattatcttttggattatcttgatgaggaaactgcaaaacagatggaagaaatccgtttgggaaaagaaaagtgttaatttttaatgaagatacaagttttttggtgatattaatgttatgatataagaaataaagtcgcaaaacgaacaagtgagcaaattggtcagtgctctgggaaagtgagaattgtgacttatgaaagcgaggtagagatgatgagatgtatgaactgttatcaggagataccggatagttgtaagttttgcccgaattgcggggcgaagcagccggtacagaagatggaacctgtatcacaggtgaaggaagagacaacagataacataacagaagatacagcagaggtacagcagccgacagaaaaagtgcagtcagaagaagatgtgctgccggaagaaaaagtgcagccagaagaagatgtgcagccgacagaaccaacacagtcagcggatgtggcaggttcatatcagaacgatccatacaaaagtgtgaatcaggagcagaatacttcctatggtgaaccaaacaactatgagtatggacaggggtacggtcagcaaaatcagaattatactcagcaagctccaaactatggtcagcagaaccagggatattatcagcagaataatttcaatggaatgccacaggagccagtgaactgggttccatatcttatattatcaattatttcaacattatgttgctgtcttccgtttggtgtagtgggaatcgtattctcggcgaagatcaatagtgctatgctggcaggaaatcttgaagaagcacagaataatgcgaagatggcaagaatctggattatcgtatcctttgcaattggtcttcttacatggttgatctacatggttctgatcgtgacaggggcagtttccggttcggcttattactattattaaaaagtgagcggatgatgatttggaagataaagatgcgtgaagcatttcaaacaaaaaggtcagccaggatcatcgcagttctaacgggggcagtgattgcagtggccgctgcgggttatctcttttttcataatccgcaccagtatccgctgccctgcctctttcatattattaccggactgtattgtccggggtgcggtgccgggcgggcaagctattctattttacatggaagattttatatggcattccggtataatccgatgtatgtgacattactcccgtttcttggtgtgtatattgtagcacgattgattgactgggttttgaccggtggtaatcatgtggatcagaagattaatcagaaagtcctatatgtggtattagttatagtggtggggttcggaatcgtgagaaatattccgatttatccatttacattgcttgtgccggcgggatattaaaaaataaaatcagagaaacgaagttctttcagattctgtttaaatgagtgacagagaaagaacttcattttttgatttattaaaaagcatgactaggaaaattctcaagaatatggtattatgaaaaatgatatattgtgcgtaaagaaaagtaacgcgtcaacctgaaggaaagaccgaaggttatcattcatcggtgatccgatgaaaagtaacaggatatggaggaatgaagaatgattaataaactggtagagaagatcaaaaagacaggtgcaccgatcgtagttggactcgatccaatgctgaactacatcccacagcacgtacttgacaaggcttatgcagagtatggtgagactctggaaggagcagcagaggcagtatggcagttcaataaggagatcgttgacaagacttatgatctgattccggcagtaaaaccacagatcgcaatgtacgagcagttcggaattcctggactgatggcatttaagaagacagtagattactgtaagtctaaagaccttgtgatcatcggagatgtaaagcgtggagatatcggttctacatctgccgcttatgcaacagcacatcttggaaagattaaggttggaagcaaggaatatacaccattcggagaggactttgcaacagtgaatccgtaccttggatctgacggagtgaatccatttgttgacgtatgcaaggaagagaagaaaggtctgttcatccttgttaagacatccaatccgtccagtggagagttccaggacagaatcattgatggaagaccgctttatgagtgggttggagagaaggttgccgagtggggatctgactgcatgggagatgagtacagctacattggagcggttgtaggagctacttatccggagatgggtaaagtattaagaaagatcatgccgaagtcttacatccttgtaccaggatacggtgcacagggcggacagggaaaagaccttgttcatttctttaacgaagacggacttggtgcgatcgtaaactcttcccgtggaattattgcagcttacaagcaggaagcttatgcgaagttcggaccggagaatttcggtgatgcatcaagagcagcagttgaagcaatggtagctgatatcagcggagcacttgcagcagcaaaataatttcaagaaaggaattgcataagtttatggcaaagcagaaagaaaatgcagtagtacattcccaggagcagctggcggatggaatctacagcatgtggatcaatacagaggcagcaaaggacgcaaagccgggacagtttatttctatgtatacaacagatggaagtaaattacttccgcgtccgatcagtatctgtgagattgataaagagaacggaagacttcgtgttgtttaccgtgtgacaggaccaaagacaggaacagaagaattttctaagttgaaagcaggagatatcattccggtgatcggacctcttggaaatggattcccatacgagaaggctgaaggaaagaaagtatttctgatgggcggaggaatcggtgtaccgccgatccttgaactggcgaaacagatggactgcgagaagaaacagatcgtagtaggataccgcaacgcacagacattccttaaggaagagttcgagcagaacggagaactttatatttccacagaagatggaagtgtcggaacaaagggaaatgttatggacgcaatccgtgaaaatgctctggaagcagatatgatctatgcctgtggaccgactccgatgctccgtgcgatcaaacagtacgcagaagagaacggaatcgagtgttatatctcactggaagagagaatggcatgcggaatcggtgcctgtctggcatgtgtatgtaaatcgaaagaaaaggatgcacatagcaatgtaaataacaagcgtatctgtaaggacggccctgtattcttgtctacggaggtggaaatctaatgaacatgagcgtaaatattgccggtgtagaatggaaaaacccggtaacagttgcatccggaacatttggctcaggagaagaattttcagaatttgtagacctgaaccgtcttggagcagtgacaacgaaaggtgtggcgaacgtaccgtgggcaggaaacccgactccacgtgtagctgaggtttatggcggtatgatgaacgccatcggacttcagaatcctggaatcgatctgttctgcgagagagatattccatatctgaagaattttgatacaaagatcatcgtaaatgtatgcggacacgctccggaagagtatcttgcagttgtagagcgtcttgcagacgaaccgattgatatgatggagatcaatatttcctgtccgaacgtcaatgcaggattccttgcatttggacaggatgcacataatgtggaaaagctgacagcgcagattaagaagatcgcaaagcagccgatcattatgaaactgacaccgaatgtaacagatatcacagagattgcaagggcagcagaagccggtggagcagatgcggtgtctctaatcaatacactgacaggaatgaagattgatatcaacagaaagacatttgcggtagcgaataagaccggaggagtatccggaccgatcgtgaaaccagttgcagttcgcatggtttatcaggtggcacaggctgttaacattccgatcatcggaatgggtggaatttcctgtgcagaagatgcaatcgaattccttcttgcaggtgcaagtgcagtgtctgtaggaacagcaaacttccacaatccagcagtgacactggaagtgatcgacggaatcgaagcttatatgaagaagaatggctttgagaatgtaaaagatatggttggtattgtaaaataaacccggaggtaagatagaatggaaagttataagaaagaatttatcgaatttatggtagactgtgccgcactgaaatttggagatttcacactgaaaagcggaagaaaatccccatttttcatgaatgcaggagcatatgtgacaggatcccagttaaagaaacttggagagtattacgcaagagcaattcacgagacatatggagatgacttcgatgtactgtttggaccggcgtacaaaggaatcccgctcggagttgtaacagcaatcgcatacagtgaattatacggaaaagaagtacgttactgctcagaccgtaaggaagagaaagatcatggcgcagataagggaagtttccttggaagcaagctgaaagacggagatcgtgtgatcatgatcgaggatgttacaacatccggtaaatctatggaagagacagttccgaaggtaaaaggtgcggctgacgttacaatcgttggacttatggtatccttaaaccgtatggaagtaggaaaaggcggagagaagtgtgcacttgacgaagtgaaagatctctatggatttgagacagcagcgatcgttacaatggaagatgttgtagagtgcctttacaacaaggaatgtgacggaaaagtagtgatcgatgatgaattaaaagcagcgatcgatgcatattatgagaaatatggagcaaaataaggaggcctggtgttttggaaaaagcgtatcgtgtaatgagaaacagcggagcaggtaatattgcaattggaattatcctgcttgttacaggagttacggtaggaattatttctattatcaatggagccagtctgttaaaacataaaaataatataacattttaaaaggaaagtcccctcgtagcttgttcattgtgagtagttacgtccgaagtgaaccggcagaggggactttctttttctgtgaaggtgtaagaaattgacaaaaaaagaagcgaagagagtcaggacgcttggaaagatcctgtttatattatatattatcttccttgtatactttctgttcttatcagactggtacggcagggaaggcgtaatggatgaataccattacaatctggagctattcaaagagattaagagatttattcaatacagacatcagcttggaacatttgcggtgttctcaaatttatttggaaatattctgattttcatgccagttggttacttttctgcaatggcaggaaaaagaagaagcttttttaaaacgttatttcggagtttttgtctgactctttgtgtagagttaatgcagctgatcacgaaagtgggatgctttgatgtggacgatattctgctgaatacaatcggcggtgtacttggatatatagtttttgtagtttgtaatctactaaggagaagaaatgatcggaaaaaaagaaaagaaaaacgatgaaagagaaaaaaatcagaagaaagaaaaggaacgaaagagtaatcaatcaaagaaatatggcaaagcagcgtatctgcagtcaagaagaggtgtgatctcctgctggttgaccggatggtcacttgctatcttgctgggatgtgtcggatatgcattcctgacgagaggaaaggcagccggaattgtcggagggattgcaatcctttctttaatgattgatatatatggaatctggaatgcaatagaaggatttgaggagcaggatagaaaatatctttcctgcaaatgtggaatcgggatcggtattgtgcagatcttgtgcttccttggaatttttgttggaggtctgagcttatgatcggaaagttaagtgagttacagaaggagaaaaatgaacagtgcacacagcgtcacgaactggcagttgagcgtctgcgcacgatcgtgacagaagaaacagtgaatgcagcatatatttcttactttcaggattgtaccttgtttctgcttgagttagagaatacacgaaaaaagctagaagatggaagctgggacagcttaagtcttgaagaaaagcgtagcctgaataggattctttatagtgatattataggagagaaatatcagacaagctatgccaatcaagactatgcctgtgaaaaattggggcaggagatgggacagcttttaagtttgttgtatacggaaatcagagcaggaattccgtatgtgtttgaacagcgcaaggattatctgacaatcctctatgagttgtttctcgaagtctatacctgtttcgagggaatgagtgaggaagagaatccagttccaaagccggagcagatcaaggagattctgtattggtatgcaagcgattactgcgatgtgttttatgcagaccgaattctggagcagatggatccgtcagcggattttgcagtacagatcattgagaaggcagatcttgatgaagatgattatctgtatgaattcggtgagtacatttccaagaatgaacttggaacagctcatcatctgagaaatctgccacaggagacactgcagaagatggcagatgtatatacggaaggatatcgggttggttttattaatactggaaaagatctgtcaaagaaatcgattgtaaatatccgttacagccttggatttgaaaaggtgatccgccttgcgatcgagaacttccgtaagatgggattaaagccggttatttatcgtgcagcctccagcgtgatcacgaagagagagcaccacaagattggatattacggtgcgatcgcgaatcagcagtatgagtatgatcatagacaggaccaggcactctttatggataagcgttatgtagaacgtaagcttgaggtaatgaagactgttttcgaacagaataaggagatggcagcaggtgttgcaggaccggcagttatggagatcttcggtgagacaccattttcaccggaagcgaaagaaacagcaccggcatatgatgaggcgcagagagaactggatcttctctttagcagcagatcaggacagattacgaatgagtatatcaagggtgaggaaagaagtttcacgattgttgcttatccggtgccggagattggggcagattatgcaaagatctttgatgaagtgatcaagatcaatacattagacgcgaagctttatgaaaaagtgcagcagacaatgatcgatgcattagatcagggaacttgtgtacatgtaagaggaaaaggagaaaaccagacagatattacagtacagttatatcatctgaaagacgcacagaaggagacaatcttcgaaaattgtgtggcagatgtgaatattcctgtcggagaagtatttacatcaccggttttggaaggaacgaatggcatacttcatgtaagcaaggtatatctggacggacttcagtatgagaatctgaagctgacatttcaggatggaaagatcaccgactatacatgtacgaactttgaagatgaagcacagaataagaaatacatttacgataatgtattgaagaatcatgagactcttccgcttggtgagttcgcaattggaacaaatacgactgcatatgtggcagcaaagaaatttaatatagaagataagatgccgattctgatcgcagagaagacaggaccgcattttgcagtaggagatacatgttattcctggagcgaggaaatcagagtctacaatccgaatggaaaggaaattgtggcgaaagataattcctgttctcttcttcgcaaggaagatgtatcaaaagcatactttaactgtcatacagatataaccgtgccttataaagagttagaagaaataagtgtagtgacaaacgagggaaaagacattatactattagaggacggaagattcgtattgccgggaacagaggtacttaatgagcctttggatgaagcgggattttaaggaaatcctataggtaattggatagttaatagatgattaaatggaatctttcataagtatggataataaataaacaaagttttccaagggaaggaaaacagtataccactgaggaggaaatgatatgccaaaagtaggaattgtcatgggcagcgactcagatctgaaggtgatgagtaaggcagcagccacactggagaagtttggaatcgattatgagatgacgatcatttcagcacaccgtatgccggatgtcttttttgactgggcgaaggcagctgaaggaaagggaatcaaagtaattattgcaggagcaggtatggcagcacatctgccgggaatgtgcgcagcacttttcccaatgccggtaattggtatcccaatgtcaggaaagaatctggagggtatggacgcactttattcaatcgttcagatgccacctggaattccggttgctacagttgcaatcgacggcggtatgaatgcggcaattcttgcagcaaagatgcttgcaatgtcagatccggagcttttagagaaactgaaagcttattctgcagagatgaaagatacggtacaggcaaaagcagacagacttgcagaagttggttatgaggaatatctcaacaataaataaatacgattcgaaagaaaaggagatttacgatggattacaagacatcaggtgtagatattgaggccggttacaaatcagtggaattaatgaaagaatatgtaaaagagacaatgcgcgcagaagttctcggaggacttggcggattctcaggagctttctctcttgcgaagatcaaagagatggaagagcctgttcttctttccggtacagacggatgcggaacaaaggtaaaacttgctatggtaatggacaaacatgacacaatcggaatcgatgctgttgctatgtgtgtgaatgatattgcatgtgcaggtggagagccactcttcttcttggattatattgcatgtggaaagaattatccggagaagatcgctgcaattgtaaaaggtgttgcagaaggatgtaagcagtccgatgcagctctgatcggtggagagacagcagagcatccgggacttatgccggaagatgaatatgatcttgcgggattcgcagttggtgtttgcgataagaaagatatgatcacaggagagaatcttgcagccggagatgttctgatcggaatggcttctacaggtgttcacagcaacggattttcacttgtaagaaaagtatttgatattacaaaagaatctttagatacttattatgatgagcttggaactactcttggagaggcacttcttgctccgacaagaatctatgtaaaagcacttaaaagcatcaaaaatgcaggtgttacagtaaaagcatgtagccatatcacaggtggcggattctatgagaacattccgcgtatgctcaaagaaggaactcatgcagttgtagaaaaagacagctacccgattccaccaatctttgcaaaacttgcaaaagagggcgaaatcgaagagcagatgatgtacaacacattcaacatgggacttggaatggttctcgctgttgatccggcagatgttgataagacaatggatgcaattcgtgaagcaggagatcagccatatgtagtcggcaagattgaggctggcgaaaagggagtgactttatgttaagagtcttaagtatggtgtcaggaggcggaacaaaccttcaggcaatcattgacagcgtaaagaatggaatgatcacgaatacagaacttgtgggcgtgatcagcaataataagaatgcctatgcactgacacgtgccaaagaaaatggaatcgatgcgaaatgcatttctccgaaggactacgagtcaagagaagtgtttaatcaggaacttttaaaggctgtagatgcatatgagccggatctgattgtactggcaggttatcttgtggtaatcccaccggagatgattaagaagtataagaaccggatcatcaacattcatccatctctgattccatctttctgtggaacaggttattatggattgaaagtgcacgaggcagctttggagcgcggtgtgaaagtagttggtgcaacagtacatttcgtagatgaaggaactgatacaggcccgatcatcttgcagaaggctgtagaagtacacaatggagataccccggaagtgcttcagcgcagagtgatggaacaggctgaatggaagatccttccacatgcaatcgatctgatcgcgaacggaaaggttgaagtagaaggacatcgtacaatcgttaccgagtaaggaggcagagactatgaacgtattgatcgtaggaagcggcggaagagagcatgcaatcgcagcaagcgtggcaaagagcccaagagcagacaaaatcttttgtgctccgggaaatgccggaatcgctgagtatgcgcagtgtgtaccgatcggcgctatggaatttgataaattaagagatttcgcaaaagagaatgcgattgatctttgtatcgtaggaatggatgatccgctggtaggcggtcttgtagatgttcttgaagaagcaggaatccgcacatttggaccgaagaagaatgcagcgattcttgagggatctaaagcattttccaaagacctgatgaagaaatataacattccaacagcagcttatgagaactttacagatccaaaagcagcagttgcttatcttgagacagcgaagtttccgattgttttgaaagcagacggacttgcactcggaaaaggtgttctgatctgtaaggatctggaagaagcaaaagcaggcgtgaaagagatcatgctggataagaagtttggtacagccggaaatgagatggtcattgaggaatttatgacaggccgcgaggtttccgtactttcctttgttgatggaaagacaatcaagacaatgacaagtgcgcaggatcataagcgtgccggagacggagatacaggacttaatacaggaggtatgggaacattttctccaagcccgttctatacaaaagaagtagaagaattctgtgagaaatatgtttaccaggcaacggtagacgcaatggcagcagaaggacgtccgttcaagggagttatcttctttggattgatgctgacagaagacggaccgaaggttcttgaatacaacgctcgtttcggagatccggaagctcaggttgtacttcctcgtatgaagaatgatatccttgaagttatggaagcatgtatcgacggaacactggatcaggttgatcttcagtttgaagacaatgcagcagtctgtgtcgtactcgcatccgaaggatatccggtaagctacgagaaaggcttcccaatcacaggactggaagagttcaagaagcacgaaggatattactgcttccatgcaggaacaaaattcaacggagatcagatcgtgacaaacggcggacgtgttcttggcgtgacagcgaagggaaaagatctgaaagaagcccgtgcgaatgcatatgcagcgacagagtgggtaaactttaagaataaatacatgagacatgatatcggtaaggcaatcgatgaagcgtaaataaaggggcgcagacctggttcaataagataaaacgatataagaagtaatgaaggaaaccggcagggaggaaaaatccaaactatcggtttctttgtgattttatcacagaaaaataaaaaatatgtgctatactagggttgtaacaaaggaaaaaggtaactgttcagttacagataaaagatataacatctataaggaggatataaagatggcagtagtaaaacttacaacagacaattttgagcaggaagtacttcaggcacagcagccggtactcgttgatttttacgcagactggtgtggaccatgtaagatgatggctccaatcgtagaagctctttcagaagaactcagtgatgcaaaggtatgccacatcaacattgatgagaatatcgacattgcacagaaatacagagtgatgagtattccgactttcatcgcatttaaaggtggtgaagagagcggaagacagattggtgcgattcctaagacagcactggttgaccttgtgaaataaatttgcgataatagaagaaaggaaaaacccagacgggctgccgggcacagagaaggctgagagatatggctcattcctgtgaacgacagcctgtcttttgcttagatattaagaagaaaggcgggagtcagagcatgtcattgcagtttattttcggaaattccggaagcggaaagtcccattatttatatcagcagattgttgaggagtcaatccgtcatccggagaagaattatcttgttctggttccggagcagtttacaatgcagacgcagaaggatctgtgtatggcacatccgcgtggcggtattatgaatattgatgtcttaagttttggacgtctggctcaccgtgtttttgaagagacaggaaaggaaagacagccgatccttgatgatgagggtaagaatctggtgctccgtaagattgcaggaaattacgaagatgagctgaccgttcttaagggaaatcttaagaagcagggatatatcagcgaagtgaagtccgtgatatcagaattcacacagtatggaattgattttgaacagcttgattctttcatggaaggactgaatccggaaagttatctgtattataagttaaaggatatccgtaaagtatatgaaggatttgaggattatctgcgtgataaatatatcacaaaagaagaattacttgatgtgttgagtcagactgtaccggaagcgaaaatgcttaaagacagtgtgatcgcaatggatggatttaccggatttacaccggtgcagaaccggctgatcggggaacttctgaaagtgtgcgataagattatgttgacagttgagatcgatcggagggaagatccgtttgtctataagcatccgtatcagctctttgcgttgagtaagcagatggttacttcactgacggaagtggcgcaggaagtgagagtggagattgatgagcctgtctggttatgcaagaatccgtcgtatcggttcaaagaaaatccggagatggcgtttttggaagaggaactatttcgttattccagaagaaaatacagtggagagaagatgcggtcaatttctcttcatgaagttcatacaccacaggaagaggcacagtatgtggcagaggagatccggcgtctggtgagagaagaagggtacagatatcgggaaatcgcagtgattgcttcggatctgagtacttatgcagatgctttggaaaaagcatgtgatcgatatgaaatcccggtctttatggatcataagaaaagtattttattaaattcttttgtagagtatttaagaagcttgctggtgatggtagaacagaactatacttacgaaagcgtttttcgttatctgcggaccagcctgtgtgggttcacaagagatgaagtagaccgtctggaaaattactgtcttgcgctggatttgaaaggattcaagaaatgggatcaggtctgggtgagaaaaacaccgatgacgacaaaggaagaactggaagaactgaaccatctgcgcatgcgctttgtggaaaaactgacaccgctgtatacagtcctgaagaagagaaaaaagacggtaaaagagatcacacttgcagtttatgaatatctggttcaggagaagatccaggagcagcttgcagaattggagcagaaattccaggaagatggagaactggcactggcgaaggaatatgcacagatttatcgtattgttctggaattattcgataaattcgttgaacttctgggggaggaagagattcctttgaaggaatactgtgaacttttagatgcaggacttgaagaggcgaaagtaggtgtgatccctccaagtctggatcaggttgtgatcggagatatggagagaacacgtatcaaaaatatccgcgcattattttttgtcggagcaaatgatacgcttcttccaggaaatgcaggggcaagaggtctgctttccgagcgagacagaaaacagtttcaggagaagaaaatgaatctttctcccggaccaaaagagaaattatatattcagaaattttatctctatatgaatctgacgaaaccgtcagaacttctgtatctgtcctgggcaaaagtatccggggaaggaaaagcacttcgtccagcgtatctgatccaggatctgatgcgtctgttcccggtacttgttccggtagaggaagacagaaagggactgcttgatcatgagatgatgagaaagagcggactcttgcagattgcagaaggtttaagagagagggagcatggactggatgattcctggaaagaactgtacagatggtttgtaaaggatgaacagagtcaggaaactctgaagcagatgatagaagccggtttctaccggaaggatgagccgagccttggaagtagagtagcaaaagaactcttcctggatccaaagcgtgtcagcgtaacaagactggaacgttttgcttcctgtgcatatgcacattttctgaattacggactccgcctgtcagaacgggagaaatatgggttcgaagcaatggatctgggaaacattgcacatcaggcactggagcgatttgcacacaaggtagaagaggagggtctggattgggttacaatgccggaagagaagcgggagcagctgattgatgaaagtgtagaagaaagtattctggattatggaaatacagttctattttcatctgcacgtaatgagtatatgattcacagaatcaagcaattgatcaaccggtccgtctgggcactgacacagcagatggcggcaggcgattttgtgccgagcgggtgtgaatttaagttcggaagcggaaagattgacagaattgatacatgtgaagatgaaaatgcggtctatgtgaaggtaacagattataaaactggaaggaaagcatttgatatcacagcattctatcacggtttgcagatgcagcttccggtttatctgaatgcggcactggagatcgaacggcagaaacatccggagaaagaagtatttccggccggtattttttattacaggatccaggatccgattgtgaagaaagaagagacaaaagcggaagttgagcaaagtattctaaaagagctgaagctggatggactgatcaatgcagatgaaaatgtagttgagcatctggagcggaatctgagtggaacttcaacattctatccgctgcggatgaataagaacagaacgctcggttcggcatcaaaagctttatcaaaggagaactttgatacggttcttgcgtacacgaaagagaaagaaaaagagctgaaggacgtgatgtatcagggagaggttgcggcacttccgtatgtacttgatgagatgacaggctgtgattactgtgggtgcagggatatctgcggatttgaccagaggattgaaggctgtgagtacagaagattaagaaaatataccttggaagaagcgttgaattctatgaaagagcgtcttggtattttggaagagaaaggggaggcaggagaatgagcgtaaaatggacagaagaacaacagaaagtaatcgacttgcgtgaccgcaacattctcgtatctgcagcagcaggttccggaaagacagcggtacttgttgaacggattatttccaggataacagatgaaaatgatcccgcggatgtagaccgtctcctggttgtgacttatacggaagcagcggcggcagagatgaaagaacgaatcggtgcagcaattgaaaagaagctggaagagcagccgggaaatgtgaatctggagcagcagtccacattgatccacaatgcgtcaatcatgacaatccacagtttctgcctgtcggtgatccgggatcattttcatgtgattggaattgatccggcctttcgcattgcagaagaaggagaattgcgtcttctgatgcaggatgtcttagaagagctgatcgagaatttctatgcagagggatccgaggcatttttaagctttgttgaccagtatggaacaggaagaaatgatcagaagatcgaggaacttatcctccagctttatgaatattccagaagttatccacagccggaaaagtggttgaaggaatgtgtggataattatgagatcgatccggagaagatggaagaagcagatgtcgtgcaggaggcaaaggcaagagtaaggcagaatctcacagatgtgaaagggtttgttcaacaggcgatagaagtatgcgaacttccggccggtccgtatatgtatggtgaaatgttagactctgatctggtacagattgagcaattggaaaaagcagagacattttgtcagcaagagcagatcgtcagtgattttacatggaaacgtttgtcaggaaagaaagatccgacagtcgatccggagctgaaagagaaagcgcaggggcttagaaaacaggccaagaaactgatagaagatctgaaagcaaactatttctacgcgcctgttgatgagtggatcagggatatgcaagaggcacagacagcaatgaagatgttagttctgctggtacaggcttttgcagaggcattttcggagaaaaagagacagagaaatctgttggacttcagtgatatggaacagtttgcacttcggattctgacggaagaaaaggaaggaaaactggttccgtcagcagtggcacaggagtatcaggaacgctttgaagaagttatgatcgatgagtatcaggatagtaacctggtgcaggaaacaattctgacgagtgtgtcaagagagtcggcaggacagaataatctttttatggttggagatgtaaaacagagtatttaccgattccgcttgtcgcgcccggaactctttatgggaaaatataacagctacagtatgcaggagagcagcaggcagagaattgatcttgacaggaacttccgaagcagaagagaagtacttgacagtacaaattatattttcaggaaactgatgcggaaggaattcggagaaattatctatgatgataaggcggcactgcatttgggagcctcttttcctgaattaccggatgaaaatgtgtttacggatcagacggaactgcttctttataatcagacggggcttcggagcagtgaagcgagagaagaagaggcgcggatgatcgcacagagaatgaaagaacttctaaacacgggggttgtgcttgataaggagacaggagaataccgcccggttcattatcgggatatggtgattctgacgagaagtttacaggggtgggcagaagtttttgcgtccatactggccgaggagggaattccggcatactctgtgagcagagaaggatatttcgagacgtatgaggtcagtgttcttctggattatctgaaagttcttgataatgcaagacaggatctgccattgacagcagttttgacttcaccgtttgccggtctgacggcagcagagttgtcagtgattcgtctcgcatatccgaatcagttgttttacgaggccgtggaaggattttgcagcctgagtccggaagaaattccggaaactgtggacaaaaagcaggcaatacaggtacaggaaaaattgaggaagtttttcgaggtattggatcatttcagggaaattcttccgtatacggcaatccatgaccttcttgcggaaataattgataaaaccggctatgggttatttatcagtgcgatgccagggggcgcacagagacaggctaatgtagaaatgcttgttgagaaagcaagagcatttgaagggacgagttataaaggtctgtttaatttcgtacgctatatcgagcaactgaaaaaatatgatgttgattatggcgaagcaagtatcatagacgaacaggatgacacagtccgtattatgagtattcataaaagtaaaggtctggagtttccaatcgtttttgtagccggaacaggaaagcaattcaatacacaggatctgaaaggaagtattgtgatccatccgagaaacggagttggaattgacgttgtagaccttgagatgaggacaaaggcaccgacctttttgaagaaaatgatccaggagaagacaaagcttgagaatcttgcagaagaactccgtgtgctttatgtagcgatgacaagagcgaaagaaaagctgattctgacaggcagtctgaaaataggagaagacggcctggaaccatatgtgaatcatatgacagacagggaatctccattgagcctttatcagttagaaggcgcaaaccgttatctggactggattcttccggcacttcttcaggaaggagatctcaagagagaagctgatttatgtggaattctcaaaacagaaagtgaagaggtgcagcaattgccgattaaagtccggatttttgatgcaggagagatggattttacagaagatgcacagcgacaggcagaagtaatcgcaagagaagtgcttgaacactgggatacaacgaaggtttatcttccgggagcggaagaaaagctggaacagcagatgaatttcctgtatccatataaagaagaaggaaaaatgaagctgaaatttacagtttcagagttgaagaagcgtgagtctttgcaggaagaagcaggagaagaactgattcaggagccggagattgtgccactgcttccgcatttcatggaagaacagaaagaaggactgacgggagcttcaaggggaagtgcttatcataaatttcttgagcttcatgatttttcaaaagagtatacagaggaacttctgaaagaagaaatcgaactgttctatcaggcagggagactgtcaaaagagatggcagactgtatccgcacgaaagatattcttgcgtttttaaatagcgagagtggaagacgaatgacacaagcagcaggaaatggaaagcttcggaaggaacagccatttgttctcggagtagctgcatcagaaatctatccggagatctatcaggacattcagaagagaagtcaggaagcggatgaaaatcgaaaggaagagaccattctcatccagggaattattgatgtctggttcgaggaggaagacgggcttgtactactggactataagacggatagagtcagaaatgcatctcaattgaaagaactgtactatgcacagcttgattactatgctcaggcgctggagcaactgttagagaagccggtgaaggagaaaatcatctattcctttgccttgaaggaggagatcatcttatgaaatatttctggtattatctgatatttatcaatttatttgcattttgtacctatgggattgataaatggaaagcgaagaaaggcgcatggagggttccggagaaaacgctgttaatccttgcactgatcggtggaagtgcaggagcaatcgcaggtatgatgtgcttccggcataagatacggaaagcaaaatttatgattacagtgcctgtgatctttgttgtggaggtaattttgctgatcatctggcttttgtaagaaagaaaaaaagaaaatgttctttatcgcatcatcaatttgcacagttaaagtgctgaaattattatcaaagaaacaagattttacaaaatcttgtttctttttttcaacttcttttcgaatgaaaaaaaatctgttaatataacacataggaatactagagttattggttgcagaatactgtgaacagcatgaaagcagctgggaaaggagtttgacaagatgccaaagttaaatgaaaattatcagaatgtaaaagacagttatctttttgcagaaatcgcaagaagagtaaaagtatatgaggaaacacatccggagaaagcggcggatattatccgtctcggaatcggtgatgtaacattgccattgacaaagagtgtgatcgaggcacttcatgaagcagtagattctcaggcagtatctgagacattcaaaggatacggaccggagcagggatatgcatttgcacaggaagcaatcgcagattattatgcacgcaatggcgtagaagtaaaagctacagatatctttatttcagatggcgcaaagagtgatacaggaaatattacagagctttttgcaaaggataacgtggttctcgttccggatccggtttaccctgtttatgtagatacaaatacaatggatggaaagaatattatctatatgaacggaacaaaagaaaacgatttccttccaatgccggatgaaaatgtaaaggcagatatcatttacctgtgttctccgaacaacccgacaggagcatgctataataaagagcagttagaggcatgggttgcctatgcactgaaaaatgatgcggtgatcctgtatgattccgcatacgaagcatttatcacagatcctacacttccaagaagcatctatgcgattgagggcgcaaagaaatgtgcgatcgagttctgttccctttctaagacagcaggattcacaggtacacgtttctcctatacagttgttccggaagaacttgtgtttgagacatcaaatggcggaacattgagcctgcacaatatgtggaacagaagacagtgtacaaagttcaacggaacaccgtatatcattcagtatgccggagctaaggtattcacagaagagggcatgaaagagtgtcaggagaatatcggatattatcgtgaaaatgcgcgtatgatcgctgaaacacttgagaagaaaggaatctcatttacaggcggcgtgaactcaccatacatttggttcgagtgcccgaagggaatggagtcctgggagttctttgattatctccttgaaaatgctcaggttgttggaacaccgggagcaggattcggagaaaatggaaagaattatttccgtctgacatcctttggaaaacatgagaagacaaaagaagcaatggagcgtttcaattcattattctaagatataaagtgaacggatcacgtgcataacagaagaaagttatcatagtgatggtttacagaaggaaaaagagaagctgttcgtgcttctctttttgttgtcaggcaaagcgggaatcctgaacagcaacattttgtattacattagaaacaaatccggtgtgagtttacaagaccgtacaagtttggtatgataaagacggtatatcagatgcgagataaactctcatctgacatagcctctggcaggattgcagaggtgcgcaggagaaatatgtcctgcattcgcatgacgcgcacctcgcagcaagaatgctgaggcattcttgatatttgaaatttagaaaggatggaacgttaaaatgaaaattggtattggtaacgatcactccgcactggagctgaaagcagaaatcgtagaatttctgaaagagaaaggtcatgaggttgtagattatggaacatatacaacagacagctgtgactatccggtgtatggagagaaagtggcccgtgcagttgtagcaggagaagtagagaaggggattttgatctgcggaacaggacttggaatctctctcgcagcgaataaagtaaaaggaattcgcgcatgtgtctgcagcgagccatttacagcgaagatgtcaagagcacataatgactgtaatatacttgcatttggagctcgtgtagtaggtggagaacttgcaaagatgatcgttgatacatggatcaatacagaattcgaaggcggccgtcatcagcgtagagtagatctgctgatggagatcgaggagagaaactaaaagatttcaagaaagagacttctgcgttacattttatcagagcgcggaagtcttttaaaaaaggggaagaaaaatgcaggaatacgatttatcacaatgggttttattcttttttctctacagttttctgggatggatctgggaaagctgttatgtttctgtcagaaagcaccgttgggtgaaccgtggatttatgcatggtccgatgcttccgctctatggttccggagcaatggttgttctgatcgtgacgattccggtcagagataacatcctgcttgtctttctcatgggaatgatcggtgcgacaatcctggagtattttacaggaattacgatggagcgtctgttccacgtaaggtactgggattatagaaacctgaaatttaatgtcagaggatacatttgtccactggcaagcttgtgctggggagcattctccattcttatggtaaaggtcgtacatattccatttgaacatatggtattgttgattccggttacaatagccgatatccttgcatttgttctgacaatcgcagcagcagttgacttcacacagtccttcaacgaggctatggatatgaaacgtatccttgtacagcttgaagccagcaaagaacagatccagaagatgcaggagcgcctgaaagatgcttctgaggaaatgcaggacagactgaaagatgcatcagaaggtgttcaggaacggctgaaacgtgcatctgaaggggtacaggagaggcttgaggacagctatctgttgtatgaagagcgtaaagagatgaaagcagcggagaagcagacaagaaaagaattgtatcttgcgaagatagaagaacagcgtagagaacgaaaagaacagcttacacagctttcagagaaggttgaggcactgcttcgtactgttcgactggagaatgaagcacaagagtctgaatcgaaaggaaactggagaaaagaacttgcccagatgcgttccaatatattaagtgagagaaagaaattaggctcacgtacagacagaaattatgtaaatgctatgagacagctgagaagaaaccctacagcagtatcagacaagttcaagaatgcgatggaagaattaaagaaaaatgccgaggtgaaataaatgacaaagaaacagcgtgcgcttgaagtgattgaaagactgaagaaagagtatccggatgcaggatgcacgcttgattatgatcaggcatggaaattgctggtcagtgtaaggctggcagcacagtgtacagatgcaagagtaaatgtagtcgtggaaggtctttatgagaaatatccgacagtggaagcactggcagatgcgccggtggaagacattgaagagattgtacgtccttgtggacttggaaagagtaaggcaagagatatcagtgcctgcatgaaaatgcttcgtgatgaatacggtggaaaagttccggatgattttgatgccttattaaagcttccgggagtcggaagaaagagcgcgaatctgatcatgggagatgtgtttggaaagccggcaattgtgacagatacacactgtatccgcctgacaaaccggatcggtctggtagatggaattaaagagccgaagaaggtggagatggcattgtggaagattatcccgccagaagaaggaagtgacctttgccatcgtcttgtttatcatggaagagagatatgtactgcaagaacgaaaccatattgcgacagatgctgtcttgctgatgtctgcaaaaaggtcggagtatagtaaaaagatcagggtataacagtcaaaataaaaagtctgtgaaaagaatcttaagagtagatagattctttcacagactttctttctatcagtctaagctaactcaatagcacctgttccgccggcacaagcatagtaagctttcttatcctcaggttttacatagatcttaaggtcggagctgtccataccttcagcgttgcatttatcaagaatcttctctgcaagtacagcagcgtcatattcgccgttctgatactggatgaaaagatcatatgccggagcagcatttactggtgcagttgtttctgttacagtcacttccggaacaggttcagctgttggtgcagctgtctctactacaggctgagcagctggtgctgtggtagtcggatgtacctcattaaatcttttctgtcttttcttatctgttctcttgctcatggatgttacctcttttctctaatctgaaaaccgaagtccgggatgtctgtccttgctggttgaaataatttagtaaaaagggggacatcggtcacttttcctattatataacgaagtggaaaataagtcaaaaaagttgtattttttatcagattcgtatattatgatgtaagtgtcaaaagtataaattgcgtttgtgcttgcacaaataagcaatttatacttattgacacgccgaacaccgaaaacggaataaaatggtgtgaatacgccattttatgggagtttgaggtgttcgaggattgcgggaattgcatagcaatggagcaatccgtaggtatcataataaaaataaggtaaaagtcgtcagggcagaaaggaaagttaatatgaatttttcacagcttggaaagatacaggaattaaaaggacatatggatacattccgcagaaatcatccgaagtttccaatgttcttaggagcagtagctcagaatgcagttgaggaaggcacaatcatcgagatcaatgtgacagcaccgaacggagctcattacgagacaaatctgaagcttcgtgcagaagatctggaatttatccgtgcactgcaggagatgggaaaataaaaaatataagaaaatttaaaaaagtacttgcatatttaaaaagagtatgataagatactaatcgtgtcagagataagacacgaaatgcgggtgtagttcaatggtagaacaccagccttccaagctggatacgtgggttcaggcgatttaaaatggcgagatgcgttgctggtcgcacatcgtgtgaacagtaactgcagatagttaataggaggaattatttatgtgtggaatcgtaggatttacaggaaaccatcaggcagctccgattctgttggacggattgtctaagctggaatacagaggatatgattcagcaggtcttgcagtgcgtgacggagagcatcttgcacaggttgttaaggcgaagggacgtctgagtaatctttcagagaagacagacagtggtaaggcactcaagggaacttgcggtatcggtcatacacgttgggcgactcacggtgagccaagtcagatcaatgcacatccgcatgtatccggaaactgtgagagaagtggatccggtacagttgagtctgaggttgtcggagtacataacggtattattgaaaactatacagagttgaaagaaaagctgttaaagcatggttatacattctacagtgatacagatacagaagtagtgatcaaactggttgactactattataagaaatataacttaggaccgatcgatgcgattgccaagactatggttcgtgtacgtggttcttatgcacttgagctgatgttcaaggattatccgggagagatctgggttgccagaaaagacagcccgatgatcatcggtattgcagatggcgagacttatgttgcatctgatgtaccggcaatcctgaaatacacaagaaatgtatactatatcggaaaccttgagtttgcaaagcttgttccgggagaggctcatttctatgatcttaatggtgacgagatcgagaaagagacaacagagatcaaatgggatgcagaggcagcagagaaggccggtttcgagcatttcatgatgaaagagatctatgagcagccgaaagcaatccgtgatactctgaattctgttgtgaaagacggagtgatcgactttacggatattgatattacagaggaagagattaagaaatacagccagatttatattgttgcgtgtgggtctgcatggcatgtaggagttgaggctcagtatgtgatcgaggagctggctcagattccggttcgagtagagcttgcatctgagttccgttaccgtgagatgccgcttgtgaaggatggtctggttatcgtgatcagccagtccggagagaccgcagatacattggcagctatgcgtatggcgaaagataaaggacttgctacacttgcagttgtaaatgtaatcggaagcagtattgctcgtgaggcagataaggtgttctatacactggcaggaccggagatttcggttgctacaacaaagggatacagcgcacagcttgtagctcttgattgtattgcagttcagtttgcaaaagtgaaagggctgatcacagacgagcagtacagctattacatttccgagcttcagacaattccggagaagattgagaagattcttcaggataaggagagaatccagtggttcgcagccaaatatgcgaatgcgcatgacgtcttctttgtaggtcgtggagtggactatgcagtatgtctggaaggaagtctgaaactgaaagagatttcttatattcattctgaggcttatgcggcaggtgagttaaagcatggaacaatcagtctgatcgaggacaatattctcgtaatcggagttctgacacagagcaagctgtatgagaagacagtcagcaatatgatggaatgtaagagccgtggcgcatatctgatgggtgtgacaaactatggcaattatgagatggaagacaaggtagactttacagtctatgttccgaaggtggatgagcactttatgggaagtctcgcagtgattccgctgcagctgctcggatattatgtaagtgttgcaaagggacttgatgtagataagccgagaaaccttgcaaagagtgtaacagtagaataagaatatgatgaatcaggcaggtcgggaaaatgaatccgtcctgcctgattttggaaagagccagaaacagcaccgcatcttcccactgttctggctcttgttttatataggaattattatctaggcatatcccaatttgtatgatctgtatgaagcagcatatgtgatttgtgtgacaatggtttctcaaggaaatcgttgtacaatttcataacatcctggttctcatgggagaaacggatctttgcgttcttgtcaaggaagtagaggtttgcaccgcgtgtgtgtgcaagttcttcgccgtcgtggatcggctggccgcctccgccgacgcatccgcccggacaggccataacttccacaaagtcgtagtgtacttcaccatgttcaattgcttcaagcaatttgcgtacatttccaagaccactgacaacagcagcgcggatcgtagcatcaccgatctggacttcagcttctacaacacccgtctcaaaggatggactgcggacaatcttaaatgcatccggatccgggttacgtcctgttacaagatagtgtgcggaacgaagtgcagcttccataacaccgccggtagcaccgaagataacaccggcaccggaccactctttcataagcggatcacattcgcggtctttcaggctctttggatcaatatgcgcagcacggatcattcttgtcagctctcttgtagtgagaactgtgtcaatgtcatgtccggcatactcgccgtagaaaagttccatgttgcgttcaccttttttcgctacgcaaggcatgacagatacggtgtaaatgtcttccggagcgacaccgatggattgtgcaaaataagtcttcataacagcaccgaacatctgctgtggtgacttggctgtggacagctgtggcaccagatgcgggtactgtgatttgatgaaacggatccagccagggcagcaggaagtgaacatcggacgcagctttaattctcctttggtgaagcgctgcaggaattcatttccttcttccatgatcgtaaggtcagcagagaaagaagtatcgaagacgtaatctacgccgatctttttcaaggcgtccatgatctttccgattgttgcttcttctctggacaggccgagagcttctccccacgcggcacggactgccggagcaacctgtgcaaccaccactttcttcttgtcggcaatcgcactccatacatcttctgtatcatcacgctcacgaagtgcgccgacaggacaatgagtgatacactgtccgcagagagaacaggagacttcattgatctttttatttccgtttacattgatcgttgttcttgaacctgtacttgtaacatcccagatgttcagtccctggatcttatcacaaatctggatacaacgcatacatttgatacatttgcgtgaatcacggataagtgggaatgtcttgtcccaaggcgtatcttcaaaacgttctttgaacggaagatcgatcaggttcaggtcatttgcaacttgctgaagtgtacagtttccgcttctgacgcaggttgcacatttgcagtcgtgctgggaaaggataagctgtacagtctgtcttcttgcaatgcgtaccttcgggctgttcgtgtagatcaccatgccttcggttacgacgttattacaggatgtgaccagacggtcttttccttcaatctcaacaacgcagacacggcaggccgcaatctcgttgatatctttcaaataacataatttcggaatcggagttccaagctttgccgcagcttccatgatagtagttccggaaggtacggatattttctgattatcaattgtaacatttaccatttttctttccgcccccctttgaaaataccataaccgaaatgatcgcagcgcaggcatctgtgggattcctgttttgcttcggcttctgtcatacagttttcaacgccttcaaagtcacagacacggctgcatgcttcgcgttctgtcagttcaactcttccgcaaggttcgcggtcgcttaagcgaggttccggaatctcaacatcacagctgatgatatggtggaaaccaagatattcatcgatattggcagcaacaacctttgcagcggcaattgccttgattacggaagcaggaccggatgcacagtctccaccggcgaatacgccagggatattgtcgaaaccgccataacgctctgtcatgatcttaccgcgggaaaccggaacaccggcttctgcgaaatgttcggattcgatatcctgaccgattgcaacgatgagtgtctggcaagggataaggaaatcttcttcacctgtcggacagacacttgcacgaccgtccttgatcttgctgatcatctgtggtgtgacgtagatacctgaaacgtgtccgttctcatcagtctcgattctggatggtgctttcagtgtgagtacttcaattccctctgcaactgcaccttcgatctcagccggaagagcagtcatatctgcagtacggcgtctgtaaacgatacttacttttttcgcaccgagacgttttgctgtgcggacggcgtccatggaaacgttaccgccaccgatgacagcaacttcctgtccggtaagatcagggctcttgtcttctccaacatcacgaaggaaggacacagcagagatcacgccttctgcatgttcgccttcgataccaagcttcttatcagtgcttgcaccgatggaaataagaacagcatcatattcctggcggagactctgaattgtgatatctttaccaatacgttttccaaattctacctgaactcctgtctcaaggattgcctgaatgtcttcgtcaagacgatctttcggaagtctgtagttcgggattccatagcggagcattccgccgagctttggaagcatctcgaatacggttgtctgatgtcccatcaactgcaggtagtaagcagcactgagtccaccaggtccaccgcctacgacagcgatacgctttccggtggaaggtgcgcattccggtggcggaaccttgcctgcataatcagcggccatacgtttcagtccacggatattgatggcatcatctacgatatttctacggcagcgggcttcacaaggatgctcacaaataaaaccgcaggttgtcgggaacggattatccttacggatcagacggattgcgtcagcgtaacggccctctccggtcagtgcgatatatccagggatatcaacatgtgcaggacagagagaaacgcaaggtacaggctgtgtatagtggcaggtacagcgtccctgacggacatgttcttcataatcttcgcgacagtctcttaagctcttatgtaccatggcaccggcttcatatccgatcggacagtcagatccttcgcggatggattcagacaatgtgtcaatcagatcaagtgtctccattgtagcagtaccgttcataacatctgtcagaaggttcttcaactgccacagcccaacgcggcacggggtacattttccacaggattgtgtctgacacatctcgatgaatgcacgagtcatgtcaaccggacataatcccggagggctggattcaattctgcgttccagatctttgtacagctcttcaacgacgagctggcctttgtctggacctgggatttcaagtctactcattttaaacctctccttttaccataacgttcattactgactggttttaaaataggaaatgtatttgaaaaaacctatcttcaaaccagtaaagtttcatttagtaatattctacaaataaatctaaaaattatcaagaaaagtttaaaaaatgacaagcttgttatatattatacaaacaacaagcttgtcaaaaataaacaaaaatattctaaaaaatattgagaaacagctaaaaaaattaattcatatagcggtagcaacgaaaatgataacagagcgttcacctaaaaatattttagattctaccgtaggcattgaatttttgtgaaaaaactgacatttaggatcgccggtgttgaccgcaactttccatttgtaatgttcaggaagttccggcagagtgagtgtgaccggaaaccatccggaatttacagccagataaacaagatcttcttcttgtattgcttcatcataacctgcgaatcgtacacagacaacatggctgttaccggagaaatttgtctcatccggagtgagcccatgcgtgctcattgccggaacaccaagataacttggttcgagatccttacggatgacaggatgatctttgcggaaccggatcatatattgaaagaaatcgaacagatccttattttttttgaggagactccagtccagccaggagatcaggttatcctggcaataagggttattatttccataacgtgtgtctgcgaattcatcaccggagaggaacattggagttccgcggctgcaaagcagaacggcacaggcatttttcatcagttgtttacgaagtgccagaatggcaggatcatctgtttcgccttctacgccacagttccagctgttattgtcgtcagctccgtcagtgttcccccaaccgttggcctcattatgcttctgattataactgtacagatcatgaagcgtgaatccgtcatgacaggtgagaaagttgatggaagcatttccacctcggtaagcaggatcgtacagatcaggagaacctgtgattcttgctgcagcagtccgggcaaggaagtcatctccttttaaaaagcggcgcatatcatcacggtagcgcccattccattcagcccagcgcttccaggaagggaaagaaccgacctgataaagtccgccggcatcccatgcttcagcgatcagttttacatttccaaggatcgagtcgaatgcaaggcttcgcagaagcggtggttggcttagaggggttccgtcatcatttcgtccaagaatggaagcaagatcaaaacggaatccgtctacacggtattcgatgacccagtaacgcagacactccaaaatcatgtctcgtacaacagggtgattgcagttcagtgtatttccacatccgctgaaattataataatgtccgtccggagtcaacatatagtaaatgttgttgtcaaagcctttgaaagaaaagcacggaccgaattcatttccctcagcagtgtggttgaagacgacatcgaggatcacttctataccattgtcatggagatctttgatcagtgtcttgagttccagtccttcgcggttatattccatagaagaacagtagcttgtatttggtgcaaagaaactgaccggattatatccccagaaatcaataagttcattttcatcaatcaatcgtacatcacgcatctcatcaaattcgaagattggcattagttcaacagcattgactccaagttctttcaaataaggaatcttttcgcgcaggccttcgaatgtaccgtggtgcttaacaccggaactttcatccatggtaaatccgcggacgtgtagctcgtagatgatcaagtcttccataggaatagaatggtgacgctggtcaccccagtcaaagttggattgtaccacacgggcacgataaccatgctgggcgttatttacatgtccccactggctctgtccggtgacggcgcgcgcataaggatccagcaggattttgtttttatcaaaacggagacctttcttttcatcataaggaccatccaatcgataggcgtactcaaattcttcgatatccagatcaaagacgatcatagaatagcagaatccgatcctgtaactttccggaaatggaatcacggcgtaaggttcttcggctttgcggtgaaacagcagaagctcgcaggaggtagctccgtgtgtatgaatcgtaaaattgacaccacccgggatagcgactgcaccaaattcacggaaaaagccgggacggatctggaatccattgacggtatcgattggcttgagctgctcggatattactggcatataggaaaactcctttctaattgtattcaagttagaatgaattaagaattaacataacaattaacataagtataacacttagaaaaataaaagcataggttcagcctatcattctgtgagaaaatgtgctacaatgataccactatttatttgtagaaaagaggttatggtattatggcagaagagcagaaaacagcaggatgttcagaggaatcctgcgccagctgtgccagtgcaggaacatgcacaagtaagaaagttgatatgcatgaaccgatgaacatgtattcatctattaaaaaagtgatcggcgttgtcagtggaaagggcggcgttggtaagtcactcgtgacagcatcccttgcaagaatgatgagagcaaaaggatataatgttggtatcatggatgcagatattacaggtccatctatcccaaagatgtatggacttcatgagatggcagtaggaactgagcagggaattcttccatgtgaagcagcagatggaacaaagatcatgtctgtcaatcttcttttggaagacgaggaagcaccggttatctggaggggaccagtgatcgcaggtgttgtaaagcagttctggacagatgttatgtggggagatcttgattatctcttcgttgatatgccacctggaacaggtgatgttccgttgacagtattccagtctcttccggttgacggcgttgtgattgttacatctccgcaggatcttgtacagatgatcgtgaagaaggcatatggaatggcgaagcagatgaatattccggttcttggaattgttgagaactacagttatgtgaagtgtccggattgtggcaaagagattaaagtatttggagaaagccacattgatgagatcgcagcagatcttaacgttccggttctcggaaagatgccacttgacccggcaatcgcgcagatggttgaggaagagaagttttctgaggcagagaatccatatctggaaggattcgaactgtaaagcgagttgagtgtatgtaatgggagtcatggaagacaaggttgggggatcttgtctttcgtggcttttttacgcgagcaacgagcaaagtccgtgctcctaaaagaataacagaaaagcacaaattataaatcatacaggagaaattaacacatgataggcgaaagaatagaattatggcacaaagaagaatatcattaccctgcggcgcatggttttatcccgattatggtcagctatattcatgaggatgagctgatgcatccggcgatgctggttgttccgggaggcggttacagacttgtatcgccttcggaagcacatctggttgctatggaattttatcaggctggttataatgtgttcgtccttgaatatacagtgaatccactggatgaagcaccattaaagcttcagccgctgaaagatatttccagagcaatgcgaatcatccgttttcgttcggagcagttacatattttgtcagatcagatcgtggtttgtggattttcagccggaggacatctgtgtgcgagtctgtgtgtgcatggagcggatatcgaggatccggatgaaaaatatcagaagttttcaaacaaaccggatgctgctgtgctgtcttatccggtaatcactacaggaaagtacacacataaagattcttttgtagcattatatggaaagaatcctacaagaaaagagctagaatatatgtcaattgaaaagcatgtaacaaaagaaatgccaccatgctttatctggcagacagcaacggatggaacagttccggtgcagaatagttatcttttagcacagaaatgtctggaagaaggagttccatttgcgcaccatgtattttcagaaggcgtacatggaatgtctgttgcaacagaggactggctggaacgcagagggagagaaccttatacacaggagcaactccgtatgctggcagaagcaatccttgcgggagaaacttcatttccaaaggaaatgggagaagaactgcttgtgaaaaatggaattggaagaacacagccaccgaaatggacagcagagcagaaagaagaaatccgaaagactctgaaagaagtacagatctggcccaaactggcagaggaatggctggagaaaataattgattacaaaggagaagcaagatgagaattctattgatccgtcacggagatccggattatgtaaatgacacattaacagaaaaaggaagacgtgaagcggcactgcttgcaaaacgtgcagtatctatgaatatgggggaatgctataagtctccacttggaagagcgaaggatacggcgactccatgtcttgaggtaactggaaaaacagcagaaatattggattggctgcaagagttcccggcgcaggttgatttgaataaaaatccggaacttgaaaaagcatatcccgatgtgaaaaaagaaggtgagcatttcctgcctagaattgcatgggatatggttccggggtattggacagaacatgaagcttatatggataaaaatgcatggcgtgaaacagaagtggcgaaaaattctgatcttgtagaagtatacgatcatgtgattgaagaatttgatcgctttctcgcagagcatggatatgtaagagaaggggcgcattatcgtgtggagaaagaaagtgatgagacagtgacatttttctgccatttcggaatcagctgcgtgctgttgtcccatttatggaatgtatcaccattcgtgctttggcattgccttgcgcttgcaccgacttctgtgacagaagtggtaacagaagagagagaacagggaacggcatatttccgaggattgaaagtaggagatatctcacatctctatgcaggtggagaagaaccgtccttcgcagcaagattctgtgagacatatagcaacaaggagcagagacattaaaatcaaatgtctctgctccttgctttatggattttggtattattaaaccactttctgataagcaattcgttctgttccatcctcaacatatacgattccgcaatatttgaatccattcttatctaacagatgctgcattacgatattgtcccggtgtgtatcaatacggatattgccgcattgttccgaagcccagttcaggcagaaggaagcagcaccttttacatttccggtggaagtgatgcggtgaacaactccgtaacgggagtcgttgatccattcaccttcgtagatgcgcatgtaagtcggatcagccccttctttataatagaaagtagcaactatctggtccttttctgtgcagacataactgttcccctcagtgatgtcatccagaattaactgtggagaaggataattgttttcccattgagaagcatttccgtgagttgccatgaatctgcgtgcatgttcgtacatcttaagaagtacttcaagctcttctggttttgtctttctgatttccataatattcctctttcataaactaaatatagatacgctaatgcactattatatcaaaaaacagaacgtaactccattgacaaaaatatagagaaaacatgaaacgaaatcgttatcatagaggaaaagtacctagagtgaattttgaaagaaaaagaggctgtttatttgtctgtaaatcagaccgtacacatggggaaaatgttctttttacagtacatttttactgtattaaagttcgtacaattccccgtaaaatgggcgttttttcgtatattttgtactaaatcgaatacaaagcgatttccgatatttattctcgattttacgcttgtcatttatttaacacggtgttatactatgcccgtaaaacaattacaaaactattttaggaaagaatataggaggatttttcaatggctaattttgagcagtgggctggcttcaagggaagaaaatggacacactctgtagacgtgcgtgatttcatccaggagaactacacaccatatgaaggtgatgagtcattccttgagggaccaacagaagcaacagacaaattatggggaagactgcaggaacttcagaaagaagaaagagctaagggcggagttcttgacatggagacagaggttgtttccggtctgacagcatacggcccgggatatatcgatgagagcatgaaagaccttgagcagattgttggtttgcagacagacaagccgctgaagagagcattcatgccttatggtggaatcaagatggcagagcaggcttgtacaacatacggataccagccaagcgagaaactgcatgagatcttcacaaaatatcataaaacacacaaccagggagtattcgacatctacacaccagagatgaagaaagctcgtcataacaagattattacaggacttccggatacatacggacgtggacgtatcgtaggtgactaccgtcgtgttgcactgtatggtatcgacttcctgatcgagagaaaacagtatgacttcgagcgttatgcaagacacggcatgaagggtgaggatttccgtcttcgtgaagagcttgcagatcagatcaaagctctgaaagagatgaaagagatggctgcagcttacggatttgatatttcacagccggctaaggatgctcatgaagcagctcagtggctgtacttcggatatcttgcagcaatcaagactcagaatggtgcagctatgtctgtaggacgtatctctacattccttgatatctatatcgagagagacctgaaggctggaaagatcacagagaaggaagctcaggagatcatcgaccacatggtaatgaaattccgtatggttaagttcgcaagaatcccatcttacaaccagctgttctcaggagacccgacatgggcaacacttgaggttggtggacttggacaggacggacgttctatggtaacaaagaacgactatcgtttcctccacacactgaacaacatgggaccttcaccagagccgaacctgacagttctttattcttcaagactgccagagaacttcaagaagttcgcttccctgatttctgtaacaacaagttctatccagtatgagaacgatgatgttatgcgtccggtatggggcgatgactacagcatctgctgctgtgtatctgctacagagacaggtaaagagatgcagttcttcggagctcgtgcaaaccttgctaagtgtcttctttacgctatcaacggtggtatcgatgagaagaacaaagtacaggtaggaccggcttaccagccaattacttccgagtaccttgattacgatgaagtaatggagaaatatgaccagatgatggagtggctgtccaagctgtatgttgatacactgaacatgatccactacatgcatgataaatactactatgaggcagctcagatgtccctgatcgacacagacgttaaacgttctttcgcaacaggtattgctggattctcacatgtagttgactccctgagcgctatcaaatacgctaaggttaaagttgtccgtgacgaagatggacttgctacagacttcgagatcgagggagacttcccgaaatatggtaacgatgatgaccgtgcagacgagatcgctgtatggctgctgaagaaattcatgcacaaactgaacaagtgtcacacatacagacattctgtaccgacaacatctatccttacaattacatctaacgttgtatatggtaaggctacaggatctcttccggacggaagaaaggctggagagccactttcaccaggagctaacccgtcttacggcgcagagcagagcggacttcttgcttctcttaactctgttgctaagcttccttacgagcttgcacttgacggaatctctaatacacagacaatcaacccaggtgcacttggacatacagatgaagagcgtaaagagaaccttgctcacgtactggatggatacttcgatcagggagcacatcacctgaacgtaaacgtattcggtgttgagaagctgaaagatgctatggagcacccagagaaacctgagtacgctaacttcacaatccgtgtatcaggatacgctgttaagtttatcgaccttactcgtgagcagcagcttgacgttatcgcaagaacttgccatgaccacatgtaaataatgttgcgatttgcggataaaagatcataaataacagataatatatcaggacgcagtcatttcaccatgctgcgtcctttttcataagacctgcaattataaagaaatgtcagaagacaaatctgaaggttgcagaagaatggcaggaaactgccggaaaaagaaggagaaatatatgtcagaagtaaaaggatacattcactcaacagaaagcttcggttccgttgacggacctggcgtacgctttatcatttttgtaagcggatgtccaatgcgctgccagttctgccacaacccggacacatggaagatgcaggacggcgaactgaagacaacagacgaactgctcaagacagcacttcgttataaaagctactggaaagataaaggcggtatcacagtcagcggtggagagccactgatgcagatggatttcctgatcgatctgttcaagaaagcaaaagaacagggtgttcataccaatattgatacaagcggagctgtatttacaaaggaagaaccattctttggtaaactgcaggagctgctgaaatacacagatatgctgatgcttgacattaaacatattgatgatgagcagcataagattctcacgggacagagcaacaagaatattcttgagtttgcacgttacctgtctgatatcaagaaaccaatctggatccgtcacgtactcgttccggagcgcagtgacaaggatgagtacctggagagactccatgatttcatcgagacactggataatgtagagcgtgttgaagttcttccatatcatacacttggtgcatataagtggaaagaacttggatatgattacaagttagagggaatcgatcctccgacacaggagagaattgagaatgcaaaccgtattcttgagacagcgaaatatttaaaataaggtaaaaaaagaactctgttatgagatgtatgaatcaatacattcgtaacagggttcttcttttataaatactttacttaaaattttctcagaaagaagaaggtcacgacacacacgattgcctcggtaacaggaaggcagagccagatacctgtcattcccaaaagtgcggcaagcaggaacgcaatcggcagaatcagtacaagtccacgcaggatggaaatgatgaatcccggtaccggctgatcagaagcacttaaataagtcgctgacaccatattgatgcctgaaaagaacaggcttacaaagtaaatgcgcattccttctgctgccattgaagtaagcggcggattcttgtctttattaaataagtcagcaatcggaactgcaaagacaaacacaactagataggcgatgaaagccataagtaatgcagtgcttaatgcatagcgtcttacctggtggcgtacaggggctccatttttaccaggatggctgctgacaatcggctggatgccctgcccgattccggtaaagatcgccacaagtacgagtgcgatattagcaaggatactgtatgccgcaagtccggtcgttccgctgaatttcagagtcagcatgttaaagacaagaattacgatgccggaagataattcagcgacaagagaagaaactccaagccggcagatatctatagcagttttcagatgtatccttgtttttaccagatgaaactgattcttctttttccagaaatgcatggacagaatactcattccaaccagtggagcggttgcagtagccagtgcagctccggtcatgccaagctgcataggatagatgaaaatgtaatccagcacaatatttgtcagacttccaacgagcattgcagtcattgaaagtcgcggttctccatcatttctgacaaaacagttcaacagattgttgcacaaaaacagcggagagaacatgagcaggatgcggatgtatggaatcgcatgcggcaatgtagttccgtcggctccgagtaagacacaaagaggtcttgcaaaaaacagtccgatgctgaaaaagaacagcatagctacaaatgcaagctgaagtgcctgggtgaagatcgtgcggtgaatctcactgtcagctctgccggaggaaagcgagtatcgcgcagcagcacccataccgatcatcagccccgttccgtttaacaagctgaaagcaggaagaaccagattaagcgcggcaatcgcatccgagccgattccccgggcaacaaaaaacgtatcggcaaggatataacaagaatatccgatcatgccgagtacatttgctgagacatatttaacaaagagtggaaatacatgttcccgggcagttaaagtaactgagttggatgacataataaaaaattcctttctgtattttcagaatgcgtataataccatagaattttgagaaaatcaaatctttctttcttatgaaaatagaggtaaaataaaaatgttatgtctacggtatttacaatccccgaaaagatggtttattcattataacatagaacgaagaaaggaaacatatatgaataaaaaagaagtacttgagatccgtaagcagttctcaccgaaaaactgtgcgattacgaaaatctgtggctgctatgtggattatgagaagaataaaaagatggagtcaaaagacgcatttctcgcacttccggaggaagaagcatttaagtattttgatatttttaagaagacactttccggaagtatcggaaagaatatgctgaatatggagttcccactggatgcagagatgccgggcggaacgcaggaatttctgttgaagcttcgtgacagccgtctcgaagacgatatgcttctggaagaattctatgacaaagtgattgcaacatatgagtatgcggagaattattatattattttgatccatgcagcatacgatgttccgggaagaacatccgatgatcttgagatggatgatgcttccgatgaagtatatcagcatatcctgatgagtatctgtccggtcagtctgtcaaaggcaggacttagctataacgcagaagagaattgtattcaggacagaatccgtgactggatcgttgacaagccggacaaaggattcctcttcccggcattcaacgacagaagtactgatcttcacagtgtgctttattacacgaagaaatcagaagatcttcagccggagatgatcgaccagcttcttggtgcgaagatgccgatgtctgcggacacacagaaagagacattccagatgattattgaagatacattgggagaagatggtgattacgagactgtccgtaacattcacgagacattgaatgatatgatcgaagaacacaaagaagaaccggatccgctgacattggataaaacggacgtgaagaagattttcgagcagagcggtgtgccgaatgagaagatggagaactttgagaagaacttcgaagaaaatgcaggtgagaaagcaacgcttctggcaagcaatatcgcagagacaagaaagttcaatatcgagacaccggatgttgtgattaaagtaaatccggacagaatggatcttgtagagacaagaataatcgacggaagacagtgccttgtgattcctgtggatgaccatattgaggtcaatgggatcaatgtcagaacgatgaaggtaaaaggcgttgcaggaccgaaagcaggtggttctggtgaagctgtggaaaatgcagaggatgatgttgttccgtttgatgaagattaattgacggggaatgaaatagagaaaacgtacaaagaggattcctgcctgaaaatatttccttttctttaaaatgaaatattttcaggagggaatcctctttacaatcttctttgaataaaaacaggtagaagaatagtaacattagatgattgtatactgcatcagttcatagtgcagtttacaaccttctacaatctcagccgggagcagtgctctggctacgagttttaactcttcatccggaagatcaactcttcttaagtgtgcataatctccatcaatctgttctacgatataatcacatactaacattttaaaatctccttttttccagcatttcttcaatctttgcctgcatctcttctacagtgtgttttcttgtgcgtgcacattcctgcgcctgacagccgcagatgatacatttgcggtaagaagggcgggaaagtttctgtccgtctgtgtcaatcacatccatatcaaagagacgtccaatcggatgtgtttcttcaatctcagttgtgatatctttgattttttctgccggacagtcaattgaaagtaataattcatctccggttttttcatgaatttccagaaaatttttgatctcagcggaagattgttccaaccgggttaaaagtgcggtctttccgctttcaaaagcagcacggatctgctcatttgtctttaccggtcctgggatgttcatgcagaatgaaatgacaggacagtgatactggctgagaaaagtgtcctgaatctgtgcccggcgttcccggcagaggagcatgtcggttaagattacctgttctccttgcattttgaaatcctccttaatgatgtactacattttgtgctgctttgatcttttcaatcacaggtgcagcttcttcactctggaaataacgaagggttgtttccgggacgcgtgtctttaacagctccattttaccacttttgagggcggttcgtacagtagaagcgctgatgacagaaccatttgcttcttttctaggaataatcttgcatgcaatctgattttccggcagtttttttgccatgatttcattataaataccggtgacctgactgttcggttcttctccaacataacggtaattaataccgagagtctgcgcaatccggacaaagatggtcagatccagattggcgtggctttccataacggcatctgcgtccttctggaaataacttggaaaagtggcgttgctgatgatatacggaccactctcatggtaaatgatgttttttaggtgggcagtaccttccagaaccagtttctttcgtacggagaaaggaacaagactctggtcttcactgacgatgaacagatgcaggatgtcattctcggaagctgctttttcaacaagatattgatggccaagggtaaagggattcgcattcatgaccagtgcggcgattttggtttttgctgaatcgttgcagctgaactgccggaacacctcagactgttccgtttctttcttaagtttttcaaggtaagaagtaaatccggtttttctgttctccataaatacaatctgaccgtcaattcgggcaatctcataaaaaccgagatcaccaaaaaacttggcggaattgcatttcgtataaagaaagaggtgtgtattcccacgctcgaactggatgctgatcagatgggtgacaatctgattcatcagcccctctccctggtgtgcattgctgactgccatgcagcggagtgtgttgccgaagcagcttccggttgcaatgatattcatttcctcatcatacatgccgcaggtgtaatccagattggcatctctgcggattccttctgcaagaagcagcttattaatctgtgtgttagcccgtctgtcagacggatagatctgtgagatcgcatattctgacatgttttttacctcccatgatttttaacaatatgaataaaagcctgtgcctgtggcagtgaggcgactgcattggtatagatcagatacgtggagcggacgaaaggctctccgtttttgaagatcagcggctggacatgcccggagaaattcttcagacacagttccggtacgattccccatccaagtccgcgctcaaccatttccatgcaggtgacaatgctgttgacaaagattccctgacgtgagggatgaatctcattttcccgcatccattgggcaatctcacgttccaggacaatatcggtggaacgtccgatataagaaagctcctttaaggactttccggcatcggaagagctgcagatcgcacagatattctctctggacagcaggatctttgactcctgccaggggtattcaccgcggacaattgcgacatctacttttccgttcatcatcatctgatagaggttacggctctggtctgtgatgatatgtgtatttacatgtggatatttctgacggtattctgcgagaacatcaggcagggtatacagcccataattgattgagatcccggcgtttagtgttccggagatataactcttgctctgatcaagattccggcgcatcatggcgagctgctcagcagcagcctgtgtccgttcgagaacttcttccccttccggtgtgaagtggatgccctggcgtgaacggagaatcagtgttgtaccaagttcttcttccagtgcattgatccgcttggaaagtgcagactgagtaatataaagaagatctgcggcacgggtaatatttttggtctgattcaaagcagagagcagttcgaaatcacgttcattcatggaaatcatctctccttccaattgaattagtaaaagttcataaaatccaacccatcaaattgtataaatgttacaataaaagattcctaaaagaagataaaaacttaaaaaatagattccatttaagaatgaaagtggaaatgaagtaaatcatcaaaataggaaaaataattgaatttataaggatattctaacattacgggggaaaaagtaaagagggaaatccattccaaaaaggaatgcaaatggatgaatattacaccttttacatttcgctgtggcgggtgtttaataaaggcagatcgagagagaaaaacgatcaggaaaaaaaggaaaagaaaaggagagatacgatggaaattcagaaaacagcaattgccggaacattggaatccagtgatgcacagattacagtagaaccagcagagaatggaattgagctgacactggacagcagtgtaatgaaccagtatggaagacagataagagaagcagtattaaatgtactggaggaacttggagtagagaacggaaaagtcactgttgttgataagggggctcttgaatgcacactgaaagcaagagtagaatgtgcggtattcagaagctgcgacatttccgagaagaacattccatggggaggtattgtaagatgattacacgtaaaaaaccagaaaaaaaccgtttgcgcagaacaatgatgtttatgaatgcccagaagccgggactgatcaaggatgcttacatctacggttcagacagtatcattctggatctggaggacgccgttgcagagaaccagaaagatgcagcccgtttttctctctatcaggctttgaaaaatattgattacggcgatacagaggttatcgtaagaatcaatggactggacacaccacactggcaggaagatatccgctgtgttgtagccggaggggcagatggaatccgtattgcaaaatgtgagagcgcagcagatgtaaaactggtagaagaacatgtgcttgctgccgagaaagaattcggtatagaagaaggaagaacacttctgatggctgctctggaaagtccgcttggaatcatgaatgcttatgaaatcgtaactgcttccgacagaatgttcggatgtgcgatctccggaggagatttccgtaagagcatgcatgtacgcatcgaaaaaggcggtatcgagatgctggttgccagaggtcagatgcttatggcagcaagagcagcaggagttcagtgctttgatacgatgttcccgaacattgatgatatggaaggattcaaagaagaagtcatccagaatcgtaagatgggattcgatggaaagagcgttgtcaacccgaaacagattgaatttgtacataagacctttgcaccgactccgaaagagatcgcatatgcagagaagttggtaagatctttcaatgagcaggcagattccggtgttggtgtctgcacagtagacggaaaaatggttgatattccattctttgaggatgcgagaagagtcattgcacttgcaaaagcgtgcggtgtttatgaaggagacctgtaacatcaataagagaaaaaaggaaaagagaatcacaaggaaggagcatatcgaaaatgattaatgcagtaaatagagaaatcttcctatctgtgtaaagaccagacaggaaaattcctgtatacgatccacggggattttagtgagatcagtgccttttccattgatgaaaagagcggaaaactgacttatattaaccgggcgagtaccggtggtgtgaatccggtacatttatcgctagacaagacgaaccgctggatctatgtggcgaatctgcagactggaactgtagcggtgattccaagacacgaggatggcagcgtcagggacgttaaaacattgtataccattgaggggaaagagccggatacctggtctcatccacatcaggtgatgcaggatcgaaccggagattatctgctggtttcctgccagggaagaaaagcaggatttggtcaggttgatgtttttagaatccatcatgagacaggagaactggaagagacctgtgtggtcagatcaagagaaattgcggagccaagacacattgcatttcatgagaataatcgctggtgttacggagtaaatgaaaaagattattcggtcactttttatgagtttgacgcgaaacagggcaaacttaccccgagacagattcttccgacgcttccggatacttataccggagacggatgggcgagtggaatcgtcttaagtccggatggaaagcatgtggtagtatcgaaccggaaacatgacagtattacaagtttttctattgatcaggagacaggaaaactgaagtatgcagactgcgtcaaaacaggaggaggacagccgcgttttattacatttgcagaccggggcaactttatccttgcggcaaacgaaacgaccgattcaatcacagaaattgcgttggatgaagaaacgggaagattaacggcaaccggaagaaagatagagacagaaagcccggtttgtgtgattttttggataagtgagtagaaattgtagagaagcagccatgaaatcaggacacatggctgcttttgtatgcctttgggctcattccggtatactttttgaagacaacagaaaagtaagcagggtcgtgaatgccgactgcttccgatatttccccggttttcaggtcagagtgctccagtagatcttttgcctttttgatccgaagatctgtaatatagctgatcacagacatgcccacttcttttttgaagacacgacttaagtaagaagcgttactgtgtacatgttccgcaatccattccagagaaaggtcttctgtcaggtgttcctggatcagagtcattgcctgtttcacaaaaatactgtatttcgtgccgtctgactccgcattttttgatgcaacagggacggatttcttctgtttcagtgtattctggacagcagcgatcagcttgtctttcgacactggttttaacagatattcagatacatgataacgcattgcagactgggcatattcaaattccgcatagccggacagaataataaccagagtatctggataattgtcataaatatatttcgacaattcaattccgtcgatcaatggcattttgacatcggtgatcacaagatctacaggatgcgcctctagctttttgatggcttcctttccattgctggccgtgtcgtatacggtgcaattgtattcttcccagggaatatagctggcaagtgctttgcggatcggtacttcgtcatcgacgatcagtaattgaaaactcatgatggattctcctttgttggtaaatgaagtggcaggtcaaatgaaattgtagttttctggttcggaatactctgaatccgcagaatgctgcgcctgccatacatcaggtacaggcgccggttcagattcttcaatccgacgtgtgggtgaagttgtccagatccgtccgaaagaacggaaacaggagtcgtgtccggtcgttgtgcggattcatcctctgtgaagtcagggattttctggaatccaactccgtcatctgctacggtaatcgataagcagtccttacggttttttacagtgatttggagaatcccgtctgtcggtttgggttccaacccgtgaacataagcattttcgacgagggactgaatgcagaaacatggaatctgataattcccgatattcggatcaatcgtttcaatgacccggatcttatcttcaaagcgcatcttctgcagatagttataaaaatgaacaaactttaattcttcttccagagaaatcgtattggaagtccggtacagtgtggaagaacgcaggatttccccaatcgcgatcaccatgttggaaatctcactgttatcggccatttctgctttccatgccagtgtgttgagcacattgaagaggaagtgcggatttagctgagattgtagcgtcttaatctcggaatctttcaacagaagtttctgctccagcagattgtcatgatacgaatgaatctggtcaagcatatcgttgatcgcagtctgcaggttgtaaaattcaatatagtcctccaaaccggaaatctttttggaatagtctccctgtgagattgcgttgatctttcggatcatgacagcaatcggccggttaatgaaacggctgattacaaaggaacagagcacactgatcagcagaatcaggaaaatgaccagaatataagagctcatgacattgtatacctgagaacgcaactgtgcttctggtgtcataaccgtcgctgtgatatccagaagatcgatcggattggtcagggtaagataattttcagaagcaagagggattgtctccagtttcttccgattcggatctgtcagggaagatttcaaggcatcaatctcaggttctgtaacatcgggagatccggagagcagagtgaaagcatcgttaaacaggaaaatcctccatccgtcggtcagatttctggtcaggctgttgctccatttttcctcgttgacagcaacaatcatcgtccccatgacatttccgcttgtcaggttgtaaattgagcggacaaaatataggttcccgtcctggttaagtgtataaagtgagagcgttggggagggagcggaaagcattttgtataccgaagtgttggcaagctgggtcagagaagaatcttcttttgcaatatggaattctttcccggaaggggtgaacacgaaaacagattccagataattcttttcccagatattgttgatgatcaggacagaggacatttgcttttctgcccagataaaatcagaaggttccgtggaagcggattccataaaatcatagatcgagttgttcgaaacaagaagccggtagatggaatcaatcgaattaatatccctggatatatcagagattgtggcgttgctttcctgaatcatcagatcctgatagtttctggtcagttcccggtaggttttgacgcagaataaaaaagcactgacggtaagtgcaacggcaattgtgatcgtaataagcagggatgtctgtgaggaaagcttcctctttttcttgaatatctgtctcattgcataaatacctcgcactttctttcttgtgatttgtctatttattataacgcgaatttgagaaaaaagtaaaaaaatttaaaaaacttataaaaataatctatgttatgtaacaaaaaaatccgtataattttaaatataaataaaagaacaaacgaaacggaggaaaaagtgatgaaaaaaagagtactgagtttatttctctgtacaacaatgctggcggggatgcttgttggatgcggaagcaagacagaggatacttcctcagacaagacggaggacggaaaggttgtattaaatgtgatcaactaccatgtcggaacagattatgcggcagattattatgagtatctgtttgacgctttccagaagacagaagaaggaaagaatgtggagttcaagtttgaagagattcctacgacagatgcttataaccagaagattaagcttctgatttcaagcggagatctgccggatatcgtattcaacggaggaaataacattacggcactggcagccgaagcaggaaaggtaacagatctgactccgtatctggatgaggatgccgagtggaaagcaatgtttgatgattcggatttggaattcaattcctatgaaggaaaagtatatggaatcccggtatctaaagaaatctcttacatttactacaacaaagatcttttcaaagaagcaggactggaagctccggatgtggcttatgagacctgggatgatttctttgcagcctgcgatacgctgaaagcgaaaggcattacaccagtaagcatggatacagcagatcttggatggctttcgaatctctggtacagcgggctgatcggaaccagcggggaggaaggaaataagtttatgaatacccagtatccgacagactacaatgttccggtagttgagaatgcgacagaggaactgcagaggatgctggagaattacacaacatcagatgcagcaggtggaaaatacgatacgatggcaacccatttctttaacggagaagtagcaatgcttccaaacggaccatggatgattccggatttcaacagcacagagaaagcaccggaaggattctatgacaaagtaggtatcatgcttcttcctggatatggaatggaaagtgttccgacacctggagacatggtcggaacagatgatccggagaagattgaggcagcagttgctttcctgaagttcgagacatccgcagagaatcagctgaaagctctggaaatggcaggattacagccggtatccagtaatatcgaagttccggacagtttaaaagaggcagatcctctgatggcagatgttctggagattcagagtcaggcaaaatatacgtatggacagaatcaggcatactggtatcagaatgtaatcgataccttctccaaccagttaccggagctggcatatggaaatattacagcagaacagttctgtcagaaacttacagaatctgcacagaaaaactaaaagaagatcagggcatgagtgctgtgctgtgagcacagcactttctttctgccaaaaaacgggctctggtgtagcaaaaactgcctgaaacagacgttgggcagcttgaaacagaaaggagttagaatgagtacaagaggaaaaaagggttggattatcgcatttactctgccgtgtgtcatattattctgtctggtttatgcaattccatttattatggtgatcacaacctcattttgtgattacacactgacacaggcaccggtatttaaaggaattggaaattttaagacgatctttgcggatccggattttgtagtatcgatcgtaaatacattgaaatgggtattgatccagtcaacgatccatgtgacatttggatttttgatggcattgatcctgagaagaaaaccaaagggatggaagttcgtaagagttgcctatgtgattccgaatattataccgactgcagcaactgcggtaatgttctcattgcttttgaatccttcctttggtgttgtgaaaatgatctacgaaaaactcggcatgaatacatcacaggtattgaatctttttggaaattccaaatacgcattcctgacagtgacggcgacgtgggtcttctattccggatttaacatgctaatctttatgggcgagatgggagcaatcagcccggatatctatgaggccgcaatgattgacggggcaacaccggggcaggcggaccgttatatcacaattccattgatgaaaaatgcgtttggaacctgtgtgattctggcgtcagttgccatggtttcccagtttgacattatttatatgacgaccaagggtggacctggaaatgccacactgaatcttccaatgtatctgtacaagatcattacactggagaataattacggcaaagcaaatgcagttggtgtggtacagatcattctgggactccttcttgtaattttaatccagcggctgtttaaccagaagaagagtttaaaggaggcatagatagagatggcagtaaatcagaaaacgaatcagacaaaacataccgtacgaaatgcaggaattggccggtcgcttgcttccaaaggaatcctgggaacatgcaaatatttgttcttgcttttgatcatcctgatttccatcggaccgatcatatgggcattcttaagttcctttaagacctatgccgagatcaatgcgtctgcgatcagtctgccaaagagctttaacctgaacaattatgcggatgcattccgttatgcaccaatccagaaatatttcctgaacagtattatcattgtcggaatcagtgttgttgtgacggtctgctttgtggcgatgtgtgcgtatattgttgcaagatataattttaaaatgaagacaattctggtattgatgatctcagcgtccctgatgcttccggcacaggcaatctcacagcctttgttctctattttcaaggcactgggaatctatgacacaaagatcggactgatcattgtctatgcagcaatgggaattccaatgtctttctttgtcatgacgagttattacaagacaattccggtggcgttggaggaatcggcatatattgacggggcaacatttttacagacttttttcaaggtagttcttccgctggcaaagccggggcttgcgacgattgccatgcttcagtttatcaatacctggaatgaattctattttgcgttgatgctgacgagtggagatacggcgagaacagtgccgattgcgctgaactattacctgggaacttttgcaaataattattcggcactatttgcggcggttatcattacagtacttccaacaattattgttttcattattctgcagaaacaggtcatggaaagtctgaccgaaggagcagtcaaaggataacttgttagtgctgttacgttcaagatcaattctataaatgaggaaaaaagatggatatcaggaaacaatcaatttatcctgtagaagtatgggatattacagaaacagaatttaagaaagagaacaattacagaaatgagacaacatttgcattgtccaacggttatattggaacacgaggaactctggaagaagcgtatgcattcgatattgatacaggactggaaggaaattttgtcaatggattttatgaaagtgaaaaaatccgttatggggaggcgaactttgggtctccgttatggagtcagtcccttctgaatttgccaaatctgaaggaaacacacgtaatccttgatggggaagaatttacgatggaacaagggaaggtagaagagtatgcgcgcatccttcatatgaaagaagcaattctggaacgaaagcttctgtggacttcgccacaaggaaaacagacgagaattcatatccgcagacttgtttcaattgccagaaaaaatattatggcaattgagtatgaggtgacaccgatgaattattccggtaggattgaatttatgtctaaactgcaggcagatgtggaaaatcatacaagaaagaccaatccgatcgtggattacggtccgtttggcagaaaactggattcggatgagcttcgggcagacggagatattctctattatgaaggaacgacacagaacagtcacttgtcggttgcctgtggaagttcgcacggaatatggaaggatggagcggaacaaaagaatctcgagtggaagtcttctgtcggagaactggaggcagaagtggtaactggaatccaggcagaaaagggagagactgtagtgctggagaaaatgatctgctatacaactagtctggatctgggaaaagaagaacggaagtcttttgtgctggcagaacttgaaagagcacaagaggatggtatgcaaaagctggaaaagtggcaaaaggaatatatggcaaaattctgggaggcagcagatgtagaaatcaaggggaatgaagcattacagcaaggacttcattttaatttgtttcacatcattcagtccgccggaagagatggaaagactggaatgggagcaaaggggctttcgggagaaggctatgaagggcactatttctgggatacggaaatgtatgtgctgccagtgcttgtctatacagaaccagaagtggcgaagcggcttctggattaccggttccgtacgttggaccaggcaagagaacgggcaagaattcttggacatgagaagggggcactttatccgtggagaacgatcaatggagaggaagcctcaacatattatccgctcggaacggcgcagtatcatattaacgcagacatttcctatgcgctgtcattgtaccttcaggtgactggggatgtggaatatctgaaagaaaaaggcgctgagatcctgatcgagacagcccgtgtgtgggcggatgtcggaagctttgcagagtgcaagggtggaaaatactgcatctgtgacgtgaccggaccggatgagtacaatgtacttgtagacaataatttctatacgaatctgatggcaagagaaaatctgagggatgcagtgggtgccgtagattatttgaaagaacatgtgccggaagtgctggagcatctgaaagagaaacttgatttttcggtagaagagactgtgctatggaaggagatcattgaaaagatgtacttcccatatgatgagaagcgtcaggtctatccaatggatgatggatttatgatgagaaagccatgggatgaatcgaaaatcccaccggaaaagagagcgtggctctatgaaaactatcatccgttatttatcatgcgacatagaatgtccaaacaggcagacgcaattctgggcatgtatctgcacagcaatctgtttagcgaagaagaaattaggagaaattatgatttctatcaggaagtaacgctgcatcattcttctctatctacgtgtatctttggaattgtggcatgtgagatcggttatcttgaggaggcttaccagtatttttcacagtcagcaagaatggatctggatgattatcataacaatttctatgcaggcattcatgcggcaaatatggcaggaacctggcaggcaattgcgaatggatttgccggactgcgttgccagaatggaagattgaaactgaatcctgtactccccaaagagtgggaagagtatcggttccgcctgaaatataaaggcagtctgctggaggtaaatgtgacaaagaaagaagcaaaggtgactcttctggaaggaacggaagcgagtcttttgttcagaggaacggaaatccgtctgaaaggagaaaaggatagttatgcagaagaaatataaggcggtcttttttgactgggatggaactgcggtattttcaagaaaagcaccggcagatgcggcggtggaggcaatgcgaccattgctgcaaagaggagtgaaactggcaattatcagtggaacaacaatagaaaatctggcagggggaaaactggcggagtattttactgcaaaagaactggagaatctttatctcggtctgggaagaggcgcgtataattacaacttccaggagggacagccttttattttcaaaaatatggttccgccgaaagaagaattgctgaccattcacagaatctgctttgaaattcatcaggaattgaaagaaaagtatgattttaacacggatatcgtattcagccgtccgaattattgtaagatcgacctgatggtggaaaatgtaagaggcgagaatctttttatgcaggagaatgagctggatgtgttgaaagaaagcctgagaacgcatgggatttcaggaggactgcagggattgatcaatcttgcagaaacaattggtgaaaaatatggaattcaggtgaaaccgacttgtgatgcaaaatatctggaagtcggaacgacaagtaagagcgataatgtagactgtattctgaaccgaatctgttctgaaaatcagattttttcggaagaatgtgtttactttggagatgagtttgtcggaatcgagccggggatctttggaagcgacagcttcatgcagacagaaaaaagcagagcgggcgatttttttgatgtgtcggaagtgagtggagaaaggccggaaggtgtgaagcagatcggaggaggcgtggaacagtttctggattttctgagaaaacaggcagatgaataagaaaagtgacagttgagaattttcctctcgtgtattataataaaaaataccgatgaaaaaggtatgtaaatctaaagtatgggggattctataatgaaaaaacaagctttttcaaaagcctgccgtttaaactgctggtaggcgtcgtagtaggaattcttgccggacttgccctgaatgcaacagacggagcagctttgacgaatgcaattctgaatgtagttgtaactttgaaatatgttctgggacaggtgatctcattctgtgttccactgatcattatcggatttatcacaccgtcgatcacaaagatggggaacaatgcatcgagattacttcttttggcagtatgtattgcttatacgtcttcagttggagcagcactgttctctactgtagccggatatgcgctgattccgcatctgtcaatcgtgacagatgtagggggactaaaagaactgccggagatggtatttgaactgtctattccgcagatcatgccggtgatgagtgcacttgtattttctattatgatcggacttgcggctacatggaataaagcaaagttgatcacggggatgctggaagaattccagaagattgtactttctatcgtatcaagaattctgattccgattcttccgctgtttatcggatttacgttttgttctctgacttataagggatccattacaaagcagcttccggttttcttaaaggtcatcattattgtaatgattggacattatatctggatggcattgctgtatacaattgcaggtgtttattccgggaaaaatccgttggatgtaatccggtattatggaccggcctatctgacggtggttggaacaatgtcatccgcagcgacgcttggtgtcgcactgcaatgtgcggataaggcaaaacctctgagaaaagatatggtacagtttggaattccgttgtttgcgaatattcatctgtgtggatccgttctgacggaagtgttcttctgcatgacgatttcccaaattctgtatggcaaactgccgtccgttcctacgatggtattgttctgtgtattgcttggcgtgtttgcgattggtgcaccgggagttccgggaggaactgttatggcttcccttggactgatcacaggagttcttctctttgatgatgcgggaactgccctgatgcttactatcttcgcacttcaggatagctttggcactacttgcaatgtcacaggtgacggagcattgactttgattctgacgggatatgcggacaggcatcacatccaggaaaattcggatgagacgaagaccgtagaattataatagaaagaaggcagaggaaaaggtcttctttccattaagaatactttaattcaggatacagaaccggaactctttcgcggaagagctccagtaacaattgaaggtgtctgttgagatactggttcttccggtagatcagacagacatctcttgtatcaggatagttttccagggaataataagtgattttatcggaaaatcgtttttgtcggatgtaaatatccggaacaaaagtagcacccagcccttgcgcagccagcgtaagggctgtttcaatgttagaacaagcgatggttgtctgtggatggaaagcgcaggcttcaaaaatccgctgactgatctgcccaaggatctgcttttctgtcaataggataaaaggaagttccagatcaggagttaagaggactgcttgcttcgaagagagattcttctgaaataatgcggtcttttgctttggaactgcaagcagaatatgttccctggcaagaagctcactgttgtaattgatcgtatccggatgtggaatatcaataatgaggtcaagttgatcttcttccaatagttccttgagcaggtaggttggttcttcaataatctgtatatcgcagttatgagacctttcgtaaaaagcagtcagaatgtccggtagaagaatcagactgcggtgtggactgatgccgagacggatcttatgtctggcatctatggaaatatcggacagctgatcagagagaatctgttgggaacgaagcgtacttattgcccagtggcagaaaagttcaccggcataagtcagcgagagcgttccatttttacgttcaaacagagcggttccaagctcctgttccagcgacttcatgctcatggagagcgaaggctgggagagatagagcttctgtgccgcttttgtaatattcttttcctgtgcaattgtcagcacatattgtaactggttccagttcataaaaaactccttagaataataatgatatcaaaaactactgattttatgttttattgtaattgaaaatttctgtgagaacaagtttacataagcaaaaactataaaatttataaaaaaacatatattttacctataactaagtgggtgataaaatggaagacgagaaaaagaaaggcggagaagaaaatgaaagagaagataaaaacaggtttagagttatttgcctttttctttaagattggatgttttacatttggtggaggatggagtatccttgcccagatggagcaggaatttgtagataaaaggaaatggcttacgaagtcagagcttctggatatggttgcagtagggcgctctgttccgggaattatgatcaccaatatcagtatgatctttggatattccgtcggtggagtctttggaggaatctgctctgttttaggaattacggcaccggcaattctgattctgtcactggtaactgtattttataataagttaaaggataacatctggtgcgcaagtgcgcttcgtggaatccggagcgcagttgttccgattattgcaagtgcagcattttcccttggaaaagaagcatttaaaacaaagatttcaatcacggcaggtggaattgcattgctcttatgtctttttacagatcttggaaatatcgagctggtaggacttggagttgtagcagttctgatctggcagacagctgtctgggtgaaggaaaaagcagtggagaataaagcaggggaggaaaaagaagaaaatgagcacgttagttgaattgtttattgcttttgttaagatcggttttaccagtttcggtggaatgtcaatggtgccactgattctggaagagatgcgagcacaccagtggatgtcaacagaggatctgacgaatgtgatcgcaattgcggagatgactccgggaccgcttggaatcaactgcgcaacgtttgccggagagagaaccgcaggtgtgattggcggaattgtggctgtagccggagtgctgatgccggcatttacattgacacttttaacggcagtctgtttcgaacgattcaaaaacagtacaatctttacacggatccttctggtgttgaaaccaatctgtattgtgttgattttaatgacgattctggagcttctgggggaaaactatgttgcggggagcaggctggatctgccagcctgtggaatcggaatactgatgatttatctgattgaaaagaagaaatggcaggtgccaaaagtgattggtctgtcggctgtgttaggtgtattgtgctatggaatcttctgaaatattaccatgttttgctaattggtgaaaggggaaaaatgttatgggattccttccactgatcattggagtattatctgtaccgctgacacttttattctgtacagattcttacttcttcggacttcttccggttctgatcagtatcggaaaccagttcggtgtaaatcctgcacacatagcaatcgcaatggttgtctgcagaaactgtgcaacattcatcagcccggtagtaccggctacattccttggagtcggacttgcaggtgttgagattaaggatcatattaaagcaagtttcttctggatctggggcgtaagtattgtatgtcttatttctggaatactgctcggagtgattcatttctaagagaataaagaataaacgtaacagtgaggttattgagcagttacgaataaacaataggaaaagacggataatctttggaaagaggttgtccgctttttcgtgtgcgccttgcggcgcacgtttctaatgggtgaaagtccctaatccaataacacattcagacaaatgaaatatagaaaatatatgtctgagattttgatgtggatttactatagcagaataaaataacaatgtcaacgtaaaaaagctatcaacgacgacattcaactccattcgttgttatcgtagttgatagcttccttatttcacttcattcttccccgactccaagtctaacgcccagaaattcctctgtaaattttctccgctgtcatcggcagttctctaatgatcactcctgtcgcattctggatcgcattgctgattgccggtgatggtgtattgattacaatctctccgatggacttcgctccgaacggtcctgtcggctcgtagctgctctcgaactctacgcggattgttccgacatcaagacgagtcgggatcttatactgcatcagggaattgctgaagttctttcccttttcgttatatacaacatcttcatacagtgccataccgattccctgtgcgattccgccttccacctgtacacgcgcaaggttcggatttataactgttccgcagtctacgactgctacataatcgatcagttcaagtacacctgtctctttgtcgatctcaacttctgccataccaaccatgaatggcggtggagataccggtgaggaaaatgcttcacttgcggaaagtggtgcgttgctgaagcacattacattatttccaatctgacttcttgaaatctgctttcctgttgccagctctgttacatattctccatcgaaatctacatcttccggcttacatccgagatattctgctccacgctcgcagattttcttacgaagggattcacaagtcttaacaacagcctgtcctgttacataagttgtactggatgcgtatgaaccacaatcgtatggagagatgtctgtatctactccgaacacaacaacttcttccggtttacattcaagacactctgctgccatctgggcaaggatcgtatcgcatcctgttcccatatcagtagctccaatgatcagactgtagaatccgtcatcatttactttgatttcaaccgcacctgtatctactgctgagattccagatccctgcatggacattgcaactccgacactgcggacttttccatttcccatatcacggtatggatacttttcatcccagttgatcatttcttttgctctggcaagacatctgtcgagtgtacagctgtttgtaacttcgccataataagccggcatcttatcgccctggcgtaccatgttcttctcacgaagcactgtcgggtccattccgagaacttctgcaagttcatttacagctgattctacagcgaactgtccctgtgttgctccgtatccacggtaagctccagctgacattacatttgtgtaaacaacgtcatatgtaaagcggaatgcctctgcctttccataaagcggaatagacttgtgaccggaaagacctacggttgtcggtccgtgctcaccaaatgctcccgtgttggaaagtgtatagagatcgattgctttaatatttccttctttatccgctcccagacgtacatgaagttccatctcatgacgcggtgaagaagcgatcaaagactcttctcttgtgtaaatgatcttcgccggttttcctgtcttccatgtgacaagtgccggataaacttcggaaactacagtctgcttcgcaccgaatcctccaccgattctcggcttgatcacacgtactttactcttcggaatatcgagtgcatgagcaaggattcttcttgcatggaacggaacctgtgtagatgaaacaacatttaatcttccgtatgcatctaaatatgtataagtacgaaaagtctccatcatcgcctgctgatttgcctttgtgtgataaacgcggtcgatcacgtgatcacattttgcaagaactgcctctacgtctccgtcttcactcaccccatgtgcacaaagatttctcttgttgtccgcgccaaccgggcaaaggcttctccagttatcttccgggtgcacaagaatcggattgtccttcgctgcacggaaatcaagaaccggttcaaggacctcatactggatcttcacaagcttcatcgctttcttaactgcttcctctgaagttcctgccacgattgcagctgcatctccaacgaaacgtactctctggtcaaggatcagacggtcatacggacttggttccggataggtctgaccagccattgtaaatctcttatccggacaatctttatatgtaagaacacattcgattccaggtacagcctcagcacgtgctgtgttaatatccttaattaatgcgtgtgcatatggacttctgatcactttaacaatcagacagtctgacggtgcaaggtcatttgtataaacactttttcctgtaacaagtgcagcagcatctttctttacaagagggcggtttacaatcttcagggattctatagcttctcctttttcctgattgctgtggacaaattccggtttctcaggaatcagattctgaactttatctattctttccattcttactcctccccgcccattttctttactgtaatgttaactgctgtatttctgacttccatatatttctggattgcacgaagctgtcccatgtatcctgtacaacggcatagatttcctgccagatattctttaatttcttctatagaagggttcttcaattcacggaacattgcgagcacgttcataatgaatccaggggaacagaatccacactgctctgcaccttcctgtgcaagaaatgagccgaattctgctgcttctttctccacaccctcaagtgttgtcacttcatgtccgtcaatgcttgctgcaagaacagaacatgacaggcgggattttccgtcgatccatactgtacacaaaccacagtttgttgtctcgcatccacattttacactcttacatccaagatcacgcagaagattcaacaggactgtatctgcagcgatctctgtacttactttctttccattcagggtaaactgtacttccatcctatttctcctccgcattatattcatctaaaattgagcgcatctctctgcgaagcagaacctccgcaaggtgctgtctgtactccgcacttccgcgcatattgcttccataagtaaattctgctgccacacgttttgcatactctgtgagctgctcgtctgtagcatctttcgggatctcccactgcttttcaagcaatgccgctttcatcggtcttgctcctaccgaaaagaaccaggactcctgacctctgtaaattcctgttacgacagaacatgtcagtactggaaaatctgtctttgtctgacgaattgattcgtaacggaattttctcttgctctttctgacgatcacggatacaagaatatccttatctgcttttctgtttacaaactcagaaagtcgaacagttcctccattatataattccacaaatgtatccagtgccagtaatgcagtcagcacatcagaaaatccgtatcttccatagatactgcctccaactgttgcctgatttctaaactgaactccaacaatatgacgaaggctttctgcaattccgtccccatagaattttctcagcccctcatgctcttccagctggcgcagtgtacacattgctccaatgcggaatacatggtctgtctcctcaatctcattcaaaccaagttccgacatatcaatgattgtcttcactcttgcatttcctaatctcatccacatcatgccgcccatgatacgactgtttcttgcctgattcagctcgtaagcctcctccagtgtcttaactttcacgtaattaccgattgttaacacagtaggtctccttcctatccacataccttttccaagaatcgcggttctcatcctcgcaattttctcttgttatcttatgtcgtttcttgcgattgtttttcaaaaaacaaacatacaagcataaaaaaagtgcaaatgaaacagctttgtcattcacacatctagcaaattaatgatatcatatatataagaaaaaagtcaaaaaatcggttatactttattataatcaatttttataaggtgtacttataacccgggtactataaataagaaagaaatccagaaaccatgttgacatcattgtaccctcggtgttattatttgcttaaacacggaaacgtagatagaggttgcatttttcataagtaaggtgacggatgtgtcaggaacagaagaactcatcggaaagggaaagatgccgaaagggtaagaatcctgagttcttgttcttgggcatgacgtgaatagcggcatgactgtcatcgcaagatggagagctatctgaattatacataatgtatattttgggacggcgcatcttgccgtttcttttatgtttatttacagtttacgcattcttgcatagatgtatattaaacagttactgctcatggctattataattatcgttcacaaggaacttatgcgcaataacctgctatgaccagtaatactttgtttcaccatgttgaaggaggataaaaagaatggcaatttttaaaggcgcaggtgtagcgatcgctactccgatgaaagagaatcttgaggtcaattatgacaaattagatgagatgttagaggagcagattgcaggcggaacagatgcgatcgtcatctgtggaacaacaggtgaatccgctactatgacagaggaagaacatgcagcaacaatccgttttgcaattgagcgtgtgaaccaccgtatcccggtcatcgccggaacaggttctaattgtacaagaacagcgatccagttgtccaaagaagctcaggaagatggagctgacggacttctgctcgttacaccatattataataaagcaacacagaacggactgattgctcattacacagctatttgtaatgaagtaaatattccggcgattctgtacaatgtaccaagccgtacaggatgtggacttcagccacagacagttgcaacacttgtgaaagatgttgagaacatcgtaggtattaaagaagcatctggaaatatcagcacagttgcacagatcatgcatctttgtgatggcaacgttgatctttactcaggaaatgatgatcaggttgtaccgcttctcgcacttggcggaatcggagttatctccgttctctccaacgtagctccggcttacgtgcatgacatgtgctacaaattcttctcaggagatatcgcaggtagccgcaagatgcagttagatgcacttccactggttgatgctctcttctgtgaagtgaacccgatcccggttaaggctgctcttaacatgatgggaaaagaagttggaactcttagagcacctctgacagagatggaagatgcacataaagaagttctgaaaaaagcaatgatggatcttggaattctgtaagagaacaaagaaaggaagaagtgattttgaggtcgcttcttccttttttataattgcctgatccggcgtttctcttggtattaacatcacatcatatcgcccgtagccgctttctctgttggactttacttcataacgatctcttaattctaacaaaagtcccagaacgaatccatgatagaaacgctccggctgactttttcctgacggatgtcttcctgtatcaaaactgttgaatgtagctagtgcaacttcattcatataagtattcatctctttcacattcccccaaagcatcgctttgataaatgcgttataatttgattcagaattagagaaccatccttgaaacatttcttgaattttctttatttttttcttgacattcatcactccataaggtatacttaacaagtcgcttgagttaagcgacaactgaataggggattggtcaaatggtatgataggggtctccaaaacctttggtgggagttcgattctctcatcccctgtattaaaaagccttagaaaccgcgtaaaatcgctgttttaaggctttttcttttttccaaaaagcaaaggtaatcaaatatggtaccaaaaagccctgcaaatccagattggtgccgcggagcgatataattgagaaagagcagtcactgtagtggtggctgcttttgctatattgaagactgcataataatgtgctatgataaaattgataaattaggatttagaagatgtgaatgagcagcatgaagaaaacaaaagaaggaattaatttaaaaaaactccttaagctgaagaatacagacagtatctttgtgattgctgggcttttgatgattttggtaatagcgtcgtacacatatattctgcaaagttcttacactaagaccgcccttgaaacagaaatcacacgtgacacagcgagtgcagatgcagtacacaaactggtgaatggaagaatcggcaaagaagattttgatcaaatcaaagatcaatctgatgaaaagaatcaattatataaggatatttcttcatatttcaatgaaatcagaacactgaattctactcgatatatttacaccgctaaaaaaaatgaagcaggaaaactcgtttatgtggtagacggtttggatccggatgcagatgatgtaagacaccctggagattatattgaagaagaaatggttccatatattgatagggctatttctggggagaatgtgtactctcatgatatcattgatacaacatggggtccgatttttacggcttgctatcctgtaagcgcaaatcatgatgggacaggagaaatcattggcgcattttgcattgaaatggatatgcaatcagcttatggaatggttgaaaagacgaatcatatttccatcatctgcggtttagtcgcaggagctgtattgcttttaatttgtctatatacctattatgtttaccagaaaagcaaggcagaagagcaaaaacaattattaatgaccgccgctgaagaagcagatgctgccaacaaagcaaaatctgcgtttttgcttagtattagccatgacatcagaacgccgatgaatgccattattggatttacaaacattgcacttcaccagaacacggtttcagatattcatgatagcttggagaaagttcaacaaagttcgaatcatcttctctctttgttgaatgacgttctggattttactcgcattgaaagtggaaaagttactatttcgcccgagccagtggacattactcaattgacagataacgtccagacgattatgaatggacttctttataatcgagatcttaagtttgaagtacatcgagaaatcccaaagaaccaatatgtccttgcggatgttgtgcgtatccgagaagttttggtgaatcttcttggcaatgctgtgaaattcacaaaggacggcggaaagattactttggatatcagcagttacccaggagcggatgagaaacatatcataactcgttatgttgttcgagataacggtattggcatgagcgaagagttccagaaaaaattattcgagccgttttcacaagaagatgatactaatgccagaacccaatataagggaaccggtcttggtatggccatcacaaaaaaatatgtggatatgatgggcggttcgattgatgttgagagcaaaaaaggtgtaggttctacattcacagtggagatcccactggagttgccagaacaggttattcaatcagaacaaaaccaacatttgcatagagatttgacgggtattcatgttcttatggctgaggataatgatctaaatgctgaacttgctacgataatgctggaagatgctggtatgaccgtaacacgcgcatcagacggaaaagaagttgtgaatttgtttaaaaatcatccacgaggcacatacgatcttattttgatggatattatgatgccaaacatggatggacaccaagcagcaaaagccattcgagccttgggtatagagcggtccgatgcagttacgattccaattatagctttgtctgcaaatgcttttatagatgatattcaggaatccctggatgcaggcatgaatgaccatatttccaagccgattaacatggaggaattaatcaatactatcactaaatacattaaacacgattaggaaaacaaagaagttaattcgaccagatttcggatgccattgttaccgtctgactgtcccatgacagaaacagccgtgtggcagcagagtgcatgatcaaaggtaagtaatcatccgtattatcaaagtaagccgcccacttgggcggctcaatttctttgttgaaagattcagatcataccttgcgaattcgcgttcctgtcttgccaacggcataccatttacatactttgcattcatgatacctgcaaccagtgatgagattgctacacttcctttgataagcggagatattttgtcgggtcttaccatagtcccgcatttcggacagctgtatacataagtagagaccttggcgactgccgcgcaaaagatgtcgaagaaatgaatggtcactttttaatgtttaacaagaagtattatctcaatcaatgcgaatccttttcttcaccgcaaaaaccaacaacaaaatgggtaaccagaacattaaccactaaaagtgctagcattattcctgcgataataagaatcggccaacgaaatgtgaaatatgacaatttattttccatataaatctttactccaaataaagctgccattcctacagtaaataacaatcccaccacacacataaaataataactgccttctccaaagagcattaatttcatttgtttatcggtcatcccgatacttttcattacatcaaactctttccgtcgtgcgtacatcccagtgaatacaacgttacaataattggtcaatcccgcaatgaataatataatacttacagcacctaagagaattcgatttcctcgcatatatgtttctttttgctgcatcaggtctgatttacagataacaaaaactcccgcttcgccggttccttcatccattgatacttctgtcatttcggatcgttttttattttcctcggagaccagctcgctgatctgtgttttcacataaggttctttttccgagtcggcagttaattccattgttaatatctttttctcagttggtatcttttgaaagcctttctcactgataaaataatataagctgccctctccatgccaggattgatgtatttccgggaaatcatcgttttgtcgatccaaataaccacatagagtaaatgtttcagattctttttgagggaattcgtcttcctgttgtttctctttattctcagaattacttagttcttttctacgaatcgcatcttctcttgaaagcaaagttttaaagtataccggttcgccaattgcttcatctgcaagtttttgctgttccggggtcagcatatgatcatgtatgatcagcacaccatttccttcttccaaagatttcaaatcaatattgagttgattatcctgaacgtatttcttaagcgacaagatttgattttcatttaaaatctgcacagtatcccaccagaatccttccaccatattgtcatttgtaagattcgaaaccccttcgtcataaggacggatgccctttctggatataactgtagttacataagctccttcgatcagattagaattctcccaatcgataccatctatcttgtgtatttttttctccaactcttgagagattggtgaaaattcatcataatcgttatcatacaacagttccacaccatctccctgcgtcagcaaaggatccacatcgatttctcttgttttatattcttccccacacccctggcttttcccaaattcgctaaactctcctgccagcaaaaaatcaggacgtttctcaagaagatgcttataatcacatccatttgtaagtacattcattagaacaaaagacaggactcccaaaaatatggaaaggcttgtaatgataaatcgtgctttatgccgtgttatatttccccatgcaatatagaacatttcttctgtttcagaacgtctgtgcactattttcccagagtgttttgtttttctggcaactgtattttcgttataagcagcactctcaatacaagacagcttcgttatttttctaataacgccttccgatgctatccacaaaattccatttacaaatacaacagaaagcaaaagaatccacggtctgaaaaaggaaagtattgtattccctcccatttcctgataaaaatggaaacctaatagttccggtattaataagactaaaatcagtgcagagatcaaacttcccaagacagaaccttttaacatgagtgacctcatttgtttccggtatatttttgtaatctgtctttctgtggctccgatcgtgtggagcagtccgagattttgaacatcttcgctcatggatatccaaaggacattgcgtacaaggaaatatattccacacaaaattcctattgttcctaatatcaccatctcatatccacctgcgaatttagaaacagcagtatattgtgctgtatcagaaacgtatatcttctgatctgcactcttcatcggcaatgtctgatataatttttcctctgttttactcctgtttaaatgatcactctgactgaaaagtaaagtataaggacccttttccagtttcaactctttaattttgtcatgtgaaatatatccgattgctaattcatttccagagtctgtataccagccacacaattcgaatttttcttttgaatgttcgaacacacctttgtatacatctaagtttatttccattccctgttccggttcagagataccaagttttttcaatgcccgctcagataatagaatttcatcctttttctgtgggtagcttccaatcacattggtatatgccgatctcaaaaaatcgttccagctttctgagtcagcccagactatatcacatatcgtttttgcattgttctccgaaacttctgtagcttcacctacaaaaatactttttccaacttgttttatataatccagttgttttaattttgcatattgttcttctgttccatcttctattctccccgaagaagcagttccattttctctgattaatcttatttcttctgcctgtatttttccaaaggagattccgaataccatggtaatagcaacaatgccaattacaatcgagcaaaatagaatcgtatttctcaccttttttgtgcctgcaaaatttttagccaggaatcggattatgtctttattgttattcggaatgttcttgtgaagcatagtaatccctcctaacaatcgttacaatctcttgtatagattttcccatcagacatacgtattactctgtctgccatctgtgcgacctcttcttgatgcgtcacgatcaatgtcgtctgatgaaatcttgcagcacaggattttagtaatcctacgacttccatacttgtaacagaatccagatttccggtcggttcatccgccaggacaattgccggtttcgtcaacaatgcccgtgctatagaaactctctgttgctgtccaccggacagtgttgatggaaaacgttctaatttatcttttaatccaagtatttctacaatctcattaaagaaatctatatcgatttccttaccgtcaagtcgcatcggaagaactatgttttcgcgtatactaagcgaaggaattaaattgtattgttggaatacaaatccgatatttcttcttctgaatattgttctttcttccttgttaagatcttttaaacttgtatttctgatccagacacctccaaaatccggaatgtcaagacctcctaacatgttcataagtgttgtctttccacatccggacgtaccaacaaccgctataaattcgccctcttccaccgttaatgacacaccatctaaggcacgcacttcatatgtatcggatgtataatatttttttagattcatggctttgattatatccatcttttctgtaaactcctttcgtaaatgctacctttaactcagccataatctattttacatggtacctcttacaaacttcttacaagctacatatgaactgtctataccggaagatttacttctataagcagccctggcttcatttgttttgctttcatcatccctttttgtaataagacaatctctctggaaaggtataaaccaattccgcatccttcctgccctcttgcctgttcacctcgataaaatctttgaaaaattttattttcttctccgtcttttattccgattccataatctcttatctgaatcttataaaacatttcggtttgtttcattgtgatattgatcgtgctgttgtttttactatatttgactgcattatcaaacacattataaaacgcctcacacatccagtttttatcatgttcgcaaatgattttctctggcaattctacttgaaaatagatatctttctcttctgcctttttctgtatttgccccaacgcatttagaatcgtttcaacaagattttctttttgagtgtgaacttgtatgattccctgctctaatcgggcagtttttataaagctctccaccaaaaacataattgttcttcacttgttcgcaagtcttttatgtattctgtattcaatgtttcttgagtttcatttaatgactcttgcagcaattctgtataattttttatattcgccagcggtgtccttagttgatgcgcaatctcagaaattaatttctgtatctcatatttacttttttcagcctctttccttcttccttccaatatttcctgcaaacggattaattgattggtcgttttagaatagattgtttctttccctatatcagaaccatctaattcattgccgtttattaaggattccgtcaatttatatattttattcatttcatttgttctcaaatgattttcaactaaatatacagtgcttcctccgagtatgaaacctattaaaagtactgtaaaaattgctacagccatgctactctcccattctatatcccattccaaatacattactgataacattcgatgaatcatttaatttctttttcaatctgctgatcataacgctaattgtgttgagatcaatgaattcactatcgattccccatatattttccattatcatctcttttgtaagaacctggttctggttcataataaaatattctaaaagctgatactctttgggtgtcaaagatatttccgtctctccaacaaaaacctgttttctatcggaatataacataacctgtccgcacataaaaatattttcatttgattttctctttagcacaacttcaatacgctttaacaatacttttattgaaaatggtttaaccacataatcatctgctcctgtatcaaacgcttttaacatatctttttcgtcatcttttgcagtcaaaaaaatagctggaatttttctatttttttgaagctcctgatatagatttattccatctccatccggtaatccaatatctacgatcaataaatctacagaactatttatatttttaattgcttcttttctcgaaccagcaagaatcgttgtataaccttgatttttcaaagatgtatccaatgcttttctcaacaaattgtcatcttctataattcctattaccatatactcctccaactatgatacctacggattgtttcgtgcaatgcactcccacaatcctggtatcatcatataatataaaaatacacatatcttcctgccaatacaagctttttacacaataatatgaagggagatgttcagaaatcgttactgttcactcccgtgtcaatcacttcgctgattgacacggaggatgtatgttttggcttgaatgcatctcgcccatcgccaaaggcgatttaaaatggcgagacaatgttactcagacagccgcagatacgatagccagtcagattgaaacgattgttcatagccatgagccagatgtggaagtttctgaaattgtacaggaatcttatataccggaaaaaaagcaggaggccaatgaatcctataacaatgaggataagaagttgacagttcgtttagcgactggtgcagcaatctatgccattggtatggcattgactgtttttgcgaaagtgccactgcctatcgagttaacttttctcattgtttcttatgttattcttggtggagatgttgtatggcaggctgtgaggaacatttcaaaggggcgtgtatttgatgaacattttttgatgagtgtttctacgattggggcttttgtcattggtgaatatccagaagcagttgctgttatgctattctatcaggtaggtgaattttttcagtcattggctgttaagcgttccagaaaatctatatcagacttaatggatatacgtccagattctgctacagtaagaagaaatggggaattgattaccatatctccagaaaatgtctccattggtgagattattattgtaaagcctggtgaaaaaattccattagacggtgtggcattggatggagattctatgctggatacgagggctttaactggagaatcggttccgagaagcgttcataaaggaaacgaagcactttccggttgtatgaatcagacgggtgttttaacgattaagacaacgaaagcatttggtgaatctactgcttcaaagattattgatcttgtggagaatgcgtccagtagaaaagcaccaacagaaaatttcattactacatttgcacgttattacactcctgttgttgtaatcttagcagctattctggcaattctgccaccgatccttcttggtggaggttggacagagtggattcgcagaggatttgttttccttgtggtatcttgcccatgtgcattggtcatttcaatcccgctgactttcttcggaggtattggtgcggcatctaaacgaggtgttcttgtaaaaggaagtaattatttagaggcgcttaataatgtcagcattattgtgttcgataaaactggaacacttacaaagggtgttttcaatgtgactgatattctgcctgcaaatggattttcaaaagaacaggttctggagtatgcggcccaggcagagagcttttctaaccatcctattgcaaaatccattctctctgcttatggaaaagaaattgaccaatcagttatctctgattacaaggaaatttccggatatggaatcagtgccatggcaggaaagaagaaagtttatgctggcaatacgaaacttatggattcagagcatgtggagtacacagcctgtgaaaaagttggtacaaaggtttatgtagcagtagatggtcaatatgccggatgcattttgataacagatgaagtaaagccggacagcaaaaaagcaatttctgatttgaaacatatcggtgtggaaaaaacagtcatgcttaccggtgatgatgaaaaaatcggaaaggctgttgcggaagaattgcagttggatgaatattatgcacagctgcttcctgaccaaaaagtggaaaaggttgagcttttagatagtaaaaagagaccgggaagcaaattagcttttgttggtgatggtatcaatgacgctcctgtccttgcccgtgcagatgttggtattgcaatgggtgggcttggttcggatgcggccattgaagcagcagatgtagttctgatgacagatgaaccgtctaagctggtggacgcgattgaagtagcaaaagcgacaaaacagattgtcatgcagaatatagtgattgctcttgggattaagagtgtgttcctgattcttggcgctcttggtattgcgggaatgtgggaagctgtatttggtgatgtaggcgttaccataattgctgttttgaacgcaatgagaattttgaaaaaataggaaatgaggtggaaatgtgaaacgaaaactgattctgttagttgttacgattgtttttcttgtaggttttggtgccattttacattcaccgccttctatgattgatgcagtcacaggagcaacaccgaagtcaaaaaaggcggctcaagcctccgcacagttggaaggctcttatgttctcggtattaatatgatgtcagatggtctcgacaacgagaacacccggaataaattaaaagaattggcactggacgattcggaaacaaatgaaacagatcttatgaaaacggacattagttttcggttatatgtatctgagacggattatccgcttgtcagttatgctaagaaactctgtgacagattgaaacaggccggtttttccgtagatctgaaagagtacagtaacacaatgatgctatcaaaagtggtaagtggaaagtatgatgtattcctggcatcggatgattttattgacgttacaatgttatcacagatggactatatgatcatggacagcgaagaaatgaggtgagcgggaatttatgagaaaatggaatacgattttgtctgttttaatgcttctcatttttatgattcatggaatcatgggaagctttatgctgaacggagttggaagtagtgcagggaaacttcttgcatggattggtgttggtattcttgttgtgcatacggtgattggtgtcatcctgacagttcagagtttacagacagcgaagcaatccggaaaaatgtatctgaaacagaacgccatattctggacgagacgagccagtgggctggcaatactgatcctgctgttcttccatattggcttgtttggaaaggtgcagaatgggacatatattttgttcccttttacaacggtaaagatggtaactcagcttttgttcgtggcggcaatctttgttcatatttttatcaatatacgcccattgctcgtatcactgggaatcattagttataaagaacgaaggagcgatatttatttgatcctttcggtgcttcttctttttatagcgggagcggttattttatattatattgggtggcaatatctatgagtaagacaattattattataggtgctggactggcaggactttcagcggctttgcaggcagcggaaaatggatgcaatgtaaaactggtttcctcccttccgtcagagcgggcacagtctgttatggcggagggcggtatcaacgcagctttgaatacaaaagatgaaaacgacagtcccgaagaacattttacagatacaataaaggcagcatgtggtctggcagatccaaatgcagtttggggaatgacacaggcagcaccggagctggtgcactggctgctaaaacttggagttaaatttaacatgagtggctatgatgatgtggatctgcgaaattttggcgggcagaaaaagaaacggactgcttttgcacagagcgataccgggaagcagatcatgacagctatgatagacgctgttcgcaggaaagaagcatctggtatggtagaacggttcagccatcattctttcctaacacttcgtctgtgtggcaatatttgttgtggctgcgtaatcagggatgaatacagtcaggagactgtggaattaccgggggatgcggttattgttgccaccggtggtatgcacggattgtttggaaatacaacgggttcgctgagcaatacaggagaagtcaccgcagaattgttccggcttggtgttcctctggcaaatggcgagatgatccagtaccatccgacaactgtgaaatgtggtggaaaacgcatgctcatcagcgaggcggccagaggggaaggtggcaggttgtttgccatgaaagatggaaaacaatggtatttcatggaggaaaaatacccggagcttggaaatctgatgccacgagatattaccgccagagagatatggaaggtcagccatgaatcagaggtatttcttgacatgacggaaatatcggaggagattatttcaaataagctatctggtctggcagacgattgtatgacctatttgcataaagatatacgaaaggaaccggtgtctgttttaccgggaattcactattttatgggaggtattctggtggatgagcagcacagaacgccgattcagaatctttacgctgccggagaatgctgtgcccaatatcatggtgccaaccgtcttggtggaaattctctgttaggagcgttatacggaggacgtgttgcggcaaaatcagcatgcgaacaggcagatgtagtagatctatcttgtgcgacacagatagattttccaccagcgtctcaaatttcagaaataaagcaattaaacaaagtgatgcaggagactatgggcgttgtcagaaatgagaatacgttgttaaatgggattcaaacggtacaagcgctgacaggaaatcttccattgcttggcatggcagttctaaagagtgctcttgcaagaaaagagagccgtggtgcacactggcgggaggattatccgaagagcaatgacaatgattaccttaaaacaacggtagccagatttgatggaaagcagatacagatttcctttgtacctgttccagaaaggcggtgattcacttggtatataaaataaaaatcaggcggcaggagagtcagaaatcagatagttattggcaggaatttgagtttgacggaagcaaaaacagctctgttgccactgttctaaaggaattgaacagtagaactcctttgaaagataactcaggaactatagttactcccatcagctgggaatgtagctgtatggtgcgaaaatgtggggcttgcgccatgctgattaacgaacgtccgaggctggcatgctctacatttctacatatgttaaaaggttctacaatcaccttggaacctttaagcaaatttccgcttgtaagagatttgatcgttgaccggtcaattctgtttgaaaatttaaaaaaactgaacctttggcttgaaagtgaagcttatatgaatccgtggacacatgaaccgagataccagtcggcacgctgtctgatgtgtggctgctgccttgaagtgtgtcctaacttctctgcaaatgggactttcgcaggcgctgttgctgcagtcaacgcatttcggattctgaatgaagaacaggaaagcactcatttgaatgagatttctgctgaatataagaagaaatattttgagggatgcgggaagtcgttatcttgtcatgatatttgtccgattggtctgcctgtggaagaactgcttgtaaggtcgaatgcagcggctgtttggggcaaataaaatggatgataaaagctataatgaatgtatgaagagggtgtcgcaaaatcatcagattagatgatagagtgatgccctcgctctatcatatgtaaaaaaatcggaaagaatcttttgaactgttgattctttccaattttttgcgtactttaataaagctaccagtttttcgcctttttatgcggtttcttttactggaaataggtggcttcctgttcgctcattctgtatttttgcatgcaacttattcaaattatatcccatacacaataaaagaatctccagtttcactttggttttcccacgaagcagaaatctttggaattcatagtcattttttagaactccgaatgctccctccacttgtatcgagcgattcatccagtataagattcccttttcgcttaaaatattttcactatctacaccaatctgcacgttatatcccggctttagctgtgcatttctcatgtgatcatctttcatgtgcataaacgtaacgtctggatctgttttacaataattattccttccctgaaaactggctgtatgccagtcataaacagtctggcgttctataaaacagcatatcttctgaatatcgtatgttctggtttctttcgatacactgaaagactgtaggtacttccggtttagcagagcgaccgcttcctgtgtttttaggcataaaaacctgctaacaaaagtcaaggctttttagcaggtttttaaataaatttttggtaccgtttcaccaaatagacgggacgtacttcatttgataaaaaactaaaaaaacagcgatttacatcaattgatgcagaaatcggtgcaagcaaaagaaaatcgcataattttcaaaacatatgggcagttccggtgcggaattgcccattttttaaattgtaaattacgattgataggttcttattttgcactgatgttaatatgcgttgcttgtagcaacggacacttttacttacgggactgatgaagtacagaaacaagagcttttgggaaggtaataagacgattatctttgatacactgacggacagacaccagtatgaagtgattgcagtctttaagacggttatttatacaaaccgctaagaagatatctgagtaatgcaggtaaaattaacattaaaaatacttttctgacaagtttgtatggtggaaagtgtactttctcggacgtataatattagtagacgaggaggtgaaacaagtgttggcagataacctgatatttcttcgtaatatcaaaggactgacgcaagaacaggtcgcagaagtgataggaatttccagacagtcctattcaaaatgggaacagggagaaacttatcctgatattgataagtgtgacaagctggcaaaatactatggcgttacgatagattcacttgttcatcaggacaataaagtcgatgatataaagattgctcctgccccgataggtaagcatttatgggggacagtcactatcggcagcaaaggtcagattgtaataccgaaagcggcaagggaaacatttgaactaaatgaaggcgacagattagttgttctcggagatgatgcagaaggcattgctcttgtaaaggcagatgtctttgaacagcgagtacaagaagcattaaaattaagtaggcaaatgacaaatgaatgaaatggaggtgcatacaatgaaatgccttgaatgtggtaaagagatgcgtgacggatacttgttttgcagtaaagatggtgcttttagctttgcaaataaagtaccgggagtatttgaaaatgcgaaaaatgcagagggctttgtgaaaatcacagagcttaaaccaagtcatagaacaagggtagctgcttcaatttgtgaagagtgcaaaacagttatatttaagtattaagcagttacaattcaataaagaaattatgagacagtcttacgaaatcaaacgtaaggctgttatttttttcgagaaaggaggaaaccgatggctgatataaaaacaagagatacaagccagatggggtgtgcgtgaaacaaggcagaattatcagaaagccaaaacgggaattgcgaatttcaagaccaagcgtgcagagaagcagcttcaaaaacaatcggtcaatcctgtcggaaaacagagcatccgaactctagaacgtacggagaaaacaattaaacagtctgcaaggtcggcaggaaatacgacagttacgtagtcggaagcagcaatatctatggatacggtattccggcatattaaaaattccagacggtgtctggaaaattgaaaagatggctgctcagttgagtagccatcgggtacattatgagaaatcggttgtttctctgttattcaggaaaatatggtgtgtgtgataagtgaagctgaaaagcatatcggcatcttcttttttgccatctaaaaaggaaatatcatcggcaaggataaacaacattgctagcagcttcttaatatatccgttgtagcaaccgtaatcaagatagatgtgtgctacataaccttcgctaaattcttctaaatttacatcaattttataggtgttagataattcttctacggttttaatgaacttatctttattggcgattctttcttcatcaggaacacttttgcggttctttcgcatacattcaaagaaatcactgacttgtgaaatagcggcatcgtaatcagcatcgtctttggattctgtatcagaattcatgaacttatatttcttgaaacgcttactgaatattatttttctttcttccattcctttttgcccctaagtttttttggagattatttaacttggctcttgggttgtgatttgtctttcgccattaacaatcgtgaattactacttttatagtataacataaattttcagtataaaaaatttctgctatcgacaaatttttcgggacttcgacagagagaatatgctataacaacaactgtcagtgataaacacatactaatagacataggaggaagcagaagtaaacgacattttcagacaaatagcaaaagaaaatgaaacaaccgaaaaagcagtaaaagaggaaatgcagtttgccattcgggaagcaatgaaaagtgctgaaccggaagcaatagctttttggaaagcagttgcaccggacggaaaagagccgccgatagaaaaggttatagcaatgattgcattgaacgttaataatagaatgtataattgaggtgcttcggcatctcttttttattattctttaaaagagttgcattaggtgtttgtaaaaagtgacaccttgtcggataggagttgcgaataaatccctatatcttgaaaaaatagattattcatagtataatgtcaaatgagtaactgtaaccaaaaggaacggagaatacgaaggagcgttacagatgagaataagctacaacaaacttcaaaaacttatgattgataatcaaatgaaaagacaagatttaatgcgtgctgcggagatttcatcgtctgttgcaacaaaattaaataagaatgaaacagtatcccttgatgtgcttatgagaatttgcaaagtatttcattgtgatattggcgatgtatgtgaagtcatattagacgaatgatatgaggaggtctgaagatggcggcaagtggtaagaaaaatatgtttaatgaagctacccgtgttcaaatgccagcaatggttcatttgacacgccttggttatacctatttcgggaaaataactgaagatatggcaggcacagtatatgaccctgataccaatatcttaattaacgttttcaaggagcagttcatacggcttaatcctacccacgcaggagaagcggaacagacattgaaaactattaggcaggaattagataatgatgatataggacgtagtttttacgagcgtttatcgtctgtttcgcctgttagattggtggattttgaaaatccaaagaataatacatatcattttaccgccgagttcacttgtaagcgtgaccaagatgaatttagacctgatattacattgtttgtaaatggacttccacttgtatttgttgaagtaaagaagccgaataatcacggcggtatggttgcagaaagtaagagaatgaaccaaaagagatttcctaataaaaaatttaggagatttttgaatattacacagttgatgattttctctaataatatggaatatgacactatgggtggtattgttccggttcagggggcattctattgtacgacggcaaaacagtctgcaccgttcaactgtttcagagaagaaaatcctacaaatttggatattgcaccttataatgcagatttcccatataaggatattgacccgattgttgaaaagaagatattgactgactttaattgtcaggttattcatacttctccggaatatcaaacaaatttagatacctatacaccgaccaatcgagtactgacatctatgtgcagtcctgaaagattgttatttatattaaaatatggaattgcctatgttcgttttcataaagaaataaatggcaagatagagtttgttgagcagaaacatataatgcgttatcaacagatgtttgctgccttaacagtaagaagtaagattgatgaaggtgttaattcaggtgttatatggcatactcaaggtagtggaaagacagccctttcttattatcttacttatgttctttctgactatttcagcaaacaaaataaagttgcaaagttttatttcattgttgaccgccttgatttgctgaaacaggcttcagaagaatttgaagctcgtggattggttgtgaaaacggcaagttcccgtgctgaacttatggagcagttccgtaacaatcaagcacaagagggaaatacgggaaaacctgaaattacagtagtaaatatacagcgttttgctgaagataggtcaaaagttgaccttcctgcatatgcaacgaatttgcagagggtgtttattattgatgaagcacatagagggtataaaccagaaggctcattcttggctaatcttcttgatgcagataaaaatgcaataaagattgcgttgacaggaacaccgcttttgaaagaagaaagagaatcttggagagtttttggtaattatattcatacatactattatgacaaatcaattttagatggatatacgctgaaaattatccgtgaggacatagaaactcagtataaagagcgactttctgagatttacgaaaagcttgaaactttggtagaaaagaaagacgtaaagaaaagtcagattgttgaacacgataactatgtcaaagagttgcttagatatattatttctgacctaaagagatttagacaaattcagggagataatacgctcggcggtatggtcatttgtgaaacaagtgagcaggcaaggaagctgtttgcgtattttgatgaaattcaagcagaacttaataaagacgcttctatgaaaagtcatttgcgagctggacttatacttcacgatagtgatgacaaagatacaagagataagattattgatgacttcaaaaataacatgacagttgatattcttatcgttttcaatatgcttcttaccggatttgatgcaccaagattgaaacgcctgtattttggtcgaaaattgaaagaccataatttgttgcaggcaattacaagagtcaacagaccgtataaagaaaaccattatggttatgtcattgattttgcaaatataaaaaggaattttgaggaaacaaatgaagcatacctcaaagagctgaaccgttttaatgacccgaatgaagttggtgcgggaaatgaaacagatacattcaaacaggttattgaagacccggcagaactcattaaacaaatgcaggaagtgcagcaggttctttttaactacaccacagataatgcagaagaatttagttcggaaatatctacgattgaggataagcaggaattgcttaaacttaaaaaaattcttattgctgctcgtgactgttgtaatttggtaagaacctttggcgatgatgagttgaaggaaacatttgcaaaaatggaattaacaaagttgccttcattgatttcagaggtgcaacatcatattgataacataaatcagaaagaactttttgcaagtgatgataccacgaaattgcttgtaaatgaagcaatggaggatattacatttaatttcagcaaaatcagtgaagaagaattgaaaatcgtcggtggtaaagacgcagtaacggaaaagtataaaaagactgttcgtgcttttacacagaatatcgaccctgatgaccctgagtttattactttgcaggaagcatttttgcttcgtttcaagcaacacggttttgaacctaagagtgtatctgagattgaggagcaaggaaaagaactggaagatattctgaaaaagcttgatgaattgcagaagaaaaacacggttctgctgagaaaatataatggcgatgcgaaattcgcaagggttcataaaagaatcagggaagaaaatcttgctcgaaaagcagcaaataaacagccgattgtttcagagtatgatatgtctattatgaatgttttgctttctattaaatctgatattgaccagaaagtgtatgacagaaatgatatattgaagaaagacgcatattttgagagaacggttatgacacaaataaaagcaggcattgataagttgggagtagcgagtgctcgtgaggatagagtgtttatacagagcaggattacaaaacagtatcttgaccagtacaaccagacttattcagtggcataaaggagaacacaatggaagaaacaaagacgataaaagaaaaaaccatagagttgatagatgccttaaaagcaacttgtcagacctatggtatgggaaacgatggtaacgaatataaaattatcactcaggttttcctttataagttccttaatgataaattcggatatgaagtaaaaaaagtaagtacggttcttaaaaatgccgaaaaatgggaacttgcttatgcagaaatgtcagaagatgaccgcttggatatttttgatagtttaccgtcagatattccattacttaatccggaacatcttattgccaacttatggaatcagcaggcaaaaggcgattttgatttaatctttgacagtactatgacagatatagcagataagaatattgatatattttcaactcagactgctcagaatacaaaaataccgctttttgaaaagctgacacagtatgtaacggacgatacggcaagagcaccttttgcccgtgcgttggttgacaagttagtaaatttctcttttgaagaagcatttgaaaagcactatgatttctttgcggatatatttgaatatctgataaaagattacaataccgcaggcggtggtaagtatgcagaatattatactcctcacgctattgcaacgattatggcaagattgcttgttggtaatgcaactgatttacatagcattgagtgttatgacccatctgctggaacaggaacacttttgatggctcttgctcacaaaattggagaagataagtgtacgatttttgctcaggatatttcacagcgaagtaataaaatgttaaaacttaatcttatcctaaacagcttggtatcttctcttgaccacgcaattcagggagatacgttgattgctccgtatcacaagagtgataatggacaagaattgagaacttttgattatgtagtttcaaatccgccttttaaaatggatttctcagatacaagagagcgtatagcggcaatgcctgttcgtttttgggcgggagttccgaaagtgcctgccaagaagaaagagagtatggcaatttatacgctgttcattcagcatgttcttaattcattgaaatcaaccggaaaaggtgcgattgtagttcctactggatttataactgcaaagtcaggtgtagaaaagaagatactacaacatattgtagacgagcatattgtttatggctgtattagcatgccgtcaaatgtatttgctaataccggaactaatgtatcagtattatttttcgataattcaagaaaaacagataaggttgtactgatagatgcttcaaaactgggagaagaatataaggacggtaataatcagaaacgcagacttcgtgattttgagattgataaaattgttgatacattccttaataaagaagctgttgatgatttttcagttgctgttacctatgatgaaatcaaggaaaagaagtattcacttgcggctggacaatattttgatgtaaaaatcgaatatgttgaattgtcacaggacgagtttaatgctcgtatgagtgcctatgcagagaagttgcaggaatattttgcagagggcgacaaactgaaaacggaaattatggaacagttaaagaaggtaaagtatgagtaaacttacaaagtacaaatttagtgatttatatgaaatgagttcaggtatatcttcatcaaaagaacaagccggacacggttccccgtttatatcatttagcaccgtgtttaataattattttttgcctgaagaattaccagatttgatggacacatctcttaaagagcaagaaattttttctgtaaaaaaagatgatgtgtttattacaagaacaagtgaaaccgttgacgctttggcaatgagttgtgttgctgttaaagattatccgaaagcaactttcagtggttttgtaaaaagactaagaccgaaaacaacgggaatagtgtattcaaagtatattgctttctttttgagaagtaagtattttcgtaaagtgttagattgcaatacgataatgactttgagagcaagttttaatgaggatatgttttcatttttgtatttatatttgcctgattatgaagaacaggtaagaataggcgatttattatataaaatggaaatgaaaatccgaacaaataataagataaacgataatttaccatatcagtcgctgatagtggcttgaccgttcattaacataggcaaaagccagtcacgaagtgtaatcaactcctgattttctcttgtattttcagaaattatattaaacataggagttacctgttcattaaaggttttgagttcctcaaaatcaggaatataaataggtcggtctttcaataacggcttttgtaaatgctttagtcctgttccttgaaagaatttttggttaagttccggctttattgacaccaaaagcaagtacaaataatctgacatattattagcagagatgcaccaagtatccgtggaataggcggcttcgccaacatagaatttgacatcggcattacctccggtattcaaaaagcagtttcgtccatctataaatggtgtatcccatttcaaaatagccgagccacttgtaaaaaacggatattctccggtagattgttttgcttcgcctacctgaacagatgatttatctgcttcgacaagaatatctttaagctttgcgttaggtttttttgaaaagaatgagtgcatataaatgtcatatgccatagcagttaaattatcgtttaacatacatcccataactcttgtgggtggcgagagttaaatcaggggactacccactccgtagtcgttctctaagttaaataaaggagaattgactaatgaaacaaaatttaattacagatgttgttcaggctatgttacctttcttgaacaatgcacagacagaacgcttgcaagaggtgttgcagcatacactttttggttatgaggtaacaaaaattgaaagtgaaaaggaaatctcggagcagaactatatggaattgttcatatcggcaaagcgaattgagggctgttccgagaaatctcttaaatactacaaagcaactatcgagatgatgattgcgactgtcggcaaaagtgtaaagcatattgaaactgacgacataagacgatacctgaccgagtatcaggaaaagaaaaaatcaagcaaggttacgattgataatatccgccgcattctttcaagtttcttttcgtggcttgaggacgaggactatatactgaaaagtcctgtcaggcgaatacacaaggtcaaaaccggcacgaacattaaagaaacatactccgatgaagcattggagcttatgagagataactgcaccgagccgagagatttggcgatgattgatatgttggcttcaacgggtatgcgtgtcggcgaaatggtattgcttaacagaaatgacattgattttaacgagcgtgaatgcatcgtgttcggtaaaggaaacaaggaacgagtggtctattttgacgcaagaacaaagatacatttgcaaaattacttgaacagcagaaccgacgataacccggcactatttgtatcgctgaaaacaccgcacgaaaggttgaaaatcggcggtatagaaacaagactcagagaatttggaaagcaattagggttgcacaaagtacacccgcacaaattcaggcgtacccttgcaactatggcgatagacaaaggaatgcccattgagcaattgcaacagctcttagggcataggaagatagacacgaccttgcagtacgcaatggtaaaacaaagcaatgtgaaaattgctcatcgaaaatatatcggataaggagaaaaggatggagactaagaaactgatagattgttgtgaatttatttctgatggcgaccatttaccaccacctaaaagtgatagtggcgttccttttattacaatatctaatattacaggacaaaacaaactttcttttgaagacacaatgtttgtgcctgaaagttactataacggattgaatgaaaataagaaggcacaaaagggcgatattttgtattcggttgttggttcttttggtaaaccggtatatatagattttgacaaacaaatggttttccaacgacatattgctatcttgcgaccaaaaagaaatgttaatgcaagatttatttactatacaatgctaaacccgcaattttataagttggttgataaacttgctattggctgttctcaaagaaccgtaacattggatactttgagaaatatagaaatcagcttgcctgataaagatattcaggacaagacagttgaagttctttcattaattgatagaaaaattgatgagaactgtaagataaacgataatttagagcagcaacttatgcttttatatgattattggtttacccaatttgattttcctgataacgacggcaatccttatcagacttccggtgggaaaatggtttggaatgatactttgaagcgtaatattcctgaaaattggaaagttcaatctgtaatttcaaactgtttatcatccataataaaacccggagtcgaaatctttaatacaaaaacatacttagcaacagccgatgttaaaggtacttctatttcaacaggaactattgttgattacgacggtagagaaagtcgtgctaatatgcaaccaagtataaattctgtatggtttgctaaaatgaaaaatagtattaaacatctttacctaaacaaagaaatgcaacctattatttcaagttctattctttcaacaggattttgcggattacaatgcaacgaaatcagttttgaatatattgcttcttatgtttcaaatgcatattttgaaattcataaagatatgcttgctcacggagcgactcaagaagctgtaaacaatgatgatttagcaggcgttcacattattattcctgaagatacagttttacgtgcttatcacgaaactactcaagctatatatgcacaaataagtaaaaatatttgcgaaaatcaagaacttgttaaacttcgtgactggttgctacctatgctaatgaacggtcaggcgaccatcagcgactgatacgataaattatcgtttacagtagaaggagaacctatatgatgagtgtttcagattggataagtattatttgtgcgggagttgctttaatagtcacggttattattgcagtcctgcaaataagacaaagcaaccgtatggagaggtttgaaaaaaggcaggacaagcgtgatgagcaacgtcatcaagaaagtgtaaaagcacaagcagtatcattcatttctaaatattataaggacagagggcttattccgttatgtgcaatagccacgatgtatgatgatttgttttattacaatagagagatgtatagagaattttgctgttgtactaaagaggttcaaaatagaattttggaatattgtgatttggatttacgagtcagtgagtacaatatttatgaaaagtgtttggttgcaatagaaagtgtgctaaataaacgcttccctgatgataaaagtgttttttacgatggagggaagtattttactcgtagcttagaatactatgctgataaaccaattccacatcaagagtttgaatatcaaaatcatattacagatgttttggctaatgcgtttaacagcaatgacaaaaaggaaacaccaattcagcagttgtcggtggaatatagttttggaagttgcaaagaaatagaggcgtgccagttggttactgttatagcagagtttgcagcaatctatgggaataaaaataaaaacattgataaatcatacggttctccgggcggatacgatggagaagttatagaaacaatggaagatttattccttttagctttatttgaaatatatacaaattgtgttttataaattataaggtaagtaaaatgatttttcagagaggataaacgagtggcatttgattttaagaaagaatataaagagttctatatgccgaagaataagccgcagattgtgacaattccaaaggcaaattatatagcggtaagaggtaaaggaaatcctaatgaagaaggcggagaatataaaactgctattggtgttttgtatgctgttgcatatactctcaagatgagctataagacggattacaaaatagaaggattttttgaatatgttgtaccaccgcttgagggcttttggtggcaggacaatgttgaaagtatagattataccgataaatcagctttcaactggatttctgttattcgtctgcctgattttattgcaaagaaagattttgattgggcggtggaaactgcttcaaaaaagaaaaagatggattgctctggtgcagagttcttaagtattgacgaaggtttgtgcgtacagataatgcatataggagcttttgatgatgaacctgcaaccgtgacaatgatggataaatatcttgaagaaaacggttatgtaaatgattttactgatgagcgacgccatcacgaaatttatttatcagacccaagaaaagttgcaccggagaaatgcaaaacggtaataagacacccgataaagaaagcataaattgagtaaaatgaaattaggtcagaggacaactaatggcatcaagtaaagaatatttggaatttgtattagagcagttggcagaattggacgagattacttaccgtgtgatgatgggcgaatatattatttattatcgtggtaaaattgtcggcggaatttatgatgacagattacttgtaaaaccgataaaatcagcaatttcatatatgccgacagctacttatgaattgccgtatgatggggcaaaggaaatgctgcttgtagaagatgtggataataagaaatttttaacaggactatttaatgcaatgtacgatgaattaccagcacctaagcctaaaaagaaaaagtagacagatactattgatggagcgataggtatataaaaattatggaaacaaagccaaggattttatatttacaaaagattttactggaaagaaccgatgaagaaaattctctttccacaacacagttaatcaatatattgaatgatgaatacggaatatctgcacacagaacgacagtcacaaaagacattgctacacttcaggagtttggaatggacattgttactatccattctactcagagcaaatactttgtagccagtcgtaagtttgaattgccagaactgaaactgctgatagacgcagtagagtcatcgaagttcattacaaagaagaaaagcgaaactttgattgagaagatacatacgatgaccagtccggggcaggcgtcgaagctgaagcgtaataactatgtggtcaatcgtatcaagccggataatgaacagatatattacattattgacgctataaacgacgccatcaacgcaggcaaacagatttcttttcagtattatgattataccggattaaagaaaaaggttctgaagaataagggcgagatttataaactcagtccgtataaacttctctggtgtggggactattattatgttatcggatattctgagaagaaaagcaaggttatcaatttcagggtagaccgtattgcttctaaaccggagatactggataaggacattattcctatgcctgatgattttgatattgagaattacacaaaggaagttttctttatgttctcaggcgagaaagttcttgtagatttacggtgtgataacagtctgatgaaaacaatggtagaccgcttcggagaagatgtgacaacccttgcgtatgatatgacgtctttcagggtacagaccgaagtatcagccagtccgacttttttcggttgggtgtttggctttaatggcaaggtacagatacttgcaccggaaagtgtaaaagaacagtacagacagatgattgcacaagccgatgaggatatgtaagagagtgagtagtgattcgtaaacgatttaaaatttgtgtgaaaaatcaattattatgaatatgaaaatgatatgtttttaaattgtgcagacggtctgcacaattaggaaggagtcaatatgcttacaccgtcaaatcaatatttgcaggcagtagaagaaataaatgattatgtcaatcaggctaaatgcagagcttctgtcagtgtaaatagtgagataatgaaaacaaatatatttattggaaatgttattatccgcaattctgagtggggaaataaatttgtggaaaatctgtctaaggatatgaagatgagatttccaagtgcaaaaggttattctgtcagaaatttaaaatatatgaagaaatttgcacagacttttacggaagatgatgtagatgagtacggattgggaaggattacttggagtcatcatcagatattgatgagtaaagtgtcaaatcgagaagaatatatatggtatctggaaaaaactttggaacataagtggtcagttgatgatttgacttcccaagttaagagtcaattatatgagcgacaggcagttgctaacaaaatatcaaattttgaaagacgattaccggctgaacaaaaggatatggtattaagcacaatgaaagacccatatatgtttgatttcatcgattatacggaagaaatgttggaaacagatatagaaaatgaacttgtaaaaaatgttacttctctactgatggaattaggcactggttttgcttttatgggacagcagtatcatcttgaagttggaggaaaagatttctatatagaccttctgttctataatacaaagcttagatgttatgtagcaatagatcttaaaactggcgagtttaagccagaacaggcaggaaagatgaatttttatttatctgctttagacgatttagtgaaagctccagaggataatccatcagtgggacttattttgtgcagagatgaaaatagaacaattgcagagtatgcattgagagatatgtcaaaaccgattggtgtcagtgaatatcacttatgcacggatttaccgttagatttgaaaaatgcattacctgccgtagaagatattagaagtagaattgatatgaaaaagtaatttgtgcagaccgtctgcacaaattgcaaatttaaattgcattgaacaaaaagcctttatgggctgtaattttcaatgaaaacgaaaaactttacttttaacattagctgagttaaaaagaaagtttttgagttaaaagatacggaggtgttagcaaattgcgacacctcttttcttttgcgaaaaacctacttggaaaaattttcgtatcaggtataataaaactatcgaaagcaaagtgctttcgatagaaaagaaagcgaggtgcaggtatgagaagcaagagtcctgaacttatgagtgagataaaaaagtatatcgaggattattacctgcaaaacagacaatccccatcgactacaaagattgctgaagcggttggtattgccagaggtacagcatataaatacttggtagagatggctgagaagaatatgattgagtatgacgggcaggagattcgtaccaatgtgacccgtaagtacagtggcgaacagacacagacaccgattgtaggttctattccttgtggcagtcctcagtatgaggaagaaaatattgaagaatatgtatcacttcctactgctattttcggcaaaggagatttctttatattaagagcaagcggtcagtctatgattgaagcagggattgatgacggcgaccttgtggttgttaaaaagcaggttgaagctaatgagggcgatatagtagttgcccttgtggataatcagaatacattgaaacgctacttccgagatgatgagaataagaaaatcattctccacccggaaaataagaagatgaaagacatcattgtggatgagtgctgcattcagggtgtggcttgtcacatcatcaaagaactataacagaggacagacgaatgagaacacttgaaggaattcgctatctaatcaatttggatagtgcggaaatacaacagaactttgcagccacttcaaagggaacggcttatgaagaatgtatgctgcggtctgagttccagagcgattgcaaagcaggagggcgtatattacagctccgtggataagtccattgctgcggcaaagaaaaactttatcaaattttatgaaaatctctgattttgggtgtgcatttcagacccctttgtccaaatgagtgaatgggagaaggatagaaaaacgctgatatatgggcaggtagactaatatgtatggagaagcactttataagcctgaaatgaaagaaggaaatcctataaggttatatagtttggatgaaatcacggagatattctgtaaattaggacttcgtatttgtaacagctttgctgatttcagtggaaagccgagttctgataatgatattcaattgatggtttattccatacgggaataaatcttcatcaaatctttatttttttctgttaggttatatttcagtaagaaatgaaatatagaaggaaggatagtaaagatggaaatgatgttacagacacaaaatctatgtaaatattttagaaaacagaaagcggtaaataatgtttcacttaatatcgaaaagggacagatttatggactgcttggaccgaatggcgctggtaaatctaccacattgaaaatgctgaccggtatgatgaaaccaactgcaggaaagatttactttgatggaaaacttttggataggaaagatttatcaaaaataggagcgttaattgaaaatccgcctatttatgaaaatctttccgccagagagaatttgaaggtaagacaattattgcttggtacagatgaaaacagaattgatgaggtcttgcagattgtatcacttacaaacaccggaaagaagaaagcaggacagttttctttggggatgaagcaaagactaggcattgcaatggcattgcttggagaaccggaacttttgatattggatgaacctacgaatggattagatccaataggcatcgaggaattacgagagctgatccggtcttttccggaacagggaatcactgtaattctctccagtcatattctctcagaggtacagttacttgcagataaagtcgggattatttcaggtggaatcttaggatacgaaggagcattaaagcagggagataatcttgaagatttgtttatgaatgtggtaagaaaaaaccagaaagcaggtgaaatccatggttaatattataaaagcagaacatcaaaaagccaaaagaaccatgcgaaaaaagtttatctggggatttcctcttcttacatttgtcatggcatttatatttactcttgggatgacaaatgcttatgcagaaagtgtttggaactggtggtatacacttttgctgccggggatgattgctctattttgttatctttctgtggcgcaggagaaaaagataaaatactatcatttaatgactattcccacagacagaagaaaattgttgctggggaaaattatttatattgggtacatgattttgttttctaatgtgattgtgtttgcaggagcaacgcttggaggctttcttctaacgacacatgttccagttggaggagcgttgattgcagtattgtttctgacggtttctgagttatgggagattccggtagctttatttttaagtgaacgatttggaatgattgtaaacctgttcgtctgcctatttattaccgtcagcggtgtggtaatatcacaaaccagaatctggtatgtacttgtttctgcaatccctatgcgaatgatgtgcccgttgcttcatgttttaccaaatggacttgccgcagaagcagggaatcctcttttggatacgggagtcattgttccgggaatgtgtctctcaatcatctggtttgtttttgtaacggttctgtttttgaaatggtttgagagaagagaggtgaaataagatgattgggagatctcttaatgcagacttgcgaaagatgaaaggaacatctgtgattttggcacacttactgattccgattataaccagcgttatatttttaatatattactttttttcaccatggaatgaaaatatgaaagtgattgcattttatcaggcaataggagcaggacttccggtacttattggaatttttacagcaagtgtgatggaacaggaacaaaatgcaggtgattttcaaaatctgttgtctttaccggataaacctgcagcatttttatcgaaactgttgatgctactggttttgtgtctgtgctctatcctattgacagcaatcatattcggaattggatttggaagaatcgcatcaagcgatatcgaaatcatgaaaggatgtatatttgcagcattgctgctgtggggaagcagtgttccactttatctgtggcagctgattctggcttttcagtttggaaaaggggtatccattggagcagggattatatcaggactaattagtgccttgatgcttaccggacttggagattatgtgtggaaatatgtatttgtctgctggacgggtagagtaccatatacttatctgcaatctgtattgggagaaactagtgtaggtgaatggttgtcattcataccaggttgcttaatatttacagggattagtatggtatactatttttggtgggtaaaccactgggaaggaaacagaatatcggaatagaatcgagggaaactatggcaaaaatactggcagttgatgatgaaccggcaattttggaaatgatagaaagcattttgaataaggatggacatctggttaccaaagtaagtaatccactaaaaattaatatggaagaattacatcgttatgacctgattttactggacattatgatgcctggaattgatggcttcgaattatgcaaaagaatcagggcacttgtggattgtccgattttgtttcttacggcaaaaacggaggaaaacagtctggtaaacggactttctttaggagcagatgattatatttcaaagccatttggagtgatggaacttcgggcaaggatcaatgcacatcttagaagagagcacagggaacattctgtccggatggttttggggagggtctgtattcaaatatctcaaaagaaactattggttgatgataaggaacttcctcttacgaaagcggagtacgaaatctgtgaatttctggctaaaaacagaggacaggttttctcgaaggaacagatattggaagcggtctttggctttgacaatgagagtaatgacagtactataatcacgcatatcaaaaatataagagcaaaatttgcggattatgattatacaccgataaaaacagtctgggggattggatataaatgggaagagtaaagagaagcaatgcactcagcaggatttttatgagatatgtactggtcatgcttggatcattagttggtttggtgattgttgcttatctgctgctgtaccttttgattagtgtgggctgtatttatccggcaaattatgcagagcaaaagattaatgaagcatatgatacgattctacgtgcagataaagtgactgctgagatgattcccgcactttgtgattatgtaatcttttcagagaatggagagaaaataggtggagatctgtcagaacaatacgaacagatagcatggaatgttgcaaagtacggaaacgcatccgggaaatatttttataaagtaattgtaagggaaaatgaatatgttgtattgcaatatcgcctgacacctcaatatcattcagcttttttgagggagcattttataggaccacagaatgtgatgattattatgtctgtgattggagcggtagcgattatcatcattccgtccatacgttttggaaaaagaatcaaaaagcagatgcagcctgtattagacgcaatcggacaaataaaggatcaaaatctggaatatgagacatcctgttccggtatcaaagagtttgatgactgtttatcggcaatcgatgatatgcgagatgcattgcgagaatctttagaaaagcagtggaaaacagagcaggaaaagaaacagcagatgtctgctttggcgcatgatattaaaacacctcttacgattgtacggggaaatgcagaactactttcagagactgaactgaccacagaacagaagaataatatcacttatgttttgaacggcacaacacagatacaaagttatgtaaaacagttgatagatgtcacaaaatcatggaattgcagtgatgttacctatacaacggtgaggttagaagattttttcgcagatataaaggaacaggcactcggactggtagaaatctatcaccagaaaatagattggaaggcgggacaaagtgataaaaaggtaacgattgcttatgatccaatgttccgggccgtaatgaatatgattcagaatgcagtggagcatacaaaagaaaatggaatcatttatattgacgcaaaggagcaggatggccggctgacattcattgtggaggatagcggatcaggatttacaaaagaagcattattgcatggcacagagcagttttttatggatgacacaagtagaaatggcgaagcccattatgggatgggactattttttgcaaaaactgtggctgaaaaatatggtggaggtattaaactttcaaattctgaaaatacaggtggggcgagggtagaaatatttttcctgagtagtcaagaaacaagctaaatagaccgcaattaagctatgtaaaagaaattttacatgcttttatctaatatgtaaaagccttttgatagacattactactactctaagcacaaggaggttgaggtttggctatgaataacagtttagcagaagtacatttcctgaaaacccaccctgtatatgaacactggtatccggtctttgcagtaatgataggaactggacttcgtgtgggggaagtaaaagtggctgttatttcaatgtaaatacaacaaagactccggcgagtatgaggcaggttccaatgctcggttttgtgaaagaagcatttgaacatgagaaacagaagcaggaagatttaggacttcattgcgaggtcacgattgacggatatacagattttattttcatcaatcgttttggtcaggcacagcaccaagccacactcaacaaagcaatccgaagaattatccgtgattgcaatgatgagcagtttttgcacagtgatgaacctgatgtgttacttcctcattttagctgccactcgcttagacatacatttacaacaagaatgtgtgaagctggagtaaatataaaggtcattcaagacgcactcggacattcagatatttcaactacactgaacatctatgctgatgttacaaaagaaatgaaagcggaagagttcaaaggattggatagctacttcaaagtataatattggacttcacatacagaaagagaacatacagagtgttgtgtgttctttttttcgtgtgcgccttgcggcgcacgtttctaatgggtgaaagtccctaatccaagagtacaaccttgccaaggttggggtcgcgggttcgaaccccgtctgtcgctctgaagcacttagatctttaaagatttaagtgcttttttcatatctaaaacgttcccctcttgccattttattttttatcaactatactaagtaacagattatgttttagaaaccaggaggaattatgaaatgaaatttatatatccagccgtattccgtaagaaggaagatggaggctatgacgcacatttcccggatctcgaatgctgcgaggcatccggtgaaactttggacgacgcgatcgacaatgcaaatgaagctgcaagaacatggatcactgttgaattagaagaagaggatccaatcttcccacatgtatctgatctggaagatattgaacttgctgaagatgagattgtaagaaatatttccgtaaatatccgattctacgaaggatgggacgaataaaaagctttaaaaaaggattggcagttgtctaagtgacagctatcaatcctttctttgtatttttgagtatttaatttccacactctatactgatctcattgaacttgctcaagatatcttctacctgaagttcttctttttcttttcctttgagatccatcacaactccaccctgatgcatcatcagcagacggtttccgtattccaccgcgtagcgaagattatgtgtaaccatgatcgttgtaagctttttctcttctacgatctttcctgtcaattccatgatcagctctgctgttttcggatccagagccgctgtatgctcatcaaggatcaggaaatcaatcggtgtcatcgtagacatcagaagggcgattgcctgacgctgtccgccggaaagagatcctactttcacatccattttattctcaagtccaagtccaagctggcttaaaatctcacgataatattctttacgcgccttattgattccggaactgaggccaaagaattttcctttattgtctgcaagagacatattttcaagaatcgtcattgtcgggcatgttcccattgccggattctgataaacacgtccaatcttctgatttctcttgaattctttctttgttgtaatatcttcaccgttcatcaggatctgtccaccgtctaccggaatacttccacagaggatgttcagcatagaagtcttacccgaaccattacttccgactacagagacgaattctcccttgtctacagtcaaattgaatttgtcaaacaggcacatctcattgatagtccccggattgtagtatttttcaatatttctaagctcgagcattcttcttcaccttctttctgcgttctccaccgatcaccaggatcacaaggaataatactgctgtgatcagtttcatgtcctgtggttcaaagaacttcaacgctgctgcaacacaggctttatagatcacagatccgatcagcactgctgttgttgctttcataaaggatacatttttaaataagcttgttcctataataacacttgcaagaccgattacgattgcacctgttccactcgaaatttcaaatacgcgctgttcctgacagaaaatacttcccgaaagagcaacaagtccgtttgcaattgcaagtcctaagattttcacattgccctgatcttttgcaagagatgtgaccaatacgtcattatctcctactgcgcggagcagaaaacctgattttgtcttcatgtaaaggtctaataatactttactgatcactgcgatcacaagcacgatcacaagtactttgtaatttgaaaggccatcatggaagattccatttacggatgcattatcaaagatactgtcatctccaaagattggaacatttgctgttcctgccagtcttaagttgatcgtccacagtgctgtcatcatgataattccggataagagatctcttaccttgaattttacatgaatcagacctgtgcagactccggcaagcacaccgatcaggaatgatgccggcagtgtcaggattggatgaacgcctcttgtgatcatcgtcgctgtcagtgcggctccaagtggaaaacttccatctactgtcagatccgggaaatccaggatcttataagtgatgtataccccaagcgccaggattccgtagatcagtccctgttctaaaatcgtaatataaatccccataatgtgttaacctctctgtttcaatactattttgtaatctctgtaaagctctctaccgcttcatctgcaagatcctgtggaactgtaactccaaggttttcagcaactttttcatttacatagaagcctggttctgtgattgtctcaaaattcatctcagatgctttcttctcacctttcagaatctctgctgccatcttacctgtctgttttccaagtgctacatagtcaagtccttcggctgccagacatccgattttcacctgctcgatctcacttccgaacaccggaatgttctgtttgtttgctttatcaaggattgttgcaagggaagcaactactgtgttatctgtaagatttgtcaggcagtcaacctctgtcagaagttcatctgttgcaagagagatatcggctgtctgtgcgattcctttgtcaacgatcatgaatccatagtctccggcaagctctttatattttgcaagagcggatacagagtttgcttcgcttgttgtgtaaaggattccgatattctttgcatccggaagcatctcacggatcatctcaagctgtgctttgatcggaagttcatcacttgttcctgttacatttcctgcaggtgttccatcctctttcgcaagctttgctgcaaccgggtctgtaactgctgtgtatacaaccggaatgtcggaattcattgctgaattataagcagcctgcgcactcggtgttgcgattgcacatacaagatccactttgtctgaaacaaatccatcactgatctgttttgctgttccctgatctgctgccgcattcttcacttctactgtcaggttcttaccttcctcgattccttcttctttcagtccttctaaaaatccctcacggcaattatcaagagaaccatgctctgcaaactgtgaaataccgattgtgtagctcttctcgctgtcgttggaagatgtctttcctgcatcagatgatccacatgctgcaaggctcattgtcattactgctcctaaaataactgctaatactctctttttcataattgttgtctcctttttctttttaaataaattctgcaaaagcaaaggagccgatttgggattcttgtcaataagctgtggatttctttttataaattaactttcctaacatataaaaaaccgccccaagcttattgcttgagacggtaataaaattcattattatcgcggtaccactcaaattgacgttcgtccactttctcacgtactaacatacgctcctgattgataacgggttcggttcccggcggttcctactcttttcatttcaggccgccctcgaaagtccattcagaatcagaatccatacagcaatcccaccatctgctgctctctgtgatctcttctaaaacctacttctctttctcatcggtttttgcttttgatgtgtcttattgtagtcgttcactttctatttgtcaagagaaattttattatattttaaatttcttttgatattgtcagaaaaatcaccatttattcttctgttgtctcttcctcattctcctctacagcaacagcaaggctaagctcttccagctgcttctcggaagccggtgtcggtgcttctgtcatcagacaggatgcatctttgatcttcgggaatgcgattacgtcacggatgctgtcctgttttgccataagcataacaagacggtcaagaccgtaagcaagtcctgcgtgcggcggaactccgtatttaaacgcatccagaaggaatccgaactggctgtaagcctgctcttttgtaaagccaagtgccttgaacatcatttcctggatatcatcctggaagattctgacactaccgccaccaatctcatttccgttcagaacgatatcgtatgctttcgcacgaactcttcccggatcagactcgatatactggatatcttcttccatcggcattgtaaatgggtggtgcattgcaacgaaacgattctgctcctcgctccactcaagcagcgggaactctgtgatccatacaaaacgatactcatttttatcaagaagttcaagctgttttgcaagctcaacacggagtgctccaagagaatcccataccactttgttcttgtcagctgcaaagagaagcagatctcccggctctccatccattgcctttacaagtgcatccatctgctcgtctgtcatgaattttgcaaatgaagacttcactgttccatcttcatggagtgcaacataagccagacccttagcaccgtaatctttaacaaacgctgtcagcttgtcgatcttctttctcggcatgctgccctgtcctttggcattgataccacgaacgcttccgccattctcaagcgcgcctgtaaatactgcgaatccacagtctttcactacatcagatacatctttcagttccattccgaaacgaagatccggcttgtcagaaccataacggttcattgcttcctgccatgtcattctctggattggaagctgtacgtctacatcaagaacttctttaaaaagtttcttaagatacttttcatttacttcaataacatcatctacgtcaacgaaagaaagttccatatcgatctgtgtgaattccggctgtctgtccgcacgaagatcctcatcacggaaacatcttgcaatctggatgtaacggtctacgcctgaacacatcagaagctgtttataaagctgcggagactgtggaagtccgtagaaagatcccggatgaatacggcttggtacaagataatctctcgcgccttccggagttgtctttccaagcattggagtctctacttcaaggaatccttcatctgagaagaactgacgtgtcagtgtcataacctgactcttcatacgaagatttctctgcagatccggtcttctaaggtcaaggtaacgatatttcagacggatatcttcttttgtctttgagttttcttcaatcgggaacggaggtgtctgtgactcagaaagtacacgaagttcgctagggatcacctcgatctcacctgttgcaatcttatcattcactgcaccggaacgtttctcaacttttccaacaacagcaactacatactctgcacgtaaagatgctgctttctcaatgattgctgcatctgtagttccttcttcacatacaacctgtataattccagaacgatctcttacgtctgtaaatacaagtcctcctttatttctgttcttctgtacccatcccatgatagttacagtttccccaacattggctactgaaagttcaccacaacggtgtgttctcttaagcccctgcattgattcagccatggttatttacttcctttcccttttttctataagttatcaacagaatctctgtagcactctgtaatatctgtgtatccctgttctgcaagctgctccttctggaacttcttgttcttcttcatgttcatgatcattacctggcgtcctgctgcacgctccttcttcgcaagatcaagaaccttaagcatgccttccttcggcatattcttctcgatcaagaatgccttcttctctttgctggtcggaactttgtatccacgctccatcagaagcatgacaatacgttcaaatccgatagagaatccaactgccggtgtatcctgtcctgtaaacttaccgatcatcttgtcgtagcgtccgccgccacctacagatccgccgaactcatccatagaaatctcaaaaatagttcctgtatagtaagacattccacgtaccagtgtaggatcaaacagcatacggaaatctgcttccttcgcactttctacgcttgtgatgatcatttcaagagagtctgccgcatcttccggaaggaatccctgaagtttctctttacatgcacgaacaccttctacatctcctgtaatctccttgaacaactgaagatatttctcaacagattcctctgcatatccattttccttcatctctgctgcaacaccatcaagaccgatcttgtccatcttatccagtgtaatgaatacgctgtcataatctttctcttcaaatccactgtaagctgccattgccttcaggaaacggcggtcattgatacggattgtaaagttattgaaatccagttttccaagcagggatgtagtagcaaggatcagctcgatctcagcaaggttagacggctcaccaagaatgtcaatatcacactgcataaactggcgataacgacctctctgcggacgatccgcacgccatacacttcccatctggagtgctttaaacggtgccggaagctcattagaatgatttgcataatatctggacagcggaagtgtcaggtcataacgaagtcctccgtctacaagatcagcttcttctttcgcctctgcaagtctcagcttctctccacgctttaagatcttgaagatcagcttctcattatctccaccctgcttactgcacaggttctcgatatgctctacacatggagtctcaatggatgagaatccaaagcttctatatgtctctttgatcagaccgatcacataatctctgatctccatctctgcaggaagaatatctttcattcctgttaccggttttttctttaatgccatagcacttctccttttcgttctatcatttcactactataatctcttgatttcgtaatgttcttcacaaaaaatacaccttaatcacgagtcttatataataagtcaactccttctttaagggtttccgttatcgtctgttgatgcttctcagaatagtccctaagtttctgatgttcctccgcagacattcggattgtcacaattttatctttgatcacgtctgacttcggacgtcccatcttagccataggtaatctcctttctctcacctattctattatactttcgtaatacgaaatgtcaactatttttgattctgtttatttttgttctaattgaaacaatgcttcttccttggattgccttttggattgctatttccacgaatatagggtagaatggcaagaggccggtgcacaaaatagtgcgcaggcctctcttttcagaaaatgaatactaaacttctaagccattctctcccaacatcatttgctttaactcactaagattatacggtcctgctacctgtaaccttcacttgatttatcaatcaaaaattcttgtaatatcctgatatcggttcaccacacgataaatctctacatattcgctagcgaccttgtaaataatcacataatcttcccatatcgcatatttatagtctgtccgaaagctgacccgtttaaagagatccgaccccattcccggaaacatctgaagattttcaaatttaccataaatctcttttatcgtctttgcagcatattcttcattatcctcagcaatataatcccgaatattcttcaaatccgttgttttatacattactttaacatttgtacaataataaaaaatcattttcgttgatttattttcatttctcaaagaaacttttaattatttaccgtcaaatatctggtcaattttcagtcaatgatatctagagaaaacaattcaaaaacagataaatctatctaaatttcaaaactccatacaatttatttaccgtcaaaattatggtcaacattctaacagtccttgatttataaggcttttttcaaaaatttcgtagagttgtttactctacgaaatatggtctaaaaaaacatctactcttcttatcaattccaactcacaacttatttctttatcaacatctttacatatatacttataatctctgtaaaaatccctattagtatttttctcctaacaaaaacaactctctccgtcaaactattcttccatcttctagcacaattatgttacaatggatatctaatattaacgtgggtgacctaataatatgaaagatcaaaatactacaaaaactgaatttgaattatccggactgaatcctactgaattagaatttatggatcctgaagaacgaaagaagctgcttatagcttccggactagatcctaaaaaatatgatttctgatagatgaaaatggatacttttgataaacttagattaattaaattgacaaaaaacaactgtcaaatacttctcgactcgaatgatggatttattataaacaccatctataatggtaacaaaggtggggcttacaaaagagaatataagattttcaatggcaaattacatatccatgaaaggtagaacactgatagttcccatgataatacttggattgctacagataaggaagttcacctgttcttggagaaatatttatggaaggtatctcttgataatatatctgtatgacacgctgctatactacttattacattttctgctttgattatgctatatataataagtctgctaaaaacatgtgtacagctgttattttagtattgcacattccaaatttttaccggaacatgcaacactttattgcattttctttaaaatcttgctttgtaatttgaagttaagtatagtagagtcatatctattcaatgtctgtatgtacaatgattacaagaatcatcgtatagataaaaggggaactttatgactaacttagaaatgatgaaaggtgatcttattaatcaaataaaaaaatgacttcgaaacaatatcataaatttcttacaacgatttcagaacactataatccaaaatcaatatataatattattgtaaaaaataatgtgatgttgtaatatttccaaagaggcgaatatctctggggtgttccattgatatccgcctctttttgggattaaaaattaaaaaatattactttttcagcttgtcttcaaaaatctcaacaattgttttctctgtgccaaccattccaggtgaagcaatcagtcccatatttcgcatagtctcttccggtgtatttccattaattccatgcacttctgaaatataaataccattcattgcaaattcaactgatttatacgctgcatctaccgctgcaactcccttcattgtacatccctggtttccgccatcacaaatcatacctgtaatactacttgccatgttattcaatgtatgagccatcatttcgactgttccaccgcgtaaataaaccagtgcacatgccataccagaacctgcagcgatagcacagccacagaatgctgataatcgtcctgaatactcttttatgtacatacatacaagataactcaaggctgttgcacgaagcaactgttcttctgtgtatccatttactttatacgctgcatataatggcattgtagcgataattccatgtgctccagaacctgtaatactcatagcaggtttatccaaaccaataactcgtgcctcaattgctgcattacacatcaaagatgctgttttctgctcatcgtcagaaacttcttttcctttattaatagctaacaactgtcttgcaaatgttgttcttggattttccaaaccttcatggaacaattccaggtttactttgtatgcttcgttaataaaacgaatttcttcaatatctactgttgttacataatcgtataattgttgtaaagtatatttatgaatagaatgagattcttcttcaccgccatcttcttctgtctttttctcatcctctgtttccagttcgactttatcgttcactataatttttgtgatattagtatgagagtcacgaattgttacgattgccttatcttcttctgtctccactgtagcttcaataaaaatacgacttgtaatgccactcagttcaactgtaatcttgccctgatcaatcatttcctgcgcttttacattatcttcaggtgtaacatctgcaagagactccaatcccttgtctgcatttcctgctactacacctaatgcagctgcaaatacattacctacttcattactgtttgggattccacaagtaaatgcatttttgtacattccactattcattgcaacattaactttcttaatatcacccttcgtgaaacttcttgcctttgctactgcaaatgcaattgcgcccggttccgttacgcctaatgctggcttcatatcgtctttaatcatctgtgacaattcatgcatagtaaaaacctccttatttacttgcttcttatttagtatgtctattacttattctttttcatttcttttgcagggatatattctccattctcgccttcaaaagctcgtccccatcctgtcaaacatgcaataagcattacaatccaaattgcccaactataaaatgttgtaaacatcatatcagctccacctaatttaggaaggaatgggtatgtatccatcatggaagaaattccacctaacaataacagtacacatcctccgaatggaaggaagaatgggaaggaacaaattgttgttgcaagaatatctgtacgtctatatggatgaagattattcttcttacctactgcattaacaaatggtgccacacaaatatttgcaattgtgttaatcgctgcaatcaaaataccaaaaattgttgctaatacccaaatagctacttctgcgcctctaggagtcttgattatcgtattattcatccaatcaacgattgcttccatacaaccacttttaacaagcatatttcccatagcaacaaccaaaatcaatacgatacttactgttgtcattcctgcaacaccttcaggaattgctcctgaaatcgcaccgtctttcattgagaataacgctgaagctgggaataatcctgctgcaagaccaattacggatgctgtaatgattcctgttcctaatgctgcaaaaatattaatgcctttgattgctaacgcaataaccagaattgtcggaattaaaagtaacagtcctttcggattctgatactgagctaatagcatttctgcctgttttgcatctgttgcttcacctgcaccaccaaaaataaagaataaaataatggaaataacacctgcaataacaacaaattttgctcttgtttttactgtacttccgatatcagcaactccttctctattctgatattcctgactggaagaagcgataattgctgtatctgaaactggagcaatattatctccaactgctgctcctgaaagaattgcacctgccaatactgccggattcgatcctaacaaaatacctgctggataaagaataaaactcattgtagaaattgttccgaaaccagaacctgttgccattgcaaatactgctgcaaagataaatgctgcaactgtaaatgctgctccactaacatgaatttttacacttaaccaaaccaaaccttctacaatctgtccacggttcaaaatatttccataaattcctacaactaaccacagcattactgctgtcattgcaacttttgaacctaaaccttccaatatagtgtcccaataatcattaagattctttgcgaaaaacattccgactaacaaaccgataacacctgcgccgatcatcatgtttgtatcagccgcattaaagaatgataatgcaattgtaataacaataaagattgcaaatggaactaatgccataaaactactaccacgaaactctaattttttgttttcatccataagatgcacctcttctcatctttcctttagtttactcgttttcgtaagcactcacattgcaactgcttcaatctctacctttgcacctttcggaagctttgcaacttgaaatgctgctcgagcaggatatggggctgtaaaatatgtctcataaacctgattcattgccgaaaaatcgttcatatcttgaaggtatacagttgtttttaaaatccgatccataccgtatccaacttcggctaaaattgacttaatattctcgagcgattgacgtgtctgatctgatacatcatcagatacaaattcaccagtttcacaatcgattggtaactgtcctgatacaaataccaatcctccgttattcactgcctgtgaatatggtccaattgctgctggagctttcattgattcaattttttccttcatattgattcacctcccttattttttctgttaatcacatcttacacccctacatttttatttacaataattttttattaaaaaaataattttttactattattacaattttattgacttatttttgtataacatgtatattaaaattataaaaacagtaaagaaagtatttataatgaccaataaagagattctttccattttcgtccctattgtcaattttcttagtgaaatattaggtgaaaacaccgaaattgtgctacatgatgtgtctaatccagaacattctgttattgcaattcaaaacggattccactctggacgaaccattggaagttcgcttacagactttgcattccaagtcacaaacaatcaagcgtatacgacacaagactatttggtaaattacactgcaaaagcgagaggaaaggatttcatcgcttctactttttatataaaaaataatggtgaactaattggcatgctttgtttaaatacagatactaccattatcacaaatttcatgaaagcggctcagcaatttgtcggttgtttaccaatgggagtttccatgacaatgggagaaactattactggatctaccactatggtagaagaaaatctagatgttccaattgtttcttttgcagaatctattatttctaaaacgattgctgattctaatattccgcctgaacgcatgaccagacaggaaaaaatggaaatcgtttgggaacttacaaaccaaggaattccgcgtatgaaaggtgctatctcagaaattgccaaacaattagaactttctgaatccactgtgtaccgttacattagtttaaaagaagattaataataaaagcgattcactaatagatctaaagcggaaaaaattgacaaactcctttccgctttagattcttttattctttctctagctgttctcttcgatactgcttcatttgatctgctggtaagttaaaataagacttcacctgctcatcagtcaacccttcttccaaccccaacaagatttcattcatctgatctccatctaattttgatgcatacggaagattcttccaatccatgataggatactttgctttgatcggtggaactggtgcctttatttgctttttcggtattgtttttccgattgctttttccattctctgttaggcggcctgcgttgccatcttttctttctacttctgcatatgatctataatatctatctgttcctttattcggatagagatctgataattctaatacctctatgtcagaatcaatctgcaaaaaattttgaaaccatctaatatcacttttcgttcccattaatcgtatctttaacatctgctgtttcctcctaacgctgtacatgtcatttttcctcctcctttcgcaagttttaaacaataacagaaaaaaagacgaactcatttagcataatgaattcgtcttttaaggtaaggttattaggttttcttgtacgtcatatagtaaatttagtattatttagcactgattttcacagatttttgaactaatttaatgtacaaataatgtaccagccctttttatggaggtatttttcattttcaatccttctcaaaaagtgctttttttcgttcaatcatctcatcgattctagcgatgtattgcttgatatccttgacattctcgcatctttcgatgtgataaccatccggtagattccatacacgtttggtggatgctccggccccgcaagctaggatggcctgtttctcttccatgatcaaaatgttatacaccccagccttgtcctgctctgcatatccaacattctcgaagtttccggcaatgttcttctggcgatacaggtaatatggcacaagccccatgcgttctgctgacgctgctgccgcctcgaccatctgtgtgatctcagtccccggatccatcgttcttccttcctgaccgaacttcgcagcacgtttgatcgcgagtgcgtgtactgtcaggctatccggatgaagcttctcgatcttctcaagtgtatcctgcatatcggccgcatcttctcccggaagtccggcgatcagatccatattgatattatcgaatccaagctcacgtgcgaggtggaagatttgttctacatcttctaccgtatgttttcttccgacaagatccagtgtcttctgctgcattgtctgtgggttgacagagatgcgggttacaggatatttgcggatcacttcgagtttttctcgtgtgatgctgtccggtcttccggcttcaactgtaaactcaagcacatgctctaggtcaaaattctcccggatcgttccaagcaaacggtcaagctggtctgcctcgagtgttgtcggtgttccgccgccgatatatacggtatccagcgtctttccctgcatcagctttgctgtagccttcaattctttgattatcgcatcaaggtaacgatcgacctgatctttccactcagcgattggtgaagagctgaaggagcagtaggagcagatgcttggacagaatggaattcctgcatacaggctatagccatttttacagtccaactgatcaagaagtgccttttcacgacatgcaatctcatacgcaatctgtgcttttttattgccaacacaatattgttcttttagaaatccaaagatttcttcttttgtcattccctgctcgattttctgcattacaagctttgtcggacggactccagtcagcattccccaggcaagttcctgtcctgtctgctttgagagaaactgatagactttcttcgttacatcgcgtttctcttcctgcacatcttctgtctgcacgcattcttccggtgcaagggaaaagcaagtcccttccggcaaatgtatcttcaccagtggttcttgcttctcatctactgtctgcacgatatcctcttttggataaaatgctttcgtgacatggtatacgttataagtaaatttgttcttcttactttctatctttatcatatgaatggattatgctccttctcaaactgaactgatgtctcttccatatgtcccggatagatctttgtatcatccggaagtgtcatgatcttctcctgtacagagcggaccagctgactgctgcttcctgtcggtaggtctgttcttccgatggaagcacagaacagcgtatctccactgaacaatctatgttcttttggaaggtaatagcagcatcctcctacggtatgtcccggtgtatgaagtacatcaacttcaattcctgcgcattcgatcacctgaccgtctcttacaggctgtgctccgtggaatgcgtatttcggtccgtacatacaagaaacattcagtcggtcatcctcgatcaccggaagttcgtcttcgcctgcgtaaaccggcacaggaaaggctttgaggaaatcatcgattcccatgatgtggtcaaaatgtccgtgtgtcagaaacaatgctttcatttctagtccattgttcttgatataattgacatattcctgcggacattctgccatatccactgcaaaacattccttcgtctcttcattggttacaatatagcaattcgttccaattgaccccagtacaatactttcaaccttcattcgttttcctccatcagcctgttgttctctcaatatcaattacattttcaatctgtctgagctttccgatcacacgattcaattcttctcttccgtgtacaacaaatcccatctccattgtcgccgtacccttcttgctcgtccgggtattcatggacttcacgtcaatcttctcttcggtaaatacctttgatacatccagcagaagtcctcttctgtcgtctgcaaatatcttcagttctgcaagatactgaccgccttcttcgagatcattatcctcccattctgctgtgatcagacgggatctctccacatcagaaagattgatgatattgatacaatctgttctgtggatcgacattccgcgccctcttgttacaaaaccgacaatctcatctcccggcaccggattacagcactttgagaagcgtactgccatatcattgattcccttaactacgattccgctctttgatttggcaatgtgtactctctgtttattcgcttctgagatcttctccaaaatattctcatccgtgatctctttcttatgctctttctcgtactcttccagcaggcggttcacaacctgaccttctttcagtccgccgtgtccgattgctgcaagcactgcatcccagtcacggaaaccgtatttcttctgaacgatctgctgatacttcggcttgatgatatccggcagattaatccccttgctcttacagtaggcactgatcagatcctttccgcggataatattatcttctttgtattccttcttaaaccatgaattaatcttgctctttgcctgtgtgctcttgacgatattcagccagtcacggctcggtcccttggaattctgagatgtaaggatctcaattcggtctccgttctgaatcttataatcaatgtttacaagcttgccattcactctggcaccaaccatcttattaccgactgcactgtggatcgcataggcgaagtcaaccggtgtggagccattcggaaggttcttcacatccccgttcggtgtgaagcagtatacatcttcctggaacagatccaggtcacctttcagcaggcttaagaactcacggttatcagacatgtctctctgccattccaggatctgacgcagccagttcagcttctcttcctgtgtgttcagtcctttcgtgttgcttccgcctgtctctttatatttccagtgtgctgcgataccatattccgctgtcttatgcatctcttctgtacggatctggatctcgaacggctgtccggaaggtccgatcagcgttgtatgcagagactggtacatattcgccttcggcatagcaatataatccttgaaacgtcccggaatcggcgtatacatctcatggatcacaccaagtgctgcgtaacagtctttcactgaatctacgataatgcggacagcgaacaggtcatacacctgatcaagtgtcttgttctgattcaccatcttcttataaatactgaagaaatgttttacacgtccgtatactttcgcttcaatatcagcattcttcatatgctttgatacttcagcaacaatctgttgcacaaattcttcacgttccgtcttacgtgcattcagatcatgaaccagctgattataaacttccggctgataatatttcagagaaaggtcatcgagttctgtcttgatctttgaaataccgagacgctgggcgatcggagcgtagatatccatcgtctctcttgatttctctttctgcttcgccggtgtcataaactccattgtacgcatattatgcagacggtctgcgagttttacaatgatgacacggatatctttcgccatcgcaaggaacatctttcttaagttctctgcctgggcctccagcttgtctttggaatagttcaactgtcccagcttggtaacgccgtctacaagaagtgccacctcttcaccaaactctgctgagatctcatcgagtgtcattgtcgtatcttctaccacgtcatgaagcattccagccacgatcgtttctttgtccatctcgagatctgcaagtatgattgccacccagagtggatggatgatataaggttctccggatttacggaactgattcttatgcgcttctttgcctatctgataggccttctcgatcatcgtaatatctgcagaaggatgatacttacgcacacgagctattaaggcctgatataactcctccggatcctgataatcctctggtgcttttactgcatgcccgtccactatctccagatttttattcagatcttcatattcccgagtgcctgccatatcgccttcccccttcattcatcctgtgttctgttcagatccaacttccaaaatgcttcatatttcgtcagtatggcatatccgacgaatgcattttagacacaaaacaccttagttctgaacaattaatatgatttagtatatcactatttttccctttttcaaataagaacttcctattctgcttcattttaagcaatttgtacggtttttttgatattatctactgataattgacaattgtaagctgaatcgttcttttccccatatattcattgaccgtaggatagtaggtaaatgacatgatctgcttcttttccatctgctgcagacagtcttccacttctccgaaataaaccgcttccatctgatttccctgctggtcctccagtctgcatttcagcacattccggttctttccgaagattcttggctggatcacacgcagtttactttctgcaaataacggtttcccattgccttttccaaaaggctccaatatcttaagctcatggatcagctcttcattaatatatggaaatggaagccgcatatcgatcgacaccttcatctgcaaatcctcttctgtcagatccgccagttcattgatccgtttcctgaaagcttcgacattttcctcttctaaagaaagtcctgctgccagcttatgccctccgaacttcgtaaataattccctgcagcggctcatttccgcaaacatatcataggcttcaatcgaccgtccggaacctttcacccctgtctctgcctttgtcagtacaaaggtcggacgataataacgttccttgatcctccccgcaataattccggcgatactttcgtgacactctggaagatacacgaccagcacctggtcgtccttccaggaacttgattcaatctgccggacagcttcttctacaccttcttcggtcatttctttccggctgtcatttaattctttcagatctgctgccagtgtcactgcctctctccggttcgatgcattaaggagttccagtgcacgcttggctgtatccagtcttccgccggcattgatgcacggtccgatcacaaatccgatatgataagtattcaggttcgctgtatctacccctgtacattgcatcaatgcgtgaagcccttcattcttcgttgtcttcagaagctcaagtccctttttcacaaagacacgattctctccaaccagatccatcacatcaccgatcgtggcaatcgcaacattttccatcaggctttcctgcagatgctctacctcctgctctgactttccagacactctgtacaaaacctcaaccagcttatacgctacagctgcgccgcacagtcctttaaatggatactcacagtctgctctgtgcggatcgaccactgcatccgccggtggcagaagatgctttttctccccattttcttccagatacggaacttcatggtgatctgtcacaacgatcgtcatcccattttcttttccgtaagcaatctcactcattgccgcaattccattatcacaggtgatgatcgtgtctacatcatcctccagtgcacggtcgatcagcatctgattcaatccatatccgtctttgatccggtctggaatatccgtatcaacatctgctccaagtcctgcaagcccctgttgcaaaatatacgttgcattgactccatcaatatcataatcaccgatcacacggattttctttccttcttctattttctccttaagaatatctactgcacgatccatatctttcatcagtaagccgtcatacagatcctccactgttccattcagataaaaatcaattgcatcatctccgatcacatcacggtttctcatcagccgtgcaatgatcggggaaatctgatatttctctgctattccattaaaatccgcctttttcattgcgacgaaccatttctccatccaaataccctcccagtctgtcagtatcatatttttttattataacaaaaatctgccgtatcgaaaatcatttttcatttccgatacgacagattttatttctgcgtttattcatcctgtttccaggctgttatttatttcttagcgttttttgctctttttgttcttgaaagaagtcttctttccttttttcttcttggagctgtcgtctgcagatgtatctgctgcgttactctctgtggaagtagttccttctttcttgtctgctgcttttacagaaaccgtctttgtgccggaagctgctctcgcagccttcgcttcctcaccaagtcttgtcttcatcacataccacagtgcacctgtgatacatacggatgtatatccaccgcagatgatacctaccatcagaggtgcggcgaattccttaatggagcttacaccaaggatatacagagcaacgaccatgacaaatgttgtaaagtttgtatagatcgttcttgtcagtgtctgagtaatacagcggtttacaagatccttcagatcttctgtacggctctttgttgccagcgcctcacgaatacggtcaaagataacgatcgtaccgttgatggaatatccaacaattgtcagcatacatgcaataaatgtatttccgacagatactcttgcgatcacatagaatccaagaactacaagtacgtcatgcatcagtgcgacaacagcacttgttgcaaaacgaatatctttgaaacggaaccagatgtaaagcagcatacagattgtagcaatgatcacagctataacagcatctcttctcatctcggaacttactgttgagctgatattctctgtagcgatatcagatgtctctaccccgtagttctcattcagataagaagcaagtgcttcacgtttctcaagatcaagtgtctgtgtcttgaagactacctgattgctgtcttttactgtctgaacctgaatgttcttatctcctgtgatctcttccaggcttgggatcatctggctgtcgatctcttccagtgtatattctttatcaaatgttacatttgttgaagtaccacctacgaaatcaaggctgtagttcatcgcaccgattcctcttgcatggttcacgcccatcatgaccggtccggccaggcaaaggatgatggaaacaatgaagaagatttttttctttccaaggaaatcaaccggtttacgttctttcagatgtcttccgtatactttctcattgcggatgcctgctccatagaatgcaaagatgatcagtcttgtgatcacgagtgctgtaaacatggatacgacgataccaagtgcaagtgtctgggcgaatccctttacagtaccacttccgcgaagccacagcacaccggctgcgatcagtgttgtgatatttccgtcaacgattgcagacatcgctttctggaatcctgatttcagtgaagcgtgtacgctctttcctgctgtcagctcttctttcacacgggcgaagatgataacgttcgcatctaccgccataccgataccgaggatgatacctgcgatacccggaagtgtcagtgtaatgtcaaatgcatttaaaaggattaagatcagttctgtgtaaaggatcagtgcaaggctggatgcaagtcccggaaggaggtatacccagcacatgaatacacatacgattgccagaccgatgatacctgcgatcagacttcctttcagagcatcctgtccaagctgtgctcctactacttctgaactaagctcttcaagttccagattcagtccaccgatacggattgtagaagcgatgttatcagcctcttcataatccatgtttcctgaaatctgagcttttccattctcgatcactgcatttacctttggcacactaatcagtgctccgtcgtagtaaatggcaattgtatcattattgttgttataagcttcttctgttgctgtcttgaacttctctgcaccctcatctgtcaactcaagatcaacaccatactttttatttcctgttgttgagtcgttgagcactccggctgaagctgtctttacttctgtacctgtcagtacgatggagtctgtatctttcagttcgtcgattgacttattcagtgtatatccggaagctgtcagggaatagttttcatttccctcactgtctttatgcttgataaagtacagtgaacccggctgtccaagttcttccagaatcttgtttgcgtcgctcacacccggaatctcgatactgatacggttgtctccaacctgataagcctgtgcctctgtgctgtactgctccacacgtttctgaagcttgtacacggtgtcatccatgtctgcctgagatggcttgtcaccttttacctgatatgtaatgctgactccgccttccaggtcaagaccgagattgatgttcttcgcagctcccattccctttaaatcaagtccaagcacacaggtcataccgaagagtgctgtaactgcgattacgagaatgaggctgagaatactcttacctttcttcatctctttctttcctttcttgactgctgctctctaactttattgttcttcatccgccagggcagcctttatcatgatcgcacattccacacgttttctctccatctcacagctcacttcgtaagtatcatggatcgtattgtggaacttgtaagaattcgccatacagccaccactgcagtagaatctggcaaagcaggttctgcagctttccttggaatatacgctgcatccacggaattcttccgcaatctccggttttgtaattccctcatcgacatttcccatgaggaattcttcctgtcctacaaactgatgacatgggtagaaatctccccaaggtgtcactgccagatactctgtacctgaaccacagccggacagacgcttggacacgcacggtcctccttcaagatcgatcatgaaatggaagaaattgaatcctcttccgctcttctcacgctcgatcaggaattttgcaagtttatcatattcttcaaagatctgtggaagatcttctttctggattgcatatggttctgtgtcatcacctactacaggctcgattgacatctgcttgaatccaagatctgcgaaatgttctacatccttggaaaaatccaggttatttcttgtaaatgtacctctaatgtagtacttctcctgattacggctctctgccagcttctggaacttcggaacgatcagatcatagcttccttttccgttacggaacgggcgcatctggtcattcacttcttttcttccgtcaagactgatgacaacgttgtccatctctttgttcacgaactcctgaacttcatcgttcaaaagaactccgtttgttgtaagtgtgaaacggaaatgcttgtcatgaagtttctcctgctctcttccataagcaaccaggtctttgacaacctgccagttcatcagcggctcaccaccgaagaagtcaacttcaaggtttcttcttgttcctgaattcgcgatcaggaaatcaagtgctttcttaccaacctcgtaagacatcaaagctctgcggccgtggtattctccctcttccgcaaagcagtacttacaggcaaggttacagtcatgtgcaatatgaagacataaagccttaacaactgtcttacgctgctttacaacgtcgataaagccctcataaatgtcttttgtaaacagacgtccctgttccgtcagttctgttactgcctctaaaatatccagcagatctttctcagaatatttctctccaagctcttttttcaatgcttctgctgtttccggagatttcaatgtctccactgtatgatcttcattcatgcgattaagcacttcgatgacatcatacgcttcctgatccacaacatgtacagctccgctgttcacgtcgaggacgatattatatccattgttctggtactgatgtatcacgtggatacctcgctttctatatgtatttgtaaatctatttgtaactgttcaaagcccggcattttcacaatgcagctctaagcagatacttctaaaacatgcttaaggcagcgatttgcaccgctgcctcacctgtaatcctgttgctgttttcgcataattgcaggcagtatcaccgctcaaagcaactctgcagcaacattatcttcactttcaggttttcttattttgcattttcgcaagtctggtttcctactgtacaggatgtcttacatgcagactggcaagatgtctggcactctccgcatccaccttttttaactgtgttgttcagtgtctgtgtattcagtgttttaatgtgtttcatttttactcctcctaacttcgcacatattgctttcgctattatagcacacacagccaggtttttaaagtattttttcacacatccctctggtttttcttcatgagaccatccctccaagcattccgcctccggtacaaagtacaaatgtcagaaacaaatcgcctgtccctgacgaaacctcacggtacattccaaatgagatgagcagtaatagaacaaaataaactacaccggttccaagcccccagaggaacttcttttggccttccagttttcccatcacaaaaccaccggaaaaagttcctattacataaatgagaataattcccagatttacattttcttcactcaatcctgctttataaaggagaagtgcaagaattaacagaaacattcctgtgaccagataggcgcaaagtaatgccttcactaaattttctgcgtatattatcccttttttcccatgattttctctcattttcttttcctttcgatgcatgtccggttttccactgatactattctatgcatcctcccggaaaaatatgacacttttaactcaactgcctcccaagcagatctgctgcgcctgccgcaaacttcttttccatctctccgaaatgctttttctcatttttctgcagaaagatcactccacctgcaatatcaccttcactgagaatcacactgattatttcctcgctgtattcactcctgtcttttgtaattgctacaaactcagcgtcactgctctttttcaacacggtctttctttcttgaaacacttctgccagctctgcactcaacagcatttcctgaagttctttcttcccgtttcctgctgccgcgatcacctgatccgtatcagtgatacagaccgtacagccaagtgtctttgaaagactatctgcatagatccctgccagtgttcctaattcaccgattggagaatatttctttaaaatcacctttccttctctgtctgtaaaaatttccagtggatcaccttcgcggatccgcaatgtccttcttatttctttcggaattacgattcttccaagatcatctatcctccggactatccctgtggctttcatggcacatttctgttactgaaaacttataaaaagttataaacttccatgtttcattcctacttcaacgagtatgcttttgatgatataaatatctatctactcacaagttcttgtactctccataggcgtaaattccggactaacgtatccgtacatatttgcattaacgtttcagtgttagcttgcaaatcgttctccataagccttgagatttatagatgcctggaaatctctgtcaatcatattcccacattcacatctataaaccctgtcagataacttcaaatcttttttgatgtttccacagcagctgcaaagctttgatgatggataaaaccgatcagccacaataagctggatccctttatcattgcatttgtattcaagctgttgtctaaacctaaaaaatccttgttcctgtactgctttggataaatgtctatttttcatcattccgctgacattcagatcttcaatacaaataaatcttggctttcgatttacgatctcagatatggtctgattcaaatagtttttacggatgtttgttaatctgtgatttcgttttaataaaagtttttcctttttgattacattatttgttttacagtaactttcccctttcttatttttctcgtaagaacgagagatactacgctgtaatctacgtttctgtttttctagtttctttactttctgactcttattgatgttcttatacttaacggcatcagagcagacagctaaatttttaattcctaagtctatgccaactccatcatcattaagtgtttccttgcagtcaggaaattctacacatacactgatccaccaattcaatccatcaaaggatattctcggattcatatatttagcatcaattggaatacgtccatgttctgcaagtcttacccaattctttttttgcttatttgctttcctgctggaagaaaaaccttcaagcttaacgtgggtattactgaattgtatcttaacgttgtcctgatagaacttcggcattgatctctttctggacttgaatcttgggaatttttgcaaacccttgaaaaagttcttatacgcagtacaggcatctttgattgcctgtttggtcacattatttgaaatatttaataaccatgcgtattcatcagaatgtctaagctttgtaaattcttttctgagttctgaatctgaaatgaacttgccacccttttcgtagttttctttttccctggccaaagcccagttataagcaaatcttgaagctcctgcgtactgaaacatcttagttttctgtacgttgtttggtatcaacattacttttatggctcttaccatctgtttcctcctgtatcaattcccggataagtttcttagctttgttcgctcgttttccttgtaatttgcaactggatactgtgattatttgaaccagatcttcaacaagttcctgctgttcagatttttcagtattatcaataatctcaatctcacaattataaagtgaagcgatatattctatcaactcaaaaccaaagctcaatagcctgtctttatataaaacaacaaccttttcaacctgattttgagagattcgtctgatcaattcctgaagcccttttttcttataatcaatcccagaaccgatatcacttattatctcaaacggctgcccttttgctagaagatatgtcttgacattatcaatctgtcgttccaaatcatctttttgtttacggctggaaacgcgacaatatccaattgtaatgcgatttttaggctttacatttattacttggttgagttgctcatcggaataatatctatagccacttactgtagtatgatgcggatgaagttttccattggcatcccaatttcgtaacgtctgagcagatacgcctataatttttgaaaattcatgtatagaataatatttactcaaagtatcaactcctttcaataatattctactctaatatcttataaagctcaacaccggcttatatgactttataatttatatttaactgttaacaacctccataatcaatttttgattagtatgtggtaaaatataggaaattatgttctttttgtgataaaatgatgtaagtgcgggaatgcatagcaatggagaaatccggttacatcagtgagtggcaaaatttacttttgacactcacatcataaaatacttaatactgattatgaaacaaggagattttaaatgaaaattgtatttttagatgtcaaaacaattggagaggatattgatctttctgcatatgatgaactcggtgaagttgtaaagtacagcttttcttcacccgaagaggtcccggcgcgtgtcacggatgccgatgtgatcatattaaataaagttccggtcaatgagcagactattggaactgcaaagaatctgaagctcgtctgtgtcacagccacaggcacgaacaacctggataaggactatcttgattcaaaaggaattgcctggagaaatgttgccggctactctacagagactgtcgcacagcacacatttgcaatgcttctcttcctattagaaaagcttcgttattatgatgattatgtgaaagaagagcgctatgtaaatgatgtctctttcactcattttgcagaacatttcacagaaatccatggaaaaacctgggggatcatcggacttggggcaatcggcagacgtgttgctgagattgcacgtgcatttggagcgaaagtcatttactactccgcctccggtgctccggcgcaggaaggttatgaacaggttgactttgagacattgcttacgcaatctgatattatttccgtccacgctccactcaacgagcatacagaaggactgatcaacagcaaagcgtttgaaaaaatgaaatcttcctgtattttcctgaatctcggaagaggaccgatcgtcgatgagcaggcattatataatgcactggtcagaaatcagattgccgcagcaggattagatgtcctttgtgaggaaccaatgtccgcagataatccattgctcaagatcaaagacagtaaacgcctgctgatcacaccacacattgcctgggcgagcgtggaagcgagaactcatctgatggaaattatccatgaacaagtcaaggacttttttgcttaagatcaatattttgtttatccctacaatttttctgtaatttgcaatcaatatttttctgtaaagtttaaagaaaataattgtaaactccgggtaaattgttttataatagccatgtacgtaattttttgcaagacgtaacatgtcaacttaataacttaagaaaaaggaaaaaagaaaatgggaattacaatggttttgtccttgctcagcggagttgccctcttcctgtacggaatggcactcatgggagacagtcttaagaaggttgccggtaacaaactggaacttatcttatacaagctcacaaactccccaatcaaaggattgctgctgggtacagtcgtaacagcgatcattcagtcgtcatcagctacaactgttatggtcgtaggattcgtaaactccggtatgatgaaagttgctcaggcaatcggaatcattatgggtgccaacattggaacaagtatcacaggctggattttatgtctttcttacattgatggctccagtggcattgcgcagcttctgtccaccgcaacaatctctgcgatcgttgcgatcatcggtatcatcttccgtacattcgtaaagaagaaaccttattccgatatcggtgacattatgcttggttttgcgatcctgatgttcggaatgcagacaatgagtggtgcagtttcacctctgaaagagaacccacattttgtcagccttctgacaatgtttaagaatccatttatgggtattcttgttggtatcgcatttactgcagtgcttcagagtgcatctgcttctgtcggtatccttcaggcattatcaatcacaggctctattacatttgctgccgcactgcctattacaatgggtatcggtgtcggagctgcctgtcctgtactgctttcttctatcggtacgaacaaaaacggaaagcgtacagcacttatttacctgctgaatgacttattcggaatgatcttctggtctatcgtattttactcagtaaatgccgctgtccactttacatttatggacatggtcatgagtcctgtcagcatcgcattgctgaactcggtattccgtatcgctacgatcctgatccttgctccatttatcagcaagattgagaaactcgtcttcttcctcatcaaagatactgacgaggacaacgaagagcaggctgattttgatctgcttgaggaacgttttttgaattacccgccgctggcgatcagtcagagccagatggctgttaacggtatggcgaaaaatgcccgcaagaatctcatgcgcgctttcgaacttctgacagactttagcgacagcaagttcaataagatccaggaaaaggaaaacatgatcgacaagtacgaggataaacttggtacttatctgatgcagttaagtatgcatgatatgacgcctgagcaggcgaaacagacctccaagttccttcatacgatcagtgacttcgagcgacttggtgaccacgcagtcaacatttccagagttgcccaggaacttcatgaaaagtcccgtacattctctgaatctgctacttatgagctgaatgtgcttgagaaggcattggttgagattgttgatcttacagtaaattcttttgtagatgaagatcttgagactgctgcaaaggttgaacctctgcgcgaactgattggtattctctgtaatgatctgaaacttcgtcacattaagagacttagaaatggtcagtgtgatctgaataccggattcgctttcaatgacctgcttacaaactacgagcgtatcgcagcgcactgttctaacgttgctgtagcgattctcgagcttgattcttctaactttgatattcatgaatatacaaagagtgtccgcaagctgaaggatgaaacttatcttacagcctttgaggaatatgaaaagaaatatgatatcaacggatatcagccggaagctgaagcagataagaaattctctgcaaaagcgaaggatagcgagaaggataaggacaacgagaaatcttctggaaagaagaaagacaaagacaagaaaaaagataaaaagaaataaattcctttctatttcattaaaaaggaacagtcccacctggaactgttccttttttgtatgtattctccttacgtgcaataccgaaatgtcttatccgtaagaattcttgcaaagatcaaccctaacggaagagctgcaacgatcagtattgccgccgcaaaccaggaagctgatgcagaaagattcattgttcccagattataaaatccacggtacagatacaatcccggaaccatgattacaatcgacggaaccgtgacagaaattctcggatatccgacctgatttttaatcatagttgccagaagtccggctgttaatgctccgacaaatgctgctgccgccggaggcaatgccgtcagatcaaccagttccaatcgcagtgtattggcaatagcaccgattcctgccgccactgccgcaaggcgtgcaggactgttgaacataatcgagaatccaaacacaccacaaaagcttgtaagtaaccggaaaataatccattcttcctgcgtcagatcaagtttcaggaaatccacaggttgtaaatttaagactagtgccatgatccatgcagacattgtagctaccaaaacaatgatcagtgcatacatgagtcgttccatgccagaacgcatgtccaattttgcaaggtcaattccacttgtgataaaagggaaacctggaataataaatagcattgcacaaatatatcccgcctcatgctggattggaatcgcccacaaaatctcagctgctttcaagagtcccgcataaaccagacaggctgccgaaacagatgaggctatacacaaaaataatgtgaaatgatgtttactcaatttgcacctgataaaatttccaatcccggcaccgataaatgcacaaaacatttcaattggtccaccaccaagcagaaatgtaaatccgccacacgccaatgctgctgccattcccaatgcaattggagaatatagtccatgaatctcttcaatctgatccagcagcttatgcagttgttcaccagacatatcctgtccgccctgttcgaactcacggataaagtgttccagtctgtttaacttagatgtattcacgcctgtattcgtcagacacaaagactgcgtgaatccatcgtcaccatcaaaacaggtatactcaatcgacatcagaccaatatctgctgtgcaggtaatccccatctcttctgccagagcattcatagagcttctcactctccacgctccggttccacaggagagaagcataatccccactcttccgacaattgaagctttctccgttaaacttgcctgtgttaccggtgtttcttctccacctttatctgtatattcatgccagagaatatccatatgattttttcttattttctgtgtctgcatctcattcacttcctctttattctaggtcaaggctttccgctccggcctttttcatcatcttctctctgcatgaaagaacaatcccatcaatctcatccagatgatgaagcattcgtttctcaaatccatgaattggaagtaaaactcctatctcgtcaaatcctttctgacgcttctcaccggtatcctgcccataataaacttccactctcggagcctgtttctgaatcttctggaaagtatcccagacaactgcataggcctgtgcttctgtcagtccaagctttctggtatccggtaatgcatataacgccatcacgccacgcttcttgttctcttttttctcctgaatctgcatgccctctgtataggaacgaactatgtcatatccgtcagcaagatacagttttgatctcggtgcacattgatgttgcctgtacgtctcatggaacttttcatattcatgagctgttacttcccttttcttactctccagaagctttccctctacatcagtcaggagaaccggattctctcctgattttccatgaaatttctttggaatcagatatgcgtcccgaagcagatcaaacatacttcctccgcacaattcaagtagcaacgcgctgacatctccatttttatacgcctggagcaagacctctgcaaaatgtctgtcgccatcgtcatttatctcctgataattttccaaatgctcataaaatacttcatttagccgatcacaggcctcttgtgactcaagaaccttagatataactccttctacagcttcttcacgtggtaatactgtctgcatactcacacttcctttgttatttcttgtttttcacctgttaaaacagaataaaatcctacttattaatatagaaagcgccggttctaaagtcaaaccggcgcatactgttttattcacatatctgatatatattttctacataggaatagattgaatccgcaatatcttcttaaacaataccttatttcagaactaacatttttttgaacatctccgccgcaatacttggcggaaatgtgtgattctcaaccagacagatttctctttccggaatattctcctttagtggaatctgacagacctttccttcctcgatcactggtcttacgaacagctccggaaggaatccaatgcccagtccattcataataagcggcaacacctgatcgatcgtctcaacttccgtatccggagatagaaccagatcattctccaggaaaaatttggaatagaactcataggttgtgcttccctgcccaagagaaatcaacggattctcaattaagtctttcagccttattggtttttctttcccctgaaaagaatgatctcccactgcaatttccttaaaagacattaaagaagtacttttcaacggcttctttgcctgaagcggcgtagtcacaactgcaaagtccgccagtccgttcttgacggactcaactgcctccggcgtggaatgattcagaagtctcagccgaacacccggatattgcttatgaaagcgccccagtataggaagaagtaaaagatgaagtgcaatctcactcgcactgatcgtgatacttccgctctccatgcttcgctccattgcaagttccgcttcagccgcatgaagatgctgatatgcaacagaaacatgctgatacagcttctctccttccgctgtaagcgtaactcctcgattagatctgacaaacaatttacacccaagctgattctccagattattcataaaatgagtaatattcggctggttgctcatcaatactttcgccgctttagaaaagctcttatacattgctacataataaaaaatccggtaataatcgtaagtaatttccataagttccccctaaactgacactaatctattactctccacctgcagaggtgggagtcaaaccacatccgataaatcatataaaaaatatatatctgttataacaaatatgtatttttatttctttgttatttattatatactgaatgacgaaaaaatcaaacacattcatttacgaggggcgatatcatgatcaagcaaaacattaaatttctcacaaccggacaatttctcactttttcacacacttgtaaaaatctttcttcggatgtgcgcatccaggatcttgagaaccacaatcgcgtagatatcaatggaaaagagctttctgaacttgccacgatccagcttggtcttccgtttctcctcgttattcatggagaagatgaaaaaatggccagaagaatgttgaagaaatattgtgcataaaaattgagttgccgtttacactctgtataagcagcaactcaactcttattactctccccaaacttcttctgcaatttctttcacaagctttaactttgcccattgttcctcttctgtcagtttgtttccgatttcacaggaagcgaacccacactgtggactgagataaagtctgtctaatgggatatattttgcagcttcatgaattctcctaatcacaatttctttctcctcgagctgaggtatcttcgttgtaattaaccctaataccacttttttatccggagatacctttgcaagcggagcgaatccaccggatcttgcatcatcatattcaaggaataatgcatccacattttcttttgcaaagacataatctgctacagaatcatatggtccgcttgtaaaaaatgttgaatgataatttcctctgcaaatgtgggaagtgattaccatatcctccggttttccttccagtgcaaggttattcacttcaagaagctcttttttcacatcttcaatatccgttccaagaagtttgtatctctgctttgccgcatctccgacaattgctccccaggtacagtcgtcaagctgaagatttctgcatcctgcttcatagaactgacggatcacttcctgataagctgttccaatgtcgtggatcagttctttgtttgtctcataatattttctcgtatttttatagttgaccggaataatcatctgctggaacatctgcgccggcgccggaattgtatattttgcaactgtgttctcatcctcaaactgtttcaggaatttgaaatgttctacaaacggatgcgcctttgcctttatctttcctgtcagataagtatcttccagtgatgccagctctccatcaaactgtaccccgctaccggtctgttcatgaccgacaccttcaaatccccacataaaatccagatgccagtaagttcttctgaactctccgtctgtgatcacatgaaatccaagctctttctgctttgctacaacttctgtaaccgctttatcaatgatctgattcttttctgcttcgctgatctttccttcctgataatctgcattcgcttttttaacctctttcggtctcaaaaaacttcccacaaaatcgtatctgcatggtgtctgatatttgctcataaattaattctccttttatttttgtaagtgatgttttatctgcaatcatcttatcattccatgcttattttgaaaaatatataaatttatgcgtttgtcatagtttgaagctatggtgagtaaccctctattatatttatgggctatcactccacccaaaaaacataatcatcttttcttggtttcgcctctgctgtttcttcatccggatacccaagtacacagtgtccaataccttcatactctcctgtcactccaagatcagacagaatctgctttccttcttcactctcaaactcttcctttgcacgatgaatccaacaacttccaatcccttctgtatgtgctgccagcatcagattacccattacaagacttccatcatacacatgtgttggccagtctttctctgccagtacaaccaataccacaggtgctccatagaacggatcaaatccttcgtcccatccaccaatcttacgattcatctctgaaagtttatcccgtaattctttatttgtcactgccagaataatagatgcctggtgtcctcttccatttgctgcataagtacctgcctctacaattcgctctattatgtctcttggaatcatgtcagttttatacttgcgaacacttcgtctgttgatcattgcttctcttgttgtctctacttgtttcattttggattccctccctgttgatttctttcattgatgtattgtttctaataagaatactacacctattatacattatcaagaattgtatttaacaaaaatggcgaagcttacaccttactggtacaaatcttcgccatttctttcactttttcaactatatttctttcacccttgatcaaatcacaagaatctcatcctgcaccggtccatacactttcgtttctccctccgaagtaatatgcacatcatattccagtctcacaccatacttctctgtatacagtcccggctctatggaaaacatcgtccccggaagcagacagcggtcatcatgtgtttcataatcatccagattggcaccaattccatgacatctgtgaccaatattatgtcctgtccggtgcatcagatactgtgcacatccaagctgttcgaatctttctttcagccttcgatccacttcatatcctctgactttttctcctgcatctaatctcgcctgaataaactgtcttgcatcttcccgcgcatcatatacgatctgaaaccatttctcatactccggatcaatcttttctccgacattcatgcaccaggatacatcataatataccgcatcctcttccggaagacgtccggcaatatctatgatcaatctgctgccttcacgaatctgcctcgaaccattttctttcggttcatatcccggatcacaggcatgctcatcaactccgaaaaacggcggagaatccatatagatattctcctgccctatcagttcctgcatctgctgaagcatcgcatactcatcaatataattacctgcatctatattctctctgatccaagaaaatgtatcagtaagaatcttatgtatgataactccagcctgtcggtgtgtctcgatctgatgttccgttagtaccgcaccgaaatgctgcatcatatctgcacttgtaaccggttcgattccgtaagttctaagatactcgatcaggccagcatccatagagctgatcgtcgggacatttccgcccggagagtactggcaggcaatcttcatgcccggcttcaataactctgacaacactttcttctgtccttcaattccatgatataacattttctctcccagaagatgatcaaggagatgcggctcaattactgaaagcaccttgactggttcaccctgcgtcggaatcagatagaacagccttcttgtgcagaaacgatttccaagttcaagaaactcttttgtaatataatcatgtccctgaaaatctgtaaataaccatccgtctagttttgcttcctgcaataatttctgtatctttgcaatatccaacttaataattctccttttgattgtccggcttatgtgctatgacattgacatcctgtactcattgattccttatgctccaaggattctcttgtaagctttcttcaccggaacatacagaatcgcaattcctactactgtgaatccggcattgataattgtagccgggatagatgtaatctctgctgccaacgctgcactccaggaacttccgagaacaaccagttcaactgttgaccagataaagtctacgataatgttcgtaacgccgtagatagccgcacagaggactgcataaccatattccttcttcgcatctccctgagcttttttcttcagagactgaaagatcatgcccacaagcagacatttgataattgtgctgacgaatacattcgggattgcctgaatataaccgttcaatacatcaaagacgagaagtccgagaactcctgccacagttgaaagcttaggtccaagcattaatactgcaagcattacgaaaatgtgtccgaaatgcagaaatggtgttccgacagccgccggaagcggaatacggaaagactggattcccagataaataatagctgcaaaaaatgcagtcattacgattttctttgtgctgatactttcgtttttcatattttgtaaatctcctgtttgttatctcttatgttgagtaataatctgacagctaatgtcagacttgtaagtgaattttcccaacataccgccttattatatcagcgccctggtctgttagatatatccagttttaaaatatttatgcaagccagttttatagttatataacaaaacaagtaaaagcaacacagaaaaaaaacgtcccccggggaaatccccggagaacgttttctttcaacttatattcttaatgtcatccatatatggatgacaaaagtattacagaagtcctccgatagaaaggaacagtggagcgaatacaagtgatacaactgtcataagtttgatcagaatgttgatagacggacctgatgtatccttgaacggatctcctacagtatctccaacaacggctgccttatgagcctcactaccttttccgccgtggtttccttcttcgatatacttcttagcgttatcccatgcaccacctgcatttgacatgaagatcgccataagaactcctgttacgagggatcctgaaagaagtccgccaagagcgtcaactccaagaagaacacctactactacaggaacgataaccgccatcaaacctggaagaagcatctcgtgaagtgctgctgttgtagaaatagcaacgcatgacttgtagtcaggtttctcttcacctttcatgatgcctggtttctcacggaactgacgtctaacttcctcgatcattgaatatgcagccttagatacagactccatagtgaatgctgagaagaggaatgtaagcataccaccgataaagataccgatgattactttgtagtcaagaaggttgatggatttcagacctactgtctctgcataagatacgaacagcgcaagagctgtaagtgctgcagaaccgatagcaaatcctttacccatagctgctgttgtattacctacagagtcaagcttgtctgtaatgtcacgaacggactcatcaagaccggacatctctgcgataccaccagcgttgtctgcgatcggaccatatgcatcaactgcaacagtgattcctgttgtagaaagcataccaactgctgcaagagcaattccatacagaccaaatacattataagaaacaaaaatacctacacagatcagaagcagcgggatagctgttgatttcataccaactgcaagaccactgatgattgttgtagctgcacctgtctcagactgctctccgattcctttaaccggtttgtaatctgctgatgtgtagtactctgtgatgttaccaatgataacaccaacaatcagaccagcgataactgcgattgctgcgttcatgtttccgaaaagcacccagctaagtgctaaagaagcaatgattacgattgctgaagaagcatagcttccttttgtaagagctttctgaggatttgtgttctctccgcctcttacgaagaatgttccaaggatagaagcgatcagaccacatcctgcgattgcaagtgggaataatactcctgaaacttcgcttactgcaacaccaagtgtcagtgctgagatcagagatccacagtaagactcgaaaaggtcagctcccatacctgctacgtcacctacgttatctccaacattgtcagcgataacagccgggttacgcggatcatcttccgggatacctgcttctactttacctacaaggtcagctccaacgtctgctgcctttgtatagataccaccaccaacacgtgcaaacaatgcgatggaagaagcaccaaggctgaatccgaataatacatctacattcttagttacgatgtacacaaggctgacaccaagtgcaccaagtccagcaacacacatacccataacggcaccacctgaaaatgcgatggaaagagctttgttcattccgctctctttagctgcgttagctgttctgacatttgccttagtagcaactgtcattccgcagtaacctgcgattgttgagaacagagcacctactacgaagcaaactgctgttacccagttacctactcctaatccgatcagtacgaaaagtactactacgaatacaataaggatcttgtactctgctgtcaggaaagcacgtgcaccatctgcgattgcaccggcaatttccttcattctttctgttccggcatcctgtctgctaacctttgctgcaagatatgctgcaaaaagaagagcaatgacagctgcaactggaaccagatacatataattgttcattcttaattttccctcctgaatttcaatatcatatgtttgtattacactatatcacatttttttagctttttaaagaaaaattttatatttatttaactctctttacataaaatagtatttttttcacatttttcttttcaaattatatgataatctaaaaaatttttaggtaatttttaccatcctgtgttgttttttacgctgttacttcttattaaatatagtagtatataagatttcaatcttatttataaaaaaaaattattcaaaaaatcgttcaataatcataaaaaataatctccggaaaaacagtctttactgcttttgggagattattttttttactcaagtattattctacatctttcaatgcttcaagatcttcttctcctgtacgtacttttactactttctgcacgttgtatacaaagatcttaccatcaccgacatgtcctgtatacagtgtcttggatgctgtttcgatgactttctcaaccggaatatttccaacgataacttctacttttacctttggaagaacggttacgtccatctcaactccacgatatttctcgccggcacctttctggataccacatcccataacctgggtaactgtcattcctgtaacaccaagattgttcaacgctgatttcagcctgtcatacttggaaagctttgcgataataactactttatgcattcctgtatctgcatctaccggtccggctacaggtacagctgctgctctctggattggagatgctgcgtcataatctgctactccaagatctgtgttttcattttcattcattgcaccttctgtaatatccatgatgctgaatcctgcatatgctgatgcaagaccatgctccttggaatccagaccaacaatctcttcttcctctgaaacacgaagtccaattgtcatatcgattactttgaagataattgtcattgttacaactgtccaagcaagaactgttactacaccaagaagctgtgttccgagaagtccgaatccaccgccgtagaacagacctttcagtgtgctttccggcgcatttgttgttgcaaaaagaccaactgcgattgttccccagataccatttaagcaatgaactgctacggcaccaaccgggtcatctacatgcactacattatcacagaaccaaacgccaaatactacgagaactcctgcaactgctccaatgatcagtgctcctaatccatctgtcacatcacaaggtgctgtgattgctaccaggcctgcgagggatgcattcagacacatagacacatctggttttccataacgaagccatgtgaagatcatacatacaacggttgctgttgccggtgcgattgttgttgtcataaaaatagatgcaagctgtgggcctgttgttgctgccgcaccgttgaatccataccatccaaaccagaggatgaaacatccaagagcacctattacgaggttatgtcctggaaatgcgtggacttttgttacttttccattcttatctcttgagaatttaccaattctggctccttccattgcagctccgataaatgctgttactccacctaccatgtggattgcacaagatcctgcaaaatcatggaagccaagctgtgaaagccatccgcctccccagatccagtgtgcttcgatcggatacacaactgcggagatcattgcagaataaatacaataggaaagaaactttgttctttctgccatagctcctgatacgattgttgctgctgtcgcacagaaaaccaggttgaatacaaaattagaccagtcaaagtttgcataatctgtaaagattccaagtgttggaactcctaccagtccgccaagtgcatcttccccgagtaacaatccaaatccaaggaaaataaacacgattgttccaatacaaaaatccatcagattcttcatgataatgttaccggcattctttgctctggtgaatcctgtctctaccatagcgaatcctgcctgcataaagaatacaaatgcagctccgatcaggaaccagatgccgaacacttctgttccgactgtgtctgtaatctgagtaataatttcttgtgtcatactacttcctcctcatacctagaaactaaaaagacgtatcttacagtttcgttgaaccatccccctgaatcggttctttctgtaagacacgcctttgtgtcattgagacttgctgctgttcgcggcaaatctgtaggtaccatattttattaaaagaaaaaggcactctgagatctgtttctcaaagcgcctttgcttttatgtcacgtagtttactccttgagccaaatattgtcaacctatatttttatttttcgtaaattttctgatttttcattctttttatgcatttctttcatatattttcacaaaacagagtgcactcttgcaatataaaccaccatctgctaaaatttatcttatgaatcaagagcaatccgctcttttcaataattgtaactatttcaagcatattaaattataaggaggactctaaaatgagcaaaattgatgaaatcagaagcgctatggtcgctgcaatgaaggcaggagacaaagaacgaaaagccgcactttcctttctgctctcctctctgaagaataaagctatcgacaaacgtgccgacctgacagaagaggaagaaggacaggtaatcttaaaagaaatcaaacagttaaaagaaacaattgatatgacacctgaagatcgtacagatctgattgaagaggctcagaagcgtcttgctgttcttgaagaatatgcaccaaagatgatgagcgaagatgagatcaaagcagtgatcacatctgttcttgcagatcttggtatcgatgctcctacagcaaaggataaaggtaagatcatgaaagaactcatgccgaaggtaaaaggcaaagctgatggtaaagaagtcaatcagattcttgccggcatgatgaaataagtacagattccagaataaagacgtagcaaagagggtgtcgcactaaacgacaccctcttactttttgttaattatttcattttttctgcttattttgttatctgttttcccacttatgataaatcgcctcaagtgcatctaccgcaccatcgattccaagaagacttgaattcagcagaattgcattcgcttcaatactgccccacttacggtctgttctaccttcataatacaggcgtctctctctgtcaatcttcttaatcttatctacagcctctttctcggaaagcttatagatatccatgattcgattgattctatcatccttataagcatagataaatgtattcacaacatttgaataatccccaagaacataatctgcgcagcgtcccacgaagattccaggtccacgttctgccagcttgcggatgattgctgactgcgtctcaaaaactttgtcactcaatggcttctcggcctcaggactaagcataaatgttgtgtaatcacccattccaatataatagcttgataacacatttcccagtctcatctcatctactcttccagcatcttcgttcgaaattccaagatctcttgctgccattcgaatcagattgtgatcgtaaagaggaatgttcagtctctctgccagtctgtttcctacttcatgaccgccacttccgaactgtcttccaattgtaataattgtgtgattcatcataagcaagtcctcctttttctgataattctattctatcactctttgaattaagaaaaaagactttcttcctgttttccgctaacaattttgtaatactgtttcgaagtcaccatgtagacaatgatatagaataatgcaaatactaaataggagcacactgtcaccagaatcaggaattttctgtcagaaaaagcaagcagatgcaccattttttctatcattggaaatgcaaatgccgtatgaattccggcagccacaagaggcaggaagaatactgtcattacctgagaattgatcgtctgacgcacttctttctgtgtcatccccactttcatcagaatctggaatctgtcctgatcctcatagccttctgtaatctgtttataataaatgatcagcaccattccaagaatgaatacgactccaagaaggattccaaggaagaacagaccgccgtacaaagcctggtaatcagctcttgatgcggctctgctgtctgtagaagctccaaaaaatagggtatctgattcctctgattcctgttcagccaatgcattgattttcttgtcaatctcgttttgaatctggatctgctcttcatctccacaggacagatcaaaattgtagtaccatttctcataagaaccattgacaccgtaaacggaaacatttccttcttccaaagcttttatatcttccagtccggaaaccaccagatagaagctgctgttcatatttgccatattatttccatttgaaatcattttatccaaatgtcctttaatcctccatgtcccggaattctccaccgtgatctgatcataggggaaatcggaatctttcgcatacagatacgcttccccgggagcaagctccagattcgtccccatgatccgattatacgcttccaacggcagagcatagaacatttttaaatgatcaaatgtattcactccattgactcccggagcattctccggattaaaatagatttcattttttgaaacaattccactgactgtaagcatccggtaattctccggattctccgcggtctggttatgttctttcaaaaccttctgtacaagctctataatctgtccattctgattctctttcatttcttccgtctgctccggtttcgtgtacatctcaatctggacagatttcggatatcgaagattcaagccatgttccatactcagatacaggctggttgtagaagataccataaccagaaccattgtggacagaatacaaatagacgctaatcctgccccatttcgtttcatacggtaaatcatggatgaaagtgaaacaaaatgatttgttttataataatatcctttctttttctgcattattttacaaaatgtgaccgagccggcaataaataacagatacgttgcaaggattaccagcacgacggcaaccataaaccagatcatcgctacaagcggatctttgattgtcagggataaataataagccacaccaagcagaagcaacccgagtactgcaaagatccagtttgccttcggaggtttctcccctgtcttctcacttcttaaaagttctacaggttttaaccgatagacagacacgatcatccgaagcatgatcaatgcaaaaatgaccaggaataacagtgccgtagccacaagtgccggaacactgattttcatagaaagtccggcattacttccaagtatcttcgctgccagaagttcccccaatttagaaaacaggattcctcccacgattcctcctgcaatcgtcagaacactgatgatcagattctcaagaaccatgatttttacaaggtcaatttttcccattccaaggatgtgatacaacccaaactctctctgtcgtctgcggatcagaaatgaatttgtgtaatacagaaggatcagagaaaagattgagatcacaccagaaccaaatccaaggatcatctgcatagtatccccacctttgatcttggcaaactgcggactcactgcaagataatcgatcagatagaacatcataaccatacagatacaagtgatcagataaggaagatacagcttcttatttttcttaattccattaacggaaagtttcagataaagtccacttttcattgtctctcaccacctgtcgcaagcattgtcagtgtcgctgagatattctgatagaactgttcatctgtctgttcgcctttatatacctgatggaaaacttctccgtctttaataaataacactctcccggccttgctcgctgctttgacagaatgtgttaccataaggatcgtctgtcccgattgattgatccgctcaaataccccgagcaattcatccgttgatttcgaatcgagtgccccggtcggctcatccgccaggatcagtctcggatctgtgatcagcgctctcgccactgctgcacgctgcttctgtcctcctgatacttcatacggatacttctccagaagtcctgcaattccaagttctttcacgattggcatcatcctgacgttcattttcctgtaatcaactccctgcagtaccaatggcagtaagatattgtcctttagattaaatgtatccaaaagattgaaatcctgaaatacaaacccaagatgatctctcctgaacttggacagatccttctcacggattgctgataacggttttccatccagataaacttccccttcagttggtttatccaatgctgccagcatgttcagtaatgtcgtcttccccgagccactctctcccatgattgctacatattcgccctcttctactgagaatgttaccttagagagtgcctgtacctgattaccgccaaaacgcggacggtatatttttttcaaattttctacttccaaaactgtcatttcttacgacctcctcttctttctttcaacatcctcagtataacaatacagccagaatgccaacattgatttctgtgacattccagctgtctgatgtgacaaatttgtcacttgcttctctctgtgtgatttagtgatttactctgttctcaacggatactctgccaaatcaatcgtaaaactgctgccttcccccaactttgactcaactgtaatctgatgccccagtttctttgccgccatctgactcagatacagaccaattcccgttgatttccgttccattcttccattatatcccgtatatcctttttcaaagattctcggcagatcttccggtgcaattcccattccggtatctgtaaccgtcagtttcttttcttcactaacagtgatcgtcactgttcctttcagcgtatacttcactgcattggataacaactgttcaataataaacgaaagccatttctcatctgtcagaacaatctggtctgtcccttcatagatcagacggattctccttcgaataaactgtcctgcatatttacggatcgattttcttacaatttcatccaaaggatactgtgcgattactagatccttcgtgccactgtcaagacgcacatacccaagtgccatctccacatactgctccacccggaacagttcggctttcagattctgattcgtctcggtatcttcctgctggagtaatacattcatcacagcgatcggtgctttaacctgatgcacccaggttgcataatagtcctccatgtcctgaccggacttctcccatctggcatgttcttttctttgctgttgttcttcttttctgattagctcctgatatcctgactcaatcccatcttgtgcgattggaagcgaatcctcataaggtccttctccttgcagcaaatgctccagcttctgcctggttttcttataccgcaaatatccacaaagaagaaaaagtaatccaaacgccagacacaacactgtcggataaaccgctgccttcagattaatctcttccaacacaaaaatcaggaaaaagattcccgcacacagcaaactccacagaagcacaaagcggatttttttcaaatattgtaaaaacatttttactccttctcgatgatgtatccaccgccgactttcgtcttgataaagccttccagtcccgctttttccagctttttccgaagtcttccgacattgactgtcaatgtattctcttcgatataattgtctgtctcccacagctttgtcatcagcgtgtctctgctgaccacgcgtcctttattctccatcaatgtctgcaagatacgaaattcattctttgtcaactcaattttttctccattataggtcattgttgtatcatagaggttcaggattgctcctctatgttccaacatcggcacttttcctgacaaatcatacgttcttctcagcagagcctgaatcttcgctgtcagtacacttaagtcaaatggttttgccacaaagtcatctccgcccatattcatcgccatgataatattcatattatccgctgccgaagagataaagatcaccggcacgctcgatatcttacggatctcgctgcaccagtggtatccattataaaaaggaagcgtgatatccaaaagcaccagatgtggaccatactctgcaaatgtctcaagaacctttgcaaaatcttccacataacgtgcttcatttccccacgcttccatctcttttttaattgcccctgccatcacaaggtcatcttctatgattagaatcttatacattctgcggattcccctttcgctcttatccactactatatatcatagtatacagtatttcaagagcacacggtcataccgtatccggcgagataacccgctggatatggattgcaagaaatccgatttcttcttttgcgaccggttgtttcagctgtctggacatatagtcacacactctcttcgccacctctccggtccttgggtaattctgaaaaatgaaatcattaaagtctgcattcgtcccttcccccttacgggttctcagaatcatataatacatatgactcatcagacgtgtacacccaagtgagccgctctccagcttctgatcgaattcctgttcaatcatggcaatcccttcatttacaatcctggtcgcatccagagtctgggatactgcctcatctgaaagacctgcatggatatgtagcgtaatgaatccgacttcatcctctgagatttcatatcctgtcagctgctgtataatttcccgccctttcagggccacttgatactcctctccaaacaacacacggatatccggtgtaaatggattcggaagctggcggttctccttcgctctcttcgctgcaagcgcaatatgatctgccaacggaagcagcatctcatgattgatcttctgaaacacgttctctgcttcttcaatgatctttcctgttgcctcaataaactccgggcggattccattgaccgttttcagaacagactcctgcttccttcttgtgacaagagaatatactttggctccgggaagtttctcgatctgttctgtaggtttctttccaaatcccacaccgtttccgagaaggatcatctccttccctgtctcaacatgatatacaagaatcccattattattcagaactttaatgactcgatacatccccccggagcctctctttctttctcttaattcaagcttacgatttctgctgtcttctcaagcttctctacttttccgctcttagacattctgatctcttcaccttcctgaagacttgtaaatacaaccatacattcatcggattttgcatgctcttggatatattttatatcaaaacctatcagtttgtcacccttttttactcggtctccgtcatttacaaaagtttcgaatccttttccatccagatttacagtatccacgccaatgtgaagcagatattcggttccgtcatcactagtcagaccaaccgcatgttttgatgggaagataaaagatacagttgcatcttccggcgcataagccattccctcttccgggcgaaccagataaccgtctcccatcattttccctgcaaatgcttcgtcacacgcttcttcgatcggtgctgccactcctgtgaatggagagcaaagctctttctttacagttccggctgcaacagttttgttctcatctttcttcgcttcatcttttgtttctgcacatttattcgtttcttctgcgctgttttcgttttcttccggaagatattccacattcggagctttctccagataatcttccagattggatttaatcacagaaacagccggtccgtagattacctggattccctgtccttttcttacgattccggatggggatgtcattcttaagacatcttcatttaccagttccggctttactaccgtacaacgaagtcttgtcgcacagcagtctacatcagaaatgtttttctttcccccaagtcctcttgtgatcagtgcgctcttctgatcttccggtgtcatttcattttcagaatctgcatcatttccatctacttttgctttataatcagcttttgtatatagcttcgtttccgcatcatcatcttctcttcccggtgtcttcagattcagcttcagaatcaaagtacggaagatgatataatataagaagaaataaataattccaaccgggatgattctgatccagcttgtcttagcatttccctgaaggataccgaaaaggaacagatcaataaatccaccggaaaatgtaagtcctactgcaatatttaacatatgtgcgatcatataagctgatccggcaaggatcacctgtaccacaaaaaggatcggtgctacaaacaggaatgagaattccagtggctctgtgattccggtcatcatacatgcaagtgctgcagaaagcagaagtccgcctgcctgtttcttcttctccggttttgcacactgatacattgcaagtgccgcacccggaagaccaaagatcatgaagataaattcaccggaaaaatatcttgtcgcatccgcactgaaatgtactgtggacggatctgcaagctgcgcaaagaagatgttctgaccgccctgtaccagctgtcccgcaacttccattgttcctccaaccgcggtctgccaaaatggaagatagaatacatggtgaagtccaaatggaatcaacgctctcttaataataccaaagatcaatgttccaatataacctgttcctgttacaagtccgccaagtgcatagattccattctgaacggttggccatacaaaatagagtacgattccgacagccacataagtcaatgttgaaataatcggaacaaatcttgatccactgaagaatgacagtgcattcggaagctgaattttgtaaaacttattatgaagtgctgctactccaagtccaacgataataccgccaaatacacccatctgtaatgtctggattccgcagacacttgtcacagttccttccagaactccggctccaagcgttccgtctgcaagaagatctccacggatcagaagcatggcattcattgttgcattcattacaaagaaagagatcattgccgcaagtgccgcaacttccttctctttcttcgccataccgattgctacaccgacagcaaaaatgatcggcaggttatcaaaaataatacttcccgctttgctcataattgtgagcagggaattcaaaattgtcccctcgcctaaaattgcctgaagatgatatgtctcaatcatcgttgcatttgtaaatgaacttcctactccaagcagaagtcctgctaccggaagaattgcgattggaagcataaaacttcttccgattctctgcaatactccaaaaatcttgtctttcatctgtaatcctcctagtatcatttcttatagagttagcgcaacaaaaaaagcataaactaatcctcaataacgaaatccaccttatctggtgaacttattaaggatagtttatgcctgctttaccagtaacactctatcgtgcgcttttctcttttaaccacgtatagtataaccatactcacttccaacagtcaatctgtaatattcaacaatatttatcctgtttttttgttgaatatgttacttagtgattattttagtaaattaaagtttttcttttgattcaaattaacttctcttcattttacgcttctggcttttgcttatttgcttttgtaatatccagacgtacattcacaccaaatggattgattgcaactccctttgcatccgggatcagtatctccggaatcttatccgccgggattgctgctgtcttcatcttcttgccctgtgcaaatctggtaaattctatcatatctgtaaagatcggctgatacagacttccgtccggctgtctcagaagtggaacctgattatcttcctgaactcctacgataaaggttcctttcttataatgcgccatcatctcttcctgaagttccttcacattctccggcatctccggtccgatattgcggtgcatctcctgcatcagatacattgctgtcagatgaagctccggattctcgatcagtttctttccgtcaggcagttcttccttattcttacgaactacaagctgttccagctgaaccctgatctcctcctctgtaccaacattcactgccagtgcattcacgcccattgtatacaggtttgtaaaaaatccaagtctggcattcttttcaatcttggcaattcctacatgataacgatcttctgcaagcgtctttgccttttcctttgcagactcttcctgataataaaccagaacctcgtcatcaaatgtctcttcatcacagaggacaaacggcatcttcgtcacacctgacatgatcacataaatctcttccagatttcgcagattcaccaatgcctgcttcatctctgtactgacaattactttattctcatccatctctttgttttcctttctggttgcttttctttatattaatgtgagtgtcaaaagtaaattttgccactcactgatgtaaccggattgctccattgctatgcaattcctgcaatcctcataaaatgaggtataaatatgatacaccctatgatcacagccatgattgccgtaaaaagcactgcaccagctgccgtatccttcgcgatcttagcaagtggctttctctcttctgtcacaagatcgacaacagcttccactgccgtattcacaagttccagtgagatcaccattccaaaaaggagaagacagatacaccattccatcggtgttaatcctacaaaggttccaactgctgttacaagaatcactgcaaggcaatgaatcttcatattcctctcttttgaaatccctgtccagattccttcaaaggcatagccaaagcttttgaataaaggctgttttcgattcttcattcgtagtctcctttcggattcgtatcatagatcaagcaacaaatctaatatctatgataccacatctgactccttatcaaaagaggtattttcctattattatcaaaagaatactcggatttcgaatcgcatatccttttcacttatttacaagcttcaaccatactctttacatattctgcaacatacggcacgcagtcttttccgtatttctcacacaacttaacgattgcacttccaacgatcgcaccgtctgcgctctgacacatcttcgccgcctgctccggagtggatacattttgcacgatttctttcagatactctcttttatatcgataggaaatatatgttttacagccgcagtgtgcatcctaaacggagcattttttatatattaggaaagcactttcctaatatataaaaaatccttgacagaatattcctattctgtcaaggacggtaaatctaaatcttttccgcgaaattgtcaaaaaattttctcaattttcttgtctttattttctttttctcttccatgaaaatccgccaactcctgctccgagtgaggagaatgcaagtcctaataagccaagaacatttgccggatcacctgtctttgcggcttttgatccacttgttcctttggaagctgatccatccgtagttgttcctgccttctttgtaacagtcggagttgcacttccattctgacttcccgcctggtttccattctttacaagtgctttgattgctgcatttaacgcatctgttgctttatcaactttttcctggctttcttttgcatttaatgcgctcttagcgtctgtcagtgcactctgcaatgccttccagctgtcaactgtgtaatcagcttctttcagagctgccgcatcactgattactttctcaagggaagaagtatcaactgctgccggctcttctatcttaacaagtgcttcaacagctgcgttgaggtggcttactgcctcgtctacagttgcctgagtttttggatttttcaattcatcttttgcttcctgaagttccatctgcatagatgcccagctttccgctgtgtattcagcttctttcagggcttctgcttttgcaatagctgcctcaagctctgttgttgtgattgttttatcctcagattcttttacaatgttctcctctgttgcctggaatttgtatgtcacgtcattatatccaagtgctgtcagtgtaatggtccaatatcctgttccatccgttccttccggaagtgtacaacgaagagaatctgtcagtccaagctggattcccattgctttgtgcatccagttatctgctgcaaattttgttccataagtagcttttgcatttgtatatgtgctgtcatctccatagtaagtccatgtaacagtctggagatttgatccaagatcaccataatttcctgtcagatcaactcttaagaattctccataagatccgcttgcttcttttactttcagccctgcttcctctgctgttggtgctgtcttgagtgcctgatctttgattccggactctgatccattattcactcttgcagagaaactgaaagatccatcctcattctttgttgctgttttcagaccgtttgtattctctgttacattggcaaccagtcctgtatagcttaccagattcttttctgaatatcctcctgcaagttcacttccgttttcgatcacacgatagcttgctttcagtgcatccagatcagatgtttttactttcaccggcacatatttcagtccgagtacatcatactctgtcatctttgttgttgcaccggattcttctgtgatctctcctctgttaaatgtaatcttgcttccgtctgtcagaactgcagtagttccatctgtccagtactctactgcatactcttttccattttccgccttgattactgcgttgcactggaaagaacctctgtgaagtccatgatttactgtagctcttgttacagtatcgaatgcacccttgtcagactctccttttgaatcctttgcatctgaagaagatgtatctcctgctgcctgcacattttcagcagcccagtactctgcccagctaagtcctacatatgcgtaagtatactcactctcctgtgataaagtataagtgaattcgtaatcctttgcatagcctgttgcctttactgagatcttaaatccatgtccattttctgcatccttaaatggagccgcagtcgtatcaattgttccatcttctttgatgatcttcactgcacgttttcctgttgccgcatactctgttccgtcaactgttacggattcgatcttctttacataagaagttacatcctctgctgcatatccttctgccgctacaagtgctgcactttcattgttaaatacaactggtacagcttctgttgttaattcaaaatctgtcgtaagatccgcatattttccggatttatcagatactttcagagtatatttgcctatctcagcgccttttgtcttataggtaagtaccccgtcttttacctgaacatcctcaagaccttcaactgtatattctgcctgataatcaccaggaagtccttctacagttacatttacttttccactttcaacatctgcattctctgctgcgacagtcccattgaatttaaccggcacatactgatctgcatcaatctcatagattccattatctgtgtaatatgtgattttattgattgtctgacccatcatcttttcataatcttttgagtccagtgtgtttccatgagatgttgtcacaaatcctgtactccatgccagttttgtctttttccagatattttcaagatgacgaagtccgtagttgtctccttcttttgtgctgatcacaactccatatactgtattaactgtttttgggagtccatttagatctaattcataatctccatactttgtgtctattgtgaaatcaattgatgcatcactcaacttctgtgcagttgcacctttcacttcactaaagctgagtgaaccatctgcatttactgttgcttccttataataggaaggagtctcacttaaaatatagtaagaatagcttgcgctctcgaataacgcatcttttccattatattctgttgttgtctcttttcctttcatattcactgtaatagaaagcttgctgtcatctgtgatctgtgtatagtttttcagtacagatgcgtcactgatcttaaccggatatgtaatacctgtaatatctgttccatcgctgttcacatgataagaaccagctgcaagtgttgatcttgttttcgcttttgtagcggaggatacactgtctgctcctgctacctgatcagctgcatagaattcagaatatggaatattcatcaacacatacgtttctttcgcaacttccgcctttttcaatgccttcactgctgtatttaactcatctgccgctgtgtccactgcactctgagattcttttgctttcagagccgccttcgctgcatttaattttgtctgcattgcactccagctgtctgctgtataatcagattctgtcagtttctcagccgctgcgattgctgactccaactttgctgtgtcaatggtaactgtctccccagctaccggagctgactggattgcttcaagtgcagcttttttaattgcatcagaagtacgtgttgcaccggaaactgtatcccagctgttaattgtatcttctgtagcagcctgtccttcaagctttgttttaaatccttttgatttggaatatgctttattgagatattttgcatttccttcgtcatatccttctttcggtgtaactgtaatctcagagaattttccatcctctactttcaagcttacttctacatcatattcttcccactcatcgtcactgtcatcttctgttctggttacatgagccgtctttgtataagttccatccttcgcagtctgacttcctgttgccgcaaagatggttgacgggcaaagtcctactaccatagacattgccactgccatggacattgcctttactttcatttctttgtttttcatagaaacctcctttttaactaaaatagttacatacagatcctgcctgtcgcagttctgctttcctgcttccgcatggaatatattatcaagttagctttcgctaacctgtaatcaaaaagtatatgtctatactgtccttacagcttctttcttcacaaccggtaaaatctttcctgcgacaattccaatcacgaaccctgtcactgttcctgccacaagaagaaccggcagataataaatcagtttcagattctccaccactgccatcgcaacaagaatctgtcctatgttatgaaagacaccgccagtgatactgactcctacaatggaaattccatccatcttctttacaagtaccatggcaagaaggctgacaaccgcccctgccagactgtaaatgatcgacattccatttccaaaaagaaatcctgtcagaagcacacgcagtaccgataccgccagtacttctggaatttccagaaaataaagacctgttacagtgaccagattagccactccaagcttcatccccggcactccaaaattaattggaatcaggctttccacataactaaaaatcattgccagcgcaacaagcattgccatgttcgcaagttttttatttctattcatacattctcctttacagtcgaacaattgatttatttagaaattgtatccggtagatgttccttttcattttgagaatcatcagaattctcaacttcttctatttctacaaccagcttatgaggcaggcagacaatggtctgtgtccggttattgatcttcccctgctcttcgcaatatccatccggacagtcagcctcttccatatacgcttttccatccttgatccggacacggttgtaaaagtctccatcctgcacttcgatcacctgatcttcatccaaagcatatcttccgtaaacttctccatccaccttgatcacaacctgtttttcctgaatttctttttgcccgctttcctttgcctgtacatactgcatcaggttcatcacaagaaacagtacacatgccgcaaagaggattccgcctcctaaaaacagatcttttttcttcatctattacactcctgcccagatcataattacaagtaacagaattgcccgaagaatcgtaaaccaaaattcatttcccttcagacctttgattcctgtatggatatgcttctttggacaggtatcaatacatttctggcattggaaacaatctccctcgactttgagtgatccgtcttccgggagtccgatcccggatggacatttcttcgtgcatccgctgcagcctttgatacaattttctctgtcgcggtgcaatgcaaagaacggaagcaccggaagcaatgagaatactgctcccatcggacacagattccgacagaaaaatctttcttccagacacatccccacaataataagaagtagtaatatcactcccggcaaatatccctgcaagtgaagatttcctgcatgcagcatagaaaaaacatcccacaggcttgtcccttttgcctttccgtatactcccgcaaaacaaagtactgcgattacggtcaacaccagatatttcaaatagcttaacctctctgtgatcttttccgaaagcagcaccggctttttctttctcttcttaaaacaccaaagataaaatgcatgaattccatctccaagacttccgaatgcacatgcgaatccacagaagaatcttccgaaaagaatcgtatacgcacaaagaactataagcaccgttacaaaagaggtcagcccgattgcctcgcctgctcctatctgtgtaaaaatgtatttcacgccggcaaatgccgctgtatacacagatggcagaaagagaaaatagagaatctgaatcaaggcacgaagccaagtatgcaattttttaatttcttttgcttttaaattatgtatattcaacttcttcaaactactttaccgcctgttctaatgcctgttctgctgcatttttaattcctgtcgaactgaacgttgcgccgctgatcgtatcaacttctgcactctgcgcctctatgatttttggaatgatatcttccgccattgcaagatatgcactgtcttccttatcggcggaagtcacttctaccgcttcgatctttccatcttttacagtcacttctaccgcaaccgttccgccaaatccatccgcttctccggtataggttccatccttgtatcctgctccatctcccgaatcattccctgactcagaatcactgccggcaccagatgactgtacctccaactgtgcattcagttttgcgatttcctcatccttcgcacggacatccaacacttcgttatatccgaaaaggacaccgacgattgccagcagactaaacagtcttacgataaactctttcatcctactgcgcctccgtctcttctggtcttaaagccatttccagtgcctttttgcatccgtcaataatcgcattcgaagaacaggttgctctggataccgtatcgatttcttccggcattcctttggtaataatctgggaaacgacaccttttttgcttgaagttccatttgccgccttcttgatatagctgtcattcgctgcatccccatctcctgacacgtcagtaatagatacaattttgtcatttcgtattgtcaccttcatagaaagctgatactctgtaaaatcttcatcctcatccggcttacatggtacactcacttcataagttccatcgatgtattttgtcttcacttcttcctcttgatctgacttctttttctcaagctgtgcaactgcaaggttcagattttccacagctttatcaaccgtctgctgttccactgtttcattcgcagctgtttccaacagctcttttgcatcattcagtcggagactcagaaccgcccagctactctgcgtatactcctccatcacaagtgcttctgctgacttgactgcattttccagttccgttgtatctgctttctcttcaatggattctccattcgttactttctccgcctgtttcaaagcattctttattgctccgagaagtcccttagaactgtaagttgcaccagatacagtatctacatctgtattctgatttttaagcacatttttcactacatccattgcgcggttgaaaaatgcttcatcatctgatgtctctgtgactaaaattgctttgatcgtatgctcctggatcaccacagctaccgatacatctccactgtatccttccgctgttccataatagattccttctttgtatggaactgtcccggttgtggatgtactctgattctgactggaagaactgttcgagccattcgtttcagatgaatccgaagttgctccatttccactcactgccgcctgacttaatgcatctcttactgcctggatgattccaaccgaactgtacgttgctccagacacggtatctacattggtgctctgactgctgatgatcgcattgatcagtgcagaggctttggaaatgtattcgcttccatcttgattctccataatctggatgtctgtgatctttccgccactgatctcaacctttactttcagtgttccaccaaatccagtccctgttccgtaataagttccgtccttatatgctgccgggtcttccactgttgcgacagaagtagaacttcctgctgccgcgccgccaccagactgtgactgtcctgttgttccgctgtctttttctcctgtcagtgcattcttcactgcactgatgattccccgtgaactataggttgcccctgaaacagtatcgacttccaatgtctgtccttcgatgatcttatcgatcaccgcctgtgcacgtttgaaaaatgctgcatcgtcagatgaactcaaaatatcaattgctgtgatctgcctgtctttgatctgcacagcaactgtaatatctcctgcgtaacctgttccggttcctttgtaaataccatccgtcagatcaaaagaaccttttaccgcctgctcctgttcttccgactttgtagtctcttcttttacagaattcgtttgctcctgcgccgcataaaccggtggctgatatccactcagggtgcctgctacacaggatgccacaactgctaccgaaagtactggtgcaaatggtttcagcttctttcctgtttcttttaaatccatttttcctccaaaatctactctgtcttacacttttctatcgaatgatctcaactgttctctccgttgaaaaatcatttttcagcccttctgttacatatagcgtcccatcatcactcataaggattgcatcaaactcatctttatgttctctccagaactctgccgctttctcttctcccataataaaaagtgaagtagacagtccatctgccaatgttccgtccgaacttacaattgtcactgagacaagtccgctttctgccggatacccggtctttgggtcaatgatgtgatgatacgtcacaccatcctgttcaaaataccgttcgtatccccctgaagtgataacagccttgtcctgaacactcagaattcccagataatcttctgtgtcatcgggactctgcactgcaatcttccatttcgttccatccgtctttgttccgagtgcctgcacatttccgccaagattcactaatccacttgtgattccattgtctttgtaaatgtccataattctggatgaggtatatccttttgcaattcctccgagatcgattttcattccttctacaccgaaagatatctttctcgtttctttgtcataagaaatatttcccgcatcagtgagtggaagaagttgatccaatgtctcctgtgacggaacctggaagttctgtgttgggaatccccatgcttccatcaccggataaatcgcaatatcaaacgcaccctctgtctcctggtaaagttccaacgcgcgttctgtcagataacctgcatcttcggaaagctctgcgcttccatctgcattgagttttgcgatttcgctgtcttcatctcctgtcgataaaagtgcgtccagacgctcaatctctgcctgtgccgcatcaacggctgcttctgcattttctccatatgcagtcactgtcatataggtatccattgcaaaaacatctctggatgcttcttgtatatcatccgactggttctgtgcactttctgacgatgtttcggatttatctgctgtcttactgtctgtcttctgtccgcatccgaccaacagagccgatgcacaaagacagactgcaagtaaacattttatattttttaatttcatgtaatcgctcccggttatagttttctaacttgtgttagtctaactaactccgtaagtatacaggatgtctattatccagtcaattggatttttattatttgagaacttttctcatttatctgttctaaacttatatatttttctcatgaacaaagaatgtgcctcggcacattcttgcgcctgcggcgttgctaagcgccagtggcgcttgtttagcaaggctcgtgacctcctgcttgcaaggcaggcgctctcccaactgagctaatcccccatatgtatgtcctcaacagaacttctatatgatatcatggcttattgagagtgtcaaccctatttttaatatttttcttttatttttcctaccggaatccaagtaaccagatcaacagcggattatggttgtacaaaaacgtcaagatcgcgctctgctcaaccatcgcataacatgttgttccaatctctgtcgtataaatcagagtcagcacaaggaatgcgatccatacgataataaatcccagaccaattccaagcactcctcccgccagatgattaatcgcaccaagtaacggaagttcaccaataatattcaccgcatacatcaatgcgcttacaagaatgatcgcaatcaaaaatgtcacaagaaatgacacaacattgaggagcattcgtgaaatataggccgcaacatattctgggaaagttgtaacatccagttcttcataaatcgcagtattattattttccagcaatgcatctttcaaaaactgtggcagcattgaattctcaatctcacggatctgtgtatcctttggaagatctccgaccactttcaggatatcctgtgcagttatccccagtttgtcccatccagattcgcttaatgatttaatctggtctaccgttaaattctccagaggtgttccactgagattcgctttcaacagatcatctgctgaaatctctggcataaatgcttccactatcttcttctccagtacgtcctgcgccggtgtatgcttcatcagcgcatccgacacgtatggggaaaggaatgacaccagtaccagtgtcaatattgttgacagaagggataaaccaattctgagaaatcccttcacaaagccggcaatcatgcagactaaaaacacaatcccgactgcaagtaacaaccaattctccatatatctctcctattttgtcaaataaacaattcgcagttcattatcactcatcacatagtatctgttcaggccaaatgcatcaaagatttcctgcgcatctgctcccaggtctcccttaaacttcaggattcctgtcgttgtataaatacagcacttacttccatcatacagaatgatattgtctccatccatctttacatgactataatctccctgtatctctttactgaacacagtatctcctgattgattatacattctcaactcataccctgacttctcctgattaagcaggacaaatccaaaataagaatccgaatggaaaacactttttatctcttgattcactttcacttcttttgtctgctttggagtatcttttcctgtataaatctcaaatccattatctccaactgcaacagatctgtcatttcccataaagaaaatctcgccgatcagcatatcttcataagtatctgctgtcactttgttatctgccttctctttgccggcagtatcaaaattataatatccgatcctgctctgcacctgtgttcctttggtataaagataagaaactgccagaacctttccatcatcagacaaatccaatgcgatcggatatcctgtatttccaatcgtaatctgctgctctaccagaatatttcctgccgcatcataggatatgattttcggtgaagtctcatcttttaaaattgcactgacaattccctgattcgatactgcgattctctcgatcggtaatgtcgtctgaatctcacctttcaacccattttttgtaaatacaagaatactgttacctccgctgtcagcaaccgcaaacacatcgtctttcacaactatcaccggtgtctgaagctgtgttggctgaatccacttttcctcattcttcttatttagaaataccacaccgtcatgattataacgcacaattccatctgcaaactgaacgtaattattcctgtccgaaaggtctttcacgtaactgtctgccttgcggactgtgccataagtcttactatctaaaaggaggtatgttccgcagattgccatcgcaatcaggatgatataggtaagaagttcttttcttctccggcgtttgatccttctttccctttgtctcagcgcttttctatcatcctgcgtttttaccacctgtaaattcgacattttctttcgcgccatattgctccccttatcgtttgtccagtgcacctttttctgttgatacacttttagctttcacttgtctttcacagtataacacggatttatggcaatatcaatttttgtccaatatagatcaggttcccattctgcaatccattcatccggctgatcgcatctacatgattaacatctccatacatttttttactgataattgcaagggtatctcctttttccaccacataaataccatcattttcatctgctgcaacggcagtcccggaaaccggaacactttctgtattcttatcttccgtctgttcttccccttcattttcttccgttatctctgcggattccttttctgtatctgctgcttcctgatttttctccacagtagctgctgctccactcgtctctttcacatcaggtgaggatgtttgcttttccccctcggcaaccacatttatcttattctggagggatttcattttgctgaaattgttcatcatagaaacacccatcacgatcaggaccagtacaaggcatgtactgattccatacatcagactgcctgtccttctttctcttttctgaccgccccgttcacgtaccagagaacgaaagctttgtgcagccgtatcttccacattttctgtctgaactgccccatttttttttcgacttgcaatcatataattctgcatgcacggattcttctcgtaataagtataatgtcctccaatttccatcagatctcccagcttatgtacaaaaaatacatcttcctggtttgtcgaatctttcataacaagaacggtatttttctttggaaataattttttatgcagctttacgttgatagaacccggagccagctgtaaatcatgctctgtcacaaaccagcctatgatttctccttcttcaaaatactggctgcattcttcacaaccacatttccatatcttgtcattgatcaggtattcaccgccctccttttttaactcttttatttttatcgcaccataaatataaatatattcttcattgtcctgcttctgcatttcaccaatcagaaaggctccttctggttgtttttctttctcgcttttttcacttaactgaagaaaaaaagtatctacataatcttccacatagatttttggactatcactcacatttcctatctgacgcacattttttggaatctgtctctccattttatactcacctttctatcacttttatttaatttcccggggattgcccttaacatagcacaaggaaatcgggagattttatcaattagtgtcaggtaagttcgacaaatattacttttcgtgcacggcattttcttaatatctccaaacatcaaaaaacgctccggtactctctgattgcagatattctgtaaacagaaagcgcgaagcgttctttttattagattattgtaactgttcagagccaacctccaaaatgctacgcatttcgtcggtgtggcagaacaaagaatgtgccttggcacattcttgcgcctgcggcggtcgcttgcgacatcttccttgtacgccgcagtgcgcatcctcgcggagcgtttttatatattaggaaagtgcactttcctaatatataaaaaataaaaatgtaatcatctctggtgtaccatcttagcttggaatccctactaaaattcatatttctttaattcacagtttttgattccgaattttgcaaattcttcatttgacatatctgtaaaataggactgtactgctcttgccacgccgttatgtgcaaccagtaaatatactttatgatccgattctttcttaatatcttctaacagaccatagattctgtgacaaaactcgagcatagattcgccaccgtcatatctctgtgcaaaatgtgttttcgcaatctgaaattcatccccatttcttggagttccttcatattttccaaagttttgctctttcagacgcatctccactcgcatcggaatccctgttgcttctgagatacaccttgctgttgcctccgcacgcataagcggtgaacatataatctcatcaatctttacgccgtcttcttttatctttctgccaagctccttcgcctgttccacgcctttttccgtcaattcaatgtcagtagctccgcatattttattcgccacattccatactgtctgtccgtgacgcgcaaaatagaaataacccatttttctctcctccttttactttattttataattataacacaaaccgcaggctcatggcgacctgcggttttcgtatgctgtcttcttaaaacaatcacactatttgttacggcttcgattgtaattaatcaggcatcctgccttgacaatcttcttctcatcttctgtcatatctgcaacataaagtgagatttctttcacttcttctccgatgacatatgctttgatatctttcatatctccgtcaaatgcttcgcggatattcggtacatagatataatctcctacctcgaattccggctcttctgtcatctggaatggaatcattccccagttcatgacgttagaacgataacgttttgttgcgtattcttttgtgatatttgcaagtcctccgatgactctctgacaacttgctgcctgttctctggctgaaccatcaccaggtttcactgcatagatcatgcttccgatttctgtctctgcaggtacgatctcttcctgtcctacaattgtatggatcttttcaaagattgctttcaattccggttctgcctctgttacatcctgacctgccactcttgctttttccactttgtctacttctttggaacgtcctacatactccggatctcgtcttgacagagtgaactctgcaagtcccaatggatttgaacggaaggatgatgtctctccggatgggatcaactcatcggttgttgtaacaggatccagaatcttagagcatactttcagcaaaatattatctgtcagtggactcatcttcggccagtctttgatgtttggaccatataccagtgatttttcctcatcacctttctggtatccgtagtatactctcttttcatataccgtatcctcgaaactgtactctggaacatctccccagcagtccaatgtttctgccgatgttaagattccaccgtttgctgctgttgctgcgatagatcgtgcgtccattaatgcaactgctgacatctgtccgttacccggtttacttccttcacggttcgggaagtttcgtgtcgtatgacgaatactcagtccatcattgcatggtgtatctcctgctccgaaacatggtccacagaatgcagttctgataattgctcctgcttccatcaagtctgcgatgtatccctgtcttgtcaggttgatgaataccggctgtgaagaaggatataccgcaaggctgaattctccgtctcccgtattcttaccacgaagtgcattcgccgcctcgactacatttgtatagttaccgcctgcacatccggcgataacagcctgctgtacctgtaatcctttctctgtgatcttatctagcaaatgaaaatctgctttgccctgagatactttctgcgcttctacttctacactgtgaaggatatctgttaaatttgcattcaactcatcaatctcgtatgtattacttggatggaatggcaatgcgatcattggtttaattgagttcaaatcaacatgtacaacaccatcataatatgcaacatctgccggatttaactctttataatcctcccctcttccatggatggtaaggaatttctttgtatcttcatccgttctccagatagaagacaggcaggttgtctctgttgtcattacatcgacaccatttctgaaatctgttgtcatagaagaaactccaggtcctacgaattccattactttattcttaacatatccgtttttaaatacctgaccgatgattgcaagtgcaacatcctgtggtcctacccacggatttggttttccttccagatagattgcaataacttccggacatgctacatcgtaagtatcgcagagaagctgttttacaagttctccaccgccttcaccgattgccattgttcccattgctccgtaacgagtatgtgaatcggaacccagaatcatttttccacatcctgcgaacttttcacgcatgaactggtgaataactgcaatgtgtggtggcacatagattccgccatatttctttgctgcggaaagaccgaacatatggtcatcttcattgatcgttccacctactgcacacagggagttatggcagtttgtcaatacataaggaatcgggaatttctccattccggaagcttttgctgtctggatgattcctacaaatgtaatatcatgtgatgccattgcatcgaatttaatcttcaggttctccatatttccggaagtattgtgtgcttccatgattccatatgcgattgtaccctttcttgcctctgctttatctattttcttacctgtcagtgcttctgcttttgcagcttctgtttctggaataattgtctgtccatgaatcagataagcaccaccgtcatataactttaccatatacgttctccttatttattaaaattcaaatggttttacctgacgtactacatccatgattgttccgtcacgtccttcaataattcctacgactctgtcaccaaactgtaccgactcaggttctcctacaatatcatacgcgatatctctaagttcctcgattgtcttaagcggtacacaatctgcttcttccaatgctttcaagagatcctgtcttgcagggtttacagcaacaccataatctgttaccactacatcaacagactcacccggagttgtaactgttgttacatttgtacagattgcaggaatacgtccctgaagaagcggtgcgataacgatcgtacattttgctccctgtgccgcatccggatgtccaccctgtgctccggtgatcacaccgtcagaacctactactacattgacattgaagttcacatctacttccaaagcaccaagtacaacataatccagtttatttacaaatgcacctttgttaaatgggttggcatatgcacctgcactgattctgtggtgatttggtctcttcacggattctactgctgccacatcaaaatcctgtgtatccagaagtttacctacaagtccttcatccagcagatcacacataccttttgacataccaccgatggcaaatcccatcttgattccacgttctttcatgatcttaccaagtgaagctgcagatgcgatcgatgctccgccgacacctgtctggtatgagaaaccatctttgaaatatggtgtgttgacaacaacctgtgtacaataatcagccatcatcaattttcttacatccgttgtaggttttgctgctcctgttgcaattttctcaggaataccgatctggtctaccacacagacataatcaacttttgtcatattgatgtctgccggatagttagggaatggaacgaggcagtctgttactgctacaactttattggcatgatttccgtcaacgaaagagtaagaaagcactccacaatcgctctttccaccgattcctttacagttaccataatcatcgcaagtcggagctccgataaaggaaatatcaatcgttgtctcacctgtctgaattgcacgtactcttcccccatgagaacgcatcgttgcaagaccttttaattttcctgtcgaaattgcctctccgattttaccacgtacaccggatgactgaatgtttgtaatcgttccgtcctcaatcaacggtaccaatgcatcatgagcttttccaagagagcttgcacagatagtcacatctttgatgcccatgttttttacttcctgcatgaccatattgacaaccagatctccttcacggaaatgatgatggaaaccaagtgtcattccgtcatgtgcaccacattttacaagagcttcgtgaatggaacttaccatcttacttgtgtcatggttcatcacaacttttgtgattggtcctctcttctggaattctgtattatctttataataattcccctgaaatacttcttttcctgtcatttccagaatttcttccggaatatctcttccaactttatttaccatcttacagatcccccttgtatacgcctgatgcttttgcaagctcaatggttctctttgctccgtcgtagaatgcaatgtcgatcatcttgccgtctaccgtaaatacaccgattccttttgctttcttgtcatcgatttctttaacaactttttctgcaaaaataatatctttctgtgttggtgtataaatctcatgtacgatctcaatctgacgagggttgataattgatttcccgtcaaagcccatcaaatgaatcgtttctacatcctgtttaaacccttccatgttatccagatctgtataaactgtatcgaagcactgaacgcctgccgctcttgctgcgatcaccatgttctgtcttgcacccatcagctcgacaccggttcctgtaatatgtgtctgaaggtcttttgtataatctccacctgacaatgcaataccaaacaatctttctgaagcttcacagatatccaacgctttcataattcctcttgcagattccagtgccgccatgatcaatgttcttccttccggaattccaaattttttctctgctgcaatgacatgttcttcaacaagttttacatcctgtgcactctctgtttttggaatgcggatcgcatcacatccacctgcaaccgcacaacggatatcttctttccagtaaggagtatccagtccgttgatacgaacaactcgctcaacacctctgtagttaatctcttttaatgcatggaaaagagaatatcttgctgcatctttctctttctcagcaacagcatcttccagatccaacatgatcgaatctggtttataaatatatggatctttaatcagtcccggtttctggcaattcagaaacatcattgttcttctcagtcttttcttatttggattcatccttgaatggcacctccccatggtaaattctcactcatctcggctgctcgaaatactgcacattctactctcgccttcaatgtgcaatcaagagcacctttatctacaatatgaattctgatatcttttacatccagattatccagtgttttcatcactgtatttttaatgctgtgaccatactgattgatgaccacactgtccagctcaaaatcaatcccctgtccttgtccattcggttctaccgttaccattgcatcactggattctaaggttccggcaaccgcatttttcttgatttccactgctaaattcctccttttgcatctgtgaatttctttatctgatattattgtaacgcctgtatatcggaatgtataattgccaaaaagaatgtagttataactttcgtctatatgttattcccaactgttattacaaacgttttgcatccatttacatcctttggattcttaatttacaaattttccatgtactgtatcattgcttctgctgctttcttagctccatcaacagcatgtacgaccgttttcgaaccggtaatgacatctcccgcagcaaatacgcctggcttcgtcgtcatataattgtcatctacaatcaataatcctttatcggaaccttccagtccgaatgtcgtacgaatcagtttcttacgcggtccctgactgattgaaatgatcgtcgaatctgcttccacctgtatcagttcctcttcctctccaatgatattttcctcttcatccaatattgtttttttgaataccggtcctttctcattgatggaatcaatctgcatcccaaatacaaactcagccccatcaagtgttgcataagatacttcatgcgaacttgctgcaatctcatttcctctcgcatataaagtcacatgctccgctccgtttcgaagtgcagttctcgctacatccatcgctgcatttcccataccgatcactgccacattttttcctaaattgtatgtcgaagcatttgccagataatcaataccaaaatgcacattgccgagacattctccatgaattcctagatttctcggtttccatgttcccgttccaataaatatgctggcatatccgtctctaagcaggtcttcgatttttaaaacagctccgatcgtcgtgtttggacgaatctggatccccagttcttccattcggttcttataccggtcgagcactgttttaggcagacgaaattccggaattccgtattgcatgattccgccgattttatctttccactcaaacacggtcaccccatatccctgctgcgccagtaagattgccacagtcattccggctggtcctgctcctatgactgcaaccttctgctgcttcttctctttttgctcgattttcatacgctccagatacatatctgaaatataatgctcaatgctggaaaaatgtactgcatttccctttctccccaatacgcaatgtcctgcacactgttcctcatgattacagactgtcgcacagattaccgacattggattattctgaaacaattcttcccctgcctccatcaaacgattttccttgaacatctgaatgatatgcggaatcggagtatgaaccggacatccctgctgacacatcggtttcttacaattcagacatctgtttgcttcatcaataatatgtaacgccataccaatttcctcctgtaacttttatgattctcaaaatcccctattacaaaaaggacagctctcaatgtcgattactcggaattgagaactgcccttttgtctaagtctggattccctcatctgagtctattttactgctcagaagtatccatgtataattgtcaaaatgaatacagttataactttatactatgtatttcacataccattatttgataaatgagaacaggaaacttgctacgatcaacacaattcctccacctaatctagaagaaagctgtgcgtatgccatcaaatccattctctttgctgcaccaagtacagctacgtctccgtttcccccacggtttgccatacacaatccggctgtaaccgcagaatcgatcggatagaaccctacaagataaccgattacagcagaacctgcaattgctccgattacgatgaacagtgcaatcactacattcgataccgaacatgattctgcaagctccttcagatcaaaatcaaatccaagacctgccatcaatacaactgcacaggatgcattcatgaatttctgaagtcgttttgcaccggcacggatattggccggaatcacaccggttgccgcaaggattacaacaaaaataatcatatatgcatactcatggatcggtgcacctgcgattgtcggaagaattttgcccgcaaacaactgtcctacaccataacatccaaagataaccaaaagtgctccgcacatatcagcaaatgtcggtgtgatttctgctccgtcatctacatcgagtatgctggaacgaagcaatgtctttttgtcacctgttaaagcaggtactttttcacccagtctgttaagcagaccacctgcgatgatcgacattacatttgcaatcgtaagaataataatggcaaatgcgtagtaattaactgcagaatctccggttactttttcataaatttctgacatcggaacagcaccggctccgttacctccacccataacaggaaggacatattttaaaatcgtatctgccggtgacacgccaaacggaagtcctgctaagacaccaaacaacatggcacatccaagtcctcccaagattgccggaagatatccggcaaaggattttaacaatacttttttgttcaatgataagacagaacctgtaatcaacacgataatccacaatgtcataaaactcaggctatctccaccgacaaaatcattgatcggctcgatataagactgtggcacaagtcccaactgtttcacaattgcagttccaaagaatgctgccagtacaccaccaccgatataagtattccaaatcggaagtctctctccaatttcaaaaaagataattccataggcaatgatcaatgccataatacttgagaaatcatgtcccaacgctccaaagtacgcacttgcaatcacaactgcacagaaaattaatgcaatgtaccatggtgctccatagatttttaaatccttcaaaccatttttctgctgtgttccactcatttttctctcctttatacttctctcattctataaaaacagtccgtacataccgaccaatgcaagaatcgccaggactgccaatgcaataaacgatactgcaaaaagttcgataaacattctgttctgtggaaatttttcttctgaattcggctgctgcgctacaccggccataatcaatgctccggttgtagaaattggtgtaaatccggataccgttccgccgattacaataacagtcaccagttctactgcatttactccaagtccgcctgccagaccacttgctgtcggaatcagtgtcgggaatacaacaccgagtccggagctgaagaatgacataattcctgctgccacagccatgatcattgatgcagttctcggtcccatgactttctcaagaccggcaaccataatatcgattccacctgacagggaaataatgttcatcagaattccaacacctaaaaccattagaattacattccatggaattgctgcgatggctttcttctcatctccacatcccaacacgagtaagaatgaaccaatcataaatccggtaagaccaacattccatgagaagaataaagcaccaaccgccaacacaagcagtcctatgattgacaaccattgtttgccattgaatttcggcagtttttcctcaaccgtctcaccattctctgtaattttccagcctttgtagtacacatatacaagcgccataacaaccagtgctgtcacaatcattccaatcatgattggaatagtatcccccttcatgccttgctcttccatcaactcacgcacaacagcagcttccggagtaagcggactcattcttcctgacatcacgcccaaatctccgataatcgctgtcataatcgggttcacacctgcagatactgcaaccggaatcgcgataaccggaacaattgcaagtgaagggattgctccgggtcctactgcacagatcaagaatcctaatatgtacattacgaacgggatcaactgttttttcttacctacaaggcctaccatctttcttgccaacagttccaatgttccatttccattaataattgcaaacagataggtgataccaaccatctgaataaacaaagacgaactgaatccggcaaggatttctttcgcatctactttaaaaataatgccgagaagcattgcaaatgcggtacatagaataccggcattacaatttctgacgaatccgataacgattgccacgagcaacagaattaatgaaacaactcctaagttcatacatcttcctccctatctgaatgtaatgcagaccggactttctgtatcaatgattctgcctgtatactccatctgtccgctgacggaatccaatttcatctctacaatggtatcgctgtcttcatttgctgcataaaatctggaataatccggattaaatgtaataaatctaggtgtctttccaagacaagaatagaatcccagttctgtcatatatccggtattctgatcgattcgatatacaacgatcgattcatgaatacggtttgaaccaatcaggatttttccttctttatccaaaattgacgcacttgcctgtccttctcctgtatatgtagacggaagcgacggaaggatctgcatcgcctgaagtgttcctttcacatcatcaaactgaaggtatgtcatcgtgtttcctttttcattaatcaaatatacccaacgattgttcggatggatcgatacatgacgtggctcgtcatactctcttcctctgtatgtatctgtctctgtcaacgttccgcattctgcatcaaaacggaatactttaacctggccgtatccctgcagtcttccctgtgttacaacgaacaaaaattctttcttattgtcccagatgcactgatgcgcaaatgaaatggttccatctttttttccctcaagacagactttctgtacaatttctcccagtgttccgtcttcatttcttcggatcacatacactgccccaccctgcaatgctgccacaatgataaaatgatttgtcttatccggagtgatgaataccggatttcttccctcgatatcgatggtattcatatattccagtgttccatcttctaaaatcttataactgcttacttttgtgatatcaccatgtacggaatagagatattttttctccaaatctaatgtctgataagacggattcggttctgtttccagacactgtaactctttccattctccggtagactctgatatttcatacgtcttaagtccttttcctctggcatttctttcttttgttgttctgcatcctacatatgcgtacatatcatttcctcctaatcttattttgctgtcgatacatcgttactcttatgtctcctctcatcacataagattcgctccatgtattccttataagacaagtatagtaaagtcacccgtcaaattgaaattcacgtcacgactatcccaaccattccaaactggaataaaacgaccggcaatccgctttttcctgcccccattgtatgttttttgcacagacctacggtttttatcgtgtattttgctacgaaaaaaagagtaaatcttatacgaattcccttcgtacaaaatctactcttttctctatctatattttctctttaatagttttattctacgctttcaagacatggcttctcatcatattcattgacatgataatattcctcaaccaatgagacaaaatccataatatcctgactctggaaacaacgctccgacaacatcatccacacttttctcttaatcggttctccgttatggtcatagattggtatcatctgcacctcgtcctgatttactttccatttatccccaaacagaaaagtaataccaagtccattttctaccatctcaatcgcaatatccgcgtatcgtacacggtacgcctcatgaggtggattgccaaaatggttcttccaccattgattgaccagcatgccgaccatcggattcaaataggacttgatcaacggctgctgcccgatgtcatccaacttcatccccttcggtgtcaccacatacaattcgtcctcaaacagacaggttttctctcccaaatacggaaaatctccacaaataatcccaatatcaatcgtcccgtcgagtaactgttgcatcaggacatcactggaattcgaaacagtaataatcttaagtctatcataccgctccttatatgctttaaataccttcggcatgtgaagccttgcgaaagaattcggaacaccgatttttaaaagttcctgtgtatcattgcgctctgcaaaatggtcaccgatttcctgcagaaaatccagcatgatctgtgctttttttaccatataatgtccgtcttccgtaaacacaacgccacggcttgtacgttttacgatctcgataccccactcttcttcgaccgccttcaaacgtttcgtcaaagcagactgtgtcatatataatgactctgccgccttggtaatacttctcttttcatatagaacagtaagaattttccaatcgatatctttcacaggccttctcctcttttgtcaattttcactttaccctgtatcaggtcagattacctgactgatactctttctctatataatgaatgaattcctctaatggttttgaaatccgtttatttttcgaatatacgaaccatgtattacgatacactccgcttccgtctttattttccaacggagtcagacaaagattgtattcattctcaaaattgcccggcaaaaagcagattgtatatcccaaacctttgtgaatcaactgccacgccacatcgatataaccgacaaccatattcgccggtgcctctgttccaaaacgattctcccaccagccattcagtatctcttttgtacgatcattggtcttataaccaatcccttgaagtttcggtaaatcctcaatatctaccggttcttttgtaacaagatacgcctgatttttcccaagtaacagtttattcaccgccccctcataatctccgcgaataaatccgacatcaatacttccttccagcatcttacggaataacacattactctgttcattcacaatactaaattctgtatttggatgtgtcattcgatactctacgagcaagtccgataagatatatttactgtatgtataagatgaccctattgttatcagactgtctgtattggtcttcatctcttcgagcatcgcttttgtttttttcataaaatcaagatactgtcttgcctgttctcccagatattctccttccggtgtaaattcaagtcccttcggtgttcggtttacaatcgtcacctggaattcttcttccatatgttgaagtcttttcgtcagcgatggctgcgtaatatacaaaagattggccacctttgtcatattcggattcttgtataattcatataaaatttcccaatctgaatctttcatcttacgttttcctcccgcatcatgtaatcctttgagctactgtgcactcgtttattgtgtgcattcccttagtttttagtatctcacgaatttataaaatcggcaactttttctcaaaaagattctttgatttttcagattgaaaaccaaatcatgggaatccaaccttctatcacataaaaagccccggtgttcggaactttttatccttcatgtaagatggcattttacacgttactttcactctgaacaccggtttcttttcatttatatacgaattattttctaattctctgaattgtctctaacagataatctgtaaactcagccgcacttgcatcttctgcaaatgttgtaacaaccagtttcttttctgtctctgtacagatttccaacgcttcttccaaaagcttgtttctgtctgcataaccaatatgtacaagcatctgaccaactgcacggatcagactgcatggatttgcataagcacctcttccatgagacatcagataaggagccgttccatgaattgcttcaaacagagcatattcatttccaatattggatgagcatgctgttccaagtcctcctgcatgttctgctgcaacatctgttacaatatctccataaaggtttggaagaacgattacttccattcctgtattgaaatcaggatccagcatctttgcacacattgcatcaaccagacgttcctgaatctcgatttccggatactcttctcccacttttctgactgctttgataaagttaccgtcaaccagttttacaatattcgcttttgtaactactgtaacatttttcttcttgttctttcttgcatattcaaatgcagctcttgctattctttcgcttccttgttttgtctgtactttgaaatcaacagccaaatcatcgcttacctgaattcctttatttccccagatatattccccctcgatattctctctaaagaacatccagtcaatatttttgtctttaattttaatcgggcgaaccgctgcaaataattccagatttcttcttaacagactgtttgcacttaccaggttcggaagtccgtctcctgctcttggtgttaccattggtccttttaagagtacatcacattttttgacctcttctaatacttcatccggcagactctgcatcttttctacacggttctcaattgtcattccttcaatgttatgaagttcaattttgccggataaaatttccggtttcacaagctctttcagtactctcaatgcctgctccatcaggattggtccaacaccatctcccggaagaattcctactttaatccttataagctttgagaaatcttttacctgttctgaagctttcattctctcaattcgttcttcttctgttttaattaattctccaaatgcttcctgtgcatttttcatctcttctacactaatctgactcatactatttcacacctcttttcgaactatgcgttttcttcttccatctttgcaagttgtttcttcagatatctaagctgaccgccacaaagtacaacttctacttcattatcggacagatccagtcttaccataaaactgaatccttttgttttgttctttacttctactcttcttgtcggtacctggtctaacagattgtcaatctcaagttcatcaaacagatcaatcttgtcgtaaattgcagggttctcaaataacatcggaataattccatgatttacaagattccctttatgaattcttgcaatactctttgcgattacacatttcacaccgagatacatcggattgattgccgcgtgttctctggaagacccctgtccgtagttctctccaccgataataatgcttgttccaagttcttttgcacgtgcagcgaaatctggtgcataacgatgataacaatactgtgacatcaacgggatattcgaacgcatgcttgagaattccgcacttgcaggtgtgatatcatctgttgaaatattattgccaccttttaagctgaccggagcacacaaatgctgctgtggttcttccggaatcggcaggaatttaatatttggtcctcgtacgatctcaactttttcagcctcttcttccggtaatggtttgatcaacatcgaatcatctacaatgtagttttccggctcatgtacttcattcaggatgccgatatcctctccgaggatttcttctgctgaagcaaatgttcctttgattgctgttgctgctgcactttccggacttaccagatagattttggcatttggattaccggctcttcctttgaagttacggtttgatgtacgaactgcaattccttctgttgcaggtgtctgaccgattgcacagcaaggtccgcaggagatttccagcattcttacccccgcatcaagcaacatatcgatgtaaccgtcacgaagcagttctttgtatgtctgtctggatgcgattccacaagtacaacttacgttctcattgacgtgatgtcctttgaatacaagtgctgcctttgcaacatctgcataacttgtattggtacaacttccgataaatacctgctgtaccggctgtctttccacttctgaaagaggaattacattatccggctgatgaggacaggaaatcaatggatccaattcactcaagtcgatatcgatacgctcatcgtaaacagcatcttcatccggcaaaagctctacatagtcttcttctcttccctgtgctttcaagaatttgtgtacttgttcgtccgccgggaaaatcgatgttgtagctcccatctctgctcccatgtttgtaattgttgctctctgaggaacttctaacgccgcagctccttcacctgtatattcatatacatttccaagaccgcctttgattgtcacacgacgaagcatttcaagaatgacttctttcgcatttacgcctggtttcaatcttcctgtcagattgacctgaatgactcttggcattttcaatcgcatcggaacacctgtcattgccgttgcaacatccatccctccgactccgatacacagcataccgatagaaccgccatgtggtgtgtggctgtctcctcccatgctgatctttccaggtttaccgaatctggatacatgcactgtatgacagataccattacccggtctggatacatatacaccgaatttctttgcagccgactgcagataaatgtggtcatccggtgttttgaaatctacataaagaagattatggtcaagataacttacactgcactctgtattgacgcgttttaatccgattgcttcaaatgccagatatgtcataaccgcgttaatatcatgtgtcaatgtctggtctactttaataaatacctcttctcccggtaccatgctgccggatacataatgtgattcaattatttttcttgttaatgactttcccaaaatgcttcctccttcaaatttgtatttggcaaaaatttaatttatcttttaactatagtatacgagagcttgagccccgggtaaaattgcgaattgatatagtagtattccgaaagggaattgcaaaaaaagtatcccgtttgagagaggatttcaaacaagatacttttttgtctcatgatttaatttattttcactctcggcagtatctctcccgtctgcctcatcctttcaatcaccgcattctgtgccgcgattttctttcttgcacgctccattacaagttctgcttcttccggtttgattacgataattccattacagtctcctacgatcaaatcgccaggacacacttctactccaccgcagaggattggaacattcaattcaccttctgctgccttggcacaacttcccggcgttacgcttcttgcaaaaatcgggaatccaacttccatacatccttccagatcacgaaaagcaccatcaatcacaacaccttccaagcctttcatagaagcacagatgcttctgtggtctccccagtatgaatgattgcagcactctttccccgctacaaccattacctcgcccggattcatagccagaatcgcatccggaataattccgctgactccttttggcggattgaccgtaaatgccggtccgacaatctttttgtcagacacacgacgtttgatatgatagtccattgtatggtaatctatcgctccgtcacagagctctgatgttgtaaattctcgtaattgctcaatgattgacttcaatttttcatccattttctttacctcaataaatctcttctgctgtgataatgtgtatgcaaaagcttgtgagacttctcactcaacggctcgcccagatattcttgatacaataactgcacatatggattttcatgtgattttcgaagcggcagtttcttatcttcttcataaattgcacgctgtctttctctgactttcttcattgtcttcggtgcatttccaccgcccccgatacatccgccttcacatgccatcacctcgataaaatgatatggtgatgttccttctttgatttgtgcaagaattccttctacatttttcaaaccatggacaatcgctacacggatttcctgtcccttaatcgtaagagaggcctcacgtatgccttccaatcctcgaactgcatcaaattccaggcgtggcaatgtttctcccgtcaacacttcgtataccgttcgaagtgcggcttccataacaccgccggtgcttccgaaaatctgtccagctccgcttccaagtccaaatggtgcatcgaattcctgatcttccaaatcatcaaaatcaattcccgcggttcgtatcatcttcgccagttcttccacggtaattgaaatgtccacgtcctgatatccactgtcatgaaattcgcttcgtttacattcaaacttcttcgctgtacaaggcattactgacacactgcatatattcgccggatcgatctgttctttttgtgcaaaataagtcttgatgactgcgccaaacatctgctgtggtgattttgccgtagataaatgttctaactgctcatgtccgtatgtctcacaatattttacccatgccggacaacaagatgtgatcaacggcaatggtccgccgttttggattctgtgcaacaactctgttccttcttccataatcgtcaaatctgctgagaagtcggaatcaaataccttatggaatccgatttttctcaatgcatgaacaatctttccggttgtaactgttcccggtgcatatcccagcgattcccccaatgtaattcttaccgacggtgcgatttgaattgccatatatttgcctgctgcgatctgttcatacacatcgtctgtattatctctgacagaaattgcacctaccggacagacttgtatacactgtccgcaattcacacagcttgtatcttccagctttttgccgtatggaggtacaatgactgtctcaaatccacgattctcttttgccataaccataacgccctgcttctcggtacatgtttccacacagcgattacaaagaatacatttgctcatatctcgaatgagagatggggaactgttatcaaatctggaatcacgcggtttcaactcatagcggtttggctgattcatattcaaatctcttgcgatcttctgaagctcacagcttccgtttttggaacatacaaggcaatcctgtggatgtcttgccagtatcagttccataatgttttttctcgctttaattactttgggtgatgcagtcttcactaccattccttctgataccggtgtactacaagccgccgggagcagtctctgcccttctacttcaacgacacagattctgcacactgcttttacagcctggtcttcatgatagcacaatgttggtatatgtacattcagccgtcttgctgcctcaagtattgttgttcccggttctactgcaatggattctccatctattgttaaatgtatcataaagcgcctccttcctgactgcatacatgacaatgttctttatcgatatgatgtaaatatacggaataaaaattctgaatactgctcaaaaccggcactgctgtagaatgtccaagtccacacaaagctgtcagacgcattgtttccgccagatcttctattgtgtgaatgtcctttacactcccttttccttctgcaattttggaaataagctgatatagtcttgttcctccttcacgacaaggagtacattttccacaggattcatcacggaagaaatccagattgttccgcacgatatcgataatgcagttacgatcatccataacaagaatcgttccacatcccagacgaccgcctgagtttgacaccgcatcaatatccaaaatcatgtcaatctgtccggcattgataatggcacccgatgctccaccagtctgaactgcaatcaactcatgaccatcttccattccaccacacacatcataaatcaaatctttcaaattgattcccattggaaactcaaaaacgcctcgccgctttacatttccacaaactgtaaataattttgttcccggactgtttgccgtaccgatctttcggaaccattcatgtccattttgaaaaataactgcgatatttgccaacgtctctacgttattcaaaacagttggctttccaaacaatcctttgattcccgggaatggagggcgaaatctcggctctcctcgttttccttcaatagactcaaacaatgcagtttcttctccacaaacataagcaccggctccggaacgcagtttgatgtcaaaatcaaaaccacttcccataatattttctccaagataatgattctctcttgaactttccagcgcagcttccagtattggaacaagataagcatactccgcacgcagataaataaatccgacatgtgcattgacggctttaccggcgattgccattccttcaaaaatcgaacacgggtctgttgataagagaattctgtctttgtttgttcccggctctccctcgtctgcattacagacaatatatttcacatctccgggagcatcatatgcaaactgcagcttacgaaatgttgggaatccggccccacctcttccacgaagtcctgacaattccaattctccgataatctctttcccatccatggataatgcttttctcaatccttcataaccgcctcttgcagcatattcttctgcttttttcggattaatcttgccacggtttcgaagtaatacaattttctcttccattactcttccacctcctcacgaatgtatcgttttacaatgtctcttacactctccggtgtcagattgacataagttttatcattgatcataattgctggagactgttcacagattccaagacatggacaatattccagtgtaaatcgtttatcttctgtcgtctctcccactttaatctgcagcagatcttccaacgcgtctacaatttcttttgcgcctcgaacatgacatggtgcacttttgcacattcggataatatacttgcctcgtggttttacagataacatggcataaaatgtaataaaactatatacctgtgtctgcgggatatccatttctctggcgatcactgctgccaccgatgcagaaaatgcggtcacgattttctgagaccggatgattactttcatcagcatttccggtcttcctttatattgcgaagcaatctccgcaatctttaccagttgcgccgacggtgttttgtaactgtaagtttcttccttcataaacttcctccttactttgttttcacctcttttttatgaattcgctagtttaaaatctaccggttcataacgtttcttcaattcttttaccatgatgttgcgatctgaatttgcaataaacacatcatacttcccttcaatgcttccgaacgtaaccgtcttttctatatcaagcaaagcttccagattctgtagcatatgttctcttgttgcctgtttatgatagattttgatatgcgcgtaccccggataattcatcgaatccgccagtacaatgcggaaatcactcacccattcctgttccatcaactgctgatataattgctctgtcttttcttttttctcaatcaccagaaaataaactacattactgcaaatcggatgttccactttcacataattccgatatggcgattttctatatctttcatatattccctgctcagcttcattttccagattctgataatagatcacaagcaggtcgtcaacaactgtattagtaaaataagttatccctatatcatctaaaaatgttgacatcttatcagcctgtgaatctgacatctgatatttcatcaaaaatgaattttcttccatatcataaagtaccgcaccatccatcgcgataatcggaagtttcagattcacgccttccaatgcctctcgaacggatgccggcgtccgaatcgtcgatattgtaaaatttgctccgttttcaataagcctgtttaattccaccttattgtatggtgtcagccgacttccgctatttaatatcgtatcgtctatccctgatacaaacagaatctcgttgtgctttcttctcggtaaatgtgctgaattcacaatgattgcaagtccgatcccgatcaacgtatccaacacacgattcataacaaacagaatcggcgattcatcggtaatatgcattactgtgatgctcaaaaataccacgcaggaaaaataagatgactttttacaatccaataccactgttgaatacaatacaatccctgtaaataaggaaatcaacatatattttgtaaaagactcttcaattcctcctggccggtttccatttaacgctaacaagatcagaataacaacaagaccccagaacgctcctacaaaggtacctgtcgtccgtttttttgccatctctttcatactcgtatgatatggctgcatacactgcagaactgccaatgcagaataaaacggaattccacgttttcctctcagataataaatcacaaaacacaatgccacagcaattgtagaacgcacgatccgctgccccggtatcggcagtttaaaagatatctgttgaatcattctgtatcactccttccaaagagctgctccatctcgtacaaaaagattgccgctgcaagcatgtctgctgcccctcccgggcttatatttttctcaatgcactccaaattaaattgcccaattgcacgatatccttttgcagtaaatgctccatccatttgcaaaatctcagccgcgcgcgcctttatccagtccaaatcttcttttgttccccggcttaaaatattggtatcatttaatctggtcataacctgaagcaacacattgatattggataaattctgattatatgctctccttcgatattctttcagacttggataagcgacctctcttaataccggaaatccctgcattgcttcccctcggattcctttttctccatatgtatgataaagatattctccatgcgaagaaggagttcgatgtttcatttcgtcaaattctttttgtaaaatgtctctcgtcattctttgacatatggcaaatacttcttctatctctacacttgcgtactttctgacagagattcctgctgccgccgcaagaattcccatcgtaaaaatcaatcccttatgggtgtttactccatcggtcgcttcaaacatctccgattcggcttctaccccaatctgtcggattctctgaaagacactttgctcttcttcccttctctgatacccgcaataaaacatctttacaatataaggtgcgattgcctctgcactctctgcaaatgtattgacattcatatcccgatgtgctccgttgtcatgtcgatccaccagtcccggtttcggtgtcgtataaacttctcccatcagagaatgataaacaatatcttccaactgcatatacaattttgattccagatgcgtatacacatccgaaccatcccaatattgtgcctgcatatattcgctgctcattcgaccgtcccctttccattttttagaaaagagatagcggacacttccactatctcttttcatgacaaatctatacctgttcgtatccccaaagattttctactatgcttgctcgatataatcatctacaatctcaaataactgtttgattttttcttttctctcttccattttctgtcttcccggaacaacctttgtgttataaatataagatccgaaaatattttttgttaccatactttctctacattcaacctgtgccatcatcctgaactcctccttcattttattcatctcatatgttcaaaacgtttatccttttccttgatttcactataacaaagaataggcagataatctaattcacaaagattatctgcctattcacaaaacgcatatggtattccaaaagtatttgtggatccttttgccatacgcaaaaaactggttatggacggaaccgctcatcttttggtgtgcaaaaaaaatgctgaacaacaatcaaaactgtcattcaacatttttcatttctcttgtaccttcaaaactacatacagttaaaaccaacatcatcatccaaacctatcactgtcgcaagcgaccgccgcaggcgcaagaatgtgccaaggcacattctttgttcttgttgacttctttttctaaaagtgatatcataatgatatcaaataaatttcattttatttccagaggaggaatcactatgaatgaaaaaatattatcaaataagaaaaacggaatgggaatgcttctgctcttttgtctgctctatctgatcgcaatagcaggatgtattctgtctgcaattgcactggaacatgaattctcagctccaccggttatcgctggactggttatcagtattatctggctatgtattggatggattccattccttggactgaaagtgttgaaaccgcaggaggccctggttcttacacttttcggaaattatatcggtacactgaaagaagccggattctattttgttaatccattctgtaccagtgtaaaccctgcttccaagacaaagttgagtcagagtggagatgttgataacaattccaagaagggagcaaatctttccagtctcctgggtgtttctacaacaggaaccactgaagagtcttcaagcaaaaagatttctctcaaggttatgacactgaacaactcccgacagaagatcaatgactgtctcggaaatccgattgagattggtattgccgtaacatggcgtgttgtagatactgcgaaagctgtctttaatgttgataattacaaagaatatctctcacttcagtgtgatggtgctcttcgtaatattgtccgcatctatccatatgacactgctcctgatgtcgatacaaccggtgacggaaaggctgatgagggaagtctccgtggctccagtgagattgttgcagcgcgaatccgtgaagagatccagacgaaagtgacaaaagcagggcttgagatcatcgaagcaagaatcacatatcttgcttatgcaccggaaatcgctgctgtcatgctccagcgtcagcaggcttccgctatcatcgatgcaagaaagatgattgtagacggagccgtcggcatggttgaaatggctctggatcaattaagtgaaaaagaagtggtagaactggatgaagaacgtaaggctgctatggtatccaatttgctcgtagttctgtgtggaaaccatgacacacagccaatcattaattccggaagtctgtactagagatggctgaaaaagataataaaaagaagcaggttcctctccgtctctccgctaaactgtatgacgcaatcgcagcctgggcagaagatgattttcgttccgtaaacggtcagattgaatatcttctgactgagtgcgtcaggcagcggaagaaaaatggaaaatatgtttccgaacatttggacgaaccgattgatctggatatttcatagagcctaaaaaaacagcagcagatgttattataacgacatctgttgctgtttctctttgttctattctctgtaaccacttctgcatttttctacaaaacgctccgcaaattctttacaagatgggtaatacaaatgcggatatcccgccacgagattctcttccagatgcatgcattcccattttctctttccatccggcttgacagcaagacagtcacttccactgtctgtgctatcccagtaatgaaactcgtgtgcacggatgttttcccccggaagaatccagctgtccgctatactcatccgttctttaagctcagaaatctgatcctcatcaagattcctttgtaaattcacatatccaaatcgaaccagttttcctgtcggaaaggttctccctttgattcgcccaactagtttccagacatttccagcggtgtcttccatctcttcatgaagatacataaatccgccacactctgccagacatgggatcttatcatccaatgctcttcttattgattcaagcatgctctgattttctgccaattcttttccatacagttcaggataaccgccaccgagaagaattcctttcacattttcaggaagttttttatcatgaagcggactgaattctatcacttcacagccaaggctttctaatagttcaagattatctttgtaataaaaacagaaagcttcatcacgcgccactgcgattcgaactggatcgttcttactttttaaatttccaaccttctccgattcttctgaaacttctgctttccatactgctgcttcaccggcaatcttttccagcaattcaagatccactgtttttgccagaatttctcccgcctgtcttaccttctcctgcagattttccatttccttcggtgttacaagtcccagatgacggctttccagatgaaaagcttcattttccggcatgtaaccgacaattttaatctcgtcttgcccgattctcgccagttcattctccaacatttcttttaatcttggatatagcattgcggatactctgtttaagagaattccacgaatattgctatccggacgaaattcaacaattcctttcaccgtagctacaagtgtcattgctgcacctctcgcattaatcacaaggatcactggcaatcctagcgtctgtgcgacatcataagaacttccttttacagaatcaagtgacattccgtcatagaaccccataacgccttcggttatagtaatatccgcatctttcgtatgctttaggtatccctctttcaaaatgtcttcttccgagaagaacagatccagattcttagaatcaacgccaagaacttctctatgaaacataggatctatataatccgggccacatttacacgcacatacacgctttcccttttgcttaaacgcagacatcaggccacaggctgcagctgtctttccactattactggaaacagcagacaacaaaaaccctggattttttttctgatttttattattgcaagcattctctttcatttttctcatgattctcctgtctgtttgtttccttttctctcatcttatacctgtccagactttcttccacctgcggaaataatataaaccggattctgtcccatcatcatatgatatcttccaagaacctttgatcttgctgcactcacctgtagaatctccgcatctggaaggattccctcttccacaagccccatcacttcactgactgtctcaagtgaaatcgcattgatcacgattcgtacatccgaatttttcttctgaagtaattgaacaatctctcttaagtttccggaactcccgccgataaatgcatgtgttggtacttctaaatcttccattgcatgtggcgcaagcccttctatgattcgcactccgtctgtcctaaatttcttccgattctgatcgatcagtttcactccttccggattcttctcaatcgcatacacacggatctgttcacctgcacgtgcaatttcaatagaaacggaacctgttccggcgccgatatcatacacaattgcatcctcggttaattcaagctctgctatactgacagaacgcacttccgacttcgtcattggcacctttcctcggagaaattcttcatctttcagatgcataccggccgccttacaatacgatggattttctacaagaactgcgcaaagtccttcaaaatcttctgccttcatctcgtacaatttgcccgaaagtatcttttcttcctcataagacatctgacatcccacatgaacctgcacgtcccctaagccatactctagtaatgtctcatagaaatgacgccccgtgtcttttcctccgagaagcagaaaggtcttcgaatgtctgtgaatcgtctgtacaaaattcatgtcttttccatgaaggctcagaatttttgcatcttcccaggaaacaccggcttttgatgcaagataagaaagtgaggaaattccaggataaatctctatctgatcagaacacacttccgtcaatcgctctttcagttttttcgctccactataaaatcctgtatctcccgaaagaagaattcctattttactatgttctttgtgctcttttatataggatacaatctcttctgtacgatattccttaataaagactccttcattcctgttgtttctctcacactgacgcatacttaatctattcatgctacgaatcttctgtgcactcgtaatcattcgttctgctccgatcagacaatccgcctcttctatcaattgtctgacttcttctgtgattacatcaccagatcccattcctattcccgcaaggataatttgtcgtgattccatttcatctcccactatataactatttttcccttgattcttttggtttctatctgctataataaaatctagaaacgggtttttaccacacttcttgttgtggcctgcccgtttcttttttcttataacagtttataccccctcggtgtcaccatccgtccattcagttccatcgttcttgaatttccaataaacactgttgtaaacatatctaccttcgtatctctaagttctttcaatgacagaatctgataagtttctccttcacgtccgatattcttcacataaccgcagatatttcctgcatctctgtactgaagcagtatatcacatgctttctgtaaataatctgcacgcttcttacttgacggattgtaaaggcagatgacaaaatcagccattcctgccgcatgtagacgcttctcaatcgtctcccacggcgtcagaagatcgcttaagctgattacagcaaaatcatgcatcaaaggtgcgccaagcactgctgccccgccggatgccgctgtgattcccggaaccacttcaatctggatggaagggtattcttttcctatctcgaagatcaatcctgccattccatagactccggcgtctccgctacagatcattgcaacgtcctgacctttttctgcttcttcaaaagccattctgcagcgttccggttctttccgcatcggtgtgctcaaaaatatcttatcaggaaactgctctttcacaagatcaatataaacattataaccaatcaaaacagggcaatgctccaatactttctgtgcacgcactgtcatctgctcttctgctcccggtccgagtcctagtacatatactgtactcatttgctttgtccctctgcttcctgtctcatctctgtgctttgattctctctggtttgtcctaattccttcttagaacaggatgcttgtctgaattctgtcgtaaatgtcggatcataaagctttgatctctcataagtcccgtcaagcacttctccgactacgatcagcgctgtcttggtgacatccgcctcgcgtgcagtctgttccagcgttcctactgtgcagcgaagtactttctgatccggccaggttgccttatagacaatagctgccggtgtatcttcgttgtatccgccttcgatcaattctgctgaaagctcctttaacagtcctgtgctcaagaaaagtaccatcgttgcctgatgtgccgcaaagcttctaactgactctttctccggcactggtgtccttcccgccattctcgtgatcacgacagactgagagatccccggcaatgtatactctgcttccagtgctgccgcagctccgcaaaatgaactgacacccggacaatcttcatatggtatctcaagtttcttcagttcatccatctgctctcggatcgcaccataaaggcaaggatctcctgtatgcagacgtacgatttcttttccgtccccatggcccttcaccatcacttctaacacttcttccaatgtcatctttgcactattatatatctcacacttttctttacacagtttaagtaatcccgggttcacaagagaacccgcatagatcacgatgtctgcttctttcaaaagtctttgtccgcgtactgtgaccagatcttctgctcccggacctgctcctacaaatgtaatcataattcttcctgccttttctatcttttcctgtcttttacaattagaagggaatagtatcccgcatcttctgaaatctcttccactgatcggacaatacgttcgtcgtccattccacagttttctacaagacagatatcctgactgctcccctgtaaaaactcttttatctgtcccatctttttcccggtcttcatcaaaatctttgttcccgataactgcagaccttctcctgcctcataagagcccggtaaaatatgaatctgctcttcctgttctccaagtggctgattcagtcttgcagctgctgcacaaaaagatgggattcctgaaactgtctcaaccggataaccatcctgttcaatcatctgctctatatacatacatgtagaataaaccgttggatctcccagcgtcaggaatgccagattccatcctttctcaagaagctgctctatcacttctgctccccgtgcatgaatctttctcagcttttccttatctttgatcattggcattgggagaaagagaatctgcttttccttaagctctgaaactgtctgcactgcaatctgataagctgtacagctttctaaatatcctgctgctctgttttccatctcattttgttctagcagtagcggctctgtcaattctctatttgaaaccggaagtactattacatcacagttcctgattgttcgaactgcttttaatgtcattaattcaggatctcccggtcccactccgattccataaaattttcctgcttgtttcatctattctcctgtatcttctttaacaactcatccgcattttctgactttccaagaatgccatcctctgttgaaaataaaatcacaccgatttccaattcttctcctgctctgttctttaagaagaattcaatccgtttcatcacactttccatcaccggctcaatcaacttctccctgcgcagtatttccattacttccgttgtattgatacaatccatgatttcccgcacaactgctgcatctgcaccattcattgctgcatgcacgccaagtacttccattcgacaatctgcctgtctggaatgcgtattcatcactcctgcggccagcttaataaactttcctatatgtccgatcaacaagattcctttcattccaagaagctttgcatcctcaattgtctcgccgacataattactgcattttactgaaagtgcggtgtccacatgcagctttttccgtaagaagtccatcccataatttcccggaacaacataacaccaatctgttccattttctttgagcatcttcatttccagataaatcgtatccgtcagtgccttctcactcattggttccacgatacctgttgttcctaagattgagattcctccctcaatccccagtcttggattaaatgtcttcttcgcaacctctgccccttccggcacggataggcgcacttgcagatttcctgtatattcatacttcctgcaaacttcttccactgcttcacagatcattctccgcggtactttattgattgccgcctgaccgattttctgctccagccccggttttgttacccgaccgattccaacaccgccatccagattgattctctcggaaagatctacactattctccgaatttattttactcttcttctctaccttttgaactgttgcatacacaagtattccattcgttacatccgggtcgtctccactgtattttcgcactgcacacgatacttctgacttcttacgcatgatatcttccagctcaagatacagttcaatccccttcggtgtcagcaatctcacctgacggatttcttcacctgacagcaacatctctgtcgccgcttttgccgcagccgccgcacagcttccggtcgtatagcccatctgaagcccggacctggtcttcccgatttctttcattagtactcaatcccttttctcgcataaatcccctgatcaaacggatgcttcactttcttgatctctgatacatagtctgcgagttcaataagtttttcatccggattacgccctgtcagtacgatttccagttcttttggtttcttctccaggaactcgattgcttcctccttcggaatcagatcatacatataagctgccataaactcatcgattacaagcacatcatatcttcctgtaagaatctctaattcaatcgctctccatagccgcagataagtttcccttacttcctgctttttctcttcggaaagatttttaaaaaagccataagacttttccagatgaagtactttaatctgagaaatatcatcgagaatcgccagttctccggaagattcattttttaaaaaccgggtaaataaaaccttaagtccacttcctgcagcacgtactgcaagtccgattgccgctgatgtctttccttttccgtctccacaataaatgtgtatcaatccctgttccattttctcatctcctgttctgcttcctctaccgacaatccctcttctatcggccttccgattacgagaagaaccgcacctgcctgctctgctgcttcaagcttttctgcaaatccgccattctttccggattcttttgttacgaaatattttgcctctgtctgacgaagaagtgcaagattcatttccctggaaaatggaccctgcattgcgatcagatgctttcctgagaatccaagttctatactctgcatcacggaaggaagtactgaaagtactcttgcataacatcgttctttataatttgtcaaacgagtatatttatccagttctttactgcctgttgttatcagtatatttccctgcgtctgctcgagatagtccacggcctcttccacgctattcacacagactacagaactgtcactcttaataatcgcatttgttctttcacaagcaagcttttctgacctgactgtccttgcttctgtcaaaaaatctcttaaacatcgtaaatactctattccgctgtttttacatgcccgctgtatattttccgtcactataactgcaaacggatgcgtcgcatctatgacaagccccacctgctctttttcaaagaatgcttccatctcctgctgatccatacgtccgtggatcactcgaagttctgatttcttatgcttctcttttcgcaactgcagatcattttccaatagttcttccccatattctgtcgcagcacttacgatacagggaattccttttttaacggcgtattctgccagctgtcgtccctctgtcgtaccggcaaaaataagaatatttttcttcatcaaatcacccacatttacatttatttaataaacttatcgattgcctcgtcaagagcacggattgtctccatatcattctgctcaatagcttccacaatacaatgatccagatgattcttcaaaatcacttttcctgtattattgattgcagaacgaactgccgcaagctggatcagtacttcactgcaatcttcatcgcgctccaccattcgcttcactgcctcaagatgtccgattgctctggataaacgattcattaccttcttcttttcttctgcactgtgtacatgacggtgaacatatcctgtgccgccatgatcgtgatgatgtacatgtgactctgccaccccatctccgttatgatgcacgtgggtatattctgttccgtcctcacggaaatgcgtatgctctttcataatcatccatcgaaccctttctttttactctgtcactgattataaagcaaaaacacgttttcttcaacttgttccgcataagttacttactattcatactgtgtgcgaccggcaaccacaaaattttctcttgcatttttccaaaagccgtgatatcttaatatgcaagacaaagacgtctgacagaaaggtaagagattgcctttctatcaggcgtcttttttgcattatcagatgaattgggaggatttagaaaatgaacaccggaaacactgcttttatgatgatctgcactgcgcttgtcttctttatgacaccgggacttgccttcttctatggcggtcttgtgcggagaaaaaatgtatgtaacacaatgatggcctgcgttgcgatcatgggactatctgttcttctttggaccatgtttggctattctctttcttttggcggcaatcacgccggaattatcggagatttccgctgggcttttttaaatgatgttggctgggaagccggtccgtatgcggataccattccgcatcttgtatttgctgcattccagatgatgtttgccatgattactccggcactgatcaccggtgctgtggtcggaaggatgagatttaaggcattattcgcatttattgcactgtggtctttcctcgtttactatccgatggctcatatggtctggggagagggaggattccttgcagcaatcggctccgttgactttgcaggcggaaatgtggtacacatcagttccggtgtcagcgccctggttctcgcaacatatcttggcagaagaaaaggatacgaaaaaacatcttaccgtatccataatattccttttgttgtgcttggagcttccctgctctggttcggatggtttggattcaatgcaggaagtgccctggcggcagatggacttgcagcccatgcatttatgacaagtgcaatttcttccgcagctgctctcgtatcctggatgctgatcgatgtgatcaaagacgggaagcctactctggtcggtgcttctaccgggctggttgtcggactggttgctattacaccgggagcaggatttgttccgatctggtcttcctatatcatcggtgcactggtcagcccgatctgctactttacaatgaacttcattaagcataaactgaaaatagatgatgcactggacgcatttggctgccatggaatcggcggtgtatggggtggaatcgccaccggactttttgcaaaaacttctattaactctgttgcaagatgggacggactggtcttcggtaatgttcatctcttcgttgcacaggtattaagcattatcatcactgcggctgttgcagttgtcggtactctgatctgcattggaattatccgtatcttcaccccactgcgcgtagatcagaaggaagaagctcttggactggatatctcccaacatggtgaaaatgcatatccgtccttcaacggattcgactaatataatctgtccaaaatttatatatccattaatacaggaggatttttaaaatgatgattaaagtagaagctatcgttcgggaagagaaatttgaggatgtcaaggctgccttaaatgaaatagaagtcaatggtatcactgtctcccaggtcatgggatgtggtgcacagcgaggttataaggagattgtccgtggttctgagattgagattttcatgcagccgaaaatcaaatttgaaattgttgtctcttccgaagaatgggagaaaaaaacaatcgaagcaatccagaaagctgcctataccggtgaagtcggtgatggtaagatcttcagctatgaaatccggagtgccatgaagatccgcacccgtgagacaggatatgatgcactccagtcaaaagaacagatactttagtagaaaaaaagttccagaatgtcgaaaaattctggaactttctttcgttttaaaattgaagtgttacttctgtctctgtcaatgccaccgtcatctgctctcttatgcacttgggacacagcagttctccgtcagcatctgctgtccgtgcagctctctcacacacattgtcaacacctgtcacctgtttcacaaaccgtgatgtggctgatacctctgtaatcttctctaactgttctgccggataagttgcaaacggtactttatatttctgcgcataggccaaaatcgcaggttcttctttcttgagatcaatcgatgcaagctgttttaactgcgtaggttcaagtccatacccttccagaacatcgtttagacccttttcaaaaagttcttttgaaatctgttttctacagcctactcctgccgtgatattgattggatacaaaaggagaatgcatggcttacgctcacatccacatacgttattcctgacatctccccacagagaacccgctagggattccacgaactgtctcccttcttccgcggtctttgtgatcacgatcacaggatgttcctctgcaaaagagtacaattcttcctgtgaaccacatagtataagttcttttaaacagcttttctgaaaatcttcctgttcaaataccagtccttcaccgatccacagaccgacctgctttccatccagcactgcagctgatatctgctttgctgcttcgcgctctgtaaaatacaggtgattcttctttgcaaaaacatctactgcaaattttccctgaacatctgtcgctgttgtctgtaccggaactgcaccggtccatactgcaagctgattggaaagttctaccgcacccccgagatgtcctgacagcagtgggatcacataccctgctttttcatccatgactacgaccgctgaatcagtgaatttatcctttacataaggcgcaatatatctcactgcgattccaactgcaccaataaaaaggaaggatgtctctccccatccttccctgatcagctcttttggattgtccggaaacggaagaatgtcagcgaatgcatatccggcaggtgcatagttctgacacgtaatcccttcgttccggaactgacttccaattctctcaccaagtcttgttcctgcctgtgtaaaacttaatataacaaccttcacgttccattctcccttaaatccttgaaactattcttctgtctcttctttcacagactcttctactgcatccactgcttcttctgcggcctcagtaaccgcctcaactgctgcttccgcagcctctgcaacgctctcttctgcttcctctgcctcttctcttacttcctgaaccagatcatcagcttcaaaaatatcttcttcctctgttacaggtgatccgcagtatgggcagaaagccatatctttcgcaaccatcttaccacaccgtgtacactcacacgcaccttttagcccttcaatcttattctcatactcttccatgctttccttgcggcttgcaattgcctcgcacagtcccttggaagcctcatccaattcttctccattctcaaatctgtcataaatactctgaccaagttccatcagatcttctgcatttcctcttgcaagctctctgatctgtgcttttaatttctgtatctcaatcgcatctcctgcctttgctgtcactgcctctgctgtctcgctcagacgttttcctaaatcttcaaaaaaatctttcatactgaaatctcccttcttatcattgctgtatcatctcaaccaccagaaaggtgatctacaatttctcttggtcttattatatcgtattcttccagtttttgaagtcattttctattatttttagactaatttcataaatagaatccttcttgcatatcctttctacaactcaactcaggagtcatcttatgaatgatcttgaaacttgcagggaacaaatactctccgaagatacacgcgacttcatcagtaatccgctgcgcactccactgttcaatgaacttctgaaaaaagatccatgtatccaggatgccgggcttggatatcagtgcatttatttttccaaagaacttgtagaaccaatctctctggcgcgtttttcttacaattctattccgaattgttttgctcctgtcgctatggaaacattgaaccagaccggcatccttcctgtgcagaactatccggcacttcaattaaaaggaaaaggcgttctgattggatttcttgacagcgggattgactatcaaaacaaagttttccgcaatctggacggtaccacgcgaattgcggcactttgggatcagactatccaaagcggaactccacccagagacttcttctacggaagtgaataccgtaaggaacagattgatctggcactttcttctgattccccactgtcacaggtcccttctgtcgatatcgacggacatggaacttatattgccagtctcgctgccggaaatgctgacgctgacgaacagtttctgggagccgccccggaatctactctcgctgttgtcaaattaaaacaagcgaagcaatatctgcgggattattactgcatcacggaaacagccgtctgctatcaggaaacagatctgatccttggattaaaatatctgaatgatctggcagatgaactggggcttccacttgtcatgtgtatcactataggctctaatcttggcggtcatgtcggcacgcttccgcttcccgcattacttggcagctacagtctgatgcccgaccggattgctgtggtcggcgcgggaaatgaagcagacaaacgtcatcattatttcaatacgatccagtcagaaaatgaccgtaaaactgtagagatccgggttggtgaaaatgtatctggtttcactttggaactttgggtactgatccccaatctcttctcaatttcaattatttcaccgtccggggaaaatacatccaaaattccatttcatgtaggcacaagtgcagacattgattttctctttgaaaaaacccgcgtctctgttgactaccggcttctggtcgaaaaagcaaactctgaactcatcttcttccgtttccgtaccccggcagaaggcatctggaaaatcatcgtagaaccgacccgcctgattaatggtgatttccatatctggcttcctgtcacagaatttttagacggagaagtctatttccttgaatcagatccttacacgactcttacaaacccggccaatgcccctagtcctctgacggtctcctattacgacggcagcaatggtgcagtcgcccaggcatccggacgcggctatacaagaacaagctttaagaatccttccatcactgctcccgggattaatatcaaaggagctcttccaggagaccgttttgccgtgcgcagcggctcctgcgccgcagccgctatcaccgccggggcagtcgcacttatgttagaatggcagctctatgaacgcaaaatgcccggcatcgacgtattccagatcaaaagccttcttgttcttggagccatccgaccagacagtatggaataccctaaccgtgaatggggatacggacaattaaacctctataacacatttgaggtcatgagacagctttaactgtcccatgacctcaaagtttctacaatatcttttatcgattcttttctcttttgttctatctgttatcttctcgattctcatagtagcttgtaaccttcttagcatcttctacctgtgttgacggtcctgttccaggagcgaacactactttcagaagaatcggtgtgatgactgttgtaataacaaccactacgataaccggtcctaagatggaagaactcataagtccgagtgcggaacctttacttgctacgatcaaggcaacctcaccacgggagatcattcccactccgattcgtttcgcctgataattcttgtaaccacaaatctttgcaccaagtccacagccgactatcttagtaagaactgccacaactgtaagagcaactgcgaacataatgatggatactgacatctgtggaaggtttaccttcagaccgatacttgcgaaaaataccggtgacagaagcaggtaagacaacgtatcaaacttagactccagataagtagatctctgtacgttggaaataattaatcctgcgatatatgcacctgtaatatctgcaacaccgaaaacttcttctgcgataaatgccataagcaggcagaatacaaatgcaataatcgtatgacgatgcagttccttctcagctccgtcaacccatttcttatacatcttatagaaaacaaatcctacaacacctgaaaatacgaagaatcccacgattttaatcagaaccattccaatctttacagaatcatctgcaagacttgtaacgattgtcagtgcgataataccgagaacgtcatcaatgatcgcagcaccaaggattgcatttcctgaacggctcttcaatgctcctaattctttcaatgtctctactgtaatacttacagacgttgctgtgagtacaactccaataaagacattctgaagaactacaggggatgacaggttgcttcctgccatgcttggacggttaaagaaccaggcaacaccataacctccgatcagtggaacgatcacaccacaaagagcaataataaaagaagcttttccacttgctttcagctctttgatatccgtctccatacctgcagtaaacatcagaacaataactccgatttctgcaacttcatggataaatgaagtctctgacagaattccaaatcctgccggtccgaggatcaatcccgccagaagtgcgccaacaacctgcggcatctgtactcgtcttgttaatagtccaagtaattttgtagatataagaataattgctaaatccagtaagtatctgtatgtgtccatttttttctcttcctttttgtgatttttttaaactaattccccaatcagttttcagatttttgaacaaaacttctctttctaaaatctcactttatccatctaatctcggtactgcctgacctctcaactgaataaccggtccgccggtaccttctatataagctcttgtaattgttacttctccaatattatcatctttcggaatctcatacataatatccagcataaactcctcaatgatcgcacgcagtgctctggctccggtatctttttccattgccttttctgcaattgcttctaatgcgctgtcatcaaactcaagcttcacttcgtctaatgccagtagcttctgatactgttttaaaattgcatttttcggctcttttaagatcttgacaagcatctctttgtcgagtccctttaatgtaaatacaatcggaagacgtcctaagaactccgggatcataccgaattttcttaagtcctcaattgtcaccttagagagcagctcttcatcatgctcgactgtatctttcagttctgcattgaatcccatcgacgttttcttctgcagacgctctttgataatgtcttcaagatccgggaatgcacctccacagataaacagaatattttttgtattcactgttgtcagtggaaccattgcattcttgctgttcgcgcctaccggaacttcaacttcacttccctctaagagtttgagcattccctgctgcacagattcaccactcacatctctctgactggaagtttttttcttggcaatcttatcgatctcatcgataaaaataattccctgttccgcccgctcaacatcgttgtctgctgctgcaagaagcttggaaacaacactttcgatgtcatcaccgatatatcctgcctctgtaagagatgttgcatctgtgatcgccaacggcacatctaaaagcttcgccagtgtcttaaccaaatatgttttaccacatcctgtaggcccaatcatgagcatatttgatttctctatctcaatctcatccattgttcctgttgctacacgtttgtaatgattataaactgcaacggagattgctttctttgcatactcctgtccaacgatatattcatccagacgtgctttgatcttatgtggtgccggaatctttttaatatccagctgtttgaattctttcggctctttctttttctttttgattttctgtgctttcggttgcagattatcaagatcagaaagattcataaagtgtacccccggaatgttcatcatgctgcttagatccatagaactattgttcatcatatcgaagcttctctgcatacaatccggacatactgcgatattattcggaagctcaaccatcttcccagtcacactctccgggcgatgacaaataaaacatattctctcatatccgtcatcatctttttcagaatggtcagaagttgtcacttcttttttttcttcttccctgccagtgtcctgtctgttgtcttccttgtttgtctcttcttcatctacaatgataaaatcattttctgacataggttgtccctttctatcgtatgaacatcgcatccccaaaactgaagaaacgatatctttcttttactgcctcctcatacgctgccatcacatgctcttttccggctaatgcagaaacaagcatgatcagtgtagattccggcagatggaagttcgtgatcaacgcatccagaatcttgaactgatatcccggatagataaagatttctgtccaaccactgcattcttttaatcttccattctcatcggcagcggattcgattgttctgcagcttgttgttccgacacagatgacacgatgtcctgcttcttttgcatggttgatcttctgtgcagactcttcagtaatcatataaaattctgaatgcatatggtgatgctccacatcatctaccttcaccggacggaacgttccaagtccgacatgaagtgtaaccggtgcgatctccacacctttcgcgcgaatctcttccaaaagctccggtgtgaaatgaagtccggccgtcggtgctgccgcagaacctgagtgtaccgcatagacagtattatatctgtccttatcctgaagctgatgtgtaatatacggtggaagcggcatctgtcctaactggtccagaatctcctcgaagattccttcgtattcaaaatggatcagacgatttccttcctccactacatccataacttctccgacaagcaggccgtctccaaagctgattcttgctcccggtcttgccttttttccaggctttaccaatgtctcccagacatcatctgctcctcgttttaaaagaagcacttctatctttgctccggtgtcttcctttgctccgatcagtctggccggaattactttcgtatcattgataaccagacaatctcctggattcagttcatcgataatctcacgaaatacatgatgctctgtcttccctgtctctttatcaagtatcataaggcgggaggaagagcggtcctccaaaggatcctgtgcgatcagttcctccggaagatcataataaaaatcacttgttttcaatgctcttaccctctcttcttactttctcaactcaataccaagttcttccagaccggaaagaatgcgatccattgctgctgtaatttcagcttcttccagtgtcttatcctttgcacggaatacgatagaataagcaactgacttgaatcctgctttgatctgagcaccttcatagatgtcaaacaggttaaagctctctaaatgagcgccgccctttttctcgatcacatcttcaatctgtccgacaagaatctcttttggaacaaccatactgatatctcttgtcactgcaggatattttgcaattcctgtgtattttctgtcaaatgtagcatatgggatgatttcaggcatatccagaactgcaacatatgcgcgctcaccgattccatagatatcagcaacttccggatgaacttctccaagatatccaactacttttccatcataaatgatgtttgcctggcgtcccgggtgaaggaatgactttcctgcattcggatcgtatttctctctgcccttcataccgattttctcaaagaactcttccactacacctttcatgttgaagaaatctccatctccatacattccaagtgtaaactgcattctctcatccggaagctctgtcagtggaagttcttttggaatataaatatttcccatctcatacagacggacattcttatttcttctgttatagtttgttgcaagagaagtcagcataccatttaaggatgttgtacgcatgatactatagtcttctccaagcggattcatgattgagattgcattgcgaagctttgaatcctctggaagaagaagtttatcaaataccttcgggctctcgaaggaataagacattccctgactgaatccacagaactcagcaatatcacttgccacctgctcaatacgaagcttgaacggaagcttacctgttgtagcctctccagacggaagtgttgtcgggatattgtcatatccgaaaaatcttgcaacttcctctgcaaggtcagctaatctgaacagatcgtgacggaatgtcggtgcgatcacttcttttgtctctgcatcgtaatcaagatcgattttcttgaaatatccaagcatatcttcctcagaaatatttgttccgagcatgcggttgatcttctctgcatcaaatggaacacgtacaggctctttcttcttgctgtatacgtcaattgctcctccgacaacttcacctgctccaagctcttctacaagctggcaggcacggttcagtgctgccatcgcattgttcggatcaagtcccttctcaaacttaccagaagcatctgtacgaagtccgacacgcttactggacttacggatgttcaccccgtcaaaacaagctgcctcaaaaagcattgtcttcgcgttatctgtgatcatggaattctctcctcccatgattccggcgattccaacagccttttctccgtcacagatcatcagaacatctttgtccattgttctttcctgtccatccagtgtaacgaacttctctccatcctgtgcattcttaactacgatctgatgtcctgcaagtgtatcaagatcataagcatgcattggctgtccgtactcttccattacatagtttgtaatatcaaccaggttgttgatcggacggattccaacagatgacagtctgcgctgtaaccactttggtgatggtccgatcttaatattcttaaccgctcttgcgcagtatctggaacacagatctgtattctctacagtcacctttacatagtcattgacatcctcatcatttcctgtctctgtaacaaccggtggtttaaactctttattaaatgtagcagctgcttcacgtgcgatacctactacactgtagcagtctacacggtttgatgtgatctcatattcaaaaacaacatcatgaagaccaagaagttctatcgcatctgctccaacctctgtgtcctccgggaaaatgtaaataccattctccggctgttccggatacatctcctttgtagaaccaagttcttcgatagaacacatcattccgtaacttggaactccacggagttttcctttcttaatcttaattccaccggcaactctctgtcccggctcatgtccgcctgcaacgcgtccgccgtctaatacaacaggaactttcgctccctcgaacacattttttgcacctgttacgatctgtataacctctgtaccgatattcacctggcaaactaccagcttgtccgcatccgggtgtttctcaattttctcaatctgacccacaacgatcttgtcaaggtctgcatccagctcctcgaatccttcaacctttgttcctgtcagagtcattgcatctgtatattcctgcgctgtcacgtcaagatccgggacatacgctttgatccatgataatgaagtatccattttatatctccttttttagtttaatttcatcaaaggggcggctctaaaatccaacggctctgcgccgttgccgcgccgcattcgcgccgcttgaagattttatcgcgctcgttagaactgtttcaggaatctgatgtcgttctcgtataataaacgcatatcgtcgatctcatatttcagaagagcgatacgctccagtcctacaccgaatgcaaatccgttgtactcttccggatcaattccgcacatctcgagaacatgtggatgaaccataccacatccaagaatctcgatccagcctgatcctttacagaaacgacatcccttgccgccacacttaaagcagcttacatcaacctcagcacttggctctgtaaatgggaaatgatgtggacggaattttgtctttgtgtccggtccaaacagctcttttgcgaatacttcaagtgttcctttcaggtcagcgaaggaaatgttcttgtcgatcacaagaccctcgatctgatggaaggatggtgaatgtgttgcatctacttcgtcggaacggaatacacgtcccggtgcgatcatacgaatcggaagttttccctgctccatcacacgggcctgtaccggagatgtctgtgtacgaagtacgatatctttattaatatagaaagtatcctgctcatcctttgccggatgatctgccggaatgttcagcttctcaaagttatacagatcatactcaacttccggtccttctacaacttcatatcccatgcctacgaagatacgctctacttcttccagtgcgattgtgttcggatgtctatgtcctacactgttcttcttagatggaagtgtaacatcgattacttctgctttcagcttctcttcacgaatcgctttctccattcttgtcttagattcctctaagagttcctcaattgctgctcttgtatcattcacaagctgtccaaccttcggacgttcctccggtgcaacatctttcattccttttaatacggctgtcagttcaccttttttaccaagaaactttacacgcacgtcattgagtttctccggaacgtcagcctcctgaattcttgcgactgcttccgctttaatctgttccagtctttctttcatcgttttctcctttcttaactcacttatcagggacgaacgttttcataaagaaagacctcatcccaaaagggacgaggtctgaatcactcgcggtaccaccctgattcctgcattctgatctacaggcactctaagttgtgtaacgtacaacatacgacattctctacttttcacatccgaacatatccgttctcctgactgtcccttagatgcttcctttcaaaaatgcagctcacgtgtgaatttcaatcgctatctgaacttaagagaactttcagccgatgattctctctctctgcaagaaaacaggtctctactgtgcacgatcttcgcttttcaaatctaataaacttttcatattctaagtgaatttaccagtctattttaacacagcatttctttttgtcaagtctaaatgaactcctattatagtgtacaatttttgtttgataaaaagaaaattgccaaaagcatctgtttagacacttctggcaattatgtattatcttaattcaaatcaagacaattcttattatctacgtgtaaatctctttctgaaaataacagtaacaattgcagcaccacaaatagccattacaaaaacattcattgcgatattagctgtatctcctgtcttaggagcttctgtctttgttgttttcttatctgctgtatctactttcttgtttgtattgtcatttgttttgttattatccttttctacagctggttttaccggagttggatttacaggtgtagtttgatctggagtcggctttggatctggagttggagtcggctctggatttggagctggttctggatctggagtcggagtcggctctggatctggagtcggctctggatctggagttggctccggatctggagttggttctggatctggagttggttctggatctacagccggaatcttttctacgatcataatgcgtacacgcagtgtgccataagctactttaatctttgtcatctgtggtacacatgatacgagctgatatccttctggcagctggaaatctgttccaagttcaaatgtctttaatacaccctcgccttctgcagctgattcttttactgttgtgcttccaacatactcaccttttactgttgcaaatgtcacattcaaaacggcctctgctgtttctgccggaatagactctacatccattgtatgttcagatgtcactccaagcggtacgtcaacatttgtcgtctgatcctcacttgtttcagcagcaaaaacattcagcgaattaaccagtaacatcgctaatgtaaggcttgaaataaggagttttctcatcctctttttcataacaaatctttccttcctttcttaattatgagtataagtctcttttgtatgacttctaaccccccttcttataaattatcgcaaaaaccattttaattataaaaaacaatttttactatttcaaaaatctttcgatataatatatagagacactcattacatcaaaaaacttctgacttccatcttgtatctgagaggctataccgctaataacatcaattctgtctattatctacccaatctttacattgcggcatattcatacgtttgtagtatacgccttaattattcttctgtcaattatttgtgtactttttgtgtttttcttattttctgcttttaaccccttctaaaattgcattgatttctcccccaagcagaataatatacatacacgtatataaccacaacataacaagaatgattgttgtaaaactaccatacatattagtgaatcctttaaaaatatccaaataaacagaaaagataaaggacagtaccatccagccgcaagctgtaaagaatgcgcccggcaattgtttccgaagagtcgtctttccttccgcaccacgatttggaagatacttgtacaccagatcccagaagaaagtcagaagcggaagtgtgaaataaatcctcaaatgtataatcttatgaattgctttgcttataagcggtgcatgttcataaaccacaacactgatactgttaccgaatacggaaagcaccaatgagagcataattgccacaaggaacaaaaaagtatacatacatgctcttgcgcgaaggtaaaaataatttctcgtctctgtgttttgataaatgcagttcaatccatatgttacagaaagtactcctttccccgctgaccacaaagctacaaggattgtcaaaggaatgatcgtaccggaagtcatatatacctgattcacaatactttcaatcattgggctgactgtggatggaaataccggaagtacagcctccatcacatccgctttcgtcactggtgtaaattgtaccattgttaaaagcaacataaagataggaatcaatgaaagcacaaagaaatatgccgcctgtgctgcgaaagctcccgtgtgatgcgaactcacggtagctgcaattcgcaatccacgatcttttatcttattaaacttctccattttctttaactccccaggttaaatactcagaacggcttatgtttcttctcagccgtcacgaaattgttacttcatggataataccataactattctcaatattcaagcaaaaaagaaagacagccgaatctcttcagctgtcccttaactttatcttttgtctaatccccaaaatgccgttccctgtattttgagtcctagccacggctaggtgggcaacctcatcctgcttttctgccgtccactgcaaaaacggaggcctggcatattactcagtcttatcggaatccctttttaaataatgtaggttcaaaatatcagggttctcgcacatttcaggtttttcttctttcttaacctattgctattatactccatccacatcatttttacaactgtaaatatgtggatttttgcatttacgcgagcaacgagccaaagtccgtgcttgcacgagaccttggcgactgcctatgtaacataagagccagaacagttaccgtgtgtggtgcctgttctggctcttactttaattatctctcaccccaaagttcgtctgcttttgttttccactctttggcgtaatgttcgcattttccgcaaaggtgttctacagtttccggggactgaaggtctgttgattttgcgccggtttcgtgtaccatctgctgcagtttttctggattttcgagcattgggcacggacgcaaatgattgttgttaaatggctgattgttatggtaagccataaacagtggctggcgcagtgcatcaagcacgctcacttctttaatgtttgcacttgaataatggataaatacgcatggctctgcatctccatttgcattaatatggaagtaatttcttccgccggcaatacatcctcctacaaactctccatcattctggaaatcgaatgcaaagagctgttttccacctgtcaatccacggatctcacggatgcggtgatacatgtattctctctgctcttttgttggaagcagatccagtgctgcatcatttccaaccggcatataatggaaataccatgcataacgacatcctttttcaataatcatatcaaggaatttgtcggatgttactgtgtcaatgttagcgcgtgtatagcagattgatgttccaaagatcaagccgtatgttttcaaaagatccattgcatgcataactttctgataaacgccttttccacggcggccgtcgttgacttcctcatatccttccagacttatggacaatgacagattaccaacacgctgcatctcctggcagaactcttcatctacaagtgttccgtttgtaaatgcatggaatacacagtcgttgtgtttctcgcacaagcggatgacatctttctttctcacgagaggctctccacctgtcagcatataaagataaattccaagttcttttccctgtgtgatcacacgatccatatcttcaaaagaaaggttcagaagatgtccgtactctgctgcccagcatccggtacatttcagattacatgcactggttggatccatcagaatcagccatggaatattacactgatatttttcacgtgactcatgcattaactttgttccgtaaagcattgcatcaaatccaagattcaatgctgttgtcttaaggacatgcggatctacttcatcaagaagtctgttcagatactgaacccatttgttgtccggatcctgaatcatctttcttgcagcttcataagaccctggctggaaacgatcttttgcaaaattttctgtaagatctacaagcttaagaagtgctttcgttctatcatctgtcttgttcatatatttaagtactttatctgctgccaaactaaatgctgctctttctgcctgaaattttaatcctgccatttttttcaccttttccttacttttcaaggaacctttcttaagtataaactattatttcataatctagcattttcctttttttcatgtaagattcagttttttccaaatgtgctgtagtttgaacattttctttttgttgttcttttttggctacaaattatgtgaaatgtatccgaaatatcaagaaatttcaacactatgttcttgaaaagtcatgttaaagaactgtcaatcttagaaacttttttaatcacattctcttttttatggtataatatttccattgtagaaaggatttgaacaaatgacagaagtgaaaaaagaactgacaaaagatttgctggcactctctttcaaagaacttattatgaagatgccttttgaaaagattacagttaagatgatcaccgacggagctgatgtgatccgtccaactttttataaacattttcaggacaaatacgaaatcatcgaatatatcctcaaaaaagaaatcaaagataagatccaggtactgattgaaaatgacatggaagacgatcttctccgtcttcttttcacctgtctttctaaagacaaagaattttataagagactttatttgatcgaaggtcctaactccttcgatcatctgatgttccaatttatttatgatacattgcttagattattaaacaaatatccattgaaatcacctgcgaagctccagatactcagtcgcgagacaattgcgcgattttatacctttgggctcgcagattctgtaaaatatgcaatcatgcatgatatcacatataccccggaagagattgcagctgcttatgattatctgattcataactccgcatttgatcttgtggaacatccaagaatctgatgatacatagaggacttaggaataatttttagacatgttaccgcaatcttccatttacccctaatttcaccataagagcttcttgaagaatctgagaaaagttaagattctctcgaatagccgcttcatttaaccattccggaatactgagagtcttttttacagcctttgatctgtgctttctccgatactctgccatatcaaattctataattaccaaaatcccatcttcaggatccaccgtttcaaattctgatgcttttgggatatcagcaccttcatcttctatactggacaatgacaaacctaatgcatctatcgccatttcatatgcttcatccatgctatcgccctgtgtcatgcattcaggaaaatctggaaagctaacccagaaaccgccttcttctgctttatgaaaaacagctggataaaataatctattcttcatcaaataacctctctttcaagcgacaggactatctaagccctgcctgtttaagtattgcctgctccaatccttttttcaagtccttggagtgataaggaacaattaccgtcttatcagttttcagattcttcatttttacatgcgaaccattctgactgattacttcaaatccattttctttcaggagttttagcatctccttcgagctcattggcatcttttgtgtctcctttccttatcatatttatatattactacgtaaaaatacgtgcgtcaacgtatttttacgtatcattgcaaagacgctggaaatctttaaccttactatatttctctcctcttagaaactacgaaatcataaagttaaacatcaaaaataacgcagacaatatctctaccatctgcgccatttctcatttatttgaattatttctgaacaatatttatattcacttgcaaacattgattttacgctgtttttcgctatctatcttttaatttactccatttttactccaaatttaagccaatattttcagttcagctacttcttcttttttcttctcttctgaaacgtgagtgtataaatcggttgtcattgccaatgttgagtgacctaagagtttctgcactacctgttggtctactccattttcataacaccttgtagcgtatgtatgtcgcagagtgtgacaggtaaacagttcaaatatcttcggctctctcttttcttcctttgccagttcaatctctattagaatcgctctatctcaagcagaacatgaagtaacgaacaagaggacttgcaaggtttttgacctttcaattcctctgctgtatcatggtgtgattggcagcgtccgttccgtcaaggactgccctacggcgtatcagcttcgccttgttccttgacctcactactgtttaaacttatctatagatatcaatttttcataaaattaatatgtgtatcaaattcttgtattatatatgttccatgtttagtagcattattattctccgcactaatatcaatactttgattataatgtattcctgttacattttccatttcgattaaaaattctatttttaaacagttctcttgaaagcattgtgtattatctaattcaaacaatatttcctcacctttataaataacactaattgtagaagatacacttacattttttccattaatctttccaaatatgggacgcgcatttaaaattatatcttctccaatgttttttatccatactcctaatattttatcttttgaatggtcatcagtaccatcagcattacaatattgaccaacttgtaacggttgatatatataacataaatcttttacattctttatgttttcttttaatccaaaataacctattttttgtcttaattgttgtttcataaaattcttactaatttcttccgtctttatactttgtagccaagacacaattgctaaagatactgttccaaaatatgccatatatccataccaaaaatctggattatcaaatataactttttcccaaaatatataagcagccaacattccgataaaaggtaatactaaaacaacactccctaccaaaagcactttacttctactcattttaaaatctcctattgattatactttctttctaattttatcatatatttactacaaatacattctcattataagcctgcaaaaattcgtttaccacccgaaatattttaaaacagtaattcataatttttctcgacagttgaccctatatatcaattttatataacatgtgcgatatttataacaacaagaggacttgcaaggtttttgacctttcaagtcctctgctgtattatggtgtgattgacaacatccgttccatcaagaactgccctacggcgtatcggctttgccttgttcttgacctcactaatttataagtaaatctgtttcttccagatatttaataaatgtttctttcattctttttgctcgttctattatatcatcttctgtaaattcatctgcattattagctagagacaataattcataaatctttgttccttcctttttctttccagattctgtaacaaacccttgataatacttcttcttgtcttgaaaacgatagtcagaagccctaatattaatattttcttccaataatgctttatttcccagcgattcaatattattcttatctatcagcgtcttttcattctcctgtcttttcttcgggaaaatatgttctatctgtaattgagtatctaactttaataaatcttgtttttcattgtgaaatgcccaccatgccaacattgattttgttataggtcttccattagtaaaactataattatctaaaacattcttaacttgttcagcatcaaatttgtaatctttaaattctacaggaaaaccatcaattatatttatcatctctggatatgcgggcgttctcaatgcattaacacccggatgaaccaacgcatatgcccatataaatgcaataattttattcaagaaataataaaattcttcctcttctaattctccattttcatttttattcttcaagaaatacacacttaccaaatatgtccacataccattcggagcatattttaaaacgaagagttttctaagtattctgtcagaaaatatatcatcttgatatacaacattgcaccaaaaattcgccaaatcttccaagttttttaacgtctcttcctttttcagcaatgcatatttatctttttcataaaactttctcaatgcttccgtcgtagtttttcgattacgttgcttcgctctttcatagtacatatatcttgtaaataactcatccattggcgaaccagatggtgcttgaaagattttatcgcttaactcttcaagtgccttccaccgattaataaactcttcttttcttcctttgtctgaataaaacttataaaattgcgccttaaaaatatccgtatcagacaatggctttcctctatcatttaatgtagaaaagattctcaacgcagtatcttgtgattccgcttcaataggcaataatatacagttttttagtatacgtgtaggtaaatacgcaaaataagatggataatcctgcaaaaattcattaattttatctgtaaaaaatctataggtttttgcatatctgctcttattgtcacttgccacttctcctgtttttaaaatagttaaaaactcttccttatcatcatctgatgacacttctgaatctattttcagcctattcttatttggctttccaaattcatcagttttccaaatacatctagcaatatcatctcgtgtgcttattgaattttcatcttgcatattcgagaatttggaataaaacgcacgcaacaataacattaatgttgtcaatcgttgctgcccgtctataatctccaacttattctgatttttatatgtaactatcggtcccaaaaaatattcatcattttcactatcaaatttagaataatcattttctggaaaagcaaatgaaaatatgtcatcccacaacgtctgacattctatctctccccatgcatatggtctttgatagtctggaattaaaaagtcagactttttattttcaaagagttcttttattgtctgttggtctatatttaactttgacatctttttctcctttgcataaattaacaatttcaatattcattctagcattttcccaataaactgtcatcaacatattacacgttttctttatttttcatctactgtattaaaaatacacactagacataacaactattcctcgtattttcaataagatatcttccctatcatttcccaaacaatattgcacaaaccgtcgataatatttagaggttggtaatattatttcgcattgagaatactcgaaaacaatttcttttggaacccgccattctctctcatgtgtccaatccacaatattatccgaatttgataaatccaattttacaattctccaccactcgttcttcaataaatatttttttgcctcatctttatcatcatatattacaggacgtccaccttgttgataaataaagtctttttgaaatctgactccaaatcctaaatatcttattttttaacacttcttcatattgcaaattttctgcaatcgccgaaagaggcgcatcttgcaaacaaactgctgggatttctccacatataaacccacttttcctcgtactccccttgattcttttttcttctaggatatttattaaattgtcgaatgcttcatctccaccctttgttaaatgtgtgattcttgacgataaatccattctatatttaaaccgttttctccattcttttctatccatttttatttccattcaccctctcaaaaatagcaaaacagcgcaagtaatgcaatggcactactcacgctttttcctatctttcttgaaatatttactccattttctttcgacttttactccaaatttactccattttaaaaatctgttacgatattttacggtattctacgatactttttctttaaagaaaaatgtcagtaagtcttgattttaagcgaacttttcaatatttccaagcactttattctgttgtgagattttctctcaaattatttcattacaatattgataatcttcttcggaacatagatctccttgatcacatttcctgtcagcttatcagcgattgcctctttacctgctgcgatcgcatcatctttggagatatctgccgggatctcgattacagcttttgtcttaccgttgatctgaaccggaatcttgatctcatcatctttcatctcgttctcatcatattttggccatcctgcattgaagattgtctcttcatgtccaagctgctcccacatctcttctgcaaagtgcggtgcaaatggagaaagaagtactgcgattgtctcgagtgtctctttgtcgattccgccctctttctttgcaatttccatgaacttgttattgtactccatgaatccggagataactgtattcaggctgaagctttcaagtcttgttgtgatgtcataaaccattctgtgacgaagtttgatcatctcttttgtaggctgaacatccttccccttgctttccataaggatattccagagacgtttcaggaaacggtttacgccgtcaattccacggtcatcccactctgcatccagctccggtggtcctacgaagagttcatacattctcagggagtcacatccgtaatcacgtacgaggtcatccggtgatacaacatttcctttggacttactcatcttgattccgttcttacctgtgatcataccctgattgaacagtttgtggaatggctcatcaaagtcgattgccccgatatcgcacaggaattttgtatagaatctggagtacagaaggtgaagtacagcatgttctacaccaccgatgtacatatctaccggaagcatctcgtctgctttttctctggaaacaagtgcttctgaattgtggttatctacataacgcaggaaataccaggaggatcctgcccactgtggcattgtgttagtctctctcttggaatcacttccacaaaccggacacttgcagtttacccactcatcgattgcagcaagtggtgactcacctgttcctgttggctcgtaggaatctacctctggcagacgaagtggaagttcttcttccggtaccggaacatttccacacttcggacagtgaatgatcgggattggctctccccagtaacgctgacgggagaatacccagtcacgcagcttgtagtttactgttgcgcgtccgattcccatctcttcgatcatatgcggagcttctttcttaagcacagaagactccataccgttccactcaccggagttgatcattgttccgactgcatctgtatatgcctctgtcatattctcgatctcttctccgtcttttgcgataacctgaatgatcggaatattgaattttgttgcgaactcgaagtcacggtcgtcatgtgcaggtacacacatgattgctcctgtaccgtagtcagccagtacataatcagacagccagatcggtgtctttgctccattcagtgggttaatcgcatagcttcctgtgaagactcctgtcttctccttgtcctgcatacggtcaacattggacttcatagatgcatcataaatgtatttctctactgcatctcttgtctcatctgttgcgagagatgctgccagttcgtgctcaggagcaagtaccataaatgtagctccgtggagtgtatccggtcttgttgtataaacagtgatcttctcatctcttccttctaccgggaagtcaacttctgcaccgtaagattttcctatccagtcagcctgcatcttcttaaccttctccggccagtcaagtttatcaaggtcattcaacagacggtctgcatattttgtaatgcgaagcatccactgacgaaggttcttctttgtaacctctgcaccacaacgctcacatttaccattcacaacctcttcgttcgcaagacctgtcttacaggacgggcaccagttgatcgggaactctttctcgtaagcaagaccttccttgaacatcttaacgaagatccactgtgtccacttgtagaactcaggatctgttgtattcacttccatatcccagtcatacagcgctgcgatatcattgatctgtctcttgatgttcgtaatgttcgcctctgtggatttcgccgggtgaacgcccatcttgatcgcatagttctcagccggaagaccgaatgcatcccatcccattggatgaacgatgtagtatccctgctgtaatttataacggctccatacatcagagattacatatcctctccaatgtcctacatgaagaccatttcctgatggatacgggaacatatccaggcagtaatatttcggcttcttgtttccgtcttttccatttcttggattgaccggtgtctcttcccatttctcacgccattttttctcaatggctttgtgattgtaaacaatctttgtacccatgtacttaattcctctctttcatcaatataaagaaaagcctcttcttctcatatatccaagagacgaaaaggctttaattccgtggtaccactcttattcatctgacacaaagtcaaatgcactcattcattctataacgggaactcccgcctccggctaatcaatataatatcttttcaccgaaagaactccgaggtcagttcaaagtctgtgctgctgtctcacacctgccgacagctctctgaaaagcatcttttccttctactactcctcatctgcgtttttacaatatacctattcattataaaaactatgcgaatataagtcaaggcttttttccgcttaaagtcctctttttattgccggtttccattctacaacctgcccctgttccaatgatttcttcacatcgatcaagcgctgattttctgatcctctgaacagcagtgtaatatttttcttatcttcctcgaatcttccatccacaagtacgtccagcatagaaagcatctcatccgtatactcgcatctcgccctactttctttcttcaattcctcatcgaacaaataaccactgtaacaccagatgttcttcttcggataacgttccttcacttttcttaaaagcttcacaagcacttcctgattctccggttcgaatggttcgccaccaagcaatgacagtccatcaatataattcggcttcaacgcttccagaatctcttcttctgtttcttccgtaaatttctttccataattaaaatcccatgtcatactgttaaaacatcccttacaatgatgcctgcaacctgacacgaaaagggcaacacgaaccccctctccatttgcaatatcacattttttaatctctccgtagttcactttgaatcctcttttccacttattccaaaatacatttcgtatcatagcattgattggaattttctttccatttatccctatcataccatatcttttcatcttttgctatcttaagtgatgctgcttagaagtaaccgcccagaagtagttactgttcactccgttcacagcaacttggtcaaaattcattccaaatcaccctttgctcccacatgatatcctgcttttttcgcatattgcatttctcccttctgaagttctcttttcagttacatgactataccagaagtcggagaaatagcaattcatcagatgtaccgaaaaagagtggtggagattggggatagttgacaacaaggagatatcgatgtaaaagaaaagccatggctcggttgccatggtcttctttttatcgtccgtttgtcgctacacctgcaagtttgacggtaacatcatatgtcgttatatcattttcaattgctttaccattgacgcagtcagcatcggtgccttccatccagatatatacatgaataattgttccattgtagtctactttttcagcgattggcatagaaccatctggtactgtataattatcgccacttttgctggcaacccagttttttccattttgatctataaattttccatcgccgattccaaatatatgattataagaagatgcaactaatgtaggatttccattattattctttatactcgtccagccattaattgcagcaaaatcattaccttgtcccgtttcgtcttttacagcataaacaacctttaacgtttctgttcctgttccctttccgtttgttcctacctatatcgatcagaaaaatcagaactgggcagttacaaaagatgagacaggaaaagattatacggcaacaagtggtacacagaaaattgcttccgatgtcggttatgatggtgtcaagatgcgagtttacatctggttggaaggtaccgatgctgattgtgttaacaatgcagtcgcagaagacacagcaacttataacgtaaatgtaaaactggcaggtatttctgctgaataaaaagaagatcatgaagagagctattgatttccttccatggtcttcttttttacaatagaaatctctgagtgccacaaccattcagggattattagttatcctgcaaattccgaattatttcgcacagaatccaagaactgctttaaattgatttgtattaccagttaaagtggtaagatttgctgctactgtatcaccatcacagccttccatccagatatatgcggtaacttcgcatacttcttctggagctgtaaaggtataaagtttatctgctgttccaacctgctgctctgtcgcaagcgcatcacctgttactcctgtcgcagtaactaatttcttaactttattatcggcaaggttatctacatcaatagtagctactgcctcagcacctgttttgttaccatctttaatggcagttgcgataccatcagctccagtagaaccattaaaggttgtatttgtttttccggttgtctcatctgtatcaatggtatagaagtaatacttcttacttgtgtcaccttttttattaacaactaaagccaaacgtaatgtctttcctaatgtgctacctgttgcagttgtcgtaaattgtgtatcctgatcaagatacagatcacatttctgggatgcttttatttcaaaattctccattaagtattcgctatttgcagttgctgctgcatattggtcaacttcggacgcctttgttgcagtattgctgctccaatgtgcctgcttaacaaatgtcattggggttgctgctgaattatctccaatggacatagatgttttaccagtagtagacactggaaccatgttaagattttgagaattagtcattgtatagattgttgtccatgcagtatcagctccagttgcgccttctgaaatcagaagtgcataagctgtttttgcggctaatgttgcctctccagttttaaccatcgtattgttcacaaaccaagcataagtacttgatcccagcgctacagcggcaacgcataccatggcaatcgctgcagccagctgttttttcagcgcttttacattttttgtttccttcattttctttcctcccattcgtatttcagcaagattattttaaatgttttgttcacttaattctcaagccttctattatcagattacaactcccaccgggcccggttgaaagagtatctccaccacctttatccggtgaggattcaatctcataatagaatctctgttttctcttgcttccatcttcctgtatttaggttctatctatataaacagttgttgttgcactgtttataccactattatttgttccgccggttttcccatgtaatttccttatccgaataataactatcattcggagcatcgtttccggctgcattgattggtttatcacctgtcaatgtgtctttaatatcttttacgaatttccataccagacttgtgttatcatctgcgtctgaatcaagatgcatgctaaactgtacgcttccaccaataatcgaatctacacattccggatcatctccttccatccaaatgactatggtgtatcggtcaacatttccaacaaggaaatctttttcatgataactgcagacaatctcatctgattcaaaattttcgcatccattttcggcatcaccgctcttagctggtgcagcatatacgatacgttctccatttttccaaaccgcaacacgaaccgctttttctgcacctttggcacaagaatctaaagtgatttttgcaatatatccgaggtcttcttttccagcatttctaacataataggtataagccatataattttttccattatgacttcctctttctactccatccacatcttccggaagatcttcaatcgaaatattggttgcatcttttaccgagttagcagtaagcttcgcagtcgcatcaccaaattctcccatctcggaaatgctgattcctctgcgatataattccagacgattaagattgattgtaaaattacccatcttttcctgtgaaaatgcaatgataaataatatgcacaccacaagcatcatgcctagcaagaccagatggagtttatccattcgaagcaatgcggctcccagacgttttggctgtctgtgcggaacatacatactgacaatcgtttctggatctacgtcatctccatacttttcaataatctcttcaagttcttcgattcgtatgatctgatctgattttttcttacttttctttttttctttcctgtcttttttccatttcatctcttgctacatctcacagcttatatctctttttaacataagccacatattcctgcatttttactctttcatctgtatcagcgaatctcaattgaacacctgtcacgaaacggaaaggccctccttttggcatctctcgcatccagcatattacaccaacaacttctgtctctggcatcccttcggacgcggaacccagacgtggaagtgtgaaaatacagctttcgccgacttcaaaccaacggttcatatagaccgcaagaccattgtttgaaatatctatcgtttctccagactctttatcaatctcacctcttgaattcaaggccatgtatcctgcatgaattgaagcggaagttcaactttcatacggacatctgcacgctttataaactgacggttttcagtaactcttcgaatcttccaataccggcggattccttctttcactgcgtcatccacatatccggcaacaattcgtgtctcttcaccttcttcatatttgaataaaaacttttggctttcatctatcggaagtgcttttccatccaccatcggtactgataccagaaatgctgactcatctaattctttataaaaagtagtaatcatatcaaatactggctgctgccacgctgttgtttcttttgcaagctgcatttttgttcctcgcttaatcccacacgctcccattctatccaacgtctcctctgtttttaatcataagtattcatttaataacatatcccccaaaagatgtctattatttattcgcaatctaaatacaagtttaattggtttgtgcatttctggtattagaaaagctcctactataaaaaagtaagagctctacattataaattcaattttttatatcatttgcactgtaacatagacatgtctggttaatagttctcagcgtgtacttccacagctacttttataacaccatctctcttattctcgaagatgtcatacgcctcttcaatcttactgagaggataggtatgcgtgataagtggttctgtattgatctttccttcagcaatcagtttcaatgtttcttcacagtcgcatccatctactccaccggttttgaagataagattcttgccatacatatctgggagtggtaagctctgtgccttatcataaagtgcaacaattgttacaattgcattcggtcttgcacattcccatgcgagacggaacgttgattctgctccggcaacttcaagaacaacatctgctccaccatgatcacttattttcttaacaaaatcctcacattcttccggagaaacagtaagtacatccggataatgcttattaataaatttgatacgttcttcgtctttctcacacatgataatatgctttggattcttcagcataacgcagagtaatgtacagattcctgtagggcctgcaccgatgatcaatactgtatcatcttccgcaatttcagaaatgcgagttgcccagtaacccgtagccagtacatctcccacgaataatgcctgtcgatcggtaacttcatccggaatcttgtttaatccctgatctgcgaacggtacacgcacatactcagcctgaccgccatcgatacggcatccaagagcccatccaccattctgatccgtacagttattgacatacccttttttacagaaataacattcaccacaaaatgtctcgacatttaccgttactctgtctcccggcttcacatgtgttacagcatctccgacttcttcaacaattccaaccatctcatgtccaacagtaatacccggaactgcgcgtggaacacttccatgcttgatatgtaaatcactggaacagatacttgcaagtgttacctttacaatagcgtctctttcatgtatgataaccggttttggtttttctcttaattcaaattttccttttgatacgtatgtataagtttgcactgtttcccccaccattttcaaataatataaagcgatttattctttcggattatctccatcccgataaggcactgtggccgccggaacaaccgctgaagccggctctgtatggatatcctgatcgtcaaaaaagatatgtgctccaaatgctgcaagtacttctgtcttactgacacctccaagaaaaaaggcttcattgatagatacaccccagttgcggagtgttttcactgcacgttcatgcgcaggagcatttcttgatgtgacaagtgctgttcggattggttgaatctctttttctttaaacatctgctgtacataagacagttttgtcaggaagttagcaaaaggacctttcgccatcggcgtgttcgcatttgccttctcatgttcttcaaatgcctgtattccgttcttctgaaagatcttttcagattcagccgaaaagagtactgcatctccatcaaaagcaatacggatctgattaatcttttgctttgcatccgcatgtgcatcacctgtaagaatacgtcctgcggcaattccatcattaatagcagactgaacgtcatctgaattcgccgacaaaaacagatctgtcttaaaagctttcagataaggggctatctctgcaccacttgtcaaagtcgctcttgtaatatccaagccataatactgtatagaattaaaaatacgaagacatgtgttggcattgttccgggacataatgatcacttccaccagtcttcccagttctgtgttgttcaattccaagaatgctttgattaattggaaagcagcacccttctgaagaatctcattctcatgtgctacctggtaagcctcatatgcttcgacaccttgttcctcaaatattttattttcctgctcaagattaaataaagctctcgaactaatccctattacaagaggttttgataaatcatatggcatttttatcgcctccgatcaagaaaagaatcatgtattaatcacatctttcttacattatacgtttccgtcttatgagatacaagtgaaaacgtataagaaaagcttatatgtttgttaaatcttgatataacatcaacaatgtcaaatttattttttaaattccactgcgtgttttctcttccacaacggaaacaaattacgctgacatacataattctttcgttcatctatcgcaatcgcatgaaagaatgtcttccacatatccgtatactcatcttcgtactcttctgtctttctcaatgtctgaaattcttcatctgtcagatagcggagataattctctccgtctttcagatgaacacaagctgttttacggttatcatctatgatcatccactgttctgaaggcatgcgatctgcaaaatgtctgccaaccaacataataacatcacttttcggctccagatggctgacataaacattgcttgcgttcaactgctcaaatcgtgcaaactctctgaaatgatgactttcattggacactctgcgacgtaattctaatatccgcatcacatgtggattcgcatattgctgtagtacactctctccaattttgaatccgacacgaaggaaattataaattgcctgcagtgcatcttcctcgacagataaagtcaccaaatagatattcagatatgcttcatccgaaatatctctccgaatcgagcgaattactttttctgctttggaaagatcttggtctacatgaatatattcatcaaatatcgtctgctgaaatacaggttctttttttaattgtatctggtcatgaccaatcagtaaagcttcagaccatgcatcatagatacaggtcatgatatcttccagacggtctttacaagtaaatatcttcatcagcatactccaaaatctgtcaatgtcatctgggtgaatgactcattcgcatgttgtgtgttccatagatctttcttatctacactaattagttgtcgcgtaatataagatgcctcaataggagtatggtacatctgttttccaccacacgtgatgaaatagtgtgcacgcttcaatacgactcccattttcttcaaacttgcataatcaagtcttccatagcgtcttgcataagtgatacggcttgctgatttcggtccgattccaggaacacgaagcagtgttgcataatttgctttctctacttctattgggaactgctccaaatggcgtaacgcccaatcacactttggatcaatcatctcattaaaattcggctgttctgaagataatagttctcctgcctgaaatccataaaatcgaagcagccaatcagcctgatacagtctgtgttcacgtaaaagcggtggtggcgttccaatctccggcaacacattatcttcattcaatggaatgtatgctgaatagaagacacgcttcagatcaaagccttgatataatgcctgtgtcgtttgcaataatgtataatcactctcaccggtcgcaccaatgatcatctgcgtgctctgtcctgccggagcaaaactgcgctttaatcgcgacatatcacggggtgccaactggtttgcattctcccaggtaagtgcatgatctagagaagtatatcttttataagactctaatcgattcatctgagaatcctgagaaatggctttatcctttttctgaacattcaagcactcagaaaagtgttttttcgaagcatcagaaaaaatacctgcattcaaaaacttattcccgccacttcgttccatataagctgactttccgattgccattctgtgagatgcaatcgtactctgcaccttacccatgggattcagaatattctgcatcgtcttgtttggagccaatgtatgcaatccttcttccgtgggcaattcaaggttgacactgatacgatccgcaagatatcctgctgccgcaagcaactcgtcggatgctcccggaatcgtcttaatatgaatataaccgttaaaatggtatttcgttcgaagcagcaataatgtctcgcacatcttctccatcgtatacgtcggattctttaagattccggaactcaaaaacagaccctcaatataattacgcttataaaactctactgttaagtcacagatttcttccggagtaaaagtagcccgctttacatcattgctcttgcgattgatacaatacttgcaatcataagcacaatggttcgtcatcaaaatcttaagcagagaaatacatcttccatctgctgcaaagctatgacaaatgccgcatgcctctgcattgccgagctctcctttctttccccgccggctggatccacttgaagtacatgcaacgtcatattttgctgcgtcagcaagaatccgcagcttttcctgtgttgtataattactatttctaatttctgtattcatattttcattatacaaacatttgttcgataatgcaagtattatttcgaacaggtgttctttttgtaactgctcaatatgttttgagcattcttaaagtacctgaaaaattaagattttttctctattatcctcacccggaaacagatctgaagtattaatctcatcataaaaaatcaactgttcctgagtcattaaaatactgatatattcttctgaaggataatagaaaaataataatatatctctcggattttcataataagattcgtaaatcctcgctaaaactgactgcaatatctctactgaaaaaggattaaaaaagtaacagcgatccacttccgacggaacttcataattttctgcactgcataatacaaactccgtgcgtgatgcggaaacggatacttctttattatctgctgctcctttataaatccgttcatcatactctacgcctattgtcttgcatcttgtttgatacgaaagataaaaacatacccgcccttttccggttccatagtcaattagagtattatttttcctgatcagtccactgtttgccaggcgctccaataccatataagacgttggttcataaggatatcgatactgatctgaatgagagtcatcccgcccggttgtctttatcttcaggagtttatcccattgtgtttcattttgattcatttctttcgatccttcatttttatgtttgaaatatcccccggtattttcccaagttctgtcaccatgtacataatctggcttccttcttctttcagccacttaattgactttttataatctggaaacacattctccacctctgcccaaaatgctttcgaatgattcatctgttttctatggcacaattcatgaaccacaacataatccaacaccttaggaggcgcaagcatcaacagacagttaaaattcaaattccctttgctgctgcaacttccccatcttgttttctgatttctgatggttatattcccgtaagtgactccgattatttttgcgaaatattctactctggttggaattatctcaagagcctgctctgcaagtgccttgattttatcaattgtcacgttttctacatttcccgattcaacacttttcttctttgcttttatttcattcatttgtttgcttatccaagcttcattcttattaagaaattcctcaatgtatttctctgtgacaccatacggagcctttacagtgacacttagatcagaattcacctgaatagccacagtttttcttttggatttaattactgtaactttcataaattgtccctttgttttttgctatttcatataatcacgaatcttatcaatcaacgtgacatccgccggaagccatgcaacactatctaattgatccttcgtaagccatttcgcggtttctgcttctttcagttccagatgtcctgcgacaacttcacaccagaaacaatattcttttctgtcttgtttctccaagtgcaaaggctgatgcatagatttttccactaccacatgaactaacaagaagtcctctatgttcattagactctaatagattgcgaaaattatttacaaatcgggcctatatgccaaatttgagttgattgctgaattaataaaagccgtatctaaacctaaagaaatatcatgattagcttttactaccatctgaatcacctccactgtaatcatttataatgtgaactacccattgtctaaagccaatgggcttcctgcttcgcagacctcgtaacctactatctccacaggcgttaattcggacagtccctgtcctatattattattccttttatgctatttgtcttaatccttcttccagtatattctttgccgcattgatatctctgtcatgatttgttccacagacaggacatatccattcccttaccgatagatttttcgtctctgtattttggtatccacaggctgaacacagctgactgctagcataaaatgtatttatcttgatatattttctgccattccactttgccttatattctaactgtcttgtcagctcataccatgatacatcacttatagactttgccaaatgatgattttttaccatattttttatctgcaaatcttctgaaactatcacttggttttcgctgataatctcatgtgacatcttgtgcagataatcttttctggtatttgttattttttcatggcataatgctatctttttctttgttttgtagtaattttgacttcttttctctttatgggctaactgcctttgcagttttatcaatttcttttcgtattttctgatgatttttggattttcgtatttctttccagctgaagtaatacataactccttaatacctaaatctattcctgtattttgatttacatgtggcagttccacgtgttctgtttccactaaaattgatacataatattttccactcggaatttgtgatatcgttgccgattttatctgcccgctaaaatttctatgcagttttgcttttacattttttaatttaggcagttttactctatttccctcgaaatctactgctatattgccattcgtaaaatttgttgtatatgacttatgattatcgtgtttactcttaaacttcggataacctgcatgttccttaaaaaatttctgatatgcagcatccatgttgtaaatcgcatttgtcagagcaaatttatcaacttctttcagccattcacattctttctttaattgtctgttgcagtaattgttacagtcagttttactaactgattttttctctttctcatatacttctttccggtatgccagtgtctgattatatacaaaacggcaacagccaaatgtttttgcaatttgcattttctgctcattattagggtatattctgtatttatatgcctttaacatccactgtcaccctctttctcaaccttgattttctatatatctgataataacactgtgcctttgacatatctcatatgaaaactgctttatatcatctgatatctgtctcgaaaccagtaatttcttcctatatttgcagacgaaaataatgtgatattgtaataagtatttatgcctgtttttagatttccatgttcccatgccatgagtatacaataatttctgatttttagctaccttaacccaccgtctaaagccagtgggattgcgatagccttgtttcaacaatatcatttaacgtactaactcaaattatatcatacaaacatttgtctgtggaaataaagtcggcagattaggatggaatgttaagacaggcattaaaaaggggacgaagaaaaatatcttcatccctttcattaaaagaatatcattatttgctttctggaatagaatcttttcctactgtcatcatcagaatgattgcagctataaagcttacagcacaagcgataattgcagcaagaacagaagaatcaaaacctgtctgaggattaattacctgaagccatccaaagattccgtttgttccatatacatactgttttactccaccaaatccgatgatagcaccaccaataccagaagcaagacaagctaacataaatggttttttaaactgtaatgttacaccgtaaatggatggttctgtaataccaaccattgcagaaataatagctggtccacaaacacttttcagttttttgttctttgttctaagcatgatcatgagaacaactcctgcctgtccaaatgcagatgcaagaccagcaattgtgataggatcgtaacctaatgttgcaagattgtttacagagattgcaacaaatccccagtgaacaccaaacataacacatacctgaataagtgctccgtataagaatcctgaaatagtcgcattcagattgaacagtgctgtaaatgctgcaccgagtaagtcacttacaaatgttgcgattggtccaataatcaggaatgcaagaacaatactaattaaaagtgtcagcgcaggaacagcgaatgtcttgaacagatcgctaattctttttgcaaagaatttctcaatttttgctgcaaagtagcaagttagaattactggaatcacagaacttgcatagttcattaaaagaaccggaattccaaggaattctacatatacatctgtctggaagatagtgccactgaataaagtataaagtgcatctccagccatgattgttgttagagacggatataccaaagctgctcctattgccattccgataaacggtgttccaccaaatttcttcattgaagtatatccgaggaatattggcaggaaattaaagaaacaatctccaacaatgtttaacatctgatatgttccggatgtagttgcaagcaatcctgttgcagtaagaaatgcaagcagtcccttgatcacacctgttgctgtaagcattccaagtaccggtgtaaacacaccactgatcacatcaataaactggctggaaatctttttctttttcatttcctgtttgaattcttttgcatctttcagttcaatttcattttctgtcgtccccatcattgtctgcagttcgttataaacgtctgctacgtgctgtccgattacgatctgatactgacctccgccttttacgatagaaagaaccccgtcaattgctttcactgcttcgtcattcgcctttgtctcatctttcagctgaaaacgcagtcttgttgcacagtgatatacgctctcaatattttcctgaccgccaacttctttgagaatactttgaatcattttctcgtacttcattttgttttccttcctctctctttaaaatttttatctaaaaaaaccgtttggtcttttttcaaatgtaatggatattcttcttcagtaacaagggtgaatttacaatcacgcgttgccgtgattctgatttcatcaatatttccttccttccacttcatatccagtactgcgcctgatttcaggcatattccattgacttctccatttaaaagactgttcggtaatgccggtaaaagaaatactttgtctgaataatcctgtataagcatctccagtaacccacaagctcctccaaagtttccgtcaatttggaatggtggatgattgtcgaacagattatttaaagttgcatattcaagcaattcctttaagtttttccaagcttcttctttctcccacagtcttgcataaaacagtatgatccatgccttgctccatccagtatggcctccaccgtatttcagtctgcgctcaatcgtctgttttgcagcctgagcgagttccggtgtcttatccatacgtatctgtcctgcaggatataatgcaaacagttgtgaaatatgtctgtgtccgggctcgacttcatcataatcttcactccattcctgaatctgtccgtatttaccgatttgcaattctggcatatgattcagtcgctcatttattgcttcattcagatcattcgggagttgattttcttccgtaatctccagataaccattaaaaagttctctgatgatttctgtgtccatagaagctcccatgcagagacatcccgcctctcctttttgattcagatagatattctcaggagaactggatggtcccgaaatccattttccatgagcatcttttaccatgtattgaaggaaaaacttaacagcatctttcagtattccataatattccttcaagaactccctgtcttttgtatatttgtaatgttcaatcagatgcaaacagaaccaggcaccgcccattggccacagggtagatgatacatgattgtcctgaggtgcacagtctccccagatatctgtgttatggtgacaacagaatccatcaattccatacatcttctcagcaacgtctttgccgtgcggatacattctttgcaaatgttctaacaaaggcatgtggagtttagataaccctgttttttcagcaatccagtaattcatctctatattgatattaattgtatacttggacccccacataggctcaaattcttcattccagattccttgtagatttgacggaagacttccttcacggctagagctgatcagaagatatcttgcaaaattataatatgtatttattaattcaatatcttctatgccattacgcatttgctcaagtctttccggcgttgtcagatgctcataagagtctttataattcaatttcagattacttttttcatagtaagataaataatcttttatatgacgctcttgtaatgttccattagattctttttcagcattactcaatacatccatacaccactgaagcggttgttcacttcggaacgatgttcttgctgtgataaatagtgttgcttctttggcatcctctactagtaaatggcttcccattcgtgaaattttgccatttttagttcttacctgtacaagtagttcaaatgcaatcccatgatctccaccttgttttccatataaacggattttattgccatccaggacttcagtaccatcacagaaagatgaaccacgtcctgatcggttatcttttcttgttaaagataaatcaaaattaagaagttcgccatctatggatttcatctgatatacaattatgtgatctggattgctggcaaaaaactctctttcgtattttcctttttccgattcatattgaatttttccaacggctcttgaaatatctaattctctgttatatgtttgaacttctacactttcatgctgaacgcttaaaagtcccccttgatcctttttaaagatcgttttgcctctctgtttgtaaaaatctatccaaacgtccccaagtgtctgataatgtcgcatatgcggatatgttgcatacatacttcgctctgcgagaagttcggcctgttcgatttctccatttaataagagttcacgaacttttggatagttctctcgcgcatcaggatttacacgttccataaaacttccggtccaaacagaatcttcgttaatttgaagtcgttccgttccgatttttccaaataccattgctccgagaaatccatttcctatcggcaatgcttcattccaatctttagcttcttcacgaaaacatattttattcatttcttcttcctcatcttttcactacgctttcttgaatctgttgttattataacaataaaaaaaagaaagactgaaaagtttctattttgcgaactttccagtcttaaaaattatggatgatttcatttttccattgggaatccgtatttattttgatacgcaattgcaattcgttcaattaacagctgatataaaacaggatggttttggactaaatccttatattcccaatcaatacatagatcaactcgagggtctttctccatttctctgtttgaagtaaacagaactacttttgcttttgtttcttcaaaacacttctttgatggagcatctatcagatgcgtatactcactaatataccttccggaatttgaaaaaataagcagtagtgtattttcttttgcatgactaatatactctacttgttttctgtcatttgtagttgtgtaaatgaacttctggtaaaaagacattttatgctgaaaattcaatgcagcagtctctgaatatccttctccaaatgcagctacttcttcataatcatgaatcaacgtgaccaagtgttctatttttttagagtcagtattgaaaaataaatagcgaatatctgaaaacagcacgtccagatattcttccgttcctttttgcaatatataatctgtaatatttatcgtatttagatcttttatgtaaacttctcttttccctctactgtatgcttctgctttaaattctttgtaatcctcaaatcctaattgcttaacgaatttggagattgtagattttgaaacagagcataaatcagccatagcacctatggaaatgttattcaattgatgaatatgttccagcataactcgagcaatatgatgttctattgattcaggtgacatctcaccggttattgatgatagtcttgtatatagtgtgcccatatattttctccctcatgattttctcttgtggtgattctgttttcataataacataaaaatgcttagagaagtacagtaagattaccaaagatgaatttatcacgttgatgagtgttcttgtaaatccgatatgcggaaatctcctggaaatttctttccatcttctatttgttgcacactaccgttatcttaccgattatcaattttctccggaaacatatcatgattactcatacgattccaggcaacctgctcccagttggtacctggctttccataattacaatacggatcgatggacaaacccccacgtggaaggaattttccccagacttctatatattttggttcaagaagcttgacaagatctttcataattatattgatcacatcttcatgaaaatctccatggtttcggaatgagaacaaatacaatttcaaggatttactctccacaagacgttcgtccggaacataggaaatcgtgatcgttgcaaaatctggctgtccggtgattgggcacagacttgtgaattccgggcagttgaacttgacgaagtaatcgttttcaggatgtttattctgaaatgcctccaatacagacggatcataatccatacggtattctgtttgctgatttcccaataatgttaaattttctttttctctcattgcttcctcctctatctcaacgcagggtcttctacgtgattcgcctgaaatgctgctgcgcgatcaatgcatgttccgcattttccgcaaggcttctctccaccttcgtaacaggaccatgtcaattcatacggaactcccagttctaatccaatccgtactacttcggctttggatacatttacaaaaggagcttctattttcagcagttttttatcaaatgaagtacgtcccgtctatttggtgaaacggtacatctttagttttttgataaatgcttgactgtaaaccttgtttatagcttattattaagtaaaatagagttgctcgaaaggggggcataatatgactataaaagacgcagaagagcaaacaggtttatcccgttctaatatccgtttttatgaaaaggaaaaacttattgagccttcgagaaatgaaagtaatggttatagagattattctgaaaatgatgtggaaaatataaagaagattgcatatctacgtacattgggaatttctattgaagatatacgaagtattatatccgaaaaagtaacattgcaggaaatgcttgagaagcaaaaggaagtattaaaaaatcagattactgatttgaataaggcgaaactcatgtgtgaaaaaatgctggatgaagaaagtattagttatgaaaaattacaggtagaacaatatgtaacagatttgcatgactattggaaagataatcgaactgttttcaaactggattccgtcagctttttgtatatatggggaagtatgcttacctggactatgattaccgcactatgcttgattattggggctttgtcttattctaagttgccgacagaaattccagtacaatggagtaaaggagtggcaacatccctagttaataaaaactggatttttatttgtactgttatttgtggacacggcaatttttattggattgttagtagttggtttggtaaaaatggatttgagagggaaagaaattttatgattcaaattttatatttcagaaataacaataagatactatttttcccacgcctactatgagaacggcggctatgagatagaaattgcatatactggcgaataaaagaaccgctgttgcatggtttatttgcttccatgtagctggtattcggctgaggtattgaaaaagataattttcaataatttttcaaaaatcagaatcgacaattcatgacaaatcaaccctgaatcggggaacgtttctcatagaaaagaactacaaaaaataagaaaataaaaacggaaaaccattgtctgtagtataagtatttgttattatgaagtaaatataggatattttacaaagtaaagcttaatctagagaatctgccagtggcaggcctctgtagataccaaggtatacaaaaggagaatgaaaaaatgaaaaaagaagacatgtcctgtatcgactgcgcagtaaaaaactgcaacaaaatggataaaacctatccggatttctgtctgacaacacacatggatgaagaagttctaaatgaagctatggaatgctacaatgaagacgagaaccgcaaagtaacaatcgctgcagctgaagtagagtatgagaattactgcaaacatacccgtgtcgaagaaatcatggattttgcaaagaagattaatgcgaaaaagatcgggatcgcaacctgtgtcggattgttgaaagaaagccgtatcctggcagatatcctgcgcagacatggctttgaggtgtatggtgtcggctgtaaagccggaacacagaagaagacatcggtcggcatcccggaatgctgcgaaggtgtcggtgtgaatatgtgtaatccgatcctgcaggcaaagcttctgaacaaggcgaagacggacctgaatgttgtggtcggactttgtgtggggcatgacagtctgttttacaaatattccgaggcactgactacgacagcagtgacgaaagaccgtgtattggggcataatccggtggcggcgctttatactgcggatagttattattcgaagttgaagaagagtgaagaagagtaatatttctaatttgggcgtttaaagatacataaagatatcccattcaagcatttctctttttatccaatcgagtagaaggctaaccattagttgattagccgacctctcacaccaccgtgcgtaccgttcggagttttttatcaaatgaagtacgtcccgtctatttggtgaaacggtacatctttacatcacgtcgactgacgtctccgtgcgtttttcgccttatgtcggtgttcgcaaacgcacaccgccgcaaggctcagtttctcatcttaataaagctttgcacctgccggaatgtggttatcaaccatcagaagatgtagttcttcatcctctgaatccttcaggttattcactgctgaaagcagcataccgcaagactcgattcccatcatctttcttggcggaaggttggtgattgcgatcagtgtcttaccaactaattcttccggctcatagtaagagtggattccgcttaagatcgtgcggtctgtacctgttccgtcatccagtgtgaactgaagaagcttcttgctcttcggaactgctacacactctttaacctttacggcacggaaatcagatctgctgaatgtatcgaaatcaacctcttcttcaaataaaggctcaacctttacgttggagaagtcaatcttcgcgttgtctttgaagaatccgttgttgtcgtttgcagttgcttcttctactgctccggattttcctgcttttttgtcagagtcaagactcttcattgtcgggaacagtaatacatctctgattgcctctgctcctgtcaacagcatacacattctgtcgataccgaatccgataccacctgtaggcggcataccgatctccagtgcgttcatgaagtcttcatctgttgtgttggcttcatcatctccctgtgcaagcagttcttcctgcgctttgaaacgctctctctgatcgatcgggtcattcagctcggagtaagcatttgccatctcccatccattcatgaagaactcgaagcgctctacatattctggattctctggtttcttctttgtcagtggagagatctcaaccgggtgatccataacgaatgtcggctgaagcagatgctcctctacgaactcctcgaagaagaggttgaggatgtcacctttcttatgtctctcttcaaattctacattatgctcttttgcaagttctcttgcctgctccagagtctcaacttcattccagtcaacgcctgcatatttcttaactgcatcaaccattgtgatacgctcgaatggtttaccaaggtccatcgggattcctttgtaaacgatctgtgttgttccaaggacttcctgagcaacaaaacggtacatattctctgtcagatccatcatgccgtggtaatctgtgtatgcctggtaaagttccatcagagtaaactctgggttatgtcttgtatcaagaccttcgttacggaatacacgtccgatctcgtatactttttcaagtccaccaacgatcagtctcttcaggtacagctcaagggaaatacgaagcttcaggtcctcgttcagtgcgttgaaatgtgtctcgaacggtcttgcagctgctccaccggcatttgctacaagcatcggagtctcaacttccatgaatccttctccgcttaagtacttacggactgctgcaaggatcttggaacgtttgataaatgtatctttagaatctgcattcatgatcaggtctacgtatctctgacgataacgtgtgtctgtatctgtcaggccgtggaacttctccggaagcatctgtaagctcttggagagaagtgtcatcttctcagcatggatagagatttctcctgttcttgttctgaaagcgaatccttcaagtccgaagatatcaccgatatcagatttcttgaaatcagcgtaagcatctgttccgattgcatctcttgctacgtatacctggatatttccctgtaaatcctgaatgttacagaaagaagcttttcccataactctcttgaacatcatacgtcctgcgattgctacgtggatcgggcttgcatccatgatgcttcttctctcttcgtaatcattcttgagagcctcttttgcctgctcttcatccataccttctacgttcggctgctggtgatcttttaaaatctcagcctcatgtgcctcatagagatcttttacttcgagtgaatggtgtgtctggttaaactttgtaatctggaaagggtctcttccgttctgctgcagttctgcaagtttctcacggcgaacctttctcagctgattcatatctggttcctgtgtgttcttctgattctgtcccactgtctgttctccttccgtttctatctgcttcctcattaatttttatatatcaatgcagaaatagttatttttatattgtctttttaagcgaattcagacctcttaatagtaagaggtctgtcctaagctgattatgaacgtttgatatcaagtactttgtactggataactcctgcctgtgtctcaacgtcaacgacatcattgattttctttccgatcagtgcgtgacctaccggagactcattggagatctttccttccagactgttcgcctctgtagaaccaacaatcttgaactccatctcttcatcaaatgtgatgtcataaacctttactgcacatccaacattgatcttattaagatcaacttcatcctctactacaacttctgcattcttcaggattgcctcaagctcctcgatacgggcttcgatatctctctgctcgtctttcgctgcatcatactcagcgttctcggaaaggtctccctgctctcttgcctctttgatcttacctgcaacttcttttctctttactactttcagattctcaagttcatcctcaattgcctttaatccggcataagtaagtaatcttttttttgcctctgccattattcctgcttcctttctacttccttaccgtcactgcctgttgcaataacgtttcgtttcctacaacatttacagattctctgcaaatcattttctgtctatacttttcatgcattcaaagtttcttctctgtctacagatattatgatataaccggattgctccattgctatgcaatttatacttttgacacttacatcatattatcggttttaaaatgcatgtctgctgtctttttctcctgaacgccaatcgttgtatcagcgtccgtccgcaatttcaatattatactcaaactcgcgctttctgtcaagcaatttcactctcacaggtcacttctgcgcagtgtatgaaaagcctttaaaaccgcctttttccgaactttttccattctgttttccaactgttttccgaagtcccggagcttcttttcctatagtctctgaaagagcagttcttccagttcctgataggactctacgcgattgatttcttcacgcaattttgcagaacctttcaatccctttgtataccatgccacatgttttctcatctcgcggataccaatgaattcacctttgtatttcaactgtaatctggcatgacgaagcatcatatcacgaacttcttcttttcccggacgttctggtaatgtgcctgtctcttcatatgtgatcatctcggagaagatccatggattcccctgtgctcctcttgcgatcatgattccgtcacaccctgtctgttttaccagctcctctgctttctgcgggcttgtcacatctccgtttccaattaccggaatagagacagcttcttttacctgacggatgatatcccaatctgcctgtccgctgtaatactgttctcttgtccttccgtgcacggctacagctgctgccccggcctcctcgatgatcttcgcgatctcaaccgcattaatgcaactgtcatcaaatccttttcttatcttcacagtaaccggcttatcaattgccttcaccattgcactgacgatttcataaaccagcttcggattcttcataagtgcagagccttctccgttacgtacaaccttcggcaccggacatcccatgttaatatccatgatatcaaatggacgctcttccacacgttttgccatctcactcataatcttcggatctgatccaaaaaactgcagtgacaccggctgttcatccggatggatctccaaaagtgactctgtatttttattattatataaaatcgcttttgcgctgaccatctccatacacaaaagacctgctccctgttctttacacaacacacggaatggaagatctgtcactccggccatcggtcctaagatgtaacggtttggcagcgtcacatttcctattttcaactgtttcatcatattctattctttctaatctataactattcttcttatttgactttagtatcatagtaaataactgccgaaaagtcaacgtacacgatctgttctttcgcattcacacaaaaaagtctgaataaatccggcaatcacaaagcttttgcaaccctccgtttattcagacttttttatctgtctcttaatatctcttgatttttcttgaagctgtcttctcaaattctttctcgcgaatgatcagactataaatctttttatatgccggtgcaccctgattgtattcatcaatcagtttttggagttctacacggacttcctcttctctttcaagtccctgtttttttgcgtactcctcatctggatatatttctgcctcgatcacaccttttgcttctcttactaatacttcctgcacgagtcttgaagaacttaatttattctcaagttcttccggtgagacattttctccattctttgtaatgatcaggtttttctttcgtcctgtcagatagataaacctttcttcatctacatatccaagatcccctgtgcaaagccatccatctttcagtgcggtttttgtttcttccggcatcttgtaatatccttgcattacactgcttccgcgaacccacagttctccatctacagtctttgcctcgcagtttggaagaagttgtcctactgaattcttttttacattccatgcaacggttgtactaatgaccggtgaacattctgtcattccatatccctggagaatctggattccaaaacgttcgaacagctcaatatactccggattcaggtatgcccctccactgcagatcgtatgaaactgagatccaaatactgcttcttttaccactttttccggaaggtcttttacgtcttctaattttttcgcaaaagtttcaatcataagaggtaccatcaagatcatattcggcttaaataatttgatattttttgctacacgcatcaaagagtcattgatacagataattgcaccgagagaaattcctttcaggatatccatactcaggcagtatgcgtggtgaatcggtaaaactgacaggatcacatttctctctgggagcttcatatccagacatgtcgcgttctcaacgagatttctgtgtgtcagcatcacacctttgctctttcctgttgtccctgatgtgaacatgatcgtacagagttgatccggagtaatctctgttttttctgctcctgtgtcctcatctatcgtttgttccatcattgattttgtaagagaaagtatattgccctcattcgcttccttctgcatagaaaggatgtacttcagttttgtacacttttctttcgctgcttcgatcacatctttacggatctcatccacaatcaggattgttacatctgcacggtcgataagttcacacagttcttctgccggaagtgacatatccaatggtactgcaacatttccgccgtccacaattccaaaataggaagcaatccatagataagaagtcgcaccgatcaatgcgatatgactttttggttctcccagttttttcaataatgctgttattctctcactgtcttctttcaactgtgtgtatgtctttgccgcaatttcattttttcctgttttgtaacggattgcgtcttcatttccaaaacatttttctgcatttgtaagaatatcgcgaattgttctatattccattttcttttccctctacttcaaagactcaagatatgctacagcttctccgactgttcggatatctgctgccttgtcctgttcaatctccacatccatctcgtcttctatttcaccaagcatgctcataaaatcaaaggatgtgaatccaagatcttccataaaacgtgattccggcttgatgtcttcctgttcaatttctacataattacaaataatatctactaactgctcaaacatgattttttcctttccattctgtcctgatcgtgattctcaacatgatccggatcatctttcttttatacaagctttatgatttctccaattgtaagttcaggattttctgctcccttgaacataattttacataaatagtaatacagatattccaactcttctcttgagattgcttttttctgatgttcaaagttgaaatccaatccattatcctccggtcggtgcataactgtcagatacattgcctgtgttgtcattccattcggataccattttgtcttatattgaattcctccaagatcttccagtcctttctcctgcaatgtcatcggctggtaagtcaaagacatcggctcatacgtcagtccattctgtggctgtggatatgtcctggagcgatatgcgaaatattctgtcgggtcataatttgcatgacggaataattcattctgtttatcacggatttcatatactgcatcgataaacttcacatcttctgaaaatacagtacgaaacgggaacgaatgaattcttgttccaccggatttcttttcttttaatgtagcccttctggcaatcgcattattgatcgatacatcctcctgtccattcattttctggaagtaagtacgtaatcccatcaataaaagacatgccagggatacccggtacttttcgcagaaatccatcagacgtttggtcggttctgcttccaaatgaaagatatccaatgcagaactcacatcatctgtcgcattaaatgcggaacgaagctttggatttttaaacatttccctcgctgcatccagcttatctgttccattaacaccgttataaaccggctctgatgcttcaatcagttccctgaaaaattctctgtctcgctgctgtgctttacttccggcttcatatgcgagatccttctttacctgatctatgtaagaacacatatcctttggatatgggacaccttcatattttgcattacagtacagctcaataatatccttcagaaatgtgatcagcgactgagcatctaccaccatatgatgtccgaggaaatacactccgttgaatccatctgaagtgcggatcattttaattttcgtcatcagtgaatcctcgaatggaaatgggacagttgtccatttctgcatcgtatcagctgcctcttccatagtcacattggagaaatcaacgaactctatctcccgttcttttctgtcctgctctgcccttacaacatactgatatacattcccctctttgtcctttgcaaagcgtatccgcatcccttcatttctctcatatgctttgtaaatggactctcggagtacatcccaatccagatctgtgccaattgtcaggcttgtgccaatattcagtactgccgcattcggacaaaatggcagataatacaaatgaaatttttgcgctaccgtcagtggatatacaggatatccttttcttgttttcatcattctatgattcctcctataaatgaatccattgctccttcataagcttctctgtctttataataactttcgcagtgtcctgccccgtggatgatcagcttctgttttggagatttacaatttttataaatttcttcagacatactgcatggaacaaatgtatcggcgtctccatggatcaaaaggacaggaacttttgcttttctgacttcacgggcagaattgcactcatccagtccatatcctgcctgttttttattcaccgcatccgcaatctgtatcattggaaacgccggaagatgatacatactgtgaagtacatgtgtaaacactgccttgggcgaagtaaacggacaatctgcaataattccttttacctgctgcggcaaatcaagcccgcttgccatcaatactgtggcgcctcccatagaattaccgtgcaggagaatctgaacattttctccttcctgtccaatcacccactcaatccatcgatatgcatcataacggtccttacatccgaatccaatgtatttcccttcactttgcccatgtgatctctgatcaacaagaagaacgttataaccacgcttcagataataatttgaaatacttccataatctgcaagcccctggctcgtgtagccatgaaaacagatcactgcttttttgcatttcttttcttcgacatttcctgctccctggaaatacgttccatgaagcttcaaactgtcttccgaccggatccagacatcttcatgaggctgctccatcatccactccctgcattccttcatctttgagaaatactgattccagtctaccccggacatcttcatcgtgcgttctgtctttgcgttataacgcatcattgttcttctgtaaaagtatgcacttccacctgcctctgctgatacgattcccaccaggcctgcaagtgcaagaagttttccgtaatgcatcatctttttcacctttgcttcctttttacagttatttctgtttctgtgttttctttattgcattctgttctgcttttctgctatcaatcagttttttcagatacaaagctttgtcaatgttgccttctactttcaattttcccagtgttactgccagaaccggatccagctttccctcgttgatcttaaataatgtctctgccgaacaagtaaaaatcgcatctctgtcataatactcgtatggttccacatacagctttccttcttttacctctgcataaaagattccctctgcttctcctgttacattgaactgatatgcaagatgttcattcacagtacttacgtctgcttccatcatcatcccttttacttttgaaaacatgtctgcgtatgtcatttttctctccctctccttttcagtttttcttttttcgaccgatggtcgatttgctatgtttttaatctatcactttttcgacccgtggtcaattatctatttcagacaatcttttgttttaaagtgtcctttttttgtcctcttttttatttctattttattggttcttccgactttattgtgctatacttaaaaggatatcggtcaattcccgtaatctggaactggccaaatatacttacgaatatacgaggcggacttctatgccaaaacaattaaaatacgataagattctggatgctcttcaaaagcttctggaaaccaaagaactttctaatatctctgtcagtgagattgctcagactgctgaaattggaaaaggaagtatttattattatttttcttccaaagatgcaattcttgaagcactggtagaacgcaattatgaagctccaataacaacagcaagacatcttgcagagcaaagagagatttcacctttcacacgcatggctctgatctttcaggcctgccgaaattcctctgcggcttttttaaagacacagccatcaactacaaaggctgcaccggaacgggcttttcttcatcaaaagtacatgaatcatctcatcgtttcactcaagccggttcttgcttccattattgaacaagggattgcacaggatttaatccgctgtgctgaccctgtttctcttgctgagatcgtactgattgtactgactgttaagatggataacaccttagtaccttcaacagcagatgagattgaacagacaatctctgctcttgtctctcttttggaaaagggaactgagaatcctgcgggatcgctaaactttctgatggcacagctgtaagcagttttctgttcgcggcacctgcattacacaacatatcccaccattttgaatcgctgacggtgatatgataaatcatgagacgaaaggagtgtttttatgattattcgtcctgtttttaatatattattgctccctgatatcacttatttttttaaacgtgatttctttccgggggctgctgcagaccagattgaagtcggtacagatattctgtttccatttttgaaaaatgaagtggatgagactactgttactatagatgatatttacccggtcggtatgtctgcgagagtcgaatccatcggtgatgatgacagcatccagattcgtacattagaacgtgtcagtcttgatgatattgagctggatgagaacggacagattacagctacagcttccatccgtccggaggtagatgatcttcctttagaagaagagaagcagactttcacaaacctgcggaactcgcttctgaaatttgttcagaattatcaatgggggatctgggcaagaagctacattatccagagaaagaatatctatgaccttggttctgctctttcagattatctgaacattacttccgaagaaaaatatgcaattgttgagacagattcccgccgtgagcgctgtgaactgattgagaatgcgatcaaagaattcatggaagttgccaaagtttcttctgaagcacaggaggcacagaaaggtgaccaggagcagctttacagagaggctgcaattaagaagcagatcgattaccttcagaaagaattagatgagatgcacccggaaaacatttccgatgtccgcgcttttgaaaaaaagatccaggaatccggcatgaatgaagatgcccgtaaggaagcggacaaagtcctgaatcgtatgaagcaggaaggaaaagacagccatgaatatgggcttctctatgactatcttgattttgtcaccagtctttcctggaagcatccggaatttacaccgattgatttaaaccgggcagaagagattcttgatgaagatcattatggacttaagaaagtcaaagaacgtatcatccagcagattgctgttatggcactgaaccggaaacagtatggttccatcctcctttttgtcggtgcgcctggtaccggtaagacaagtatcggacagagtattgcccgtgcgttaaaccgcgaatatgtccgcatcagtctcggcggtatccgagatgaagctgagatccgcggtcatagaagaacttatatcggcgctatgccgggacggatcatggaagggattaaacgcagcggcgtttccaatcctgttgtagttcttgatgaagtagataagcttgcgaaagattatggcggagatccggcaagtgcattgcttgaggtgcttgacccggagcagaacagtacatttacagaccattatatgaatgttccatatgacttatccaatgttctgttcgtctgcacagcgaattctacagatacgattcctgaaccgcttctgaaccgtatggaagtgattgattttccaggatatacggcggtggaaaaattccatattgccagaaagcacttacttccaaaggcaatggacgctatgggaatccagaagaaaatgttaaagataacggatggtgcattgcgcaaggtcattgaagattatacgatggaatccggagtccgtggacttaagaaacagattgatatgctttgtcgttccgctgctgtgcgtcttgtaaaagaagaggggcagactctgacagtaaataaatcgaatctgaaagactatctcggccgtaagaaactgcatcatgaccagaaattaacttccacacagcctggtgttgtcaccggacttgcatggacacaggcaggcggtgagattctgtttatagagacaaagctgacagaaggggaaggaaaggtgatcatcaccggacagcttggagatgtcatgaaagaatctgtacagattgcactgacacttgtgaagtctctttatcctaaagaaagcaaggttttccaggatcatgatctgcacattcatgtgccggaaggagctgttccaaaagacggtccatctgccggcattacattaaccacagcacttgcttcccttgttaccggaaaggctgtcagcccggattatgccatgaccggtgaagtttccctccgcggaggtatacttccgatcggtgggcttcctgagaaactgatggctgcccagagggccggtattacaaaaatactgattccttttgacaacgcagatgatctcgaagatgtagctgctgaagtaaaggataagctgaaaatcactccggtgaaaaaggtcagcgacgttctgaagttattgctcggataaaaagtgacctatcgttaaacggaaactatgagaaacaaaagcccatagcaggaattctgataagttcaacaaacttaccattcagattccgccatgggcttttttatagttttaaaattcgacagataaaccgtaatctatttatctgactatttattcctctgtctcttctccaagatagaatactttgtaaaacatttcaagagacttgaaaagctcttcctttgtgtcctgcagctctttgatcttcagtacacttccgatctcatcgaatgagaaatcaccctcgttgtgctctactttcaactcaaggtttccattctcatcaaacaccaacaggagaactcctccaacatccgctgtatacaacacacacatgatctgcaattcctgtttcactgcttccggaagagattcaaattccgggttcagataatatttctgctcataggagctggccgcacacaataccatttcttcatccataatttttacaccttatatcactgcccacagtttctgtaaacagtacttacctttccatattttccacattcactgcataatcccgatgacttattcacattccgtaggtcttatccacctggttatacatatccatatacgccgcgcaccgaaacttctccggcatacaccgcctcttcggttccatcttctttccgaacgatcaattctcctgtctgattgattccaagtgcgtaagcattgtactgttctttcgcgccaagaatccggacctcacggtctttattaaccagtaattcgctgtaacgttctttcagaccggacagatctccatgttcaaggaaaaccgtgtaattctgttcaaagcgtttcatcactgctgcgatcaacggtgctctctttaccacatgtccacattccagtctgagtgatgtcgctgtctcacggatctcctcagggaactctgtcaggttcacattgatccctacaccaatcgttacatgattaatgtaatcgatctgagtgctcatctctgtcaggattccgacgagcttctttccattaatgataatatcatttggccacttgatctttacatccgggtttccacaggaatctccgcaatccatgattccctctgctacacttaatgccatcacaagcgtcagcatcggcgcctgatctggttcaatcttcggacgaagcaacaaggacatgtaaatgcttgaacctgacggtgaatcccaggaacggccccttctccctcttccggctgtctgcttatctgctaccgcaagtgtaccttccggtgcaccttcatctcccatctgcttgatcctcagatttgtagaatctaccgaatcgtaataaacgatgtttcttccggcccactgcgtatccatcaggctatcgagctcttctttcgtcatcacatccggactatctacaatatgataacctttattccgcacagcttcaacctgatatccttcttcctgcaactgacggatcaccttccagactgcagttcttgacaccccgaacttttcacaaagctgctgtcctgacacatatccgtccgcttccctcaataattttaatatttcagctttcattctaattccacctctcatcagacctttatacaaaagaaaggtgtctgtcccatctctggaataacagacaccttctgctcattcttattttccacagaagccggtctgatcttcaactcatttatcataccaaacttctgctgatttctcaagttcatcaaatagattacatgctcttagaactcgccaagtgttgcaaccattactgccttgatcgtatgcattctgttctctgcctcatcgaatactttggactgtgcagactcaaatacttcgtctgttacttccatatcttcgattccgaaacgctgtcccatctctgctccgatctttgtcttcaggtcatggaatgccggcaggcaatgcaggaaaatagctgtatcttttgcatttgccataacttcttttgttaccttatatggtgaaagttctttgattctcttctcccatacttcatccggctcgcccatggatacccatacatctgtatagataacatctgcgtcctttgttccttcttttacatcttctgtcagagtaattgttgctccggactgtgcagcataacctttacaagtttcaacaagctcttcgttcgggaaatattctttcgttgtacatgctacgaaatgcattccaagcttagagcatgcgatcatcagggaattgcccatgttaaaccttgcatctcccatgtatacaagcttgcgacctttgagctctccgaaattctcacggattgtcagcatatccgccagcatctgtgtcggatgatattcatttgtcagaccgttccataccggtactcctgcatattttgcaagatcttctacgatttcctgaccgaatccacgatattcgattccgtcatacattcttccgagtacacgggctgtatcttcgatgctctctttctttccaatctgagaacctgatggatcaagataagttgttcccattcccatatcatgagctgccacttcgaatgcacaacgtgttcttgtacttgtcttctcaaagatcagtgcaatgtttttgccatgataatgatccaccggtactccgtttttcttcttctctttgaggtctgctgccaggtcaagcaggtatgtaatctcctctggtgtaaaatccttcagtgtcagaaaatttcttccttttaaatccattgttctcgtcctttctattctataactatatgaatcagaaccctctctgtccttctcttcttcatatctttgaacctacattgtaaccgatgaatttagtatactacattcgtgtataaaaatgcaactaaaactttattttactctgttttatacatatttattcagtacttatacattcttttatgcatttttattatttctttcttctctgtcttcctgcttcgaacatcagaaccgccgctgccactgccgcatttagagattctgcctcgccttccattgggatacggatgagacaatccgcgcagtctgcaacttcatcacgaagtccgtttccctcatttccgatcagaaatgcacaaccagttgtataatcttcctcgtcgtatgcattttctccacgcaaatgtgctgcgtaagttttaatgccctccttctgcagctctttgatcttctccggaagatcttccacatagaggaacggcatacggaatacagcccccatcgtggaacgaatcacctttggattgtagacgtccacgcaatctttgctcaataagattccggttacacctgctgcctcagctgttctgaaaatagttccgagatttcccggatcctgcagattatccaacacaaccaagtgcggtgccttctgatttttcatctgcatcaggtcattcatcgtataattgagtctcttcacaatcgccagaattccctgcggtgtctttgtatctgacacgtaagcgaacacagtatctgtcagaagctcgaccggcgcctgtaatttctctaaaaattctttattcttctttgcaaagctttctgaagcatatactttctcaattcgttccgccggaatctcttctgtcattcttggtccttccacgagaaagattcctttttcatctcttaagcggctcttcttctgcagcttcgccagttctttgatctgtgcattcgatgtacttgttatcataatctatttctccaattttccaattttttcgagtactttatttgctccaaccaaaatcaatagtgcattctccggaagcggcatctgtggattaaactctacattaacatttccgtcctgcatgattcctacaactgtaactccatatttcgtacgtatacccagttctgccatactgtgattgatccacggttttggaacagcgatctcaaccatactgtaatcatttgacagttcaatccagtctgtgaattctgttgccagaaggcttttggcaacccggctgcccatctcaatctcaggatatacaacagtatctgcccctactttcttcaatatagttccctgtaacttattctttgctttggcaacaaccattggaattcctatttctttacaaagcagagtcgccatgatccctgcttcaagattctccgcaactccaataattgctccgtccaaattccttgttcccagtgcactcagagcttctttctctgtgatatctgccgtaatagcataagttactctgtccgagatctcctgaattgtctcctgtgatttatctacaacaatcacatcacatcccatactctcaagtgtcagggccacactccgtccaaagcttccaagccccagaactgcaaactgctttctcatcgttttctccttctcatatactgttccttgtttttatcgcgtatctcttgttttctcttttatcttttcttagccaaccataatcttcgcttccggcaaagtacggaactgattcttcttatccacatgaccggaaaatataagtgccatcgtcattggtccgattcgtccaatatacatcatgagcatcagaacgacatgactgatatcactaagcactggcgtcagatccgctgtcagaccaaccgttgccatcgcagatgtcgcctcaaacatcagatcaaggactttctgctgtggctcgatcactgtcatcaccgtcaccccaaacagccagaagacaaatgtcacaagtgtgattgttatccctactcttataatttcgaatgtaatttttcttccataacattccgtatctttgtttcctctcaagacagaaattgctgtaagcaagagaacagcaactgttgttgtcttgataccacctgcagttcctgccggtgaaccaccgatgatcatcagcatgctggccagcagcttcgaaccattcgtaagacctgactgagatatgctggcaaatcctgccgttctcgtcgtcacagactggaaaaaagccgcctggaatttccctgcagcgttcaatgttcccatcgttgccggattatgatgctccaacagatagaatcccaaagttcccaaagtaagaaggaacaacgtcattgtcagaacaattttactctgcaggctcagtcttgtgatcgttcttccgactggccgttttcccttggactgtattgtcatctttatattcttcgcaagatcgatccataccggataaccaagaccgctgagaatgacaagcattgttgtcgtaattgtgatcactggtgtattgacatatctcgtaaagcttgaatctccaagaatatctacacccgcattacaaaatgcagagattgagtgaaacacggaatagaagattcccttcgcaacaccatactccggaataaactgaaatgaatatccgattgcgccaattccttctacaagaaatgttccccacaatactctttcaataaaccggatcattccttgaagtgtggacagaccataggcttcttgaatgacaactcgttccttcatatttattctttttccaaccagaattaaaaatgcagttgtacatgcaatgattccaagtccgccgatctggatcagaataagcagaatcacttttcctgccactgtaaattgcgcagccggcacaactgtcaccaatcctgtcacgcagacacatgttacagctgtaaacagtgcgtcgatataacgaatcggctgatgatttgaaaatggaagccataagagcagactgccaagcagaatcacgccaaagaatccgattgatatgatcctcactgtattccattttgctcttcgtgcttttctcctgtcttcatctatataaaatccatacatgcctatctttcctcgctctcacatgacaattattaaacaccatgttaccactccctttaatcatctgcaagtaaaagctgataaaacgaaagatacgccactctgattcgtcctcagaacagcgtatccttcgtttggcggtttatttaaaattattatatattatatagtttgaatcatttttagtgatctgtagactcgatctctccatcgaatcccgcatcttttatcattttcattgtgtcatcgattccctgtcctccggctgtcagataacctgatgcaaagatagaatcaacaactttgaaaagttccggttccaatcccttgaagtaaacttctcttcctgctgcacagcggatatcggactttggaatcatcagtcttgccagacaaagaactttcaagcaatactccggtgtcagctctgagatatcacgatctgccagtcttgttcccggaatcggaagtaagaaattgatcggaaccgattccggattgatctcgcgaagatccatcagcatatcaacgatatcttccttactctcacccattccaacaattccaccactgcagatctcgaatccaagactctgaagcatcttgatattattcacacgctgatcataagtatgtgttgtacaaatctccggatagaaagaacggctgctgttcagattatggttgatacggtccaatccggcatctttcaggattcttgcctgcttctctgtcaggaagccgatggagcagcagatctgtgtatctttcttcttcatctcgcggatacggtctgcaagatcttcaatctcctcgtctgagaatccgattccactcaatccgatacaatgtcttgcaagatgtttctcatctaccaggtcattatctccataaagcttttcatctgatactctcttgtacttctcaatctctgcctgagaatccttagattgtgcacaataagcgcagttctgtgtacagtttccactacgaacatttgtcagaagctgaacgcttactttcttccctttgtattttgtacgaagtgcataagcacactccatcagactgtccatctcctcctctggaagattcagcacttcaactgcttcttctcttgtaagcggacattcttcatcccagtttttcagtaatgtatgaattgatctgtttgacatggtatatttccctttcttctgtttctatgatatgagtttcaaaagtaatttttgtcattcactgatgcaaccggattactccattgctatgtaattcccgcaatcctcaaatatctccaacgcttcttcagcattatcattctgttgatcttatttgcaacatatgaaaatagtatagccatgtctttttcgattgtcaaccttttctttatttgagttgacatctttattatttctagaacaaagaatgtgccttgcacattcttgcgcctgcggcggtcgcttgcgacatctggcgatggggcgagatgcattcaagccaaaacatgcatcctccgtgtcaatcagcaaagtgattgacacaggagtgaacagtaacgaaatgtttcccaggtaattttccttattcctctgctgcaagcacgatcatttcatctccggcttttattttaccaccatgaagcacttttgcaaataccccttctcgcggcatgatacattctcccattttctggaagatctgacagccatgatgacattcttttccaatctgtgtcatctctaacagaacatcattacattttaatcttgttccaaccggaagattacggaaatcaatcccctgaacgatcacattttctccaaatgcgccatcttctacttctgcacctcttgcacggaatgcctcgatcttgtcataagaaagaagactgatctgacgatgccattttcctgcatgcgcatctccttccaggccaaaatcttcaataaatgtgccttcctcgattcttgtcttctgtgttcccttttccggacttgtacaaattgctattacttttcccatttttctatacctctcaaattactttttcacttttataatttttgtgcatgatctgcactgttacttttctgtcactgattttatttcattactgatctagccaccgattccgtacatggcccgatgttcttttttctgaccaacttcttcatctcttcgctcatccgagaaattgtgacaggccggttttttccagattgcctgacgcattgcttctttcagttcttcatccgttgcaccgcttcttaaaagttttcttaaatcaattccactttcatactgcaaacagagtttcagatatccttccgctgtgagccggatccggttacaggaatcacagaacttgtgactcactgcactgataaatccaattctgccctggaatcccgaaaagctcacatactctgccggaccattccccaaatgtttttcatacggttcagcgtttcctaatgctttctctaaaagttccagaagctcatctcttgattttccctgacaggcttttcccatcccgatcggcatcatttctataaaacgaacctctaccggatgctcctttgcatactctgccatctgaatatactcttcttctgactgattcatcggcacacaatttaacttcacacgcagattcggatattcgagtgctgcctgcagtccttccagtgcctgatttaattccccacatcttgtcactgtatggtaacacgtttcatccaatgtatcaatactgatattcactgcatccagcccctgacgcatcaactcgtccaactgatttttaagaagaattccgtttgttgtcaatgtcacctgttcgatccccgaaattctcttaattttccccaataagtccggcaatccttttctcaccaacggttccccaccggtcagtttgatctttgaaatcccaagttctgtactgatccggcatactctctcaatctcatcaaaagtcagaatctgctcatgcggcagctgctcaatgcccgcttccggcatgcagtagacacagcgcagattacaacgatccgtcacagagatacgcagatattctattgttcttccatattgatcaatcatctcttacatacctcatattatttatctcttacattactgttttactttccttcagaaactggttttccacactcacttgcatttcctgtaagaattgcaagaccatgttccagagatggaagtactgcttctagattctcttttacagccttcggacttcccggaaaattaatgatcaatgtctgattacggatcacagaagcgccacggctaagcatagctcttggtgtcacttgaagtgaagccagtctcatcgcctctgcgattcccggtgcattctttgtcgccacggcaaatgttgcttccggtgtgcagtcacgcggtgcaaaacctgttcctccggttgttgcgatcagatccacttttttctcatctgcaagttcacagagacactgttcgatcatcttctgctcgtctggaagaagccttacttctgtcacttcatatcctgcctcttctaacataccgcaaagaagcggtccactcttgtcctcccgctctcctgcatatcctttatcactcagtgtcactactgctgctttccatctttgttctttcttttccactttacttttcgccttcttttctttccttcttatatccattgttgatcagcccactcttaccgccgctctttctgaccagatagatttccccaatctccatctttttatccatcgctttgcacatatcgtaaactgtcaaaagtgctacacttgctcctgtcagagcttccatctcaacgcctgtcttcccggtcacacgtaccgtacaattacaataaattgcaagttcactctcaaccatctcgaactctaccttacactttgtgatcggaagaatgtgacacatcggaatcagatccgatgtcctctttgctcccataatccctgctgttgtcgcaactccaagcacatcccctttgcctgcagttccttctttgacagcacggaacacttcttcattcaccgtgatctttcccgtggcggttgcttcccggactgtgtcccgcttctccgtcacatctaccataatggcttttcctttttcatcaaaatgtgtaaaccccatttttttcacctctcaatctgaaaatgctgttgatatccacattccccttgcaaatatcaaccagacgattgctttttttataccaaacgattgtaccacagaatagtactaaaattcaatgttttggcaaaaagaaaggacaactataatagctgcccttttaccatcatcccatctttttctttaattcttgtatcgtttccagagtttctttcgtgatttccgcaatctgttccagtggtagtcccgcttcaatcattgataaaataatttctttacgtccacggttttctcccgtcttgatcaatatatcacgatctctgattgctttctgtcttgcttcatattcaagacgttttttctcgtccgcacttaatttgtccaattctttatacgcttcttcaaaacaagaattcttcttagccattttctcaaaatcctccctgcgtttaccattcaaaaagcgcatccactgcattaaatctgtttcactcttttgttccggcggtaatttgggcagttccaaaatatgcatttccatcagatctgtatattccttccccgtctttacatcacaaaacgaaatacgtcgataacactcatcatcttcttgaaataatacatgagcaagaatacttacttgaatacatttctgtaatctatcatagctatcaccttctcgtatctgttccgtatacatcttactcaaataataaattgtacgattcgcccaaaaatcataataaaccacctgcatttcaaaatcaatctgtacttcattatctaactgcacccgaacatctagaattccatacttatcatcttccgaatcctttcttaggattgtggggagaagctcagtatttacaatttcatctggacgcttgtttaatatagctgcaataattccttttctcacattttcattttgcatcaactctttaaagcaaaaatcaactgttggcaacataatgaaatcttctttttcatttaatgcattttcgcttttaattgcacttttagatacttttcttgggttttctttcataagaattctccttttcgtttttgtaagacaaacacttatatgaaggaaagaattctttatccaaatttattgtaacataggtttttttttcagaaaagcagaacttttaaacctgatcctttaataaactttcagttatcattcatacaatattcgtcttatgttttgttatcggattatttgttcgaatactgaactatggaaataattaccgattggttaatagatatctttgctgttcataagaataagaactgcgtgaatttaggctaacatatatttccgaaaattacaacctctttttgattttccgtttaatagaaataaggacaactataatagttgcccttaaaatcaattattaaaattcaatattcagcatctcatctgacttctccggaatcttatgtctttccgcatatcctgtaagaatcaacgtaagtgctccgtccccggtcacattacaagctgttccaaaactatcctgaagtgcgaaaattgtaagcatcagtgctgttcccgcatcatcaaacagaaggactcctgtgataagtccaagggatgccataactgttcctcccggaactcccggtgcaccgattgcaaatactccaagaagtatacaaaacagaagcattgttggaattgacggaagttttccatacagaatctgtgagattgtcatacagaagaacacttctgtgagtacagatccacacagatggatattagcaaacagcggaattccaaactgtaccatatcttttcttaatggtttcgcctttcctgcacactgcagagcaactccaagtgttgctgcggaagacattgttccaacggctgtcagatatgccggtccgtaatgctttacaacctccagtggattctttcctgaataaacgccggcgattgtataaagaagtgccatccagatataatgtccgatcataacaataatgataaccttaaggaataccggaagctgttttgtgatggatccttcatatgccagagaacaaaatgtgaatccaataaataacggaaggattggaatcaaaatccttgacacgatggaaagcacgatcttctggaattcttccaacattcctgtgattaattttgccttattccatgccgctgcaagtccgatcataatagaaaatacaagtgcactcataaccggcatgatctgtgggatagaaagttcaaacaccatctccggcagttctttcagtccatctacatctgtcacaatagaaagatgcgggatcagcgcatatcctgctgctgtagagaataacgcagccccaacagaagatacatatgcaatacatactgcaagcagaagtaatctcgatgcattatttcccatctttgtaatggacggtgcgataaatccaatgatgatcagcggaacgcagaatgaaataatctgtcccagaacatatttcaaagttacaataatgttcagaattgcatttgtcaaacttgtcccgtcatttgcattaagagcaagtccggcaagaattccgatcacaacacctaccagaagtttaaatggcaggcttttgaaaaaactagattttttcataggaagaatcctccaatactatttttcggtcctaattcacagatgtctgtaatctccaacctttctcagacctgtttagtcggtatgcaatattataatacacgaaggataaatctacaactgtctgtttacagcttaccgatttgcacctataggacttttatattttattgtcctgcaaggcagaagaatattataagtccatgcgcttttttttcttgtttttaatttcttgaaaaacaaatcctgaggttagtgtgcagaccatagctgattattttgctgctcagctatacggatgtaagttttgctttgaaaaattcaaagttgtctataagatgtatgaaattaattgacaaataaagttgtcaatgttatcatcataaatgacaagaaaagttgtcaaagcaaaacgaaaggggactagaaattgcctttattaaatcgattaaaagaatatagatcaaaactgggaatcaatcagacagagcttggaaagcgggcaggagtttcccgccagacgatcagtctgatcgagcgtggggactattccccatctgtgacactggcattaaaaattgcaaagatctgtcaggttacagtagaagatatctttgagtataaggaggatgaaaacgatgaagagtgatacaaagacgagaaacacaaagaaaaccattgtaaggatgttagcggcaatgctgataggcggagtgataggaggcgtaagtaccgtagtttatgaaattgtttttggggaagattttagtggaagatcgctgagccttctgacggaagtgacacggaggcttatggttccggggctcctgtcagtgcttgtcgtttcaattgcagcatatgagatctgcttcaaaaagctaagaaacgtctgtgatcggattgaagatgcagaagatgaggaatttcatcgactggattatgaagaagaaaggtacggagcaattctgcagtgtatcaatgtagtggcacaggtgctttgcattgctttgttgggaagtggatattctatgagatatattcatgatgaaagaacttcgctggtaaaatttcttacagcatgtgtcctgtttttaatctgtttcttttactgtggcatggctcaggcccgttatgtaaaactgcttcagaaaatacatccagagaaaaagggcgatattgcttccaaagattttcataaacaatggctggaaagctgtgatgaggcagaaaaggaagctgtttatcaaagttcctacagtacttacatattctcaggaaaattaatcggaatattgttagttgtgacgatgatcgcgcatttatttttcaatacaggagtgttcgcgattgttgtggtcggtgtaatctatttatgtataactgtaaaatactgtgtttcctgtgttaaattaaaaaataaatcatagcggttaactatagaaatttcagtaaataatgcaagtaattcgtgttctgccgtttttgccgttaacatgggaatgaacaataatcgagtaggaggctaaccattagttgattagccgacctctcacaccaccgtgcgtaccgttcggcccatcgccaaaggcgatttaaaatggcgagatgcgttgctggtcgcacatcgtgcgaacagtaacagggacgggtagataaagaatgatgtagcgcaacgccgttgcatatttgtctgttgaatgttaaaatgtgaatgtcattcagattcaggtcaaagctagaaaaagagcgaaaatggatttggataatttcgaaaatcagggaaataaaggcaggcagtatacaatgacgataaaagagattgcgcagatggccggggtgtccagcgcagcagtatcaagatatttgaatggcggatatgtgagtgaacagaaaaaggagcagatccgtaaagtgattgagaagacgggatatcagccgtctactcaggcaagaatcctaagaaccggacgtgcacatctggttggtgtggtggctccgaagatcaattcagaatcaatcagccggatcacagcgggaattgaacaggttctttcggcaagagggtaccagatgcttcttgcaagcacggataatcagccaaagaatgagctgacttatctgagaatctttgaaagttatccggtagatggaattgtactgatcggtacagtgcttacagacgagcatcggagatttttaaaagaatcaaaggttccggttgtgattgtgggacaggagacagaaatggcaagctgtatctatcacgatgattttggtgcgggaagagcaatgggacaagaagttgcggtgaaagcactgaagcggaatggtggaagacctgaagattgcaagattgcatatattggtgttactcgtgaagataaggcagcaggtgctgccagagaagacgggttccgcaaaggacttcaggaagcagggattactttcgatgaccatcggtacagacgcgaatcagaatttacaatgagcggcggatatgaagcagcagtggatttgttgagtgaagaaaatggaatcgatatcatatcgtgcgcaacagatacgattgcagcaggagcaatcgaggcattgatcgcacagagtaaaaaggcggttccggaatcggttcagaattctggtgcaaggatgctacacattttggaacagtctggtatctgtgtcacaggatttggtgataatcagatgttaagggctgtgacaggcggtattccaacggttcattttgggtataaaacgagtggaatcaagggggcagagctcttacttgaacagattgaagagaaaaatccggtgccggtgcatatgaagctgggattccagatcgtgaatagatttgaatgaatgtaactaagagtatagtgcaagttaaacaaaacagaagaatcagaattagtaaaaatgccatctttacaaatggcatttttttatttaatataaaatcataagatgtgaaaacgattacacataaaacatagaaggaagggagagtaatcatggattacaggaaaacagcccaggagattctgggatatgtaggtggaagtaagaatattgtatccgcagcgcactgcgcaacgcgtcttcgtcttgttatcgcagataatagtaaggcagataaagaggcaatagagaatgtggatggagtaaagggagtatttgaggcatctggacagcttcagattattcttggaacaggaacagtgaataaggtgtttgatgaatttatcgcgatcgcaggtattacagcaagcacaaaagctgaggcaaaggaagcagcggcagagaagcagaactggtttatgaaggccatcaagctgttaggtgatatttttgtaccgatcattccggccatcgtagcaagtggtttcctgatgggaatcatgaatgcgctggatttcatgaatgcaaatggatttttagcaattgatacaagcagttctatttatgtgtttgcgaatctgttcagtaatatcgcttatacatttctgcagattctgattgcattttcagctgcgaaagcatttggtgcaaaccagtatcttggagccgttatcggtatgattatgattcatccgtcattgcagaacgcttatacggttgcaacggaaggtgtacagcagacacagagcgtattcttcggactgtatcacatcgacatggttggataccagggacatgtaatcccggttattattgcagtatggatcctttctgtattagaaaagaagctgcacaaggtagttccggcagcacttgacctgtttgtaacaccacttgtcagcgtattcgtgacaggatatcttacactttctatcgtaggaccgatcttcgtatggggtgagaatgcgattcttggagcaatccagtggatgctgacacttccgctcggacttggaagtctgatcatgggaggtttgtatgcaccgacagtagtaacaggtattcatcagatgtacacagcaatcgatattggtcagctggcaaaatacggagtaacttactggcttccacttgcaagtgcagcaaatgtagcacagggtgcagcagcattggcagttggcgttaagtcaaaagatcagaagattaaatcccttgcacttccgtcatcacttagtgcatttatgggaatcacagagccggcaatctttggtgtaaacttaagattcttcaaaccatttatcgcaggatgtattggtggaggatgcggagcattgtatgcatcacttgtacatctcggagcaaaaggaactggagtaacaggtatcttcggtatcctgctttgcctgaatcagccgcttcagtacattatcgagatggcaatttcagtaggagtagcatttgtgatctccttcatgatttacaaagataaagatccggtagttaagacagccgcaacagagacaacagttgagaaaacagaagagacagagaatgtagtagaagcagaaaatgtttcagcagaagaaattacaagcccggtaaacggaaatgttgttgcgacagcagaagtagcagatgagacatttgcatcagagatgcttggaacaactgttgcagttgagccaacagatggaaagattgtagcaccatgtgacggtgaagtaatgaatatcttcgatacagggcatgcagtatgcatcgcaacggaagcaggagcagagcttctgatccacattggaattgatacagtttccatggatggaaaaggatttgtaaagaaagtagcagacggagcaaaggttcgtaagggcgatgtgctgatcgaagcagatctggatgctatcaaagcagcaggacatccggcaactacgatgatgatactgacgaatgcagatgacttcagcaaagtagagaagacagcagcgggaacagttacaacagctgatctcgcaatgaagattgagaaataaattgaacagtgattaaaaagatacagccgttttattcaaagaagaattcttgcagaatagaacggctgtaaatggaaaaagggagacaagagcatgaatgcattaacaagggatctgattaaactggtagatatgacggaagagatgatgaaagaaaaagagcagaaagaaggcacagcttatcgtgaaaagctgcatctgatgcctcctgttggctggctcaacgatccgaacggactgtgccagttgaatggaatctatcatgcattttttcagtattctccatttaatgccgaaggcggcgtgaagatgtgggggcactatacaagcgaagatatgatcgactgggaataccagggagtaaagttatatccggatcagccatttgactgtcatggtgtatactccggatcagcatttatcgaagatgacaaaatgtatgtttactatacaggcaatgtaaagctggaagacggagattttgactatatcaacacaggacgcgagtcaaatacggttcttgttgtcagtgaggatggaaagacatttggatcaaaaaaagaactgatgagaaatgtggattatccgtcagatctgacttgccatgtgcgcgatccgaaggtgtggaaagacggagatacttactacatgattcagggtgcacgtacaaaagaagatgtcggacaggcattgatcttcgggtcaaaagataagattaactggaagttcagaagccgtgtggaatcagagaaaccgtttggttatatgtgggaatgcccggattactttgaggtagatgggacaaaaattctttctgcttctgtgcagggacttgaaggcggagtatgggatgacagaaatgtttatcagtcaggatatttcatggttgatggaaatattttagatgattataaactttcagaatacatgctttgggattacggatttgatttctatgcaccgcagagttttaagactgaagatggaagaagggttcacatcagctggatgggaatgccggattgtgaagaatataccaatcagacgattgcagaaggatggcagcactgcttcactttcccaagagaagtatttgtggaagacggcaaagtttgtcagagaccggtcagagaattgcaaaagaggaaaactcttgtggataagtcagccggaatgttgaaaaaagatggatataaagtctatgatgtgaatatctcaggcattcagaacaatgaattcaggacagtgattgatgaagaattgattcttgagtacaaaaatggaagatttgagatgcatttcacaagtcaggataaaaattctgtatctgcaggaagaggaatgcgttatgttgatgtagataaaatttcaagtgttgaaattcttgtggataaatcctctgtggaagtatttgtaaataatggagagtatgtattcaccacacggttctatccacagaaagacagtcttgcggtagaggctgcgggagcagagatcatgatggaagagattcgatagttgaaagaaaatagcctccggactattgaaaaaaactttcagtagaattataataacaatagtcacagattccccacagatgaaaggtctgtggggatttttgcgttatgaattcaaacaaccggaggatttcctttatgataaattttaagaaatacggaaagcgctgtctgtctctttttctggcggcatctatgatattaatgccggcagtacagacatttgctgaggaagaaacagcggcagccacaacagattcaactcagacagcgggagaagacagggagacacagcgtcagaactgttatgcgatcgcaccggattcaaacagtgtggagaactggccacagggaccggcaacttatgcggattctgcaatcgttatggatatgaatagtggggcggttttatatagcaagcagattgaaaagaagcattatccggcgagtattacaaaacttctgacaacattggttgcgctggacaatgcagagcttacagatacggtagaattttcccaggacagtatctcctttctggaatatggcgatgcccatatcggcatgacaccgggggagcagatcagtatggaagacgcgctctatgccgttctgctggcatcggcaaatgaggtctcttatgcagtagctgagagtgttggcaagaagatgggtgggggttatgacacatttattcaggcgatgaatgatgagtcagaaaaacttggatgtacaggttcacactggatgaatgcgaacggacttcatgatgaacaacattatacaacggcgcatgatatggcaagaattggtgcagcagtttatcagaaggaagcgttccggacaatttcccaatcgttaagccatacgattccggcaacgaatctggtgaatgaagaacgtacttttcagcagaagcacaagatgctctggccacagaatgataattattatgaatactgcaagggcggtaagaccggctacacagatcaggcaagaacaacgcttgtgacaatggcagataacggagatatgcagcttgttgcggtggtactttatgattttggaaatgatgcttatatagatactcgtgccatgtttgattatgcttacagtaatttttcaaaaatatctttgaaggatcagaagcttccggaaggtgtgaagtcttatgaagacgaagatgcttatatcgtacttccgaagagtgcacaattttctgatgtgaaagcagaagtgaaggaagacagcaacaaggatggatccggaacagtaacatttacttataaagggcaggaagtaggcagtgtgaaagctgcgatagaaaaaacagaggaaagcagtgcagctgttttggaaaaaaagaaagataagacaacttcaactgtcgtaactgggatttcaaagtttatgaaaatcgtgatcggagttgtaattgcagttgtgattttattgatcatcattgttgtacttgcgaattaccggaagcagataagacgtcgcagaagaaaaaaaggaaaaagaagaaatgcaaagagtggtaatgtgaaaagaaagaagaaacgccgcagataagaaaacagaaatttgcgaaagaacgctgaaaacaacgttttttcgcactttttttatcataataaaccttgactagaagcgagaatctctttataataagccgtgtgtagaagttcacaggtaaagcgatgacggagacagtaggatttatccgaacgttacagcgagccggagatggtgggagtccggtgcaagtaagagatttttgaagatcactccagagcagcagttcctgaaacagatgcagaaaagaggtttctgcagaaagagagagtaaggactgacgcgtgtccggcgttaaaggataccatatgcaggtcagaaatcagacctaagtatgatgtaacaggtggtttaacgagagaagttcaggctttcgtcctattacaggacggaagcctttctttttaagaatcataaaataaactcaggaaaggataagaacatgtataagaaagtttcaactgacatgaattttgtcagccgtgaaaaagaagttgaaaagttctgggatgataatgaaatcttccagaaaagtatggatgaaaaagaaggatgtccggattatattttctatgacggacctccgacagcaaatggtaaaccgcatatcggacacgttttaactcgtgttattaaggatatgatcccgagataccgtacaatgaaaggatatatggttccaagaaaggccggatgggatacacatggtcttccggtagagcttgaagttgagaagcttcttggtcttgatggaaaagatcagattgagaaatatggtcttgaaccatttatcaagaaatgtaaagagagtgtatggaaatacaaaggaatgtgggagaatttctccggtacagttggattctgggctgacatggagcacccatatgtaacttatgataacaactttattgagtctgaatggtgggctctgaagcagatctgggataagggactcctttacaaaggatttaagatcgttccttactgtccgcgttgtggaacaccgctttccgcacaggaagttgcacagggatacaaggatgttaaggagcgttcagcaatcgttcgttttaaagtaaaagatgaagatgcatatattcttgcatggacaacaacaccttggacacttccatccaaccttgcactttgtgtaaatccgaaagaagattacgcaaaggttaaggcagcagacggacatgtatattatatggcttgcgcactgcttgatacagttcttggaagacttgcagaagaaggtaaagatgcttacgaaatccttgagacttacaagggaactgatctggaaggaaaagagtatgagccgctgtatcagtgtgcagcagacgaggcagcaaaacagcgcaagaaagcattctatgttgtatgtgatgaatatgtaactctgacagatggtacaggagtcgttcatatcgcaccagcatttggtgaagatgatgcgaatgtaggaagaaaatatgatcttccattcgtacagcttgtagatgagaagggtgatatggcagaatctacaccgttcgccggtctgtttgtgaagaaggctgatccggaagtattaaaagatctggatgcaagaggacttctctatgatgcaccgaagttcgagcatagctatcctcactgctggagatgtgatactccgctgatctactacgctcgtgagtcctggttcatcaagatgacagcagttcgcgaagatttgatcagaaataataacacaattaactggattccggaaagtatcggtaaaggacgtttcggtgactggatcgagaacgttcaggactggggaatcagccgtaaccgttactggggaacaccactgaatatctggcagtgtgagtgtggacatatgcactctatcggaagcattgaagaactgaaatcaatgtctgataactgcccggatgatatcgagcttcaccgcccatacatcgatgctgtaacaatcaagtgtccggagtgtggtaaagagatgcacagagtaccggaagttatcgactgctggttcgacagtggatctatgccatttgcacagcatcattatccatttgaaaataaagacttatttgagagacagttcccggcagatttcatttccgaggcggtagaccagacaagaggatggttctactctctgcttgcaatctcaacactgctgtttaacaaggctccatataagaatgttatcgttcttggacatgttcaggatgagaacggacagaagatgagtaagtctaaaggaaatgcggttgatccgtttgatgcacttgagaaatacggagcagatgcaatccgctggtatttctacatcaacagtgctccgtggcttccgaaccgtttccacggaaaagccgttcaggaaggacagcgtaagttcatgggaacactttggaatacttatgcattcttcgtgctttatgcgaacattgataattttgatgcaacaaaatatactctggaatatgataaacttccggttatggataagtggatcctctccaagatgaacacaatggtaaaagatgtagattataatcttggcaattacagaatcccagaggcagcacgtgtgcttcaggatttcgtagatgatctgagtaactggtatgtaagaagaagccgtgagcgtttctgggcaaagggaatggagcaggataagatcaatgcttacatgactctgtacacagctcttgttacagtatctaaggcagcagctccgatgatcccgttcatgacagaagagatttatcagaacctggttcgcagcattgataaggatgctccggaaagtattcacctttgtgacttcccagaagttcatgaagatcagattgacaaagaacttgaaaataacatggaacatgttcttgaccttgttgttatgggacgtgcatgccgtaatgcgtccaacatcaagaaccgtcagccgatcggaaagatgtttgtgaaagcagactttgatcttccagaattctatcaggagatcgttgcagacgagctgaatgttaaaaatgttaaatttacagatgatgtaagagactttacttcttatagttttaaaccacaattaaagacagtcggaccgaaatatggtaagatgttaggtggtatcaaagcggcgcttaacgacatcgatggaaatgcagcaatggatgagctcaacgctacaggtgcactcaaactggatgtaaacggacaggaaattgaacttttcaaggaagatcttctgatcgatacagcacagattgaaggatatgaatctgtaaatgacaacggaattacagttgttctcgatacaaacctgtcaccagagctgctggaagagggatttgtacgtgagatcatcagcaagatccagacaatgagaaaagaagctgatttcgaagttatggacagaatcaaagttacatacgagggtagtgaaaaggcagaagctgtcttcgaaaagaacaatacactgatcgcaggtgaggtacttgcggatgaagttgtaaaagcacagccggctggttacgtgaaagaatggaagatcaacggcgaagcagttacaatgggtgttgagaaaaaaggagagtaataaacatgttcagtaaaagattcgagaaaaaggcttttaaagcggcagtaaaggataacgttaagacactttatagaaaaacaatcgatgaagctacaccgcagcagctattccaggcagtatcctatgcagtcaaagatgttattatcgatgattggattgagacacagaaaagatatgatgagacagacgccaagacagtatactatatgtcaatggagttccttatgggacgtgcacttggcaacaacctcatcaatatgacagcatataaagatgtaaaagaagcactggaagagatgaatattgatctgaacgtgattgaagaccaggagccggatgcggctcttggaaatggtggtcttggacgtcttgcagcatgtttccttgattctcttgcaacattgaactatcctgcatatggatgtggaatccgttaccgttatggaatgttcaaacagaaaatcaaagatggatatcaggtggaggttccggacaactggctgaaagaaggaaatccatttgaaattcgccgtgaagaatacgcaaaagaagtacgctttggcggaaatatccgtttcgagaaagatcctgtaacaggaaaagataaatttatccaggaaaattatgagtctgttatggctgttccgtatgatatgccgatcgttggatatggtaaccatgtagtaaatacactgcgtgtatgggatgcaaaaccgatcacagatttcaagctggacgagtttgacagaggaaattatcacaaagcagtagagcaggagaaccttgcaaaactgatcgttgatgtcctttatccgaatgacaatcattattcaggaaaagagcttcgtctgaaacagcagtatttcttcatttctgcaagtcttcaggctctgatcgagaagtataagaagaaacatggagatatcagaaaactgcacgagaaagttgttatccagatgaacgatacacatccgacagttgcagttccggagctgatgcgtcttctgatcgacgtagaaggattaagctgggaggatgcatgggaagttacaagcaagacttgtgcttacacaaaccatacaatcatggcagaggcacttgagaaatggccaatcgacttgttctcaaaattacttccacgtatttaccagattgtacaggagattgatcgtcgtttcctgatcaaggttcgtgagatgtatccgggaaatgaagagaaagtccgcaaaatggcaatccttatgaacggacaggttcgtatggcgaacatggcaattgttgcaggattctctgtaaacggtgttgcacagcttcatacagaaattcttgagaaacaggagctgaaagatttctatcagatgatgcctgagaaattcaacaataagacaaacggaatcacacagagacgtttcctcgcacatggaaacccacttcttgctgattggatcacagataagatcggtgatggatggatcacagatctgtctcagattgcaaagctgaaaccacttgttgaagacgaagacgcaagacgtgaatttatggaaattaaataccagaataaagttcgccttgcgaaatatatcaaagagcataacggaatcgatgtagatcctcgctctatctttgatattcaggtaaaacgtctgcatgagtacaaacgtcagctgttaaatatcctgcatatcatgtatctgtacaatcagatcaaagagcatccggagatgtccttctacccaagaacatttatcttcggagctaaggcagcagcaggataccttcgtgcgaaagaaacgatcaaactgatcaactccgtagcagatgttgtaaataatgacagaagcatcaacggaaaactgaaagttgtatttatcgaagactacagagtatccaatgcagagattcttttcgcagcagcagatgtcagcgagcagatctcaacagcttccaaagaggcatccggtacaggtaacatgaagttcatgctgaacggtgcaccgacacttggaacaatggacggagcaaatgtagagatcgttcatgaagttggagaagagaatgcatttatcttcggtctgagttcacaggaagtaatcaattacgagaacaatggcggttacaacccaacagatgtttactttaatgattgggagatcaaacgtgtcgtagatcagctgatggatggaacatattctaacggtgatcacaacatgtatatcaacctgtataactcactgctgaatacacagtgtacagacaaagcagatacttacttcattctgaaagacttccgttcttatgcagatgcacagaagagagtagaagaagcttacagagatcagcagagatggtctaagatggcaatgatgaacacagcatgcagcggtaagttcacatctgacagaacaatcgaggagtatgtgcgtgatatctggcatctggagaaggttgaagttccatcaggacaggaccttttcgaataagcaattacacggagaatgaaccagataagttctaaaataggacagccttccatacaatagagtatggagggctgtttttatgcgtgatacaattagaaataaaataaagtcattttttgcatttcttatcatactgtttttacttccttacatcatttctgtttttataaacggaaaaaatgcggtgcagggagctgacagcgataatgcatctgtgtatctcgcagaaatgctcgcaggagaaacagatggtggatgtgaaatagaagcattgaaggcacaggtggttgttctacgtacagaattgtacagaacagagaaagaaaagcagactcttttggataaatgtctgacgcagactcagatgaagaaaaagtgggggacaaaatacgaagagaatttggaaaaatgtcaacaggcagcacaggaaacaaaaggaattgtactgtggtatcatgagacctttgcatgggcaccgtttcatcaatccagtaatggaaagaccagagatgtgcaggaggtacttgggaatgcagattatccgtacatcacagcaaaagaatgtccgcttgacaaggcggcagaagatgaaattcaggtacatttgatagaatataaagagatacaaaagagatgtagagaattccttgtggcagaggaacagaaaaaagcagaaaatgggtatggatacgaagattttgaaattcaggaatgggattcttctggttatgtcaggaaaatgcgaattggagagacgatatgtacaggagatcagttccgtgatgcactgaaacttccttcgagttcattttctttttatgaaagtccgcatggattaaaaattgcaactgttggaaaagggcacggattcggaatgagtcagtggactgcacaggaaatggcaaaggatgggaaaaattatgaagagatcctgcaatatttttatgaaggaacagaactacaccacatagatgaataagaacaatcatttcaggcaatgctatagccagaggtgatgattatgaataaaaatgaaagaccggcctttttgaaaggaaagggagctgcagttggcgcagtactttgttttgttgcggtaattacaatggttggaagctacacatacaatcattacaaaaaagacatggagcagcagataaaagatgcgcaaacaacagcagaacagcttacagaagatgatagtacattggcgaatacagatgatattcttcctacagacacagattcagaagaggataatgaagaaaaccaggaatcccaaaaggatgttcagcaagagaatgaaaatagtatggagaatggaaatatatccgcagaggaaattcaaagcacagcatcttcaaatacgcaggatgtatggtttactcaggaaagtacacttgcctggccggcaagcggagcaacacttttgagttttagtatggatcatacagtatattttccaacattggagcagtataaatataatcctgcactgattattggtggaacgcagggagaagtgatccacgcagcggcagcaggagttgtagagagtattgaacagactgcccagacaggaactactgtgacacttgatatgggaaatgggtatactgcggtttatggccagctggatgaagtggcggcagcagttggagattatattgcagccggagaggaagtgggaacactgaattcaccgacgaaatattatagtgtcgaaggaccaaatttatattttgaaattatgaaagacggggcgccggttgaccccatgaattttatggagtaaagttatatttgtttggataaaatgatggattcaaaagtttgattacgggtgcaggatcaatactatattgtattggatacaggaaaagttttcttgataatatagtattgatcctggataagggattcatgatataataaataacatgcatcgaaagagtaatgcgggagatagcagaggtgatgagtttttgaattatacatatatgctaaaatgtagtgacggaacgttatacacgggctggacaaatgatctggacaaacgtgtggaggcgcacaattccgggaaaggcgcaaaatatacgaaggcacggcggcctgttgaattggcttattatgaggaatttgagacaaaagaacaggcaatgaaacgtgaatatgcaattaagcagttagggagaaaagagaaacagaaactcattgccggcaaaaaagttaaattatcagatgaaagaaaagagaaagaagattaaaaaactgcctatcaggaaggaaatgttccattcccgatgggcagttttatcatagcagaagcgatcgcttctgctgataaggtttgtttaaattagccgaagtatctcttaagcagtccttcgaaagcttttccgtgtctagcttcgtcgcgagccatctcgtgtactgtgtcgtggattgcatccaggttagcagctttagctctctttgcaagatcgaatttaccttctgtagcaccgtgctcagcatcaactctcatctcaaggtttttctttgtgctgtctgttacaacttcaccaagaagttcagcgaattttgcagcatgctctgcttcttcgtaagcagctttttcccagtaaagtccgatttccggatatccttctctgtgagcaactcttgccattgcaaggtacattcctacttcagagcattctcctgcgaagtttgcacgaagatctgcaagaatatcttcgctgacaccctgcgcaacacctacaacgtgctcagcagcccatactttgtctccttcctgctctttaaacttggaagctggtgcgtgacagactggacattcagccggtgcagcatctccttcgtaaacataaccacatactgtacatacaaattttttcataatgataatctcctttttcttattaaattttttataacttaagacttcctaatgcagtcactgcattccccataaaacaaagtggaacttgaagtaatgattccatcgaaattctccccggccagccggttcacttcttcaatactcttcatatccagttccagatccagtaaccgtccacagcttgtacagagaaaatgattgtggggaataacattcccgtcaaatcgatctccgccgtcaggtgtagggatcttgatcgcttcgccgatatctgtcagcagattcaaattccggtaaacagtaccaagactgatattaggaaaatcctctttgacatgcagataaacagtgtcggcagtgggatgctcttttgttgaagcgagataatgcttgatagcttctcgttgtcggctatatttaattgcagccatagattcacctctttctaaaattgaatcaataacgataacgattactgtaattagaatataacttatatttttaaaattgtcaagagaaaaaaataagtttttttatttctcctgacaaaatattacaaaataattaacaaaaaggacgttaagattaataaaaaaggggaataattacaaatggtggagggtgataattatgaaaaaactattaaaacggttgacacatctatggttgattgataaaattacggcgtaacaaaaattaacaattatgtaacaattaaaacttcccacaaaagataaggctggaaataaaggaggttttatatgagtaacatgcggatgaagcataagcttatcatgtcaatgatggcagggatgatcataattccggggagtgtagtcagaacacaggcggcagaaactgatgacagtgagaagagtctggttccggttacaggaattgaaaacattttggaagcatcatatcagacagaaataaagaacaatatcaatctgtatctggtgccgacagaagagggagagtatttgaatatagcgttttctaatacgggggattatacctatattagaagcgaagcagatgaaaacagtgaatgggttggaaaattatattctgattcagcggcagttgtgttggaatatctggatggatggacaaagatccggtcgggaaatgcagaggggtatgttccgacggaaacattgttcacaggggaggaagcccgttcgagatcagatgagtatacaaatgagaatgttacagtcacagcagattgcctgaatgtcagagagggacatgggacggatactaccgtattaacccagatcgatcagggagaagaatatcttgtgacagcagatcctgtagatggctggtatccgatacaggtcggtgaagttaatggctgggtgtgcggtgattatgttacagaggaaagttcttattcttacggggagacaaaagaggaagaacaaaaacgaatggaagcagaagaagctgcggttgcgaaggcggaagcagaagcccaggctgcagaagcagcggctcagtcagttgcgtcagggcaggaagttattgattatgcctgtcagtttattgggaatccatatgtgtggggcggtacaagtttaacagatggggcggattgttcaggatttgtccagtctgtgtatgcacattttggtataagtcttccacgaacttcttatgaacagcgaagtgcgggatatgaagtgagttatgaagacgcacagccgggggatcttatcttatatgaaggacatgttggtctatatataggaaatgatcagattgtaaatgcaatgaacgaagatcagggaattggtatcagcagtgcaacgtatacaaatatcgtggctgtcagacggatttattaaagaataatagaaagaaaacaatgcattgtccagaatatgtatgggaaatgaaagatttgactgtaaattctaaaatcggtattttccaagaaaaatatacggatagtcaaaatgcacaaaatatgacaagaatattcaaaatagcaaaaaaatgaaaaaaagtagttttcaacttatcaacattgaaaaatcgaaaaaatgaggaaaaataaaagatttcctgaaagttatccacattatcaacaaagaaagatgtgaatagtgtggataacttttggaaataaaaagaacattcgttttggttattgttatgaaaatgacgatttgtcgaaaaaaaaaagaaaactgattgacttttgagtagtgtgataaacggaaaaagttgtatgaaaatttcagaaaatttcatggaatgataatgaaaataaggttgctaaatcatagatcagggattataataaaaattactgttcaagggtgacagaaattaattgaaaatagaaatatgtaaggaggaaacagtgatggcaatttctaaaagcacaacaattggcgaacttctggtaacatttccagagtcagctccgattttgatggagattggtatgcattgtcttggatgcccgtcatctcagatggagtctcttgaggaagcagctatggttcatggaattgatgcagatctgcttgtagagaagatcaatgcagcaatggcagccgctggtaaataattaagagaaaagatatacaagatagctgttgtgctctcaaaaaagagagtatggcagcttttttatatattaggaaagtgctttcctaatatataaaaaacgctccgctaaggatgcgcactgcggcgtacaatgttgcatgacatacttctactgcgcacctctgcaatcctgccggaggctatatcagcataaacaattatttacagtttttctataatctgaccatttctgtacgacgccagcagccattcaagatctttaatctgttcttttaatttccttccagcgtcggtgtcaccaacaagacgtctctcgttcactctggtcactactactgtctctgaatgaatgtcattttctttcttaattgctgcttctgtagactcaaatggttcatgtgctaccaaaagtaatccatacgaattataaaccagcgtgtatcctgcaattccggtttctttctgatatgctcttgaaaatcccccatcaataaccattactttaccattacacttgatcggactctcgccatcttttctcttaaccggcacatgaccatttacaatgtgtgtatcctcttttggatccaatccaaattctatcatgatattatccacaactgtctcattttcaagcagagcatagtatggatttttcttttctgtatgtgtttccttctctgcaaggaaatatctttcaaaggtcgccatcttgttctttccaaataacggtgaatccggatgtaaccagatataccacattatatcttttccatcttcccgctccttcggatccaatgcaaaaaatccttttctcacataactttccaacacatcatacaaggcctttccacgatatttctttccgaaaatttctacttctttcaggttccccttcgcatctaacggtacacatccatgatacaacagattattgttatataccttatacaaaccacctttcgcaagaaggaaacgcatatgttcctgcaatttttcacatcccacaaaagcatgcaccagacgatccataatttcttcctcttcagaagtcagtttatatgggttctttggatctattgtcgggaaatttgtatccaggagcttatattcttttccttccagattaatcgtacctttctgataatcaatcttatgcagtaacgcacgattctccagatggaatcctttctgcctctctataatctggccttctactttaaactgaataattgagatcgctttatgtattctcagattcatctgcatctcatcagattccggtctgtcagtacctttcaatttaaaacaggtacatggatcatccttgtacatcctcatagcaaatgtagccagtggaagcaaattgataccataaccatcttctataatatccaggtttccatatctggcgcagatacggatcacatttgcaatgcagcccaactgtccggccgctgcccccatccatacaacatcatggtttccccactggatatcaacagaatgatatttcagcagcttatccataataagatgcggtcccggtcctctgtcataaatatcaccgacaatatgcagatgatccacaaccagacgctggatcagttctgaaattgctgcaataaattcttctgcccgtccgatcctgatgattgtagaaataatttcattataataggactctttgtcactgacttccgctttctcggtaatcaattcttcgatcacataagagaaatccttcggcagtgattttctcactttagatcttgtatatttacttgctgcacgcttacttacttctatcagacgatacagattcactcgataccagtcatccatgttcgactccgtccgcttcacctgttccatcttcgctttcggatagtaaatcaatgttgccagtgcttttttgtcctttacactcattgtattaccaaaaacatcttcaatcttgcttctcacggcaccagatccattcctcagaacatgagaaaaagcttcatcttctccatgtacatccgtcagaaaatgttctgtccccttcggaaggttcaaaattgcctgcagattaataatctccgtagatgcagctgcaattgtcggataaagatccgataacctgtctaaataacggttttccatattttccatatacaatctcctccagacccgaaatcttccccttaccgggatctatttaccggatcttgttcccgccggtttaccggctattattcatccagtactaaaactgaataacatcccccatgtcatacatgccggctggctgtcccgcaaggaactttcctgcctcaactgcacctttggcaaatacgcttcttgaatatgcagtatgtttaaattcaatcacttcatctgttcctgcaaaaatcacctcatgttctcctacgattgttcctgcacgaactgctgaaataccaatttcctttgcgtctcgcttctttctcacctgacttctgtcatacacatactcgtattcatttcccattgcttcattaatagagtctgccaatgcaagtgccgttccgcttggcgcatccagcttctgattatggtgtttctcaacaagttcaatatcatagcctgccggtgcaagtactttggcagcatctttcaaaagtttcagtaacaggttgattcccattgacatattcgcagacttaagaactgcaatcttctcagaacactcatctaccttctttaactgttcatctgaaagccctgttgtacaaagaacaaccggaagactcttcttcacacagtaatctaacaattcatccactgctcccgcattggaaaaatcaatcactacatctacatccacatcacactgtgtgatctcctcaaataccggataatcatttggaattcctgtgaacttgtcgacacctgccgcaatcactgcatcttcttcattcttcacaatttctgtgatcatgcgtcccatttttccgttgcatccgtgcattaatatcttaaccatctgtatcttcctcctgtatgaaacctcaagtattccatgatttttcagaactactgtctatcagcattacctgttttttctttcattacactcttattttccgaaatatcatataaaaaagaatatcacatttgagttgttatctcaatatatgatatccttttcacaaagttttaaataatgaaacaatccacccttagaattcttccacacactccagtttactgacggagacctcatatgcgattcttgtctctgtttgtgtctctgacaatttcttcacatactctctgctttggattcttccgaatattctgacatgttcacctacatcaaagtttgaagcatatcttgcatttctcccccagcagatacatggaatataatcagattttccatacggtctgttcactgccagcagaatatctgcaatttctcttccaagaggtgtttttctgtagaccggacgcttacacatatatccttcgagaagtatatgatttgttcttgctccatccggttcttcttcgataaattctatttctctcgcaaacacagaaagaaccagtctgttttttgtctcctcatgacgattataggatctgaactgaccagacaccattaaatattctccacggcaatcctgtgttacgtcaatgagacgttctgatatcatgaccggaatccggtcacaagagttacttaaccgctttacaagaagttctaccatatagaaaccttctccaaagacctcatggctgtatgtaaactctgataccacctctccaataactgtcacctggttgttttcaataatcttatctgacataatttataattctcccttcctctggctggtattttaagtcattacctaatgtatgtcttattgtaatgaaatagaactattttttacagaaaaaacattcgacctttttcgtacttaaaatcgaattcaaaatctccccccctcttcttcagcacaaaatgctcctgttgactttaaattgtatttgaaaagatacataaaacatcagattttaactttttcttgtaaattttattttttgtgataaaataatgaagttatgttacagataaatattttttgtataataaggaagagtgtttagattatgaaaacaaaacgtgaagatgtgagaaatgttgcaattatcgcccatgttgaccatggtaagacaactctggttgacgagcttttaaaacagagcggtgtattccgtgagaatcaggaagtagaagaacgtgtcatggactctaatgacattgagcgtgaacgtggaattacaatcctttctaagaatactgccgttcattataatggtgttaagatcaatatcattgacacacctggacacgctgacttcggtggagaagtagaacgtgttcttaagatggtaaatggtgttgtacttgttgttgatgcatttgaaggtgctatgcctcagacaaaattcgttctgagaaaagcacttgaactggaacttcctgttatcgtatgcatcaataagattgaccgtccggaagcaagaccggatgacgtaattgatgaggttcttgaactctttatcgatctcggtgcttcagatgagcagcttgagtgtccttttgtatatgcttctgcaaaagctggtgttgctgtccttgatctctctgacgagaaacaggatatgaaaccactgttcgagacaatccttgattacattcctgctccggaaggtgatccggaagctccgacccagatgctgatcagcacgatcgactacaatgaatatgttggtcgtatcggagttggtaaagtagaaaacggtacaatttccgtgaaccaggatatggttgttgtaaaccatcatgatcctgacaaacagcagcgtgtaaaaattggtaaactctatgaattcgacggactgaaccgtgtagaagtaaaagaagcttctttcgggtctattgttgcagtatcaggtatcacagatatttccatcggagatactctctgctctcctgagaatccggaagccattccgttccagaagatttctgagccaacaatttccatgcagtttatcgtaaacgacagcccgtttgcaggacaggaaggtaaattcgttacatcccgtcatctgcgtgaccgtcttttccgtgagctgaacacagatgtcagccttcgagtagaagagacagaaaatgcagacagcttcaaagtatccggtcgtggtgagcttcacctttctgttcttattgaaaacatgcgtcgtgaaggatacgagtttgcagtaagtaaagctgaagttctgtatcacacagatgaaaatggcaaaaaacttgagcctatggaacttgcttatattgatgttcctgatgagttcactggaattgttattgaaaaactcggtcagagaaaaggtgaactccgcaatatgactccgtcaaacggtggatatactcgtctcgaattccttatcccggcacgtggactgatcggataccgtggtgagttcatgacagatacaaaaggaaatggtatcatcaacacaagctttgaaggatatgcaccatacaaaggagatatccagtatcgtaaacagggatctctgatcgcatttgagactggtgaatccgtaacttatggtctgtacagtgcccaggagcgtggtactctcttcatcggagccggtgagaaagtatattccggtatggttatcggacagaatggtaaagctgaagatatcgaactgaacgtatgtaagacaaaacatcttactaacacacgttcttccagcgcagatgaagcacttcgtctgacacctccgcgtgttctcagcctcgaacaggcacttgactttattgataccgatgaacttcttgaagtaacaccggaaaatctgcgtatccgcaagaagattctggattccagaatgagaaaacgcagcacgatcaataaataatattcgtgtttgaaacttatgctcgccgatcaaaatagtattcattaattatctgataattttaaaatcgtcctaaagttttgaaaattttcataattttaggacgatttattgtatacagaaaatctttttcatgttataatgtaaccatgatacagaagtaatctaatcattcttctgtataatttgaacaaaggagttgagcagcatgaaatttattatcagcggaaaaaacatcgaggtaacaccgggattaaaggatgctatcgaacagaaattaggaaaacttgaaaggtacttcactcctgaaacagaaatcaatgtaacgctcagtgtagaaaaaggacgtcagaaaattgaggtaacaatcccagtcaaaggaaatattatccgttctgagcagacaagcaatgatatgtatgtttccattgatcttgtagaagagatcatcgaacgccagcttcgcaaatataagaacaaactggttgctcgtaatcagggacatcctacatcatatgctccatcaggtaacagcttcagaaaagaattctttgattcagaagaagagacaacagaagacgatgaagtccgtatcgttcgtacaaagaagtttggtattaaaccaatgtttccagaagatgcctgtgttcagatggaacttctcggacataacttcttcgtattctccaacgccgagactgatgaagtcaatgtagtatacaaaagaaaagatggttcatttggtctgatcgaaccagaattctcatagaacatatctattcagtataagtagatttattgaatgttatatgacacacacttaaaggaaaggatcccctgccagatattccggcagggggtcctttctatctcacaaaacaacatcttctatgagaattattcttcatcaaaaatcttaattccatcttctgtccttgcaaaccaacaggttgtctcttcatccagaaccacctgaccgtttgtcccttccatcagttcagcccgcaggctgcccatctcatctgtcggaacaaacactgtcatttcaaccttatctgtgtaaacaggttctaattgatccagatttcgatttgcaatcagatattgaatttttcccaaatccgtataattcgtctcaattccgagtttcaccccatgaatccttgcaatgctctcactgttcttcaatccttcgatcgttgctgctgtataagccctgaccagtccacctgttccaagaagcgtacctccaaaatatcttgtaacaattacaagtacattcgtcagttctctcccacggatcacctccaaaatcggttttcctgctgttcctgccggttctccatcatcactcattctttctgccgccggattccttcctataatgtaagcccagcaatgatgtctcgcatcccagtactgctttcttgtctgctctaaaatctccatggcttcttcttctgatgtgaccggatgcacttctgcaataaatctggatttcttttcaacaatttctccgtctccgcccttatatattgtatggtagatttccatttttcagtctcccattccttttttatttttgctatatttgaaaatatttctttatctaatataccatgcttttctatataaaactgtattttttcttaagattttcaggaaaatttgaacttttcaaatttacctttatttacatcggtaaatttgatataatcatagaagtcaataaaggaggatattatacgtgaattacggaaaatcgaatctttctagaagaaaaaagcgaatttcttctaaaaagaaaaggaaaaagaagcgagtcggcgtacgttttttcaaagccctcattatttgttttctgcttttgatcgtcattggggcagccggagttggcatatatgtaaaaaaagtgattgacaatacaccggaagtcacagcaaaggacattatgccacagggctatacaacgaatattgtcgattccaatggaactttgcttgagcaactcaaagactctgattctaaccgtgtttacaagaaatatgacgagatttcaccatacatgggaaaagcttttgttgcgatcgaggacgaacgtttcttcaagcataatggtattgatatccagggaattatccgtgccggtgtcaatggtgttgcacatggcttccatttcacagaaggagccagcacattaacccagcagctgatcaaaaataatgtattccctaatttcatcaatgagagtaagtatcagcgaattgaacgtaaaatccaggaacagtaccttgcactaaagattgaaaaagagatgagtaaggaagagattcttgaagcatacatgaacacaatcaatttaggtcagggatgcctcggagttcagacagccgcacagcgttactttaataaagatgcaaaagacctgactctttctgaatgtgcagttatcgcagcgatcactcagagtccgtcgaatctgaatcctgttagcaacccggagaataatgcaaaaagacgggaaaaagtactgaaaaacatgaaggaacaaggctctatcacaaaggatgaatacgatgaggctatggctgataatgtatatgaccgcatttccgaaacagcgtcaaatacaactgcatccaaaccttacacttatttcatcgatgctgtcataaatcaggttgtagatgatcttgtaactgagaagagttatacagaaacacaggcatataatctgctctatagcggcggccttacgatcaacgttacacaggatgctgatattcaggccatctgtgatgacgaagttgctaatgtaggggattatctcaatggtgatacagaatatgggcttgattacgcacttactatccacagggcagatggttcttctgagaactacagcaaagaacaacttgcttcttatattcagactgcatggggatatgacactcctcttctctacggttctgaagaagctgcacaagaagcagttgatgcatttaaatcaacgctcaatatcaatgaggctgacggagacactgttgatgagagaattgagctctcacctcagccgcaggcttctgttgttgtgatggatcagtataccggacaggtgaaagccatcgtcggtggacgcggcgaaaagaaatccagtctttctctaaaccgtgccacagattctgcaagacagcctggatcctgtttcaagattcttgctgcttatgcaccggcacttaacgaaggaaagatcactcttgcaacaacaattgatgatgaagaatatgaatataaaaacggacagtccgtaaacaactgggataaaaaatatatcggtccgacacgtgtccgttatggaatcgaacattctatgaacgtccttgccgttaagacattaactgactatgttggtgaaacggaaagttatgattatcttcttgattttggatttacaacactgactgaagatgataaatattcacaggcgaaagctcttggtggtatcacaaacggtgtatataatatcgagatgacagctgcctatgcagcaattgccaatggtggaacttacatgaaaccgattctttacacacaggttctggatcatgaaggaaatgttcttctcgataacacaacccctgagacacatgaagtcttaaaagactccactgcttatcttctgacaagtgcaatggaagacgttgtcaacggtgccggtggaaccggtggttctgcaagactgagcaacatgcctgttgccgctaaaacaggtaccagccaggaaagccgcgacttgtggatttcagcatttacgccttattatacagcgtctgtatggggtggatatgatgagcataagacaatggatcgattaagccagaactggcatcagaaactttggagaaatatcatggaacgtatccaggatacaaaaggccttgagtacaaggactttgaaattccatcctctgtcgaagaaaagacggtttgtactaaaacaggactccttgccacaagcagttgtcctgccattacagagtatttttcaaaagacaatgttccgactaagagctgtagtggtcactattttgcgccatcagaatactatgagaaagatgacaccgagagttctgatgaaaccacacctgctacaggtaccgattcttctggagcaacatcatcaccggattcttcctctggtggaacaacaaccgaacccgctgccggcggagactctggtggaacaaccggaacaactacaggtgatactgatacttccggcagcactactggtagcgacactgaaagtggaagtaccactcaataagtaaattatgcgccgcaaggtacacctaaaaaggagaggctatacaaaacgcctctccttttcgcatacttatataactgattgctcttgtcatcctatccgtatctctctgatacaatattctgctatcttgttttacggttaatatatcttgctttatatttagaatatacaatcgtctgatctttatataaactataatatccggaaaccgcatagctgattgatatcgcgatcagataatatgctgctcctgaaaatccaaacagttcgaatgaaatcagcattgccgtaatcggacagttcgtcactccgcagaaaagtgcaaccatgctggctgccgctgctaattccggtgaaaatccaagtattccaccggcaacacatccaaatgttgcacctatactgaatgccggtacaatctcaccaccacgatatcctgcccgcatcgtaagtgctgtaagtaacattttccataaaaaatcaagtggtcttgcttcacccttttcaatagctcttgcgatcaatccactacctgctcccatataatcttttgtattcagacatattgtgatcagaatgatcactcctgctgcaacaacaattctaatatacggatttttcagatactttgcatacaactgccctactgtttttagcaagatacagaatagaatacttaaaatcccacaccccactgcgatcagtgccatcttaagtcctgactccacagtaagtcccgggatagaatgtaccggaaatgtctccggatcaatccccattcctgttgcaaactctgctgcaatgatagctgcaatcacacacggaagaagtgctgcgtaatacattacccccacgctcacaacttccattgcaaaaactgctgctgccatcggtgttccaaacacggctgcaaacgctgcactcattccgcacatgatcatcacatggtgatcaaattcatctaaatgagccagttttccaagccaatttccaatacttccaccaaactgtatcgacgcaccttctcttcctgccgagccaccggtaagatgcgtcaataatgttgacacaaaaatcaatggtgctgacagaaacggaacatcatcctttgatttaattgtagcaagtacctgattcgttcctccgtcctgccttcctatcttctcatacataaatacaatcagaactcctgcaaccggcaaaagcataaaaatccaattatgtgtatccctgtattccgttgctgccttgatacatcctgcaaatattgcactcgcaccgcctacaaccagacctgtcaaaacagaaagccccatccatttcagaaaattttccgtgttctgtcggatcctttcataataatactttattactatttttgtatcatgagaatgttttcgttttcccatctccgcattttctgtattttctttttcttccatttgcatttcccctcttgtatttctcttttatttcgaactctgattactttcttatgttcagatagaatcccttgccttatttattataaaatgattttcctcaccatgcaacacagaaaaaaggatggttttctcacattcgaacgtttcttgttcgttgtgtcaaaccatcctctaaatcaattattttttacctctgccttatcatttcattctttttatactgcttcttcttttgtattcacactcttggattctctgtcctctttgaatttatcataatatgcaaacattcctgcaaggagtgttcctgaaatagaatgccatgtacaagatactgcacagatgattgctgactccggtgtggatgcaaactgtgctgttgttgttgcaaggtttgttgcaagtcctgcattctgcatacctacctcgatcgagattgttctcttcttcgctgtattcattcctgtgagtttaccagctccgtatccaagcagatatccaagtccattatgaagaaatactgctacgaagattacaacaccggactcaaagaatttgcttccctgtgaagatactacaccgccgacaacgcatgcaagtccaagtactgcaataccaggcataattttctgaagttctttgaatgttttattttttcctaacagatagttaagtaagaatcctactgctaccgggaaaataactgtttcaataatggatacaaacataggtagtcctttgattgaaatatgtgtaccacttgccagcagtgaaaccataagtggtgtcataactggtgagagcagtgttgaaactgttgtcattcctacggaaaatgctacgtctcctccacacagataagacataatattggatgacacaccaccaggacaacatccgacaaggatcagtcccaaagcgattccatccggaagattcaatgcctttgtcagtgcaaatgcaaggaatggcataatcagatactgagcgattgctccgatgcagatatcaaacggtctctgcgcaagaatcttaaaatcctctgttgttaatgtcagacccatactaaacatgatcactccgataataatagactgacaggtaaatttattagataccggatcgacaaacaaagcgttgttaacccatcccatcattgtcgggacaaagaatgtcactactgcaatggcaataacaaccactgaagtataatctgataaaaatttgctgactttttgtaatgctttcattacaatacctccttaggattcttgttcacctaaaatttgtattcttcttgagatatattcaaagaaaaaagtccctttccagaactcaatctgaaaagggacgaatataatccgcgttaccaccctaattccgcaaaaattaattctgcgacacttcacataccaacatatgctatccatataacggtggatcccggcgaggtttacttgcaacatgttcatctgctttcagcccgcttcttagagaggatatccttacccggttattgtctgttcacaccagccacagactctctgaaaataatgacggatacggttttgttctcatcaacgaattttggtgaactgtattttgtttactctgacattatagtcctctgaaatcagaaatcaagagtctattttaatctttttcttgatttattttaatctttttgtcgtaaaattttattttcaaggcttaaattcatctaaaaaaataaaagaatcattggaaaaaaattattgtttttcctgttgtttccccgcacttttcatgctacactgtatataagaatcatcggattttaaccagaaaacagtaacaacagatacagatgtttggggcatccaaaaggtttattaatgcacaatacaatacgttatttttcattgctttcttttggaagtgatgttttttttgtaattttatctgttttctttcattattttatctggtaaaggggtatttgggaatgaataatgaaataacgaaaagacgaaagcgaacaattgaaatgactcagggatctctttggaaaaacatgtttttcttcagtgttcctcttatattttcccagattttggaagtgatgttcaacttaagtgatgtcgctgttgtcggacattttgcagattacaaagcacttggttctgtcggctcgacaactacacttgtcacactgttcacgggacttctgatcgggctcggaagtggtgtcaacgtccaggttgccaataaactcggtgccggtgataagaaagctacaaaagaaaccattcactctgcactcattatctgtgcagcggcaggtatttttgtctgtctgatctgtctgctttttgcaggaccaatgctttccatgatgaatacaaagcccgaactgctcgatcaggctgttctctacatgaaagtttttgcacttggcatgcctgccacggcagtttataatttcggcaacggtgtcttaagcgcccgtggggatacaaagcgtccgatgtattaccttgcatttgccggaatacttaatgtcctattgaatctgatctttgttatcgtattccatatggctgctgtcggagttgctactgccagtgcaatcgcacagtacgtttcaggaggattgatcctggtccatctgatgcgacgcgatgatgaatgtaaagttcgtctgcgcaatctgcgttatcataacatttatggaaaaggagttctttatctcggtgttccatccggtcttcagaatgcgattttcgcgattgcaaacctttttgttcaatccggagtcaactcctttgatgcgatcatggtttccggaaatgctgccgctgcgaatgcagacaatctgatttacaatgttatgtttgccttctatgtggcctgttccagtttcatgagccagaactggggagccgggaataaagaaagaatgaaaaaatgctatctcgtaacacttacttattctttcagtgcaggcctgcttctcggaggagcactcttcttctttgggcgcccattcttgtctctgtttgccacagaaccagccgttatcgcagctggtatgcatagaattaggattatgggattctcctatgcattcagcgcctttatggactgtgcaattgcctcttccagaggaatcggcaagagcattgctcctacatttattgttatcatgggatcctgtgtatttcgtattatatggatctatacggtatttgcttacttccatacaattccatctctgtatctgctgtacatcttctcctggggactcacagcgattgcagaaaccatatactttaaagttagtttcaaaaaggtgcttgcataatagatttcccaaagaaaaaagagggatttcacagatatccaacatctgtaaaaatctcctcttttttctttctactatttattctgcacttgttatacttttatcaatcctcaagtaccagcttagctgctccgcagattcctgcatcatttccaagagtagcaagcttaaatttcacattcttatttgcaaagaacgctttttccataaatggtttttcgataaatgaaagcagaacttctcctgctttggacactccaccaccaattacaaatacagccggatccagtactgctgccatatctgccattgcatgtcctaagtaatttcccatctctgtcgcaacttcaatcgcaacttcgtctccttctttgactgcatcaaaaacagcttttgctgaaagatcttcttttgtcaggattgttgcacgtgtctcatgctccatcttctttcttgcaagacgagagatacctgttgctgatgcatactgctccagacatccgtgtccgccacatccgcaagtatctgtctcttccagattcacacacatatgaccaatctctccacctgctccgttctctcccgtcaagatctttccattgatgataatgccaccaccaacacctgttccaagtgtgaccatgatcatattacggtaaccgacaccgccgcctttccacatctcgccaagtgctgcgacattcgcatcatttccaaactctgctgtcaatcctgtcagttcttccagctctttctttgcattcttatatttccagccaagattcgcagaaccgttgacaattccatctacagtaacaggagccggcacaccgacaccgattccaagaacctgttctttctcaatgccgtgctgctctaacttaccattgattgcttctgcaacatccggaagaatcgccgcaccttcattctcagttcttgtcacgatctcccatttctctacaatagcacctgcctcactgaacagaccaagtttaaccgttgttcccccgatatcaacaccaaaacaatatttcataaatctatctccgtttctttttatatttcacatgagaatgcggtactctgtaacatttgtaccgcatcctctgtttctcttttgttttattttcttctctttgccagattctcctgcacacgtttgtacaattcctgtgcagcgttgtatcccatctgcttctgtctgtggttaactgcagcagattctacgatgatcgccagattacgtcccggacggatcggaatattatggcagacaactcggtttccaaggaattctgtatattcctcctccagaccaagtctgtcgtattctttctctctgctccagtcttccagagtaatgaccagatcgatattctgtgtttctcttacgctctgtacaccgaacatagactttacatccacgattccgataccacgaagctcgataaaatgtcttgtgatatccggtgcagaaccaaccagtgtatcgtcactgactttgcggatctcaaccacatcatccgtcacaagacgatgtccacgcttgatcagttcaagagctgcttcgctcttaccgattccactttctcccatgatcagaactccgacaccatatacgtcaacaagcactccatgaatggaaatgcacggagcaagttttacattcagccaacggatcagttctcccataaaggaggatgtcttcttacatgtaccgaataccggaatatcatttttctgagcgatctcgatgaagctttcatccggctgaagttcattgctgaaaataatacatggtactttatgttccagaagtttctgataaatctcaactcttttctcttctgccaaagtctccagataggcacactctacattccctataatctgtacacgattcagatcaaaatgatcgaaaaatcctgccagctgaagtgccggtctgttcacatccggaacaagaacttcacgttctgtgatatctacttccggagtgagatttttcagattcatcttttcaacgatatcggttaatttcacaccactcatcttgtaatctccttttcctgtatctcttttcgtttcagacatgctgccttgataagctcaagagatatatgatatttactgctcgcataaatccaacatttccctacatgtcccattgcctgtacataagtatatcatgattttcttttcgataaaacccttaatcatgaaagaattgataaaccgattctgctgccttctcattcattgacggaagctgcgccagttcttctactgttgcgctccggattgcatccaggctcagataatgccgcatcaatgcctttcttctggccggaccgattccttcaatatcatccaaaacggaatgtacctgccctttgccacgcagctgcctgtggaactcgattgcaaaccgatgggcttcatcctgaattcttgtgatcagtttaaatgcttctgaattgcggtcaatcgggatttccacattattataatataatcctcttgttctatgattgtcatctttcaccataccacagaccggaatattcagcttcaactcatcaagcacctgcaatgcaatatttacctgtccacggcctccatccatcagaattaaatccggaaatgttgtaaatttcccagcttccgcattctcctcacgttcttttaatccatgtgtaaaacgacgcgtaagaacttctcgcatgctcgcataatcatccggtcctttcacactcttgattttgaacttcctgtaatcattccgctttggttttcctttctcatagacaaccatagagcctaccgattcgaaaccatttgtattagaaatatcatatgcttccatacggacgatctgttccagtcccaataaagatgctatctccttcactgcaccgatcgtgcgtccttcttccctctttagccgctctttatctttagacagaaccatcctcgcattctcttccgccagttctaccagcttttcttttgtacctttcttcggcacacggatcgttactttctgccccttcttcgcgctcagccaggattcaagaagttcctgctcttcgatttcttccggcagcatcaattcacccggaagaaaaggggttcctgcataatactgtttgataaaactgttaagaatttccgattttttatcctcttcgctgattctcagatagaaatggtctctcccgatcaatcttccgccacggataaaaaagacctgtacaactgcatcttcgtcctggcatgcaactgccatgacatctctgtcttccccactggaatctgtaatcttctgtttctgagccaccttttttacactatttaacaactctctatattcgattgctttctcaaattccagtgcctccgaagcggccatcatcttatcttccagatcttttaaaatcatatcaaaatttccatttagaaaacggatcacctcatcaatggatttccggtattcttcctgggaaatgtatccctggcacggtgcctcacactgcttgatatgataattcagacacggacgctctttcccaatgtcttttggaagtgaacgattacagcttcttatatgatacagcttatggatcagatcaattgtgtcacgcaccgcctgtgagcttgtatagggaccgaaataacgtgccttatcttttttcatctgacgtgccagcataacacgagggtattcctctcctgttgtcaccttgatgaatggataggccttgtcatccatcagcatcgtattatatttgggccgatgttccttgatcagattacattccagaacaagtgcttccagttccgaatctgtcacaatatattcaaagcggcggatatgtgttaccatctgttcgatcttaacccctttattcctgctgctttgaaaatactgccgcacacggtttttcaggctgattgcttttccgacatagataatctgatccgtctcatcatgcatcagatagactcccggccttcccggaagctttttcaattcttcctgtatattaaaattataattttccatagatcctatttcttgcctctgctacagaccagctatgttcttctgcaattttggaaacatcatcatactcgagtttttctttcaccactccatatccggatgctctcttcacatgaacggttccatattctgtctgcacttcgtctattttccgcttaagtccatatcttctacaaaaatactctctgacaccaagtgttgaagtgtgtttgaatatcagctgtagaaaatactctttctgctctgcccggcacatacatgtaagcagaatccccggccggtttttcttcatctgaatggaggatgtgtaaacatccaatgcgccttctttgatcagaagctctgtcgcatacccgatttcctccgaagtcatatcatccagattacagcacagttccaaaatttcttcttctaccttgtcttgcgtttctccaagaatcgcacgcacacagttcagtctttcatactctctttttccaaaaccataaccgatttcttccatctgcagaaccggcatctgttcatactttttaacaaaatgcttcagaagtgcggctcctgtcggtgtacagaattctccctccaggtctcctgcatacattggaatttctttcatcagatacgctgttgccggagccggcaccggaaggattccatgtgcacatttcacctgaccatatccgacacgaaccggtgatgcaagaatctgatccacctgaagttcattcagcaaataacagacagccacaacatcagccactgcatccatcgtcccaacctcatggaaatggatttcatccatgcgctgaccatgcgccttcccttccgcctttgcaatcaatttatagaccgcaactgcgtcctgttttacctgatcttcaatttctaaccgattgatcagacgaacaatctgagacatcgaatgatgtccgtgttcctgtgtatgcttctctttttcttctgatttatgtcctacatgctcttctgtctgcgtatgaggattctcttcttcctgtcctttcacaaacacgcggacctgatatcctctgattccacctcttgtacacgccaccaactgatattttacccctgggattttcagatcattcaactttttcacctgttttacaggttctgaaaacaactgcaataatgaagccgtcagcatatcccctgctgctcccatcccacagtccaaatataatgtcctcattccttcgttctcctctctatgtgattgatccggcttgcaagaaatcccgcgccaaatccattatctatattcacaacactcactccacttgcacaagaattcaacatagaaagaagcgctgatacgccaccgaaagatgctccatatccaacacttgtcggaactgcgatcaccgggcaatccaccagtcctccaatcacactggcgagtgctccttccattccggctacagcaataatgacacgagcttccattaattcgtcgagatgtccaagcagacgatgtactcctgcgacgcctacatcatataaacggatcacttcatttccaagtgtctctgctgttcttgcagcctcttctgcaacagggatatcgcttgtcccgcctgttgccacaactatttttccgtctccatcctttattggagcttcgcctataaacccaatccggctgacttcatcatattgaagttccaggcgttctcccacgtaaattgctgactccttattcattcttgtgatcaggactgctttctgtcccttttccttcattgcttctgcaatccggaaaatctgttccggtgtctttccttctccataaatcacttctgccacaccctggcgcatggctctgtgatggtcaatcttggcaaaaccaagatcttcaaaaggctcttcttttaacttcaaagctgcctgttctacatccattgttccggatgctacctgtcttaaaagatctatcatttccttttgttccatctttttcgcctcattctaattcttcttatccagggtttcattcatacttcccattctgtaccctgttagatccattgtaacataagtgaatccgaactgcttaaattgttttacaatatcctcacggacttcttcctgaagcaacttcaaaaactcttccggcagtacttcgatcctcgccatccttccatgcatacggacacgaaattgccggaagccatgttcaagcaataactgttctgcgttttccaccatgatcaacttctctttgctgattatttctccgtatacaaatcttgaagccagacaggcaaaagatggcttttcccaggttgaaagtcccatcttttttgacaattcacgaatctccgcttttgtaagtcctgcttcgcgcagtggactttttactcctaattccgccacagcctgaagccccggtctgtagtcgccaagatcatccatattagaaccttctgcaacataagcaatttcatttttctctgcaattgctccaatcttttcaaacagtgcatgcttgcataaataacatctgttcggcgggttctgagaaaatccttcaatcttcatttcatccacctgacagaccttatgacggatatcttcttttttgcaaaatgcaattgcctcatttagttctctctttggaaaggaaccggattgtactgtgaccgccatcacattatctcccaatatctcatgtgccacctttaataaaaatgtagaatcaactccactggaaaatgcaatcgcaacactgtccagttcttttatgtactcttttaaatgtgctaatttattatgtaattcatcctgcatctttttcctcctgtcttgttactgttcacacgatgtgcgaccagcaacgcatctcgccattttaaatcgccccggacaacttgattaaaagtcaagtgctctaccacctgagctacacgcccttaaacactcgcagaagtaataatatcataagtcttatataaatgcaagcacttttttcagattttaattttaaaatgcatctcgccgtatcgctacaggcgattctaaatggcgagacacaatcttattttttcaaatcatagaactttccgctcagatttttcacctttacataagaaacatgatctataaacattctcgaagtaaataccgttttcccatgatcgcagaaaatctcgatactggaatgatctaccataacccggacagtctgtttcttctctaactgttttgcataacggatcgttccaaacttctccgcatacacttctgtcataccacttctgtccagacaatattcttccccatctgcgcttaaaatcaaacagttaccatctttatttcctatctctatagaaaacgcaccttctgtatttccttcaagctcaaaagaacattcttcaacctttatatgctctgcaatgcttctttcatttgcacgaagctgctttagctcttctaccggctgctggatcaacctatctttctctatccaaatttctcttggaagtgttaacatgtgagcccaattattcttatcagttggatattcgctcttagaatttccaagccatccaaataaaattcttcgatgtttttcatcctcatacgattgaggcgcatagaaatcaaatcccttatcaagttcatacatttctgaaaattgaaattcttttcgttctgtatccaatggttttcctatcatgtaaactacggagaacacatttttataatcatatttattctcacttgaaattcccattggagaacagaacagcactcctttttgattctcttcataataatttggacattccaacatgtaacctaacattgcttcctgtccattctgaagtaatctcactcttccggcgtactcatatgaatctgcctgcttacctctgtacaacatcagaattccttcatgttctttactttctgctcctgtcagcatccagtattcactgtcccttttccagacatatggatcacggtaattcattgtcgtctgatccggatccatttctacaatctttttccggtctgtcagtttctcaccatcaaatctggcataacaggtacatgggatcatctcttcattttcaattcctgtatagaaaacatgtactttttctccctcttttaatgccattcctgtataacacccgtaagagtctgattctgtatccgggtacattgccacaccatgatcttcataatgaataaaatcttttgttgtcaaatgataccagtgtttcaacccatgtaccggtccagccggaaaccattggtaaaaaatatggtgtatcccattaatctcacacagcccattcggatcattcatcagaccgcatttcggtgcaatgtgccataccggataatacggatctttcctggttgtctcctgtatccgttgaaaatattcagccggcatatccgtaatccgaatatgccggttctgatgatttgaaaaatcatactgaaacataaatttactcctttatactgcttctggattcttcttcataatcagccatgtgcctgcaaatgcaactcctacagaaagcagtaatacaataatatactcaatcattcctccctgaaggtaaagcagcataccagggatcatagacgctccggttccctttgcacacaaaccaacgattgctgcgaatccaccacctacagcacctccaagacatcccatgaagaatggcttaagtcttgggaatgtaagaccatacataacaggttcggaaattccgaataatgccgggatcagagctggaatcatattagctctcttctgcttattcttctgcatcatgacaattgcaagtcctgctccaagctgtcctgcgattgctgcagatcccattgggttaatataatctacaccagtctctgtaaaaatacttacaataatcggtgttactgtatgatgcatacctacagaacagagaatctgaatcagtcctccataagcgattcctccaattccaaatggaagtttcagcatcataaggatcagatctgtcattcctttttcaattcctgaaagaaccggtcctacaacaaagagtcctgccaaaagtgaaacaagtaaagtaaggaatggtacaagcagcatgtctaagatatccggaatcacctgatgtaacttcttctccagttttgctgcaaagaatcccatgaataatgcaggaattacagaactctgataacctgtaatatttaaatgcaacggtccaaagacaaaacttaacggatcagcaactccatttaccacatcccatttatttggaagagttggtgatacaagcatcagcccaagtacaataccgaggatcggtgagccaccgaacttcttgcatgcagaccatgcaactaatactgggataaatgtgtatgctgtgtctgttaatacagaaaatactgtatcaaaagatggtgataactcaattccaaatccatttacaagaagacttcttactcccatcagaatacctgttgcaagaagtaccggaatgataggaataaaaatatcagaaatcatctttgttgtactctggaaagataatttttccttctccccattttctgttacttcagcatctccagctgtcactcctgccagtttctgaaactcagcacaaactttattcacaaatccagttccaagaatcacctgatgctggccactctttgagaaataacctgctactccctgaatctctttcatcccctcttcatcaataatagatgcatcctttacttccacgcgaagcctggttgcacaatgtgtcgcactgattacattttcttttccgccaaatgctttcagaatttcctgcgctgtctttacaggatcttttttcatctctcattacctcctatttgtgctattataacatatatcgtttttatcaaatcgattcgatatgtttgttttttatagtggccttggaatatttcctatcggccactgttatttttgtttatcgaatcgtttcgatatctgttgattataatagatcattaccatttcgctgtcaatgaatttaatcaattctttttgttttctgtatttttcaacaaattaaagtcgtgatatttggtaaaaagtaacatgtaatttaacatgtttcaccactttggactgtcacgccaaaaatagattcaacttcttcaatttttttcccttcaatttgcgagatgatcattgacactaatttttgagccatttcttcaattggctgaacaatcgcagtcagaatttctggtccgatttttgtaatatacgttccatcaatcgcaactatgctgagatcctctggaacttttcttcctcgtaactgcgcttctctcatacaggcagctgcagccatatcaacaccaagaattccatccatatcattacatgtctcaaatgcacgagctgcagcatcctgatacttttcagtagtaaatgtattatatcccacagaaatatctacaacttcacaaccttttttctgaagtatttcgcggaataccttctccttttcatcctcatagttcttaatcgtatgagaacttacaagctgtacgactttctttctgttcttctccagaaaaagcgacgctgctttctctgcaacctgtctcttgtctacatgaacagtcggaatataatctgccaaataacaatcaattgttacgattggtctgtcaatcttaagatatctctccttcttcagtgaatgagctcccataatcacgccatccatagttctacgatccagcatctgaaggtaagcttcttctacatcttcacgcccagctgttccacaaaccagtgccttataccctctggaatacagttctttctctgcgtatttaataaacgtactgaaaaagggatgtgcgatatctggaacaataattcctacaattcctgatttttgcatcttcagattacggccaagctcgcttggaatataatttaattccttcattgctttttcaatttttttcctggtttcgtcagatacatatcctttattattacacacaagtgaaacagtgcttcttgatactccagctaattttgctacatctccaatgcttgccaaatcaatctctccctatcatcaaatcataaatctacagttactcttctgcattagagttctttctctaataataaaatatagaaaaaagactgcggtatacgcagtctttccgtttacataaaataaaaatgcccagaaccggaatcgaaccagtgacacgaggattttcagtcctctgctctaccaactgagctatctgggcatagactataaaagtctgagttgcgggagcaggatttgaacctgcgaccttcgggttatgagcccgacgagcttccagactgctccatcccgcgatattaaattaatttctcaaaagagaaaagccgatgatcggactcgaaccgataacctgctgattacaaatcagctgctctgttggcgactgccgcgataacttgagaaactcgcggagcgtgtttctcatagttgggaaggaaaataaggaacctatggggcagaatctgagttttcgaaagaataacagaagaaagaaaaagaagaagccgcagatgaagaagaaaaatcatctgaaatttacaaaccgaagtaagaaattaaagtttgaaaagaagaattatcatataacaaagaattctttgattcttgcaggagagatactatgtgtttgtctggtggcagtacttttgattgcatttttcggacatcgtgtaagcaatgcaggagatgccatgagtccgacaattgaaaatggagaggttgttcttgtagatcgtctgatcgtggatatgaagacaccttccagaggaactgtggtggcatttcgaccagacggaaaccgcgaagttcatcttttaattagaaggattgtcggtcttccgggagagactatccagatcaaggatggaactgtttatattaatgggaaagagcagaagaaacatattcatgtatcagagataaaagatgcggggatagcttctgatgagataaagcttggcaaagacgagtactttgtgctcggagataacgaggagtcaggcgaagacagcagatctgagacggtcggagtggtaaaggcagatgagatctatggaaaggtctggttcaatgtaagctccggggaacatttcggatttgtaaaaagataaaatagaatgaaaaaataacaggaggaatgcaatgcattttcagtggtatcctggccatatgacaaaggccagaagaatgatgcaggagaatattaagctgatagatctgattattgagctggtggacgcaagagtgccgctcagcagtcgtaatccggacattgatgagcttggaaagaataaggcgagactgattcttttgaataaggcagatcttgcggaagacagaagaaatgatgagtggatggaatatttcaagaagcagggatattctgtcgtgaaagtgaattctaagaaaggcggcggaatcaagtcgatccagtctgtgatccaggaagcatgtaaggagaagatggaacgtgacagaaagcgtggaatcctgaaccgtccggtacgtgccatggtggtaggaattccgaacgtaggaaaatctacctttatcaatgcgctggcaggaaaagcctgtgcaaaaacaggaaataagcctggagtgacaaagggaaaacagtggatccgtctgaataagaatgtagaacttttggatacaccgggaattctctggccgaagtttgaagaccagacagtaggtttgcgtcttgcgtttatcggttcgattaaagacgagattcttcagacagaagaactggcaagtgagcttgtgaaatttttaaatcagtcatatccgggagttcttgaagagaagtacacgatagaatcttcagaagataattatgaagtgttaagaagaattgcagaaagcagacactgtctggtcagaggaagcgaattagatgtggaaaaagcagcggcaattcttttggatgattttcgtaatggccgccttggaaggcttacactggagcttccagaggagaactaatacggtatgaaagaaattataaaagaactggctggatggcttctgtatattgtgttgatcatcgcttttacctggtgtgtggtcacttttgtaggacagagaacggaagtcagtggttcttctatggaaactacgctgtcagataaggatcagctgatcgttgacaaaatgacttaccgattcagagatccgaaacgatatgacatcgtagtatttccatatcaatatcaggacaatacctattatattaagcggatcatcgggctgccgggagagacagtacagattttatccggaatggtttacattgatgggatgcgtctggatgaacattatggggatgaaataatggagaatccaggcattgcagaagaaccattgacacttggtgaggatgagtattttgtacttggagataatcggaataacagcagtgacagcagagcatccgatgttggtttaatccatagaaaagatctgatcggaagggcatggattcgcgtgtggccattgagtcaaattggggtgatacatcatgagtaaaagtattagcgagatcaagatagaatttgaacaggcaggagaacaacagtgggaagcactttgtcaggaatacgagacggattccagaacaggtgtaaaaaatctgacagcaagatatcggaagaagcagcaggcacttgttcaggagagagaacgcctcgaggtaatgaaaacattcgagagaaaatatgcggattatagttttatctgtggaattgacgaggcaggaagaggtcctctggcaggaccggtagtagccggtgcagtgattctcccaaaggattgtgagattctctatctgaatgattcaaaaaaactgtctgctgcaaagagagaagagttgtataatgagattatggagaaagcggttgcagcggcagtaggtatggcaagtccggcgagaatcgatgaaattaatattctacaggcaacttatgaggcaatgcgtgaagcaatttcaaagctggcagtagaaccagggattcttttgaatgatgctgtgacgattccggagatgatcattccgcaggttccgattattaaaggagatgcgaagagtgtgtctattgcagcggcaagtattcttgcaaaagtgacaagggatcggctgatggtagaatatgataaagtgatgccagagtatggatttgcaggccataaaggatatggatccaaagaacatattgaggcaatcaagaaatatggaccgacaccgatacatagaaagacatttatcaagaagtttatttaatgatatcagggttgtataaaagaaagagctgccaatggcagctcttcttaaatccgaaagttcgacggattagaagaggggaatcaggtagatgaaggatccgaaaaaagaaaagaataaccgcaagacaggtggaaactatgagcaggcagcaggtttttatctggaacagcatggctatcagatactacagtacaattatcgctgtcgcataggagagattgatattgttgcaaaagagggggagaatctggtattctgtgaagtgaagtacaggacgggtcctggcaagggaagtccgctggaagctgtagatgcaagaaagcagagaaagatatttcaggcagcaatgtattatctgacggaatatcatattagtgatgtcccatgcagatttgatgtgatcggtattgaagggacaaggatccagctggtgaagaatgcattttgcggatagagaagaaaggacagaatatgagtttaggattgatttataagaacgcggcacatatttttgatgaagtagaaaagaaaactccttatctggaatatccattgtttcaggagacgggcattgtaacgagtgctttttctacacgacttggaggagtcagtgagggctattattcttctctgaatctaagctttgatcgtggagatgacccggcaagggtattagagaattttaaaagaatcggagcatcaatgggtgttaatgtcgaagatatggttctgtcgaagcagacacatacaacgaatgtacgtgtagttacagcggaagataagggaaaaggtgttatgcgggaacgcaattatacagatgtggatgggatgatcacgaatgttccgggaatctgtcttgtgacttcctatgcagattgtgtaccactttactttgtagatccggtgaaaaaggcgatcgggctgagtcattccggctggagaggaactgttggaaagattggaaaaaatactgttcagctgatgcaggagaattttggatccaaaccggaagatctgcttgcagcagtaggaccatcagtatgtatggattgttatgaagttagtgaggacgtaattgagcagtttaaagaagcttttgaaaaaaagtactgggaggatcttttctataagaaagagaacggaaaatatcagttgaatttatggaaggcaaatgagctgatcttcctggaaagtggaattctgccggagcatatggcaatcacaaatgtttgtacacattgcaatagtaagatcctatattctcaccggacgatggggaacaacaggggaaatctgtgtgcatttcttgcattaaaataaggaggttaaaagtatgtatctgacaacagtgaaagaacttggaacagcattactgacaaaggggacagcctttgcactggcccaaacagcaacgcagacgaataacagctccgtcaatgatgtgcttgattctgcacaggaagtaacagcaagcacagcagatgaagtgaatcgctttgtacaatattttaatgataatattccgaatctgattgcctttgggttgaaggtgattttcgcgatagtattttacctgatcggatctaaggtgatatctgttatacgtaaagtggtaggcaaatcaatggagagatccaatgcggatgttggagttcgccagtttgttgattctatgttgaaatttgggttatacgcacttctgatctttatgatcgcaacaaaatttggcgtagaatcttcttctgtagcagcgatcatcgcttccgccggtgtggcaattggtctggcattacaagggagtctgtcgaactttgcaggaggtatcttgattcttcttctcagaccatttgcagttggagattatattattgtgaattcagagggaatcgaaggaactgtaaaggtaattcagatcttctatacaaagatgacaacaatcgataataagacgattgttgtgccaaacagtattctgacaagtaacagtctgacaaatgtaacagcaagaccggaacgtcagctggatcttaaagtaggaatttcttatgaatctgatctgaagaaagcaaaagagatcgtagagaatcttctactgaaggatgaagatgttattcaggatgaagagattaaagtgttcgtatcagaacttgcagacagcagtgttgtgatcggacttagagcctgggtgaagacagaagcttactgggcaacgcgctggagaatccttgaggagattaaaatgtcttttgatgaggaaggcattgacatcccatataatcagttgacagttcatatggcaaatcattagttattatttattagaatgataaaagtctatagaagttgattaaaaaagaggttgaaatttatatccaaacgcgatataataacaaaggtcgtcagaattgacgaccatatgccgaaatagctcagttggtagagcacttcactcgtaatgaaggggtcgtcggttcgagtccgattttcggctgaagagtaaagaccgttgttgatttcagttgtatctggaatcagcagcggttttttatatattaggaaagttctttcctaatatataaaaaacgcttcgcttaggatgcgcacttataacgaacttagaacggatacgaaaaagcatcttgacgaaggaaatgaaaatggatacaatattgttacgagtttataaaaaaagatgaaaaattttctctaataaagtaaaaagaaataaaattaattcttttaaaacaagattagacagaagcagagaaatagaaaaaatacagagggtgaaaatatggcatcagtacagacaaaagattacattgtgcagttaattaaagaggagattctttcaggagttatgaaaccgggagaagagctggcacaggaagcacttgcagagcgtcttggtgtttcaagaatgccgatccgtgaggcattacagaatcttgttcaggagggatttgcggtacgtcttccaaaccgtcatatccaggcagtagttttgagcgcacagcagattcatgatgtatttcatgtgattgcagcgatggcagcagagaatacgatcttagttgcaaagaaagagcagatgcttcgaaggaaaaatgtggaacaaacgagtcagacagaattcgaagaagatggacagagcaagcttttccttgagcaagagattgagaaaactccaagcgagcagctttttcagatactttccggcatggagaatgcattgagaccagagaagaaggcagagtgggagatggtttatcaggagagactcatcagtttgtttgagaatccatatctgtcacagcttcaggggaagacgatggatggttatgtagcttatgcaattgagaagatgggagataagcagcagaagttagagcagcttcgccgtatcacagaaggtattgcagagaataatgagcagaagatccgaatgggacttcgagaatactatctttcttatgctgatgcttttgtagaaagatgggagaagaaggcagaagaaacagaaaaataggttgaattgttataggggtgattacatacatatgtaggttgtaatcacccctttttctataaacaaagtcttatctagatttgttagtgagcgattgctatggtagcaaaggcacctcatgttcgtcattttatacaagctgtgttgaaaaaacactggattatatcgcaaatatgatgataaaatataaatcagatgatgggttagaaaattggaaagggaggacgatggaaaaagcacgacaagtaaaaagagtcctgctgcaggcaattaagattgcggtgggcagcagtgtagcaatttatctagcgcatatactgggattggagtatgaggcatctgccggaagtatcacactgcttacgttagtaacaacaaaatgggagacggtgaaattatctttttatcgtatggcgacatttgttttggcggtagttctggcggcgttgacatttggacatatgacgagttcctggcttgcgtatggaatctatgtatttctgatcgttgcggtcagtcatagtcttggatggtcggcaacaatttcggtaaatgccgttatcggcacacattttcttatgacaagagattttagtccggagtttattcgcaatgagctgtttttagtaatgattggaatcacaatcgcgattgtactgaatttgttctatgattatgaaggacagagacaggatctgattcgttatatgagggagacagagaatcagctacagattcttttgtgtgaacttgcagcgtatcttcataataaagatatggagatcaatgtctgggatcagatcatcgcctttgaggggagaatgcatgaatttatcaaggcagcgtatgattaccaggataatacatttcattcgcatccgggatactatatagattactttgaaatgcgtctggcgcagctgcaggtacttcataacctgcattatgagatcaagaagatccgtaagatgccgaagcaggcacttgtgatcgcagattatatcatgtatatggcagattatgttgttgagatgaatattccagatcagcagattgagaagttggaagagatttcggagcaaatgaagcaagaagaacttccaaagacgcgcgaagagttcgaaggacgagcacttctgtatcatattttgatggatctggaggaatttcttgtatataagaagcgatttgtgaatggattggatgagaagaagcttcgtatctactggaaacaggagatggagcaaaaagatagcgcaaacgagttgcagaaatgatgaaaagaaacggattaaagtcagaagaaacaaaaacaaagcattttctgattttaatccgtttttattaattataatatgttactgaaagaatcagatttttcccgggaataatgtgccgactcttccgccttttacaatatcataaaggacttccggatgctttccgtttgtaacaattgtgtttgttccctgggaagtggcaagggatgcggcctgaagttttgtacgcattccgcctgttccacgtcgggaacctgcgccaccagctaaagcatagacgctgtcatcaattgtatcaatctgatcgattagctgtgcatttggatacaatcttggatcgtgatcataaaatccatcaatgtcggagaaaatgaccagatgctttgcgcggcagagtactgcaacgacagctgagagcatgtcgttatcaccgaagagacgatcttcggattcgatttctttatagcttacggagtcattttcgtttacaatcgggattacacccatctcgagaagcgcattgaatgtattgatcagattttcctttttttcttcttcttcaatatcatctgcattgagcaggatctgggcaactgtcttgtcatagtcaccgaagaacttgtcatacaaatacatcagactacactgtccaactgcagcagcagcctgtttcatacgcatactgtctggtttagcagtcatgttcagtttatttcttccgactgcgatcgctccggaggaaacgagtacaacttcatatcccatgttctggatatcagaaagtacacaggcaagacggtctgttgtacgaagatcgctctttccggcgtcattggtaagtgtagatgttccaacttttactacgattcgattattataaagtcccataatacataactccttgctgaatatcttttaaaataatttccggatgtcagttaacaaccagccttgtctcatcgactgttttatagtatcatacagttatcaattacaaaagcgaatgtttctcatggattacatgataaaatcaaatacaaagtaagtgaagagatttttcgtagcgaaaacagatgggaaaatgtaaagcgaaaggagtgttaaattcatggatggaagtattcagaaatacatggcatttgttaagacagtagagtgtggaagttttacaaaggcagcggaacagttgagttattcccagtccgggatcagccgaatgatcaatgatctggaaaaggaatggaaggtagttctgcttgaacgaagcaagtcaggagtaaagcttacaagcagcgggatgaagttacttccttatgcggaacgggtctgcagagaatacgagaaacttcaattggaagttgatgagcttcaagggttaaagtcaggattgatccgtatcggtacattttccagtgtagcaacacattggctgccgaatattatcaaggaatttcagaaaaattatccaaacattgattacgagatgcttttgggtgattatacggatattgaagaatggatcatggaagggcgaattgactgtggattcacaagattgccggtaagggatgagatggatacaattttcctggagcaggacaggctgcttgtcgtgcttccggaaggacatccgctgacagaacttcagaagattccggtcagtgcgctttgtgaggaaccgtttatgctattggagaaaggtgctaaggcagaagtttctgagatctttgaaagaagtaatttaaagccgaaagtacatttcacaacatgggatgactacgcgatcatggcgatggttgagagcgggcttggaatcagtgttttgccggaactgatcttgaaacggattccgtatcgaattgttacacgagaactggaaatcccggcgtatcgtaatataggacttgccatgcgtaacagaaaaggtgcaactccggcggtgaagcggttcctggagtatctgcagtatagataataggaattgtgaaaattttatgaatgctagattacagaagataaatagcttgatagatgaaaataagcgggggtataatgttactattatgataaaaagggcttattctatgaccgacattataagagtcatcagcaatcagagaagagcacaaagattgaaagaaggagaaaaagatggcgattaaacatattttatttgacttagacggaacacttttaccgatggtacaggacgaatttgtccgtttttatatgccgcttcttgcaaaggcatatttgaagaaaggcgtggaaatggatccaaaaggattcattggtgcagtatggaaaggctatgaggcgatggtgaaaaatgatggttccaaaacaaaccgagaggcattctggagttatattgatgaattcctgccgctttctgtggaagaatcagaggcaattgcggacgcattttacgaggatgaattcaatcaggccaagtgtacgacacagccgacaccactttcagatatggttataaaagaggcgaagaagaaaggcattgaagtttatcttgcaacgaacccgatctttccaagatgtgcaacaatgaatcgtatcgactgggcgggactggatccggaagattttaagattattacaacatatgaagatcatgtatattgtaagccaaatccggaatatttccgtcaaattttggaacagtttgagcttgatccgtcagagtgtctgatggttggaaatgacgtggaggaagatcttgcgatccgtgcgcttggagttcctgtatttcttatcacagatacgatggagaataagaaaaaccttccgatcgactccgaatatcagggctcgatggaagagttactggaatttgtaaaagaattgccggaagtgtaagagcgcggtgagaatgtaaaataagaatgaaagataatcgtttaatattgcgaaacaccttgaggaggtattagtaaaaaatctcttcaaggtgttttgtgtttataggaagctgaaaacaagcgtaagaaaggcgcaatagagaaatttgttttacatggatttaacataaatcatatcagaatgtaaagcagcatttgtaaaatagaacagaaaaatggaaaagaatgttgtcagctttgtatttaagatgacaacaaagactcagagagggcattattatatgattaaaatttatgtgatggataccaatgttctgattcagtccccaaatgcgctttttagttttgaggataatctggtcgttctcccgatggttgtattggaagaacttgatcatttgaaaaaagcagatggcgagacaggagccaatgcaagaaaatgtatccgtctgcttgaagaactgcgtcagaaggggaatcttctggagggtgtatcccttgagaatggaggaatctgttgggttgaaaagaattttgtagatgttgaacttccggtagatttatctctggaggtcgcagataacagaatcttaaaggtttgccttggattaaagaaatcaagaaaagaacaggttgttcttgtgacgaaagatatcctgcttcgaattaaagcacaggtgttggatctgtgtgcagaagattttatttccgagcaagtgatagctcatgacagacagtataccggaagatgtgaagtttatgcaccggatgaattgtttaaggattttaagaaaaagggaataccggtggatgaagtttatcaattagatgagaatgagaaagcattttgtcctaatcttttggaaaatcagttcgtgatcattaaatcagatcaggcaagaaagaagacacatcttggaagagtggagcatggaatccttcggaaactggaatttaaaaagagttctccgtatggaatttctccaagaaatgcaggacagtatttcttacaggaagctttgatgcagccagcagagaaagcaccgcttgttattgtcaaaggaatggccggaacaagcaagacattttattctcttgcagtaggtctggaaaaattgatgaatcatccgacaggcgaatacagaaagattcttgtctgtagaccgaatgcgcagtttgacgaaggaatcggattccttccgggagatgaacaggaaaagatttctccgttgatgcgcccggtccttgataacctggagcagttgcttgattcgaatgaggacgagcgttataaagacgaagaggtattgcgggataaagtggaggaaatttattccagaggtttcattcaggcagaggcactaaattttatccgtggccggtcgatcgtcaagacgtatctgatcattgatgaagcgcagaatacaacgccggatcagatcaaaggcattatcacaagagcaggaaaggatacgaagatcattcttttaggagatccgaatcagatagaccgtccgttcctggatgagagaaccaatggtctgagttatgcggcagaacatatgaaaggaagtccattgtgctggcaactgacgatgacagcagaagaatgcgaacgttcagaacttgcaatggaggcagtaaaaagactttgaaaacaacatataaagagattcgggagatagaagaaataaatctgttgatcgaacagggaaatgctactttaaaagagcttggatatacagaacattccaaaaaacatgccgcaaaagtatcagatactgcaggcaagattctgacagagcttggatatggaaaacataagattgaacttgcaagaatcgcaggttatatgcatgacatcggaaatagtattaacaggcatgatcatgcacacagcggtgcactgctggcatatcagatattaaaggatacagagatgtcattgaaagatgttctggtaattatgacagcaatcggtcaccatgacgaggcaaccggagatgctgtggatccggtatcagctgcactgatactggcagataagacagatgtaagacgaaaccgtgtacagaatccggttccggcaacatttgacatacatgacagggtaaattatgcagccctgtcaacgaagttgacaattcaaaaagagaagaaagtaattcagatggaactggagctagatgatgaaatctgcaccgttatggattattttgaaatctttctggagcgtatgatcatgtgcagaagagcggcagaacgccttgactgtaaatttaagctaattgcaaatggcaacaaaatgtgttaaaggatggagaaaattaaaatgagtaatgtatacatgaaccgtgaattatcctggttgaagttcaatgaaagagtattggaggaagcagaaaacccggaagtaccgctgtgcgagcgtatgacatttgtgtcaatctatcagagtaatctggatgaattcttccgtgtgcgtgtcggatcacttcaggatcagatgctgatcagtacagagatcagagagaataagacaaagatgacttcagcagaacagatccgtgcaatcattaaagaagttaagaagctgaatcagagaaaagataaggcttatgagaagctgatgaagaagattgaagagtacggaattacattgattaatcatgcttctgcaaaatcagaggagaaaaaatttcttgagaagtattttatgaaggagatcatgcctttaagttcaccgacaatcgtcggcaagagacaaccatttcctttcttaaaaaatggagaaatttacgcagtcgttgttcttgagacgagaaataagaaggaaagaatcggaatcattccatgctccaacaatatgctgacaagaatggttgaacttcccggtggaaaaggaagatatatgctcattgaagatctgattcttcattatattggcaaagtctttaagggatacaaggtaaaggggaaatctttattgaaggtcgtaagaaatgcggatatcgatgccgatgcggcttatgatgaggatcttgattatcgtgagtttatggaagatctgatgaagcagagaaagaaactctctccggtgcgtattgatctttccagagagatggatgaaactgttgtagacgcattgtgcagatacctggatgtaactccggatagagtattccgtagtgaagcaccactggatgtttctttcgtgttccagcttcaggatcttctgcgcagaaatacagagctcttctatgaaaagcgcgtgccgcagaagagtccggaattcaaggatggacagagcattttacagcagatcacacaggaagacaagctgttatcctatccttatgattctatcagacctttcctgaaaatgctgacagaagcagcagaggatgacagtgtcatttccattaagatgacattgtaccgactggcaaaacagagtaaggtcatcgaggcactttgcgaggcggcagagaatggaaaagaagtagttgttctcgtagagcttcgtgcacgttttgatgaggagaataatatccgctggtccagaatgctcgaagaggccggatgccagatcatctacggactggagcattataaagtacactccaagctgtgcctgatcacacgcagaggggaaaatggaatccagtacatcacacagatcggaacaggaaactacaacgagaagaccgcaagactttatacagacctctctcttatgacagcgaatgagcagattggaatggatgccgcaagagttttccaggcactggctaaaggtgaagtagttgaagatatggaacatttactcgttgcaccaaaatgccttcagtctaaagtgatcgagaaaatcgaggaacagatccagaaacagaaaaatggagagactgcatacatcggcctgaaaatgaattctctgacagataagcgtatcattgataaattaatcgatgcgtctaaggctggtgtgaagattgacatgatcgtcagaggtatctgctgtctgatcccaggtgtggaaggtgagacagagaatattcatgtgatcagtgttgtcggaagattcctggaacattccagaatctatatcttcggaaatggagaagaggcacagtattatatcggatctgctgatttcatgacacgaaatacagtgaagcgtgtagaggttgcagcgccagtttattccgaacgattaaagaaacgtctgcaggatctttttgatttgatgttaagtgataacaaaaaagcgcgaaaggaggatgcaaaaggaacctattctgtggtagaatgtaagggacagccaattaactcacaggaacttctttaccaggaagcctatgcgaaagcagcagtgaacagtagcaatcagttagaggaggctgtacaacagacagaaaataaggtgatagaatgatctataaattcggggaacgtctgacagagatcagtcaggaagaatgggagaaagagaagtgtcctgctgtgttcctcacagattccaatcatgcggaggagacattggcaacagtagggatcatatatgaaagtgagatccagattgcaaagatcggattctgtaagattgagaatcagcaggaatgtatggtaggaactttctgcattccaaagcttcttgatgtattaggaagcagataccgaatgtacatgtttgtaaatgaaaataatgttgttatcgtagatgacgagacattttcagagcggcttattagtaggatcaagaggaaacgaatgcatcagggtgagacgaaagagagattcctctataattacatagcagaattcatgagtagggatctggagatccttgtggcctatgagcgtagacttcttcgtatggaagaggatgtgtcccaggatcatacagatacgatccagaaccgactgatgccgatccggagggaacttctgaatctgagaagctattatgatgagatgatggacttgacaaaagagcttgaagagaacgagaatggattgtttttgaatgatcaattgaaatacttcggaacacttactgaccgtgcagaccgtctgatgagccgtacttctcatctgttggaatatgcccgtcaggtaaaggaggcttaccagtctcagattgataatagacagaataacaacatgcagtttttaacagtgatttctacgattttcttcccactgacattgatcacgggatggtttggaatgaactttaaagatatgcctggacttgaaaatggatatccggcggtaatggcacttagtattgtcattatcgtgatctgtattttgatcttcaagaaaaagaagatcatctaaaaaactgaaaaaactgtaaaaatagcgttgacaatcctcgattgaatgctataatgatggtcagaagaagttaaggattataaagcaacatagttcttagccgataacacgatgacgagacgagtaggatgtggaatgttacagagagagatacatttgctggaagtatcttagcaggaatcatttgaagactacctctgagtggccccaatccggtccggtgattccgttataatcatgaatgaagtggttttaaagcagtacatttgctgtgatcttgaaaacaaaaagggtggaaccgcggatagtaaagtaattgataatcagactttatccgtcccttgcatgtgagtgcaggggacagatgaagtcttttctttttccatagaatccccgaatgaaagcatgcatagttacttgaagaaaataggaggaagcgaaaatgattattacattaaaagatggatcaaaaaaagaatattcagaagcaaagtcagtgatcgacgttgcatttgacatcagtgaaggacttgcacgcgcagcctgtgcaggagaagtagatggagaggttgtagaccttcgtacagttcttgataaagattgtgaactgaacatccttacagcaagagatgagaaaggactggcagtacttcgtcacacagcatcccatgttatggcagaagctgttcagacacttttcccagaggcaaaggttgcaatcggaccttctattgatacaggattttactatgatttcgaatgtcagtcattttcaagagatgaccttgacgctatcgagaaagagatgaagaagatcatcaagaagggcgcaaagatcgaaagatttacaaaatcaagagaggatgcgatcgcatttttcaaagagaaaaatgagccatacaaggttgaactgatcgaggatcttccggaaggagaagagatttccttctattctcagggagactgggttgacttatgtgcaggcccgcacctgatgagcacaaagggaatcaaagcattcaagctgttatcatcttcaggagcttactggagaggtgatgagaacaagcatatgctgacacgtatttacggtacagcttatgcaacaaaggatgagctgaaagagcatctgacacagttagaggaagcaaagaaacgtgatcataacaaacttggccgtgagatgaagcttttcacaacggtagatgtaatcggacagggacttccgctgatcatgccaaacggtgttattatcatgcaggaattgcagcgctggatcgaggatgaagaggcaaaacgtggatatatccgtacaaagacaccacttatggcaaagagtgatctttataagatttccggacactgggatcactataaagaaggaatgttcgttttaggagatgaggagaaagataaagaagtatttgctcttcgtccgatgacatgcccattccagtattatgtatacaaagcagagcagcacagctatcgtgatctgccacttcgttatggtgagacatctacactgttccgtaacgaggattccggagagatgcatggtctgacacgtgttcgtcagttcacgatctctgagggacatttagtagtaagaccagatcagatggtaaaagagttcaaagattgtatcgcacttgcacagtattgtctgcaggttctcggagtagaagaggatgtaacatatcacctttctaaatgggatccaacagatactaagaaatatattggagcaccggaagtatgggaagagacagaaggtcatatccgtacaatgcttcaggaactcaacattccattcgtagaggatgtcggagaagcagcattctacggaccgaaggttgatatcaatgcgaagaacgtatatggtaaggaagacacaatgatcacaatccagtgggatgcgcttcttgctgagcagtttgatatgtactatatcgatgagaatggtgacaaacagcgtccgtacatcatccaccgtacatctgtgggatgctacgagagaacactggcatggctgatcgagaaatatgcaggaatgttcccaacatggctgtgtccggagcaggttcgtgtgattccgatttctgataaatacaatgattatgcagcgaaagtggaagcacagcttaaagaagctaatatccgctgctcagtagatggacgttccgagaagatgggatacaagatccgtgaggctcgtctgaacagagttccatatctcttaattgttggagcgaaggaagaggaagagcagaaagtatctgtaagaagcagatatcttggagatgaaggttctaaggatcttggagaattcatcgaagcaatcaaggatgagattgcaaagaaaacaatccgtaagattgaagtagaagagtaagaatagttacccgaaacaacaaaaataagaatctcccgaagaagttcaagtatgaaaatactgatttctacgggagattcttattttatgctatattgtaactgttcagagccaacctccaaaatgctacgcatttcgtcggtgtggcttatgtaccttgaaaactgcatatagtaaaaatcaatagatttagataaatatctaatcaagacatccgaggtaatgttaacaacattaacttacagtctgaagaaaacagacttaaaataaattgactatcaccaacgcatacaacgctatgtatgtgtggacattatcccattcccgtgggatgaggtcgagttggttatgctgataagagcgtatggtggatgccttggcactaagagccgatgaaagacgtgataagctgcgaaaagcttcggggaggagcaaatatcctttgatccggagatttctgaatggggaaacctacttgagcaaacctcaagtatccttaagccaatacataacttaaggaagggaacccggtgaactgaaacatctaagtagccggaggaagagaaaacaacatgtgattctgtgagtagcggcgagcgaaaacggaagagcccaaaccagcgtgcgtgcatgctggggttcggaccgcggaattgattcaacgagtttagcagaacggttttgggaaagccggccagagagggtgaaagccccgtaagcgaaagacgagttgacatggcgggatccagagtaccacgagacacgtggaaccttgtgggaagatgcggggaccaccccgtaaggctaaatactacttagtgaccgatagcgcatagtactgtgaaggaaaggtgaaaaggaccccgggaggggagtgaaaaagaacctgaaaccatatgtttacaagctgtggaagagctttatatgctcaaccgcgtactttttgtagaacggtccggcgagttacgctggctggcgaggttaaggactaaaggtccggagccgaagggaaaccaagtctgaatagggcgcatagtcagtcggagtagacccgaaaccgggtgatctatccatgtccaggttgaagttgccgtaaaaggcaatggaggaccgaacccacatccgttgaaaagggtggggatgaggtgtggataggggagaaattccaatcgaacccggagatagctggttctcctcgaaatagctttagggctagcctcatacgagtcttgcggaggtagagcactgaattcctaagggggcgtcaaagcttactaagggatatcaaactccgaatgccgtgtagatgatgtatgggagtcagacgatccgagataagttgggtggtcaaaagggaaagagcccagaccaacagctaaggccccaaaatgtgtgttaagtggaaaaggatgtgggatttcgaagacaactaggatgttggctcagaagcagccattcattcaaagagtgcgtaatagctcactagtcgagaggtcctgcgccgaaaatgtccggggctaaaacacactgccgaagctttggaattgagaattcaattggtagaggagcattcttaaagggacgaagcagtaccggaaggagctgtggacttttaagaagagagaatgccggaatgagtagcgagaggaaggtgggaatccttccggccgaatatctaaggtttccagagtaaagctgatctgctctgggtaagtcggggcctaaggcgaggtcgaaagacgtagtcgatggataacaggttgaaattcctgtactatcctgtaacagaactgtggggacacaggcagagagcgtgagccgggaatggaaagaccggtacaagcgaggtaggagaagagttggcaaatccgctcttcaatctgaagacgtgatgtggactgaaaataagtagggaagcacgtgagctgactgtcaagaaaagccgctattgtttgcaggatacccgtaccgtaaaccgacacaggtggatgaggagagaatcctaaggccgacgggagaagcattgttaaggaactcggcaaaatgactccgtaacttcgggagaaggagtgccagtaagatggccgcagagaattggcccaagcaactgtttagcaaaaacacaggtctatgcaaaaccgaaaggtgaggtatatgggctgacgcctgcccggtgctggaaggttaaggggagaggttagcgcaagcgaagctttgaacttaagccccagtaaacggcggccgtaactataacggtcctaaggtagcgaaattccttgtcgggtaagttccgacccgcacgaaaggcgtaatgatttgggcactgtctcaacaatgcacccggtgaaattgaaataccagtgaagatgctggttacctgcgccaggacggaaagaccccatggagctttactccagcttgatactgggattcggtattgcatgtacaggataggtgggaggctaggaaatggtaacgccagttgccatggagccaatgttgggataccacccttgcagtactgggtttctaaccagcagccgtgatccggctgggggacaatgtcaggtggggagtttgactggggcggtcgcctccgaaagggtatcggaggcgctcaaaggttccctcagaatggttggaaaccattcgaagagtgcaaaggcagaagggagcttgactgcgacaccgacgggtggagcaggtacgaaagtaggacttagtgatccggtggtataaagtgggattgccatcgctcaacggataaaagctaccctggggataacaggcttatcactcccaagagttcacatcgacggagtggtttggcacctcgatgtcggctcatcgcatcctggggctgaagtaggtcccaagggttgggctgttcgcccattaaagcggtacgcgagctgggttcagaacgtcgtgagacagttcggtccctatccggcgtgggcgtaagatatttgagaggagctgtccttagtacgagaggaccgggatggactggccgctggtgtatctgttgtcttaccaaaggcatagcagagtagccaagccgggaagggataaacgctgaaggcatctaagcgtgaagcccccctcaagatgagatatctcataacgtcaagttagtaagaccccttgaagacgacgaggtagatagggcagaggtggaagtgtggtaacacatggagctgactgttactaataggtcgagggcataaccaaagcagtgataggtttggatgatgatgttggtttttgcaagcattttacatctgttttatgaaattttgcttggctctgaacagttaccattttactataaaatgttatatataacaaataataatagaataaatttgaaataatgttacatataacatatttgagaaacaagaaatttggtatcctaatattaataaaacacggaacagacatggaaaggagttcattatgaaaatagtaacagcgattgattcatttaaaggaagtatgacttctatggaagcaggacaggcagcggcagagggaatccaaagagtggatgtggatgcagaagtgattgtaagaccgttagctgacggaggggaaggtacagtagaggctcttgtatccggaatgaatggaacattacagaaagtacaggtgacaggaccacttggcgaaccggtgatctgtgagtatggtatcattgaaagcacaaaaacagctgtgatcgagatggcgggggcagcaggaattacattggtttctgatgaagagagaaatccgctgaatacaacaacatatggcgtgggagaagtaattcgtgatgcgattgataagggatgcagacgttttctcgtcggaatcggcggaagtgcgacaaatgacgggggagtcgggatgcttcaagcattaggttacggttttcttgacaaagacggaaatcaggttccatttggtgcaaagggtttgaaggttttggaggaaatcacagatacttatgtgcttccggaattaaaagagtgtaagtttaagattgcatgtgatgtaacaaatgctctttgcggagaacagggatgcagtgcagtatttggtcctcagaaaggtgcaacaccggagatgatctgtcagatggatcagtggctaggatattatgcatcattggcgaaagaaaaattcccaaaggcagatgcaaagcaggaaggaacaggagcagcaggaggccttggattcgcatttctcacatttacagatgctgtgctggaatcaggaattaaaatcgtgctggaagagacacagttagaagagtatgtaaaggatgcagaccttgtcatcacgggggaaggccggatggatggtcagacagcgatgggaaaagctccggttggagtggctgcacttgcaaagaaatacggcaagccggtacttgcatttgcaggcgcagtcgaaagagatgccagaaaatgtaatgaacatggcattgatgcatttttccctatcctgcgtggtgtggttacgctggaagaggcaatgaagaatgaaaatgcaaagagaaacctggcagatactgcggaacaggtgtacagaacatttacaattctttgatcatacaatattgttttaactgaaaatgaggtttctccacgattccgaatatcttgaatccaagatgttcataaaatggtacgtttttctgattgtgtgtctcaagagagatcatcatatcattgcgatcggcgcaggcaatgacttcattcatcatcatttctgcgagaccgtgatgttgaaatttcggatcaacggcgaggtagatgacatgaagtcttcgggtttcatgaagctgggcggtccaagcggagttgaggtaatcttttccgaggacaaagttgaaaaatgtcttcatagtcggatcctcgtggagcagccagccgtctgtgatgaggctttctttcaggctgacaaaataattataaaatgcatgacggtgatcggattcgtcagaaaggatcaggactcccttcaattcagggctgtcggcaaagacttcacaggtttcaaataattcagttacgtcgcactcaagaagatgtggcagcagacgttcttttgttgcttcatcttcgatcagagtgctgtagagcgggtcgttctgaaagcagacggtcagtatttctttaaggcggtcaagatcctgttcctgtactttgtagagcttatcgctattcattagttttctccattcttttctttattataatgtgatgatgtttcaaggcaatcgtttatcaaagcctgaattttatcaacagattgtttcatataatgtaaatcatcttttaagtaggcctgctggcggcggatagcggcttcaagtcttctgatctcaacatcaagagaacctgggattgccatctgatccagttctttcagacgttggacaaggccgtagagattctcatggtgaagaatgcgtccggcgccccacatcagacggtcttttggctgatgtaaaatatattccgtaaagtgataatagacttcttcatcgaataaaaatgcgtagcagttattatcaacttcatagagtgcctccagtgcggcggtgatgttctggctttccagtgcatggactgcctgctccaggtgacagaggttctgactggcagcagcatgagggaagcagactgcgtcctgccagtcgaggcggacgaagtagtcctgcatcttccggaaaatgtgcagcagtttagaagaaagttcggacaccattgggaagtcagcggaaacagtatggttgttgatctcctgaatcttttcatataataaatcggcagattcacatacctttgaaatactttccagaagcgcaggaatttcttccaatacttctgccggggcattggactgtgctgcaagacagtcggcgacggaacttttcattgccagaaaatgtctggaaaagtcaagtggcggaagtgtcagctgatccagtgtaactaaaagccttgtatagagctcatggtggaaacggtaaactgcttcctgatagaattcttcattgtcatattgggagtggtaatgcgtttccataaacggtcctgcgctgaaatcatttacggtagatggaataccggagatggcgatggaaaaatcatccgaccatgtctcgattggtgcaagtactgtcagtccatcagggtaagcctccttcggaacagttatattttcacaaaaatgtttcagaaaatcagcagactcataagtagagcggattgcatcctgagtgttatgggcgtgagccggaagttcaaagttgagatcagcgatcacgcggccctgccattccgggtgaacacggaatacctggttccaggctccggttgaccagtcgaatttagaatcacagacaccccactcttcggcagcaagggcacatactgcgattgtatagcgaggttgatagccactgtcaatcagagcctttatgattccaaatgtcatagagaccgcacaattgtcatcctgaaatccgtcaaaataggaatcgtagtgtgcggaaagcagaatcatccggtcgtccccttcagaagcggcagttcccggaagatatccggtaatgttataagccgggcggttacgttcaacccaggaagaggcgttgagttcaactgcgacagaggacggatgagatactgcaggatcttcgggacagagaagttcttttaaataagaagcatcctgtcttgataaggaaaatgcaggagcatattccggtccggcgatatcctgagcgttgagtgcccgcggatcaatctcagcataaccctgtgtctggacagcaatcagtccgacagcacctttcaaatatgcctgatagacagggtagttgatccaccattcatcacgctggttgatatcagcaagaacgagctttccacggacattgagcccttcatagtccgatgcggttccacggccgacatagacaagatcataagtctcgaatccatctgtctcaaaattcgtctgataagctcccatctgacaggtatgcagttctccatgttgatcctggaaacggagcacagcacgttcaaaggtccaggaatccagccaaaattcatccttcgtcacattctgaagtccgatgcgtttcatttcttcatataaaaaatcccctgtcttatgttccgcatcagaaccggcagttcggaaaccgagtatcggattggttttgtgagtctccatctgctttgccagctgataagagtaagtaatgtctagatgtgaaatgcattcgttgattctgttttctgtctttgattccatttatatcacctctgaaagtctgagcctgttgtatgtgtttgagtttctgcgcttattttagcactgcatgcagagtgtgacaagagtagaaataatttctcgcaagctcgatcagtgtccgcgccggcttgctgatataatgtcccttgcgatatgcagcaacaatctcccaggaaggatggtcaggtaattgaaaataggtaattgcctcatcttccggatccatataatacatcggtaaaattccacagcagatattttcatggatcatagagatgatcgcatggttattcgaagtctcgaacagaacattaggggtgaatccggcatttttaaaaacggaatcaacgatctcccggatggtagaggttttctgcgtgaggacaaaaggctcttctctgagcagaggcagatcaccgttcttcatatctaaagcagtcacaagttttgtaggaacagcaagaaccatttcttccgaagcaagtgtttcatagatgattcctgatttctgttgcgacctggtcaaagtcataaaaccaaggtcaagttcaccggataagagaagtggatgctgatcacgaacgctgcgttcaatcggttccacttctatacatggacaaatgttgtggaactttgggtaaacactggtgaacatggcaattccacggccgggagtgaatccgatagtgatatgacctttctgtgcttcgcagagatcgtgaatctgattgtaggcattcttctttataaaaagaatgtcttttgctgcgttgagatagatttcgccggcaggggttgggtgccagtcagtccgggaacggtagaatagcggagtgccgagctctttttccagcttgagaagctgctggttgagggcagactgggtgatgaatagcttttcagctgcatgggtgatattctgttcttctgcaatttttaaaatatattcaatctgttttaaatccataggaataacctttctgctgattctgtgaatgagcctttgcgtttctatttccagtataattcgaccgatacagaatgacaaggaaaactattagaaaaattaagagaaatagaaaaacaatgaattttacttattgaaagtaaaagtgtatgataaaaccataaagaacagcaaagaaaaatgaaacatttcttgctaagcgaaaaggaggaatcattcatggctaagcgacttcttgtaaaagtgaatgaagcagacaatgttgcaattgcagtgaaagaaatcaaagccggaacacaggtttcagaagatctggttacccgtcaggatattccacaggctcataaagtagcgcttgagagaatcccaaagggacagccggtgattcgttacggtgttattctggggtatgctctggaagatattgaaaagggagactggatcaatgaatttatgctggagcttccgacaccaccatctgttgatgatatggagtatggaaaaaagattgtaacagatcttccgacaccgccggtaacaacattcgaaggatataggaatccaaatggtggatatgccggaacaagaaatattcttggaatcagcacaacggttcagtgtgtaaccggtgtacttaatgtggcggtgaagagaatcaaagaagaactgcttccaaaatatccgcatgtggatgacgtagttccaatcaatcatgcgtatggatgtggtgtcgcaatcaatgcaccggaggcgaaagtgccgatccgtgctttacgcaatcttgtacatcatccgaattttggcggacaggtgatggttgttgcgctcggatgtgagaaattaacagtggaaaaattgctggacgaggcagatatttccccggaaaatgtaattgttcttcaggaacagaaaggtttcgatgccatggtaaatgccattatggagatggcagataaaaaacttgcaattcttgatcagagaagaagagaaacattaccgctttccgatctttgcatcggtatgcagtgtggcggaagtgatgcattttcaggcgttagcgcaaatccatctgccggatacgcagcagatatgcttgtaaatgcaggtgcaaccgtaatgttttcagaagttacagaagtaagggacggcgtacattatatcgcagaacgctgtgtgagcaaagaagtctgcgacaaacttgcggcagagatgaaatggtatgatcattatctggaagagggaaatgttgacagaagcgctaatccaactccgggaaataagaaaggcggactttgtaatattgtagaaaaagcaatgggctcgattgcaaaatcaggaagctcaccgatcgtagaagtattatctccggcagagcgcccatcaaagaaagggcttatctatgcggcaacaccggccagcgatattgtgtgcggaccttgtcagcttgcctccggtatcacattgcaggtatttatgaccggaagaggaacaccttatggacttgcagcagcaccggttattaaagtctgttccagaaatgagatgaaagagatgtggcaggatctgatcgatatcaacgcaggtccggttgctacgggtgaagcacagatctcagatatcggtacagaattatttaataaaattattgcggttgcaagcggaaaagatcagagctttgcagaaaaatataaactccacaatgatctgtgcatctttaatccggcaccgattacctaagatgtgtttttgaaaaattcttagtctcctaaaaagaatatagagctggccgcagagcgtgctgcggccggcaaatacacgaacagaaaaagaatcttgtcccaaatgctgcggagaagattctttttctttttataattgtagggaataaatttgttgataaaatagtgaagtgcgtgataaggtaaaagaaagtgaattatagtcggaggcatttattatggttaaaataggaatgtttctcccggaagagcggaaatgcaagcattttacacctgttttatgaaattttgcttggctctgaacagttatgtcatattataatatccggcataaataccatttttctcaagcagagtttcatgtgttccgcgttctgcgataccattttctgtaataacaataatctcatctgcatttttgatcgtggacagacggtgtgcgattgtgatggtcgttctgttcttggacagttcttccagactgtgctggatccagcgttcactctcgttatcaagagcactggttgcttcatcaaggatcaggatcggtggattctttaagaagacacgggcaatcgagatacgctgtttctgaccaccggaaagtcttgcgccgcgctcgccgacgaatgtatcgtactgatcaggcagttccatgataaagtcatggatgtttgcacattttgctgcttcgatgatttcttcttctgtcgcatccggcttgccataggcaatgttgtcgcggatggaaccggagaagaggtagacatcctgctgaacgacaccgatctggcttctaagactcttcaatgtaagagagcggatatcctgtccgtctactgtgacgcgtccgccagttacgtcgtagaagcgaggcaacagggaacagattgttgtctttccaccgccggatggaccgaccaatgcaactgacttcccagcaggaatctcgatcgatacgtgagagagaacagtcgtttcatcgtcgctgtaatggaaggagacatcttcgtagcagacacggcctttcacatctttgagttctactgcatccggtgcatcctgaatctcaggttctgtctccataacatcaaggaaacggcggaaaccggaaagtcctttctgcatcatttccatcagctctacgagaatctggatcgggctgataaagattccgatataaagagcatacatcgcaagatcagcagctgacatttcattgttggcaatcagatagccgccgtatacaagtgtgaccagatacatcattccctggaaaaagagattggagctcatgaattcgcccatgcatctgtaattgtctttcttggagacaaggaaggcgtgattgctcttctggaatttttccttttcgatctcttcatttgtaaaagactggacaacgcggatcccggataaagtatcttgaaggctcgcattgacatcaccgattttttttctgttttccataaaggtgcgctgcatcttctgattctgtcggaaagagaagaggaacatcaagatcacaagtacgatcagcggaagagccagcttcttattaattaagaaaaggaaaataaaggatccgacgatcttaactaatgagataaataagttctccgggccatggtgtgcaaactcggaaatgtcgaacaggtcactgaccagcttactcatcatctgaccggagttgttctgactgtaataggaaaaggacagctcttcatagtgttcgaagagttcctgacgcatatcccgctccatcttagcgcccatgatatgtccctgacagctgacataatatttgcagaagctttggatgacatacatcataaagagtccgatcgcaatccacggaagcgcctgcaggataattgctttatcctgagtaaaaagtgtcttggtcgcacttcgtagaatctgcggataagcaagatccacaagactgataatggctgcacagagaaggtcaataaaaaagaccgttttgtacgggccatagtagtggatgaatttttttagtgtattcataaacaaataaatcctccttcgtattttttcttatatacattagtttagcataagtaaatattcttgacaagaaagtcggggtatgataaaaatgttattactgttaaaaacaatgcaaagaagtggaaaaagtcaggagaacgatcaatgaatttatatcttgccccattggaggggatcacaggacatatttatagaaatgcattacatcagtgctttgacggattcgataagtattttattccgtttatcagtccgaatcagaaaggacatttcagcacaagagagaagaaggatgtgatgccggagcataatcagggaatgtatgcagtgccgcagattcttacgaataacgtggaagatttcttgtgcacagctcagaaacttggagattatggatataaggaagtgaatctgaatcttggatgtccgtctagaactgttgtgacgaagggaagaggagcgggatttttggatgagccacagaagctggatcgatttctggatgcggtttttgagaaatgtaatctggaaatctcaatcaaaacaagaatcggaatggaagatccggaggagtttgagacaatccttcctatctataataaatatccgctgaaggagctgatcattcatccgcgtgtgcagaaggagttctataagaacacaccaaagcttgatacatatgcctgggcagtggaacatagcgaacatccgctttgctataatggggatatttgttctgtggaggacatggaacagttaaaaataagatttccacagacagatactgtgatgatggggcgcggcgtgctggccgatccggcacttggaagaaagctaaaaggcggaagtgccgcaacgatagaagagctaaagaaattccatgatgttctctatgcggcatattgtgaagaaatgtcaggagaccggacgattctctataagatgaaagaaatgtggttctatcttcatcccatctttacagatggaaggaagtatttcaagaagattaagaaatgcgagaaatgtgtagtatatgaatctgtagtgaaggaattgtttttgaaagagaatattctggaaaaatgatttacgcgagcaacgagccaaagtccgtgcttgcacgagaccttggcgactgccctttctttaacgcaatctattgtttttcaagtatgagcaagcatgctccacattcgtcttcattcctgtatcactcttctaacatgaaacttcttcaagctcatattttctgttttctgtttattgaaaaagatagacttctacgctaaattttattaaacacaaacacgtttgagagatggatatcattctacagaacatccgatgcatctgcttcttaagtagagttcttctttcaagagagtagaaatcagatagcgacgaaaaagtctgtctattagaataaactttataagtgctatcggatttcgtccgcactcgaaaaagaatctctacaccaaatctttatttgtataaaaatatccccatagacgatttctcatccatggggatatttttttatgtcagcatattaaatatgctttttttcttattcttctgtagactcttcagtttctgttactgtttcctcaactgcatctgcatttttgtctacaatagcttcttctgtaagttcatctgtcagatcagcattctcgtcgaattcaatgtcatcttcaagatccagttcatcttccatcttaatatctgtgttgagttttacatcacggtacttcttcatacctgttccggcaggaatatgtttaccgatgataacgttctctttcagaccaaccagatggtcaactttacccttgatagctgcttctgtcagaacctttgttgtctcctggaaggaagcggctgacaggaaggattctgttgccagagaagcctttgtgataccaagcatgatctgctctccggtagccggctcttttccttctgcagcaagctgctcgtttacttcttcgaactcaagaacgtctaccattgttccaggcaggaactctgtatcacccttctcttcgattctgatcttcttcagcatctgacgaacgataacctcgatatgcttatcgttgatctcaacaccctggagacggtatacacgctgtacttcctggagcatataatcctgtgttgcacgaagtcctttgattttcaggatatcatgtggatttacgctaccttctgtaagctcatctccggcttcaagcataacgccgtcctgtactttgatacgtgatccgtaaggaataagataggatttggattctcctgtctcttcgtttgtaacgataacctcacgtttcttctttgtatcactgagtgttgcacgtcctgcgatctctgtgatgatggcaagtcccttaggtcttcttgcctcgaaaagctcctcgacacgaggaagaccctgtgtgatatcgtcaccggcaactccaccattatggaatgtacgcatagtaagctgtgtacctggttctccgattgactgagcggccatgattccgactgcctcaccaacctgaactgcctcacctgttgccatgttcgcaccataacatttggagcatacaccgttcttacatttacatgtaagaattgtacggatcttaacctgctcaagaggatttccgttctcgtcaacacctttcttcatcacgcgctctgcacgacgaggtgtaatcatatggtttgcttttacaaggacgtttccgtctttatctttaagatcctcagcagcaaatcttcctgtgatacgatcctgaaggctctcaatctcttcatttccatccatgaatgcagatacatacattcccggaatcggctgacccggttttgcacaatctgcatcgtgaatgataagctcctgagatacgtctacaagacgtcttgtcaggtaaccggaatcggctgtacgaagagctgtatcggccattccttttcgagctccatgggcagacatgaagtattccagtacgtcaagaccttcacggaagtttgacttgataggcaactcgatcgtacgacctgttgtatcagccataagtccacgcatacctgcaagctgtttgatctgcttgtcagatccacgggctccggaatctgccatcatgaagatgttattgtatttatcaagacctgtcagcagtgcctctgtcagtttatcatcagttgctttccatgtttcaacaacttctttgtaacgctcttcctctgtgataagaccacgtttgtagttctttgtgatcttgtctactgtatcctgtgcttcctgcatcatctgcggtttctgcggtggtacagtcatatcggaaatggatactgtcatagctgctcttgtagagaacttgtatccgattgccttaacatcatcaagaacttctgctgtctgtgtagctccatgagtgttgataactttctcaaggatctgcttcagctgtttcttaccaacatggaagtcaatttccatcttaagttcatttccctcaacctcacggtctacaaaaccaagatcctgtggaatgatctcgttaaacaggagacgaccaagtgttgcgtcaatagttcctgtcttctcttctccatttgcaagagtctttgtcacacgtactttaatctgtgagtgaagtgtgatatatccattctcgtatgcaagaatagcctcgttcacgctcttaaagaacatgccctctccctttgcaccaggacgaagctgagtcagatagtaaataccaagtaccatatcctgtgaaggaacggctaccggaccaccatcagatggtttcagcaagttgtttggtgaaagaagaaggaaacggcactctgcctgtgcttcctgtgacagcggtacatggacagccatctggtctccatcgaaatcggcattgtaagctgtacataccagtggatgaagcttgattgccttaccttctacaaggattggctcgaatgcctggataccaagtctatgcagagtaggggcacggttcagcataaccggatgctctttgattacttcttcaagcacatcccatacctctggctgaagtctctcgaccattttctttgcatttttgatattgtgtgctgttccgttcgctacaagctctttcataacgaatggcttgaacagctcgattgccatctctttcggcagaccacactgatagatcttcagttctggtccaacgacgataacagaacgtcctgaatagtcaacacgttttccaagcaggttctgacggaaacgtccggacttacctttcagcatgtcagacagagacttgagtgctctgtttccaggtcctgttaccggacgtccacgacgtccgttatcgatcagcgcatcaacagcttcctgaagcatacgcttctcgtttcttacgataatatctggtgctcccagttcaaggagtcttctcagacggttatttctgttaatgattcttctgtacagatcattcaggtcagatgttgcaaaacgtcctccatccagctgtaccataggacgcagatccggcgggataaccgggatagctgtaaggatcatccactccggtctgtttccggactcgcggaatgcttctacaacttccagacgttttacaattctcgcacgcttctgtcctgttgcattctccaggcctgcctgaagttctgcatattctttctcaaggtcaatagactcaagaagctctttgatggattcagcacccatacctacacggaatgcatgtcttccccatttttcctttgcttcctgatactctgcctctgaaagaatctgcttgtaagagagatctgtctctcccttatcaagcacgatgtaagaagcaaagtaaagtactctctccagtgttcttggagaaatgtcaaggatcagacccatacggctcggaattcctttgaagtaccagatatgggataccggtgctgccagagcgatgtgtcccatacgctcacgacgaacactggcctttgtaacctcaacaccacagcgatcacatacaacacccttataacggatctttttgtatttaccgcagtgacactcccagtctttgcttggtccgaagattctctcacagaaaagtccgtccttctccggcttcaaagtcctgtagttgatggtctccggctttgttacctcacctctggaccactccaggattttttcaggtgaagccaggccgatcttaatcgcatcaaatgttaacggttcatattgttgttcattgttatttggcataaaaacggctcctccttattattcctcacccaggtaatcatcatcatcaaaacttaagttctcaagatcactgtcgtccggctcttcgttcagtttaacatcttccagttcttctccgacaaactccttctctgtgaatccatgatctctgaaagattcattctcatcacgatactttctgtctccttcgatgatatgacgcaggtctgtctcaccgtaatcaacgctctccatgatcttaacctctgtattgtcatcacgcagtacgcggacatccagagcaagtgactggagctctttaagaagaaccttaaatgactcaggaactcctggttcaggaatattctctcccttaataattgcctcatatgtcttcacacgtcctacgacgtcgtcagacttcactgtcaggatctcctgcagtgtataagatgcaccataagcctccagggcccatacctccatctctccgaaacgctgtccaccgaactgagcttttccacccagcggctgctgtgttacgagagagtaaggaccagtagaacgagcatggatcttgtcgtctaccagatgatgcagtttcagataatgcatgtgtccgattgttaccgggctgtcgaagtactctcctgtacgtccgtcacgaagacgaaccttaccgtctcttgacagcggaacacccttccagagttctctgtgatctctgttctcagacaggaactggagaacttctggacgaagctcttcgccatgtttcttctcgaactcatcccactcaaggtttacataatcatttgccagatccagtgtatccatgatatcgttctcgttcgcacctgcgaatacaggagttgatacgttgaatccaagtgcttttgctgcaagactcagatgaatctcgagcacctgtccgatgttcatacgagaaggcacacccagtgggttcagcacgatatccagaggacgtccattcggaaggaatggcatatcttctactggaagtacacgggaaacaacacccttgtttccatgtcgtccggccatcttatcaccaacggagatctttctcttctgagcgatgtaaatacgaactgcctgatttactccaggtgacagctcatctccgttttctcttgtaaatactttggcatctactacgataccatattctccatgaggtactttcagagatgtatctcttacctcacgtgctttctcaccgaagattgcacgaagcagtctctcttcagcagtcagctctgtctctccctttggagttacttttccgacaaggatatctccggcacgaacctcagcaccgatacggatgattcctctctcatccagatctttcagtgcatcatcaccaacacctgggatgtctcttgtgatctcttctggtccgagctttgtatctcttgcttctgcttcatattcttcaatatgaacagatgtgtagacatcatcctgaaccagtctctcacttaagagaacagcatcctcgtagttgtaaccttcccatgtcatgaatccgatcagtgggttcttaccaagagccatctctccaccggatgtagacggtccatcagcgataacctgtcctgcctcaacgcgttcacctttgtcaacaattggtctctggttgtagcagttgctctggttacttctctggaattttgtcagtttatatgttttctttgttccgtcatcatgtctgatcgtgatgcttgtagatgtagagctttcaaccacaccagcctgctctgcaacttcagccacaccggagtcaacagctgtcttaacttccatacctgttccgactaccggagcttctgttgtaagaagcggtactgcctgacgctgcatgttagatcccatcagcgcacggttggcatcatcgttctgaaggaacggaatcaacgctgtagccacggagaacaccatcttaggtgatacgtccatgtaatcgaatttatttctttcgtagtcctgtgtttcctcacggtaacgaccggatacgttcttattaatgaaatgaccttcttcatcaagaggtgtattcgcctgtgctacatggtaattatcctcttcatcagcagtcatatatacaacttcatctgtaacaaccgggttcatcggatctgtcttgtcaactttacggtatggtgcttcgataaatccatactcgttgattctcgcataacatgcgagggagttgatcagaccgatgttaggaccttcaggagtctcgataggacacattcttccatagtgagaatagtgaacgtcgcggacctcgaatcctgcacggtctcttgacagacctccaggaccaagtgcggagagacgtctcttatgtgtcagctctccaagcgggttgttctgatccatgaactgtgacagctgggaagatccgaagaattccttcactgctgctgttacaggcttaatgttgatcagggactgtggtgaaataccatcctgatcctgtgttgtcattctctcacgaacaactctttccagtctggacagaccgattctgtactgattctgaagaagttctccaaccgcacggatacgtctgttacccagatggtcgatatcatcatcatttcccatgccatactcaagatgcatgttgtagttgatagatgcaaaaatatcttcttttgtgatgtgcttcggaatcagatcatgaagatctctcttaatcagtctcttcatctcatctacatcacctgcagattcttcaatgattcctgcaagaaccggataatatacctgctctgtcacgccaacctcggccggatcaatatcaacaacagcctggaggtcaaccatcatattggaaagaaccttgatatttctggaagtctcttcaccctctacccagatgtacggtactgccgcattctggatcatatcagcgatctcacgagtaatctttgttcccttttcagcaacaacttcacctgtgatcgcacttacagcatcctcagcgaggatctgtcctgatacacggttcttaagaagaagcttcttattaaacttataacgtccaactttggcaagatcataacgtcttggatcaaagaacatgcttgtaatcaggctttctgcactgtctactgccagcggctcgcccggacggatcttcttatagagctctaacagaccttcctggtagttctcagaagtatcttttccaaaacttgcaagaagttttggctcttcaccaaagagttcaatgatctctgcatttgtacctactccaagtgcacggatcagaactgtgatcggcacttttcttgtacggtctacacgtacatagaaaacgtcattggaatcagtctcatattccagccatgctccacggttcgggataacagttgctgaataaagtttcttaccgaacttatcatgtgcgattccataatagatacccggggaacgcacaagctggctgacgataacacgctcagcaccattgataacaaaagtacctgtctttgtcatcagcggaagatctcccataaagatctcatgctcgttaatctcatcagtctccttattataaagccttactctgactttcagaggtgctgcataagttgcatcacgttctttacactcatcaatcgtatattttgcatcttcctcgcagagtgtaaaatccacaaattccagactcagatgaccattgtaatctgcgatcggggaaatatcatcgaatacctctttcagtcctttgtcaagaaaccactgataggaatctttctgaacttcaatgaggttaggcatctccaatacttcttgctgcctggaatagctcatgcggaagctttttccggttttgatgggacgaattctgtttttctccattgacgtttcactcctcatttattgtttttgcaggcaataaactgccttttacgagttccagttatataaaaatgaaaagagccttgcgacagtattctctgtcactatatggcatacctttccacaatagcgcattttctactatatcacaaagctctttttattgtcaacatgattcttgtgttttttatatttttcttgacttttttctcaagatatgttatatcttccgctattctaagctttttccttttgaacagtatctttttttcagaaataacttctatatcatatcttcataaagacagatcagctcacgataaacctgaacacaccgctcaatatccgcaatttcaacatactcatccggtttatgagcctgtgcaagatttcccggcccataagacatacaattcggatttcccaaaagacctgccacaactgctgtgtctgtataacccgtgaacgctgacacaaccggatcttttccagtaacttttttcactgattcagataaagctttcataagacctgactccatgtgtgtctccaccggtggtctgtcacctgtaatcttataagaaccctttacacccggaactgcattttccccaatttcaattgcttttcgaacaatcttttctgcctcttgtgtattcatcggcggaacaagacgcatatctatcgtcaccatgctgtgatctgatactacatatggactgtatcctccggaaatctgtccaaatgtaaccgtagactttccaagttcttcatgtgtcggtacttttcccatcgcttttcggatctctgcgatcataaatgcgattccggcgattgcatctgcccccttctccggcatactcgcatgtgcagtaataccttccacattaagttcaaaccaggttctccctttgtgagccatctgaatcattccggaagtcggttccatatcaagaacccagtcttccttctgaatccatccttgttgcactgctgcttctgaccctttcatatctgcttcctcgtctactgttccgataaagactaatgttcccggaagtttttctatatcctcagcattctctttctgtgattttgccacctccgcaaatgctgtcaacgcacttgcaagtcctgacttcatatcacaagctcctcgtccccagattttcccatctgaaacttctgcgccgaatgcattctttgtccatccttcgcccttaacaaccgtatccatgtgacagataaacaccagtgccggatgcgctttcgcacctttcacaacaccttttacaatttttcttcccggctctacttcgtaagtctctgtatctgctccactctctttcaaatagtcgcagatatattcaccaatctcggtttcccagattcctggatccgtactttctatcttaatcagttctctcgtcaactcaactgcatccatttctaacgcctctttcgcaaaaagaccgcagaagcatatcatcttctgcggtcggaataaacttatattcaggaaaattatttaagagtaacctctgctccctgctcttcaagtttagttttgatttcctcagcctctgctttagaaactgcctctttaactaccttcggagctccgtctacaagctctttagcttctttaagtccaagacctgtgatctcacgaacagccttgataacttttactttagatgatccagcggatgtaagctctacgtcgaactcatctttctctgctgctcctgcaccctcagctgctgctgcaactacaacgcctgctgctgcagatacgccgaactcttcttcacaagctttaacaagctcgtttaactctaatactgataactctttgatcgcttcgatcatttcagctgttgtcaatttagccattttaaatatcctccatttttcttttcattcttaattaattagatgagcatctgctcatatatgctgtctgtatccagatcagctgacgcatattactctgcgtctgttgctgtctcctctgctgcttctgctggagccgcttctccaccctgctctgcgatctgtttgataacacgagcaaagtttgtgataggtgactgtaagcttccaagcaacttggaaagcagttcgtctcttgaagggatcttagcaagttcagaaatacctgctacatcatatgctgttccttcaactacaccacccttaagttcaagtgccggagcatcctgtgcaaatttgtaaaggattcttgccggtgctgttgcgtcatctttagaaatagcaatagcgcttggtccttccaggcagtcatcaagggctgcaaattcagtaccctcgaaagctctcttcatcattgtgttcttgtaaactttgtagatcacaccagcttctctaagctgtttacgaagctctgtatcctgagcaactgtaagtccacggtagtcaacgagaactactgactgagcgtctttaatctcttctgcaatcttgtcaacgattggctgttttacttcaacctttgccacttttcggtacacctccttatattattcgtgtactgccaaagttcccagcagatcactctgctgaaactaaaaaaatctccaggtccaaagacgtggaggttctacaaattcatacgcatgtaaaaattcattcttcctcggtaggcgttcataacttacgcttttcagcacctactgtcttcggcagttgctaggctataataccatgttattttccatatgtcaagcctatttttcatctttttctttttttctttttcaaaagaggatccgccgaaagcagaccctcctctatgacagtctcgcaactgtctcttttacattttattatgcaagcttaaccgggttaacctttacgccaggtcccattgtagatgtaagagttacactcttcaggtactgacctttaacagcggctggtctaaccttgttaattgcatcgataagcgtctggaagttgtccgctaactgctcctctgtaaaggatgcttttccaaccggaacatggataatgtttgtcttgtccagtctgtactcaatcttaccagctttgatatcgttgatagcttttgtaacgtccattgttactgtaccagccttcgggtttggcataagtcccttaggtccgagtacacgtccaagacgtccaacaacacccatcatatccggtgtagcaactacaacgtcgaagtcaagccatccctcgttctgaatcttcgggatcagttcgtctcctccaacgaagtcagcacctgctgcttttgcttcctctgccttagcgtccttagcgaacacaaggatgcgaaccttcttacctgttccgtgtggaagaactacagcaccacggatctgctgatcagcgtgacgtccgtcacaacctgttctgatatgagcctcgattgtctcgtcaaactttgctgttgctgatttctttactaatgctactgcttctgcaggatcatagagatttcctctttcgatcagttttgcagcttcgatatatttttttcctcgtttcattttacaataacctccttgtggtattggcgggaacttgcccctcccactttatgaatttactaaacaattgaactctcagcgctctctcccccgaggacaccggaaaaggtcggctgattgtatcctacaatataatcgttataaaatctggattagtcttctacaactacacccatggaacggcatgttccagcgatcatgctctcagcagcctctactgtagctgcgttcaggtctggcatcttcttttcagcgatctctctaacctgagcttttgtgattgtagcaacttttgtcttgttcggtacaccagaaccggactgaatcttacaagctttcttaataagaactgctgccggtggtgtctttgtgatgaagctgaagcttctgtcattgtaaacagtgattactacagggatgataagatctccctgatctgctgttctagcattgaactgttttgtaaattctacgatgtttacaccgtgctgtccaagtgcaggaccaaccggtggtgccggagttgcctttccagcaggaatctgtaatttgatatatccttctactttttttgccatttcaattacctccttgtggtattggcgggattctcatccctcccacgcaattttaatccattttcttcacttctgaaaaaccaagttcaaccggagtttctcggccaaacagctcaacattgattgtcagactcttcttctgttcgttgattgtctgaacagctccaactgttccttcccatgcaccgctaagtacagttacaacatcaccgatctcaagatcaaggatcacctcatcctgtttgattccaaggttctccatctcactctcatcaagcggtaccggcttggatccaggtccgacgaatcccgtaacacctcttgtgtttcttacaacataccaagtgtcatcattcatgatcatgtggatcataacatatccaggaaacatctttctctgtacgaccttttccactccattacgtatctcaggtacttcctcaagtggaacacgaacttccaaaatctggtcttccagatgacgagtctcaattgtcttgtcaatgtttgcttttactttgttctcataccctgaataggtatgaacgacgtaccattttgcctctgacataaaatcacctttctgctgcgatcaactatttcactaaaaagtcaattccatatctcaaaagcgcatcaactactgagatcagcgctccaagcactacggagacagcaacaactgccgtggtctgtttagcaagtgtattcttgtctggccaaacgatcttcttgaactctgccttaagtcctttgaaccagctctttttctgagtttttgtattctcacccataattccacttcctttcgacaacaattattttgtctctttgtgcagtgtgtgtgatttgcagaatctgcagtacttcttggtttccatgcgttccggatgagtcttcttatcctttgtcatgttgtagttacggttcttgcattccgtacattccagagtaattcttgtgcgcacaacttccacctcgcttttaatatattcacctacgtgttgctgatggttgcgagccatcaatttttaggcataaaaaaaaagcctacttccattcgcccaaacattgtatcatggggacaaacagaagtcaagcctctttcttaatttttcaatttagcatttctatatccgctactttgtgtttacatccgcagttccgtatcattcaccttgttcttccgacttctcatcgtaagtgtcaaggaaatgatgcttctcaccttttgacttatacgcaactacagtatccagatttacattttcaacactcttgaaaatattcccttccacatatggatttacttttttcaatgtagcgattaattctttgatttctttacgcttagaaagattctcttcattctcagttgtagcgcacgcttctgtaaacttacatgcacactgaagaaaatgcagatcattataatctctccatgctttgatatcttcttcgcgaaccatatagagcggtcggatcagttccattccttcaaaatttgtactatgcagcttcggcatcatcgtctgcacctgcgctgaatagagcatccccatgaggattgtctcgatcacatcatcataatgatgtcctaatgcaatcttattgcatcccatcttctgcgcatgactatacagatatccacgacgcattcttgcacagagataacatggtgacttttctatattaaaaactgattcgaaaatatctgattcaaaaacctctatcggaatctccagacgctttgcattctcctctatcacctgacggttaaccggactgtaccctggatccatcacaagaaacttcacctcaaaatcaaacttattatgacgcttcagttcttgaaaaagctttgccagcaacatagaatcttttcctccggaaatacagacagcaattctgtctcccggttttacaagttcatattcattgattgcctttgtaaatttacaccagatattcttcctgaatttcttgcgcagactctgctctacttcctccgcaaagcttaattctttctttgacttactcatctctcttcccctgtcgttctattcacattttgccaaatctttaatcacttcacctgcaatgatcaaccctgccactgatggcacaaatgccacactgcccggagtggatctgcgttttgcagccttgtattccagattttcctgacaagtttcctccacattgcaattatctgaagtatcttccaatggacggatcggctcttcttctgaatatacaactttcagtttcttaacaccgcgtttctttaattctcgtcgcattaccttcgcaagtgggcataccttagtcttataaatatccgtcacacgaaacgcacttgcatcaagcttattccccgcccccatgctgctgatgatcggtatatccaattctttacacttcataactaaagcaattttagctgtcactgtatctaccgcatccacaacatagtcatattcttcaaaaggaaattcatctgcattatccggcagaaagaaacaattgtgaatgttcacttccgcctccggattaatatcgagaatcctgtccttcatcacttctgttttatattgaccaaccgtctttctcgttgcaataatctgtcggttcagattactcatacagactttatcattatcgatcagatccagctttccaactccgcttcttgcaagagcttcacacacgtatccaccgacaccaccgataccaaatactgcaacgcgggcatcttccagcttgttcattgcttccttgcctaaaagcagttctgttctcgaaaactgtgttaacattctcggttctcctcttctattcctcttacataaatgttccgccgcccggaccgcctcccaggcacagtccgccaccgttacagcaaatattgcacatcagattggcaatacataatttcacgcaccagctgctattataggttccgggatatccgtacatcgtctgtcttgtctgataccagtttcctccaccttccagctgttgaagcaacatctgatactgcatattctgtggctccagacgaactgcttctctcgcatgttccaatgcggtcacgttatttcctaatccggaattcgccgatgcgctgtagaaataccatcttgcactatgctgactgattccgtcaagtacgttaagagcctctttataatgtccgcttcgtatgtaattagctgccgcattcagatgtgcatcttcctcactcatcccggaagttctacccgtacttcctgctgaaccatatccataagaaccaaaaccgccgaatcctccaaacgggtcaatgcaagcattttatacctgtttttgaaattttgcttggctctgaacagttacatattctatttgatataaccaataaatgtatttccgcttccggaaaccattccttccatctcactgatggaaactgtctgtgactctccattttcaggatcgatataagtaatatcattcttcgtatatcctgtcagaagaattgcatgatctgcacttgtaagtgcaatcaccggacatcctctattgatcacgtagagtacctgatccagcgtacatcctgtcagatctactttctgagcatcatatgtcttcatataacgctcacatgcttcaattgatgtctcttctccttccttcgaaagagcaacatcctctatcgaatacgaaagatctcgatttcctttctcccagacatatttctggtcagaagagatcacaactcctgaaatctgctgtgctttctgaatggcataagaagctttatcataaatccctgccagttcaccgaccccatagacatagtatttcacactttcgcttctatcagcaagaaccatctcaagttcattctttgatgccagctgattcggtcggatcactttcacgctcttatctcctgctccctctgcaaatgtaatccgcatctgtttttccatcagtgctgttgtatatacttctgttttaatcgccgtatctttgcgttcctcattattcgtaataaactcctgtgaagtaacgttgtaaatatccccgcgtttctctacacgattcagtgttaccatattgtcatcaattaaaatatcagaaatataaatgcctttatcaacaaaggaataactggcaacttttttgttcttagaattacggatttccagttcatacattggagtgatcgattctccggaagctttctttcctgcgtcctcggatttcatttttccataaataaagtctccgttaacaaatcctaatgggctgatctgttctccttctgcggcctcgactatataagtatgcagactgctcaaattcataacctgaatctctgttccaccttttttgttcccctctgactcataagccatcagatgtccatcaccagaaactgcatactgtccttctttaagattctctgcaagtgttgtctgtttattctttttcagatctacctgatacaaagttccgtctgccaaaacatataactgctcttccgcatgattataataaaccatcttgccaagctcatccgctgcgattgcataggacttcttacttggtataaatgctttctcctggatcagatttctctctacatcaaaataatagattccgacgccgacttctccttcgtgttcgccacgattcatatatccatacacagcaaatgcaagattaccactgttgtccatactgatgatacgaaccgcatgttgatcattcagattcctttcatctgtcgtatctgcatctgcaaatccgaaaatatttaataattcattcgaactcttattgtacatccaaaggtttctggactccacaaatgctgcaatcgtttctttctcatttgtctcatacggaacatctgaaggtgtaacgccgagcaaaattccgtctttatcgatcacacttctattctcactgaatacttcctgcatatcacgattgtaatccaacaggtaaattgtagttcctgcgattctcacacggaaaaattccttaatgtcatacactgcattctcaccgacatcatccacgcaggaaactctgtaattcgcaagaagagatgtatacacactattactttcctttatactccaacgcacatcaccaagcaactgtggctgcatagttccccactgaatatgagaaatatctgaatggatattgactgtctgataagttgtattatcactctcatctccaggttccagataaatattcaatgaatctacatccgtcttattaaatgctttcgtatgaaaatcctgtgcaaatgtaagacattgtgatgctgtaatatcatctgctttctcaattcttgtataaaaattaactttccttgtctctttctcctcgccgatcacaagcgaaacctgaagtactgcctcctggattttatctccaagtgattttcccggctttaatgtgacatcttcgctttctgcagactttagagttcctttatcatatgtctctgttccatccagagaatatacactgtaactgatctcccggatctggttatcatttttctcaatctgcatcttcagtgtaccatcactctctaatggtgtaatggtatctcgcattgcggcaatatccatatcatctacataacctggcaacgcatttatcttctgtcctcccatcataaatgagactctaggtaacgtggcatctcccatatccacaacctgatcatcatttccacggttcagtatcacattactgatcaccagcacagccgcaaaaagaacaaccagtgcggcaatctttattaccctttttttcattatttatctcccttttgctctgccagaagcatacctaacgttggctgaatcttcaaaaatctttcacaatcctctgcctcttttctgctctttgctgcaggactcccctttttcactgcacgcagcagaatattcttcggcgtatgctccatatcaataaattctaatacctgagtttcatatccctcgctttccagacgctttgctctaagtccatctgtcacaagtgctgcaaaacgctctcgcaacaatccataatccataattggtccgagcacttcttccatggaagctagttgatctcccagcatttctgaaacttccataacttccgtcttcgatttcatcttgcctgaatgcagatttctctgcttttcaagctgcttgttcacctcatgctgacaacatggaacagacaaaatcactttcgcattccagccaaccgctttcgcaagtgcataatctgtagctgtatcacacgcatgaagcgtcacaaccatgtcaacctgatccacaccttcataatccgcaatatctccaacaaggaatgtcaacttctcatatccatacttctttgccagttcattacaatgcagaatcacatctgtcttcagatctaatccgataatacgaatatcatattcttttaactcgtgtaagtaataatacattgcaaatgtaagatatgattttccacatccgaagtccagaagtgtaagctctctgtccttgtcaagctgcggcagaatgtcctcaacaaattccagaaaacgattgatctgacggaacttatccatcttcgtccgcacaatctttccatcctgtgtcataactccaagatcctgaagaaacggaaccacaatcccttcttccaaaatatattttttcttcctgttatgagacagatccgcagctttcgcctgcaccttcttgcgctttctcttaatcgttgctttccctttcttactgatcaataccgtgatatcctcactcaccgtctcaacctgaacctgacgaaactcttccaacaatttcgcaagctcatcttttgtctcttctaccgtcagattcttatgaaatgcctgcgtctttgtgaaagactctaactgaaataaaagctcccccttctgttccatcggtcgaagctttgccttaactacattatcctttactcgcgggttactaaacaccgcacgaataaactctctattcaaaatcccagctaaaaactgtatgatttcttccatctaaatgacctctttttcttctataataagtagaatctcgaaagactcttcttactattttgcagaataaaaagggagatgtcaagggatataggggacgaaataaagatttatcgtagggattctttttcaagttcggacgaaatcagatagcgcttaagacaagtgcctgctcaggttaatgactaacggtgcgaaattgagaaaagaggaaggtagatttgaaaagaagacgcactttaatagagcttcacagaaaaagccctattaacagctattgatattagaatgcaacttttttattgttaaaatgtgttctgcctattgctttattcttctttcgtcggaatgttcttccaggcataatctgagatctgcatctgagagattccttatatagtatatcaagtacagataaatcgaaaagattagacaggattttgggaactattgttttgacacgtccgataataaatgctcggtttgcttggtatcgatatttattcgtacttttagcggtaatctgaatttcttcaacaacttgatttttaataagagatgacaggtttgaaagaagtacgttgatataaaattcctgaagcactgaagtggtcgttgcaccggaaaattcttcaatagcaaggcggcttttcaattccttatattttgtttcgactggccagcgatagaagtaaagttcgcggaacatctgttgagaaatatgtgaatcaaaaagattggtggcaagatactctttcgttccatcactgagaataacttcgttgactcttatcctgatatcctcagtcccgtctttttcgttgccgggaagaaccgtgattatgtctccagagcatttcttagcaatgttataattatgttttaagcgcataaggcaaaggtgctgatgctcgacacagtaacgaaacatatcttcagaataatagccacgatcaaagattacaacgctgttttgatagatatttaaatcttctaaattatgcaaatgctctaaagcagcggaacgttcagatgcaagatatcgctgaaaagaagcatggacgatataatcatcaagactattttggagccatcaatagcaaacaaatgatatccattccaaagtttacgaggcgggagctgcttataaaataaatcgactgataaatagtagagttctttaaacaaggccgggttaataaattggcgagcctttgacagagcctgctttgaaatatcagggaaatcaaggcatccaagatcttcctgaatacgggaaagattttgaaacatggaggtttttgaaatataaagcagatacataattacttgaaaaagagaaagttttcgtttgcgaacaaaatgattttttgcacgatgtggttccagtttttttggggttgtgatataatccttaatggattggatgatatttttgcagatgttaattcgattcatatgatatacctaaagtgtaattaaggttcgtggcgagacgaacaattctttaattaataggtcgcgaagcgacctcgcttttaggagattttgtcaagtactttttggtgaaaaaagaaaagaattccttcaaatgcccatgaaattagggctgaaggaattctaaaatttttctaaaattcttaagttgaccacattggtgtcaggtaccaataaatttttactaagaggtagacttggcagtggaatagataacaggaggaaataaacatgagcgagattaactttcaagagtatgagtattatatgaaaaatcgaccgcatgttgtaatactaggtgctggtgctagttgcgcagcgataccgacaggagataaatacggaagaaaaatatctgcgatgagcggttttattgataaactggggttaaatgaaataatctcaaaagtatcgattcatacttcatcagataaccttgaagatatatatatggaattggacgaaagaagtaagaatgagtcgacctgcaatgcagtgaaaaatgaattagaaaatgtcattcgatattatatgagtgactttgaattgccggacgagccaactatttatgatttcctagttatgagtttgaccaacaaggacttaatcgcaacatttaattgggatccattcttggtgcaggcaataggaagaatacaaaagtatacggacaatattccacaagtggcgtttcttcatggtaatgttgcagttgggtattgttcagatgataatgttattgggaatgttggtaggatatgtagatgcggaaaagcattaaagcctatgaaactactttttccaattaagaacaaagattattcaagcgatgaagcaatagcaaaatcgtggaaacaactgaaaaatgcgcttgaacgggcatatatggtaactatatttgggtacagtgcacctaaaagtgatgctgaggctgttgccatgcttaaacaggcctggggagctgttgatgatagaaagttagaagaaatcgaacttgtagatattagggatgagcagacggtaatagattcatggaatcagtttattcacacgcatcactattcctatcataccagcttttttgatacaactttagcaagatgtccacggagaagttgtgaagcgacgtttgatagattgatgaattgcatctggttagatgggaataaaggttttaaggaaggaatgagtttctcagatatagatgaaatgacatataaactgataattgaagaagagcaaaataaaggtaagaaagaagcactttcaaatccatatcactgattcgcgaaaattacaaagcctattatagaaaaaataggaggtacttcatatggcagtagtacaagatgcattttttattcctgatgatatagcaacagcattagcgaccggtttatatcgaagaatcggtagcattggaatgctggtggtctgactctattgaattatcataaacaaataaattcgcatttataaatcgcatatgaagtgatagacttatgaaaataagaaaagcaattaagtgtccagtacctgctatatatgtaggtactggtaagagaaaagaggcggaaaaaaggaatgaaaacaatcagtgataagatttttgaattattaaaagaaaagggaatgagtcagaaagaatttgcccaaagaacaggaattgcagagagttccataagtgattggaagaaaaaaagaacaaatccttaagacaagtgcctgctcaggttaatgactaacggtgcgaaattgagaaaagaagaaggtagatttgaaaagaagacgcactttaatagagcttagatatgtttctttgatggctatggttattaccggatataacatgttttttaagcttccatgttttgaaggggaaaatgagtatagatttgtaatatctagaattcatgatggcggtatttgtaagccagaagatagagttccagtttattttcggttgaagaatgggggtttaattccatatgtaaaagaaaaaatacaagacgtgaattcattaaaaagggttttggtcggtgcaaaaaatggtagtgacattgccgctattggattgaaacatttctttagaagtaaaggtctatatgtagatgttgaaaaatctcagatgccgttgcgatattgagcttatgaagttgcccacagtggggaacaacgatccgagcagaattctgtgagctgataatttaaagctcacaaattcaatactttagaatttgacaataacaatataggaaaggaataggtggaaattatcacagttttgagtgaaatattgtgtgaagtggacatgaaaatttttaaatcttatgaaatctggatgatagttggagcagctctacttataatattatattactatcacagggaaaagaaaaaggtacacaatgcgaaagaaaaagagttactaaagaaaggcgatatgcatgaatgtttttgggaagtactttccggtggatattttccagtactatttttctttatgtcattaggaaatatcactggatcagcatacctttttcctgtagctattgcagtagtcttagttattgctattgtcatgcaagttaaaatttatgtatgtaaagaggagttagtctctcggtcgggatggagttatgaagaagcggttttagaaaaaaagaaaaatatattagaatctgcatacaatattgtctatgcggttattgttcctattacaattctttttatttcttatgggacatgtagttcatattactcagttcctaagtcattttgtatccttttatttgcaattattgtgattactgtagcggcaattatgcaatgcaaacgctttaattacaaaaagaaaatgagaaaatatcagatggcaaaaaaggaaggtttatgtatggaggaattacaaatcgacaaaaagagttcattacgggaattagtgtattactgtacagagccggagccggtaggtgcattgatgtttactggcgaatggggctgtgggaagacatatttgattgatcatgaattgaaagcaacttttgatggtcagaacggaagagaagaaaaagttattattcgtgtctctttatttggagtgtcctcggtagagaatattcattcgcttgtgaaagaaagttggatggaagcgtattatgagaattttcctactgttcttaagaaaacaacgagatttctaaaaaatattcaatcttcaattgcaaagatggaaggaaacgatgagatgaaacttcttgcatctgtaggattgtcaaattttatgcgagtaaaaaatatcataaataagaaacctgtaatcttagtttttgatgatcttgaacgttgccagatggatctcatagatgtattgggatgtataaatgattattgtgaaaatcagaagttttatacgattattgtatgtaatccagataagatgcagtcagataaagagcgaaatgaagaggataaagcaaaggatgagttgattcagcttacatatgcagaaattaaagagaagattgtgcagagaacggttcaatataaacctgattatgaggctattgtccacaatgtgatcagggaattgaaatatcaggataaagagtatcaaggctttatagagaaacatgaacgagaactattagaattatttgcacccaatatgggtgtaaggtcaacaggagagaatgtgcaattacataatattagaagtcttaagtgcgcaattactgatttttaccgaatttatattatattggaagagaatggattctcagatgttgaaaggtggttgtatgcgtttacacgttatgtgattgcatataaagctggagttaaagctgattttaatcgtaattatatgttgaaagctattgaagaatggttattacatggaaattgggatgaagagcagttgcagtatgaaataaaagaaagaatagaacgggaaaaagcaaaaaaaccgacggatttacttcgggtaaatagaattatggatttagatgaggaagatgtaaacaatggatttcctgaacttattgaattggcgtatagtggaaaacttaccttggacgagtacgtcaatttgatacagaacagtgtgtgggcaaggcaatataagttcaaatttccaaataagattgagtggggaaaaatacgagaaggaatagcgggacgcatcaatcaattaaaagaggagcagccagaaggacagcagattcatacttgcatttcaaaagaaaacgagagtttatttgacaaagaggaatggaaaacgtatttgcttattgacgaatttcgtgaaggaaataccttattgttttgtagaaacagaaaaatatacatagatggaatgggaaaagacccattggaaacattgtacatttgccagaataatcgttttaatgcatttgatgatgagatggcgtctgctacggtgaaagcattcgaaaggtgtaataacgctgagaagtgtcgtttcccaggttattttgaaagaatatgggaaaattggcatgttatagctgagattgataagaaaaatacacaacaaggttttcaaatattgttgaaaaaattggaagaattgaaaaatgaacttttggagagtaataaagtcttttctattgcacatacagaggtatttatccagaacgtgcagaaattacttgaaaaaaattcattatgagcattagaattgaaacggtctcgtaagttttcggacagactataaattactaagaaaacggaagctttatttgggtaaagcctgataacgataccacattggtgtcaggcaccaatgtggtcaacctaatgtcaacttaagacaagtgcctgctcaggttaatgaacaccagccttccaagctggatacgtgggttcgattcccatcacccgcttttttgttgccctgattttggagggcagaatcaaagttgtacagaaatagcgcgaagcattttccatagattcggttttgataaaccggataaggaaagtgctttttttcaattatttttgtactattttttcgtcctgttaacgttgtttcttatatggagttgtgctatactttaagaaatatttttggggttacactgagcagtaacacattttggggaaattacagaggaagaggtagaaagatgaattttttggaagaaagaattgtaaaagacggtattgtaaaagagggcaatgttctcaaggttgacagtttcctgaatcatcagatggacattaaacttttgaatcagatgggtgcagaattcaagaagagatttgctgacaagaacatcaataagattcttacaatagaagcttccggtataggaatcgcctgtatcgtagcagaacactttgatgtaccggtcgtatttgcaaagaagtcccagagcatcaatttagacggcgagatgtatgtagcagaggttgaatctttcacacataagtgtaagaataatgtgatcgtttcacagaagttcctttcagaagatgatcatgtacttattattgatgattttcttgcgaacggatgtgcactgcagggactgattcagatcgttcagtcttcaggagctacagtagaaggtatcggaattgcaattgagaaaggattccagtcaggcggaagaatcatccgtaatcttggattccagctggagtcactggcaattgtggatggaatggacgcttctacgggtcagattttcttcagagagcagaatgcagagaactaaaagaccaatatttttaaaaaagctatagtaagcttaagaaaatcttttgaaacatataaaagcctcctttagatttacagagtattctgtagatatataaaggaggttatttttttaggaggaaacaaaatggagatcaatcacgtattaattgtagaggatgataaagagattagagaaggtgtacagatttatctgcagagtcagggatataaggtgtttcaggcagcagacggcattgaaggattagaagtccttgagaaggaagaaatccatctggcaatcattgatatcatgatgccacgtatggatggaattcgtatgacgatgaagttgcgcgagaaatacgattttcctgtaatcatgttgtcagcaaaatcagaggaagttgataagatcacagggctcaacatcggagcggatgattatgtgacaaagccgtttacaccgatggaactgatggcccgtgtgaattctcagctgagacgttaccggagattcctggagaagctcgtaccacaggagaatgtacatgtgatcggaggacttgagatcaatgaggatacggtagaagtcacaatggatggcaatccggtgaaattaactccgatcgagtacaagattctgcttcttttggcaaagaatccgggaagagtcttttcatccgaagagatttacgaaagagtatggcaggaaaaggcaattaatacagatacgatcatggtacacgtaagaaatattcgggagaagattgaaatcgatccgaagaaaccaaaatatttaaaggtggtgtggggagttggatacaaacttgaaaagcaaccgtaagataagaacaattataacgatagtaattcttagcttattcgcagtaggtgttgtggaaagttattatgtggtaagaaaagatatcgcatcaacatttacagtagaagatgatgttgaagagtgtattgagcgaatggactattcccttgcgacaggaaatcgccttctctataacgaggtcacagatgcgatggatgcatcggaacagatggaattaatgtcagacagtgcattctctctttttaaaaaatatatggattatcagatctttgacaaagaagggaatcccttgcttgaaggaaatgacgaccagacaaacgaggctttgcagtcagataattcttatgttcttaaaatcgaatataagtatggcacatccggaacaatgtcaaatgtaacagttagcggtacgaaactgtcaccggaagaagcgtacgatgtggagaaagatctgtcttattattgtatggatgcagatcttgaggatcagattgacgatgaagagcagacagatggaatcagtatcgtttatgggatgacagatgcaaattatgatgaattcatttctgcaaatcaggaggaagacgagtatgtggattataattattccatgttctggagttccgctgcactcttctttttaggagctctgcttgcagcattacttcttccatgtattccgaaagttggaagatacgaaggaaaattattccgtatgccattcgaacttgcagtgattctgggcttttgtagagaagagattcgagctgttaaaacatattcggatcttccagttacaacaaacatgatgatgtatttttcaccattgaattatgataaatgggcagaggagttggatgtgatttcttgggactcttatccgagttggcatacaaaagaagatgaagtaccgattgctgtgtgggcagcctttatgcataaccagatgagaggatttcagaagaagccatttttgatgatggaatcaacaccatcacttgtgaattgggatgaggaaaataatgtaaaaagaccggggatgaattacttatcttcaatgcaggcaattgcgttaggttcgaatagtgttctttattttcaatggagaaaaagcagaggatcgagtgaaaagtttcatggagcggttgttggtcatgatgcgtcagaaaagaatagagtttttcaagaagttgcttggattggcaaagatctagaaaagctaagcagtcaaatactaagtacatgtaatagggcgaaggtagctattattatggattgggaaaattggtgggctctttctgacgcacaagcaatatcgagaaaatttgattatacggaagaacttttaaaatattatcgggttttttgggaaaaaggaattgaagttgatataatttccatggatcgagagttgttagattatcagcttgtggttgctccgaccttatacttgcataaaaaagagtatattcataaagtagaagcatacgtggaagcagggggaatatatgtaacaacttattggagtggagtagtaaatgaaacagatttatgttttattggagagagaccacatgagagattgctaggattatcagttgatgagattgatgtggggaatgaatattttccaaatactttctcctataaagacggtgtatataaagccggtgtgttaagagaagttgtgacacttcaaactgcaaagccgttgggaacatacttgcaagattacaatgtaaatactccagcaattacagaaaatgcgtatggcaaaggaaaagcttactatgttgctgttcaaccagatctggaatttttgaaagaatttttgggcgatgtaattgaggaagcaaatgtggaagcaaatttgacggaaacattaccttatggagttactgtttcaaaaagaagtggaaaagaacagaaagatgatgtatattttcttcagaattttaacagacatcctgtgaagatggttttgaatgaatgttatacaaatttgattactgatgaaatccttacaggttcaataatactgcaaacatatcaatgtattgtgatgcaaaagaaataagattccgtaatagggaggaactcacattgaaatcaaaggtaaagacatttttaattgatattttacttgatattgtaggtggttttttcattgcgattggagtctataattttgcagtggcatctggatttccggtagcaggtatatcaggtattgcaatcgtgttttattatttttggaaaattccaattggtacaatgacgacaattttgaatattccaattattttaatttgttacaagttgttgggaaaacaattttttttaagatcaataaagacaatgttaatttctaatatactgatggactgggttgttccattgtttccaatttaccaaggtgatatgatgttatcttgtatttgtatgagtgtattctcaggaatcggatatgcaataatttatatgagagatacctctacaggtggagcagattttgttttgatggcaatacacaaggcaaagccacatatttctataggaaaaattatcattgttatggattttattattgtaattattggtggaattctgatgcatggaaacattgataagattatttatggattaattggaacgtatattctatcatttgtcgtagataagctaatgtatggcgttgatgctggaaaacttgctttgattgtaacagaaaagggaccacaaattgcggcaaaaattgatgagctatcacaacgaggggcaactttgattaaggcagaaggaagttatacaggacgtgaaaaagaagtattaatgtgtgcatgtaacaataaagaaatgtatacgattcaagaagctgtaaagaaagtagattcatcagcgtttcttgttataatggaatcgaatgaagtgcgtggaaaaggattcaagccaatataatataaaaattaagaagttctagcatggatcggtataagattggatccggaacattatctttgattatggaacgttatcacgtgggaggaattccgattgaagaactccagatgatgccaccaaaagaggtggaattacttttttatcctcagaaaaatattaaaaagaaggatattccagatttccagtactatttatacaggtcataagatgatatctaaaaacaagaaaacaaagaaagaaccaatatcattaggaaatgaagaataatacaaccaaccttgtgcccactgggcacgaagttggcacagtcactacggtgtcaggagaaatcctggcatcttttttatgtctttttacacttcaaaaaataatttcaaaaaatttctaaaatcatgtccgattttgtcgcttccaatacagaatatatggaaggcaaattgaaaatcctctgatttccaaaaatcacaaacgtaaaagaggttcagacagttcttccgattgcaccttgacaattgaaggagctgatacatcttgaggaacatgcttaccggagataatccggctcgtgcaggcgaagactcctacgggaagagcgaagcaataatgataccaccgaaaggtacaggacctctgctgaaacagagactgatgttgaaatcacagatacgttgtcaaaagaagtaaaaagatatattgatgaagggaagacacttccatgggtaatgggaggatttccttcagggtatgaaccaaaagctgcagcagatttccaaggatatttcagtggagaatatacatttgatcagatggtagatcagttgaaagcagattttgttgaattaaaaaaataaatttaagaagtgatagaaagacaggcattcatcggagctggatgaatgcctaaaggtgttaaaatggaaaaatacagaccgaaaatacatttttcagcagaagattatattataaatgatccgaatggattggtatattataagggtgaatatcatctttttcatcagtataatattaacgagcagatttattggggacatgcagtaagtaaagatttagtgcgttggaagagactacctaaagctattgcaccagataaaattggacaaatctggtctggtagtgcggttgtggatgaagaaaatcagcgaatggtagcattttttacttatagtgaacatgaaaccaaaaggcaaagtcagggagtagcgtttagttatgataaagggcgtacatgggaaaaatattctggaaatccgattttaacagattcaagagaagattttcgagatccaaaagtatttcgctatgaagaaaagtgggttatgattctttcaggtggagattgtgtacttttgtatgaatcaaaggatttaattcattggaatcaaatatcttctttcaaaggaaatcaagaaagtcatacgggggtatgagaatgtccagatcttttcccaatgatagttgagacaacagaagaaaggaaatatatacaaaagatgaaagggtaaaatacagggtgagagaaaagaattttagaaaattcaaaataacctaaaaattgacttataacatttgctaagttaaaatgaaataaaaacaggtaagtaaatagtgctctagatttcagtgtagatagttgagaggaaggtgttgggtatggcaaaaatagaaagatatataaatgaagattttgaacagttactttccaaaattgagaacggaataataaatggcagtatgtcagcaacgttagaagatgccagtgactttcaaagtggaactgcgcgttgtagcgttcgtgtttttgagcgttacagctatgccggaggaaacagagtgagtcttaacattacactttttcaaaatgacaaagatccagttcaactttccgcaattacagcgggaggaagccaagctgtatttttcaaaattaatacatggggggaagaggcatttctcgataagttaatcgagttgttggatttcgctaattgataactttacatttgtaggggcgataagctgtttatttgaggataccttcaattatgctgataaaaacggtgtaagacgaggatatggttacgaactcatgcaggctctggcgggctataccggatggaaatttgaatatgtgaaatgtgactggtctaactgttttgataagattgaaaatggtcatatcgcaaagccaatccaggttgataagttgctgtcgataatatcagaaatcataagacaacaagattagttttagttatagacataggatcatagagaagtgttgtgatatttcacttactaagactccttgtcgttggctgcatcatataaaaacgctttttacgttaaaaagtgctgtaattgaagaaaaaacacgatatcatgcgagtaacaaatcaaaatttggaggctattggaaatgactgaaagagaaaaaatgctaagtggagagatatacgatccaacagataaagaattggagcaactacgcctgaatgcgcgtaaattagcaagaaaatacaatttgacagatgaagatcagccagaagagcaagcacagatattgcaagaattactgccaacaacagaggagcttccgtatttgcaggcacctgtttattttgattacggatgcaatactttctttggaaaattcagttctgctaattttaattttacatgtttagatgtatgtgaaatacatataggcgataatgtgatgattggtccaaatgttacattggcaactcctatgcatccattattacctgaagaacgcaatatccgaaagagagaagatggtagtttttataatcttgaatatgcgaaaccaataactataaaagataattgttggctggcatctaatgtagttgtttgcggtggtgtcaccataggagaagggtgtgtaattggtgcaggaagtgttgtaacaagagatattccaccttatagtctggcagctggaaatccatgccgggttattcgtaagataactgagaaagatcatatgccagatggaattgaaaagaattgaaaacttcaagtttgaaaaattgagaaatcgtaaaattgaagaaagaagaaatgcacagttcttagcttatcgggagctgtgcatttctgtaaataaatacttttaatttagccgattacggcatcctctgctgtaaaatgttccagagaattttcttttacctgaatgcagatataagtaattccggaaatatcggatgcaaaaaactgacgctttgcagcaggcgcgatttttagccagtctccagttgaaaggctgatttcttctccatcaattatggctttgccgttacctgaaagaattccatagatttcttcattttctttatgagaatgaacaaatgggacatttgctcctgcaggtagttcatttaaactgatttctgcacctgttaaagacaacttttcatgcagctcaattcggttttcctttccaatagttgtttttgtgtaatttgccataataatacctccatagttaatttgtagtttcagggttgcgtggtattagtatagtgtgagacatatgcaaaaacaagtacgcacctttttgtaactgtacattcaaaattgaatgtattacaatagacttggaggtgagaattatgcgagcaaaagaagaattaccggaatgcccagttgcaacagcagtatctctcatcggaggaaaatggaaattattataaatcaattatagactgattctttgtttggaatttaagcaacatagaaattgagatttgtaagaataaaaagaaggaaaaccatctggtgtttatcgaactattttcagcaaagcctcatgtttttttgcaaaaagatcacccattggcatcgaaaaaagtagtttccgtccatgacctcgcaccttatccgcggctaaactttgtacagggagagtatgaatctgtctatttctcagaggaactattcagctccattccggtggataaggaaattcgggtcaatgacagaggggctattgtcaatttcatgcttggactgaatgcctatactatttcaagtggcattttcccgaaatatttgaacggagaaaatatcatcttcgttccgcttgcagaaaatgaaacaatgcatattggatatgtgctgaatgaaaatcaggaattaaacgaacctggagtatgtaccgctgttctttgggatttttgcaggttactatgtagtacaaatcttaggtgcaattttcgtatatggggttaattctttgcttccaaatgcaatggaagtgatgaagtatatcggagcagcctatatcctgcggcttgcgattcatattgctttcagcaagccgtcaacagaaaacgcagagcaatcggcatcgtttctgaaaggtttcatgttgcaatttgtcaatgtgaagatctatatgtttggagttaccgcactaacgggttatgttgtaggatatatgtcctcctttccggctttgctgttttttgagctggttattgcaacaatcggaacgattgcaacctgtacttggactggcttgggcgtactgattcagaagttttatctgcagcattttcgtgtttattaacattatccttgcactaacattactggagtgtatttggggaatgttaagataattgttgcttttagtgaagcataatctggattatttaaaatgtcttctgttgcagatccgccgcttttattcgactttggttcatcgtttacaacaatcacatccggattcttaagaaagggacggaatgaaatcacacttatttggtgtaaaaacttgaaaatcccccgtctttccgttaatatattgacaaaaacagggaaaggaaagaaggtatgtttcaaacgattattagtacaatcagttcttttatgtacagcaagctgctggtcattatactgattggtgcaggatgtatttacagttcgaacaagatttccacaggtaagattatttaagagagcttgtggatctgtaatggaaaagccagaggataaagaggcgatttcctcttttcaggcacttatggtttcaacagcatcccgtgtgggaacgagaaatattgtcgggggttcatcggcgatttgtatagggggatttggttctgtattctggatgtgggtgattgcgatcatcggaagtgcatctgcgcctttggcgatggggcgagatgcattcaagtcaaaacacgcatcctccgtgtcgatcagcagagtgattgacacgggagtgaacagtaacgccataattacactacaactggcaactcattcccccttagttcaaagcactatactaaaattttcttaaatctctcgtatgcttcgtcccatgcttctttgtcctgtggctcgtagatcttgatgtcctgagaacgtttgataatttctcttgcttcttcgatagatttgatatctccggaagccatgagctgcagtgcaatatttccgagaacagtcgcctcgatcggacctgcacttactctgcatccacatgcatttgctgtgaactggcaaagaagagcactctgtgttccaccgcctaccatgtagactgtcttataatctttacctgtacactctttaatctcttccatcgcatgacgatatttcattgcaagactctggttgatgcaacgaacaacttctccaactgtttccggaacaggctgtcctgtcttcttgcagaattcacggattcttgtcggaatatctccggcaggtgtgaattccggtgcatccggatcaataaagctctgaagtgccggagcttcttttgccataatctcaagctcgccaaatccgtactcatttccttcgcggatccattgacgacggctttcctgaatacaccacaatccaatgatattcttaaggaaggaaatctttcttccatatccaccttcattcgtgatgttgtaatgctcagatttctcattgataataggttctgcaagctctgttccaagcagtgaccatgttccacaactcaggaagataaaatcttcttctgatgttggtacagatacaagtgcgctctgcgtatcatgtcccgcaacagccataacatcaatcttatccagaccaagctctgtacagatttcatctgtaagagtaccgatctttgtacctgtaggtacgatttccgggaaaatatgtttcggaattcccagtgcttcgatcacttcgtctgaccactcaccctttttcgcatcaagaagctgtgttgtagaagcgatagaatactcagcttttttctcccctgtaaggaagtagttgaaaaggtctggcatcaaaatcatcttgtcagctttctcaagaagctcttttcttgtctttacaagagaaaggagctggaatgctgtgttgagatccatgaactgatttcctgtgatctggtaaaatttctctttatcgatcagtttgaaactttcttcgatcattccttctgtacgtgcatcacggtaatgtacagggttctcaagaagtcttccttcctcgtcgatcagtccaaaatcaactccccatgtgtcgataccgatactttcgatctttccacatttctttgctttgatcagaccctgtttgatttcaaaaaataatctcagtacatcccagtacattgatccattcaaaataaccggatcgttagaaaaacggtgaagttcttcaatgctgatcttgtcaccatcaaaagttccgcacattgctcttccgcctgaagcaccaaagtcaaatgctaatacttttttctccataatcttcctcttttcttaatactcttttagtcggtattaaaacgggggccctgcataggcagaccccccgcattctttgttctagctctgtatcgaaactgtatttacagtctttttacattttctgacaaaaggactccttcttatttgtaaagtggtccgtagttcttacaagctctgaagtcagcgccttctttatccattccaaatgcattccatgctgccggacggtagatatctttctccggtacgttgtgcatagatactggaatacgaagcattgaacacattgtgatcaggtcagctccgatgtgtccataggagatagcaccgtggttagctccccagttgttcattacatcataagctgtcttgaatgctccctctttaccatcacatcttggagtaaaccatgtacatggccatgtgtagtctgtacgtttccaaagcttatcagatacttcttccggaagttcaagtgtccatccttctgcaatctgaagaaccggtccaagtccttttacaaggttaagacggatcattgtagctggcatctgagcacgtgtctcgtaacggcttgagtatccgcctccacggaagtatccgttgtcagccatgcaccactctgtagcatccatgattgctttctggtcttcttctgtaacgttccaccattctttcataacgccgttaccattctcgtctttagcaacaccagatgcatcaagacaagctgctccagagttgatcaggtgaaggaatccaccgttctctttagcaacaccttcgaggtcatatcctgtagctttcttaactgcctctgggctccagtatgtacgaacatcagcgaagatctgagcacgtcctgtaagaagtttcatgaacatcattccaagtccgttgagaacgtcgttctctgtagcaaggatgtatggctcacgagctccgttccagtcgaaagatgtattcagaactgcctctgcgaagtctccgttcggatagaagtctgtccactgtctctgtccctggaatccagctgccagagcgttgtgtccgattgcttcctctgagaatttctcgtcaaggttcttatttccgttcataaggtctttgatgataactgccatcttaacaacgaactcgaactgctcctctttctcctctggagaagcctgaagctcttctgggttcttatcccaaccaatcttgcaagtctcttttgcccatttaagagctttctcgaactcagccttgtcatagatctcttctgacatacgacggatgatttccacctcgtcaacagactctacacgcattccaaggtaagactcgatgaaatcagaatcgatgatagatccaccgatacccattgtaacagatccaatctgaaggtaagatgttcctctcatggatgctgctgcaacagctgcacgtccgaatctgagaagtttctctttaacgtcttccggaattgttgtgtcgtcagcttcctgaacgtcatgtccgtaaattccgaatgccggaagtcccttctgtgcatgtgtagcaagtacagatgcaaggtatacagctcccggtctctctgttccgttgaatccccatacagctttgattgtctgtggatccatatccattgtctcagctccgtagcaccagcaaggtgtaactgtaactgtgatatctacgccttctcttctgaacttatcagcacaagcagcactctcacctacacgtccgattgttgtgtcagcgataacaactttaaccggctcaccatttgaatatcttaagttctcctcaaacagttttgctgcagattttgccatgttcattgtctgctcttcaagagatcctcttacgtcaagagctcctctacgtccatcgattgtcggtctgataccaattactggataagatcctactaatcttctttctgccataattacattcctccttaattgtttgccttgctctgcttatcttccttcgcagaaccgcttctttgagtatcattatagttctttcctttctttttgtcttgtggtatactagaataaaaatataaagatattcaccttttatacaacaaagtacaatttataaacatatatttccacatatgtgtttgtttttacactatttagatttttaaaggagattattgcatgaaatacatcaattacagagaagaacgtaatcacggaactattgattttccaattgaattttatcatgttacgccgaatcatccacggtatgaaatgtcttatcactggcacatcgaatatgaacttattcgtgttttaaaagggaaattacttatgtcaattggtgaaaacgaattcacagccaaagcaggagaccttatttttataaaaggagggcttcttcacggcggaattcctaaggattgtgtctatgaatgccttgttttcaacctcgaatcactcatggccgtgaatcatgccagtgaacgtctgctcaagaagatcggaagtgacactttaacaatcccatctcacattccttctccggttaaaaatctggagcgtatcacttccctgatgttcgaacatgtaaaaaaacgcacagagggacatgagcttatagtaatcggtactctttttgaatttctaggttatattttagagaataagatgtacgaaaacgtacggattatcagtcagaaagatagccgaaaaatagaacatttaaagaaagctcttgaagtgattgaaaaccattatgctgactgtatcacactggaagatctggctcaggccgccggtatgaattcaaaatatttctgtcgctactttaaagatatgacacacagaactcctgttgactatctgaattactatagaatagaacaagcttgtttcaagctcgttacttcgaatgaatcaatcgcagacatcggacttagctgtggatttaacgatgtaagctactttatcaaaacctttaaaaaatataaaggaatgacaccgaagaaatatcttcgcgcaccactgtaatcaaaaattatgaaacaggtcaaccccatcatttttcacgcaaaaggagatccccttacggagatctcctcttttcatatctcattcactcatgaaatatccttatttatcttctttttctgcagcgtatacagttaccagtttgttcaggtaatcgtatctctccatagcttcctgctcattgagagcgaagagcttgtcagccttagccgggttagttctcttcagtgcgttgtaacgtacttcaccattcaggaagtcctggtatccttctgctttcggagccttgctgtcaagtgagaacttgtctccctctgcagccgggttgtaacggaagttattccagtatccacactctactgccagctgttcctctgtctgagctttgctcatacccttcttgataccatggttgatacatggagcataagcgatgatcagtgatggtcccggataagcctcagcctcagcgattgccttaactgtctggttgaagtcagcacccatagcgatctgagctacgtatacgtatccgtatgtcatagccattcctgcaaggtctttcttcttagtctcttttccgcctgctgcgaactgagctgtagcaccagtcttagtagccttagaggactgtccacctgtgttggagtaaacctctgtatcgaataccataatgttgatatctttcttgcttgcaagaacgtggtcaactccgccgtatccgatatcgtaagcccatccgtctcctccgaagatccactgggatttcttagcaaggaaatctttgttcttcagaacttctgctctctcttcgcaatcgcaatcgagtgcttcaagagctgcaacaagtttgtctgtagctgttccgtttgtagcgcctactgtatatgtctcaagatactcagctgctgcagccttaactgcctcatctgtagtcttctctgcgatcttctcaacttttgctttcagtcggtctctgattgtattctgtgcaagcagcataccgtatccgaactcagcgttgtcttcaaacagggagttgctccatgcaggtcctttaccttccggtgttactgtgtaaggtgtagacggtgaagagttaccccagatagaagaacatcctgttgcatttgcaatatacattctatcaccaaacagctgtgtgatcagcttagcgtatggtgtctcaccacatcctgcacaagctcctgagaactcaaggagtggctgtttgaactggcttcccttaactgttgtctctttgaatttagtaacaacttctggtttaaccggaatctctctaccaaagtcgaagaatgtctgctctcctgcattagcttccatgttagccattgtaagagccttctcaacttcgcctgtctctttgttcttctttcctgggcagacattcacacaagatccacatcctgtacagtcgtaagcggatactgtcattgtgaacttcattcccggcattccgatcatatcaagtgtcttaagtccttctggagcctgagcaacttcttcctctgtcagagctaccggacggataactgcgtgcggacatacatatgcacaacggttacactggatacactgatctggattccaaaccggaatatctactgcgataccacgtttctcatatgcagatgttcctgacggtgtagatccatcaacataatcattgaatgcagatacagggagtgtatttccttcctgagcgttaacttttgcctggatattcttagcaaatgcaattgcatcagttcttccgccgtctgcgatatgtggtgtagcaagtccttcatcagctgcatctttccagctttccggaacttctacttctacgacctgttttgcaccagcatcgattgcatcgtagttcatctgaacgatcttgtcaccttttcttccgtaagtagccttagcagctgctttcataaggtcaatagcctcttcttccggaatgatagctgcaagtttgaagaatgcagactgaagaactgtattgatacgtccgccaagtccgatctctttaccaatcttgataccatcgattgtgtagaatttaattccgtggttagcgatataagctttcacctgtcccggaagatgttcctcaagtccttccatatcccatgggcagttcagaaggaatgttcctccatcaacaagttcctgaaccatgttgtatttgttaacataagacgggttatgacatgcaacaaagttagcctgatggatcaggtatgttgatttaattggcttcttaccaaaacgaaggtgagacattgtaacaccaccagacttcttagagtcataatcaaagtaagcctgtgcatacatgtctgtgttatcaccaatgatcttgatggagttcttgtttgctccaacagtaccatctgctccaagtccccagaacttacagttgattgttccttctggtgttgtaacaagtggcttaccagcatcaagtgaaaggtgtgtaacatcatcttcaataccgattgtgaatttagctttctcatcgttgtggtatacagcaacgatctgagcaggtgttgtatctttagaaccaagtccataacgtcctgtgtaaaccggaactgcatcgaacttagatcctttaagtgctgcaacaacatccaggtacagtggctcgccaagtgctcctggctcttttgttctgtcaagaacagaaatcttcttaactgtatccgggatagcgtcgatcagagcttctgcgctgaatggtctgtaaagacgaactttaacaactccgactttctctcctgcagctgtcaggtaatcgattgtctcctcgattgtatcacatacagatcccatagctacgatcacgtgctctgcatctgctgctccatagtagttgaacagtttgtagtctgttccaatcttctcattaaccttatccatgtacttctgaacgattcccggaagtgcatcatagaatgggttacaagcctctcttgcctggaagaagatatccgggttctgagctgaacctctctggcatgggtggttcgggttaagtgcatgtgcacggaactcgtcgattgcttccatgcttaccatgtctttcagatcttcataatcccatgtctcaattttctgaatctcgtgtgatgttctgaatccatcaaagaagttgatgaatggaatctttccttcaagtgctgcacaatgagcaaccggagtaaggtccattacttcctgtacgctggattcacagagcatagctgctcctgtctgacgacatgcataaacgtcagaatgatctccaaaaattgacagtgcgtggcttgcaagtgcacgggcagatacgttgaatactcccggaagctgctcaccagcaaccttatataagttaggaatcataagaaggagtccctgagaagcagtaaatgttgttgtaagagcacctgctgctaatgatccgtgaacagcacctgctgctccggcctcggactgcatctctgtaacctgtacagtctgtccgaaaatgttctcccttccttcagtagcccactcatcgatatgctccggcataacggatgaaggcgtaatcgggtagatagctgctacttctgtatatgcataagaaacgtgagctgctgcctgattaccgtccatggtcttcatttttcttgccatttttattcctccttaggtgttacataggtttacactgagttaagtataattaattcacatgtaatttcattatatctccaaaagtcacaaaagtctagagttataaatatcctcttttgtatattttcgtgtacagcgcagtgttttgagaatagttatcagtgctgttattggggattattaactaaaacaggcagaaatgtaaaaagccagaagagtactttctgttgaacattaactcttctggcttatgaatcactatacttttttcttatcattctatctgtttttaaacaaccggtcatcccacttcggtggttttttccctttgatctttgttggcaccggctcatactgatccacttttttcttctcatttctttttctgcaatgtcttctgcaatagatcagcataattcctgtcacaatcaccaggcaacctgccagaagttctgacaccggaaatccgattcccggaagaacaagctgatccgttctaagccgctcaatccatacacgtcctgccccatatccaaacaggtacatgagaaaaagttcaccttcatatttcttatgcttcctatacaaaaacaatatgataaaaagtccggcacaccataatgactcgtataaaaatgtcggatgtacctgaatataactgactccgtcaattctctgcatgttctcgcgcataagttctgtgatatctcccggccttactgcatcaaccggaagcctcatcgcaaacagacaatccgtatattctccaaatgcttccctgttaaagaaattcccccaacgtccaagcatctgaccattcagaagtgccagtgcaattgtatccaaaatctgaaatggtgattttttcttaacagcagccatcacaaaaactgcgatcactgctccgatcacgccgccataaattgccagaccaccttctctgagattaaagatagacaaaagattatctttatataaatcccaggagaaaatcacgtaatagattcttgcacccgcaattcctgcgatcactccgacaattcccatatccagatagtcttccggattttgtcctgttctttttgcttccgctgtggcaatcagaaatccaatcaaaattgctgcaccgatgatcatgccgtagtaagcaatggaaaaaccaaagatgctgatgctttttcctacatgatccagataaatccctaaattcggaaagctgatattgtaatgcatattatgttatttcctttcatatccacagaaatcaggaacaaatctagttgtccctgattcctgtttttactgcttttccaattagaaagcaatgaatctaaccggtttttaagcatattccctatatctgttaaacgttaaatctgaacagcatgatatctccgtcctgaacgacatagtcttttccttccagacgaactaatcctttttctttcgctgccgcatgagttccacatgccatcagatcatcataacttactacttccgcacggataaatccacgttcaaagtctgtatggatcttaccagctgcctgtggtgcctttgttcctttcttgattgtccatgcacgaacttccggctcacctgctgtcaaataactgatcagtccaagaagatgataacttgccttaatcaacttctcaagtccggattcttccaatccaagatcttcaagaaacattgatttttcatcgtcatctaactgagaaatctcttcttcaatctctgcgcatactacgaacacttcgcagtcttccgcttttgcatactcacggactgcctgaacccctgcgttgttcacaccatcatccgcaagatcatcctcagatacatttgctgcaaagattaccggttttgctgtcagaagattatactctgcaagccatgcctgctcatcctcatcctctgtcacaaaactcttcgccatcttattctcttccagatgcgctttcagacggttctgaagatccagctctttcgccgccatcttatcgtttcttgaaagcttcactgtcttggagattcttctttcaagaacctcaagatctgagaagatcagctcaaggttgattgtctcaatgtcacgcagcggatcaatgcttccgtctacgtggacaatattagtattctcaaagcatcttactacatgaacgattgcatcaacctcacggatgttggcaaggaactggtttccaagtccttctcctttggatgctcccttcacaagtcctgcaatatcaacaaactcgattgctgccggaatgatcttctttgtatgatacatctctccaagcacatccagtctcttatccggaactgttacgacaccgacatttgggtcaattgtacagaatggatagtttgcagattctgcaccggcctttgtcagtgaattgaacagtgtactttttcctacattcggtaatcccacaatacctaatttcattttttatatttcctcctataaattattatattttatagtatctgtgtactatttactcaaatcgagtgccatctcgagtgccattaacagcttcaatatatgtacttttatcctacattcaatacacatgacaccttgtcaatttctttttgtttttcttcttctgtaatatgtacatacagattcatagttatgcctatattagaatgccccagtatcttctgtaatgtcttaggcatcataccaccttcaatacaccttgtagcgaacgtgtgtctcaatacgtgcatagaaaatctattaatttctgctttatcacatatcttaaataatgcagtatcatacgcactattttttacaggttctcctttacggcttaagaaaataaactcagaccattcttcctgtatttctttaatgttcttattcttttctttttgcgctatcagtattcttatagcctcatctgttaatggaattgtacggtaacctgatttacttttaggttcgccaattctccattctccaacactatgtcgatattccattgaacgttgaattttcactgtcttcttcgtaaaatcgatattttcccatttaagacctattaattcaccagtgcgaagtcctgtttgtaatatgaatctgtactgattctcataactctgcccttttgcatattctaaaaacttcttttgcgtatcaatcgtaagtgcttcctttttctgtgaaggttttcccatatcacttttaacagatttcttacaaggattactcaaaatcacatcattttcttttgcaaattctagcatattaaaaagcgtaattcttgcctgatatattgtagatgttttatatccttcatcagccatattggtaaaaatcttttgacaatgaatcggcttaacttccgttaatatttttctaccaattaccttctgaatatttttattataacgttccgtataatttctaacagtattaggacggacagtttttttctttacatcaatccaatattcaaaccaagcatctactagcatattcgtagcttgttctatgtcactatgttcatctatataagttgcatctgcaagccattgtcttacttcttgcaacttcttagaacgctttgcttttcgctttccaaatctatcaacaaatcttgcacaatatgttccattagtttgctgataaatcccctctccaagctcctttccttttaagttcttacccattgttctagctcctttccataaaaaagaagctccaatatagcaacttatagattaccacaacggagcttcaaattcaatgtgaatcagctatttttcataattcaatactgtcttttaaaaacttctcaaattcttttctttttaccaatttcttttttccaacatacaatacaaatggacatcttggcatctttaatagtgccgatattttattttgtccgatatttgaaaattcagctgcttcttcaattgtaagattcgctttctcccataatggtattttttcaatcaactacatcacctcttatcattatcaaatggattttcttcattgtctcctagcgttctaaactcactgtttctttctaaataagcttgaaccgacggatattcaatgatttcattaatgtctttataataaataactttatgaattcgtcttagaaatgcttgccatgactctttatcttctctttgtagttcagaatactgtttctcaagctcccagtttgaaacaatgtagaccttattgaaacacgcaaatttgttagaatatcgactaggtaactctattgggtatatatcgcaataaagtaacatttcctttagttttaatgatgacctaaattcatcaaaacaaattgcttgttgtgccgtatacgaatcaaacgggtgattataatcggttactcgatatacgtttacatatccattctcttccaaaactctccgtgtttttcccgtccctgtttttccataaatgtaaattacttccaaatctaatcttactgtttccttaaatcgttccatcaatatagtggtacgaactttatcaagacggtctatctgcataatataatcttgattcacagcaaggatttctgcattagtcatgttatcctgaatcatacggtaaagttctgacatatcgcttcttttgcctttactatcaggtggctgtgtaccatattcttcgaatgtaccttcaatctttttttcctgttttgattcatctaattcccattttccagatttcttaacataagagacattttcggatacattccctctgcatttttctatgtgcgcctcagggaagtgtcgttttatcatgctaaagcgtaccctagaagaaaaaacaataaaaatatgtgtatggtatctttcccctttctcatctgcaaggcaaaaatatatattggtcttgaatttactacgaataatattaattatcttttcatgcgtatatcccttttcaattggcgcattaatagtcaattgaaacatatatgattgtgggtctataatctcaccttctctgtgcattttgtgcattcttctgcacgttatctttttctcacatctataagattttgcaactatttataagtttttatagatttttataagttacttatgtgtttgtgacaccgttgggtaatacttagcccaacggtgagacaaagcttgtgacttacgccaccgctttgtcgtcacttatgcctaacattccgttgcaatttttctaagtaatatttttaatcgttctttatcttttatataaggtatctgtattggttgaatatcttgtccatctatcaaaacaagtccttgccctgtcttaggtcgatatcgttcttcatattccgtatcctctaaatgttctcctgcaaataacgattttctactctcaacagacagtcttcccattcccaaacatatttggaagttatctatagcaccaatccccgttggaaataagctcgcactaatcctctgctgaacacaccaaacataacaatggcgtgaccgccctaacataagaatcgtacttatgatgctttttattttttctgcctttttcttgtcgttttgtgtcagccaaatcatatatcctgcatattcatcaatcaaaagaattttgattatcggactgttttccgaagtcctttcgaattcttcacaatatcgctctatcagctcggttattttatcaaattctgcaaaattgttcgttatatccttaaaatccccagattttttgaaatcacatatatataattctattttacgtttttcttcctttgcatactttagtgtgttatacaacaaatacaacacagtcattgatttcccagaacctgttccgcccacacaacaaagttgtcctgtagctaatatgtctatttttataggcttttcagttattgtattatatcctattttaatcatctgatttcttccatttctttatcaagcagttcatcatgatactcttctttcactggtctaataaagccactttctgtcttcataatcgtcacacgtgaattacttgcatctgtaatgaatttatctgtttcaaaatgttcatcaaatatctttaacacccttaaataaacacttttattgttccactcttctggaatgatataactataaattcttcgttcaatgttctttcctttttttcttttgtatatcaaatgtatacttgcttcattccctttattttcttcaaatgcctctctaaagaacttcgtctctttctcatataaagttcttccaacagttgctataactgccaatattaacgaaacaagcatcaataacagtaaaacatctataaatatgtggtatttgggtattagttcattaggtataaacgacacttgtaaatattctttaaaccgaacacctattgcataaatcccaactggaattattaaaaaaagcaactttaatggagtatttaaaaattccataattcctaacattacatataatattgtatatctttttgaatgttccatataaaaattaagcatcttcttcataatcaacctccttcaattcttttccactcataaataatatgagcggaaaagttatttgttaatgtttcacttctttattggctttatttaactttcgcccttattacttgtctaaaacttcaacatcttctgctacaactgataactgattacgatactcgccataaatattagcagttggattaataagacgtatttttgaattcataggtacattaatttctttaggaatttttattgtaagtttttcatacatattattaacattctctccttccttcaagttgtaattatgcttgtcactcgcaattacaacttcaagcttcgttcccttagtaatatcagtaccaaattccttccatacagattttccaattgcaattaaaataagttttgagaaaaactctaccgcatcaaaataatcgaactggttcaatttttttaacattttcattacctcatatctttctgatgccatccttggtcgcatccaccataatatccgaaatgcatttcatactcttagcttactcctgtacgcttatttatgaatagacggatttgtttctttttttatgtttgaatcgaaacacccattaaactaacttcttaagtaatctttaatatatttgtagaattaaacagttgcttttttgtttcttttcatttataattatatcgaaacatttcattcgaaagaaaggagaatttatgaaagaaatatgtacaattttaatctatcacgacaaaaatacaaataattttaaagccacaatcgtttactcaggtaaaagtttcaacttcaatcctttatattttttacctgatgtttgcgcgaataatggaaaattaaaattttctaattatgatttttctgatactatttcgctaacggatataaaaaattctaatgacgaagaaggggagcaatatcaagctgtattaaaaggcattaatctattaatggaaaatagtatcaaaactcaaacagaaataaaacctgaaattattgaactgttacgcccatattatgatattacttttaaatttaagcctattgcaaaaagaatcgaggactcatttacttcatatccccttattgaccactcctcattgtcaatagaagatataatacaagaaaaatcatcattatattatgattatgtttatcagtgttatagtccttccgacattttgttttctgttattcactttcttacattaaacaaatataaatttgcaatatgtacgcactgtgggaaatattttgcaaccaataatttaaaaaatatttattgtgaccgttttagtgaatatcctggatatgaaaaacttgattgttataacgctgtaaaacgaatccgccaacaaatcaaacgaaaatatcgccaaatatacaaaaatctaagtgccaattatacatgcgaaattttggataattttgtaaagcaatatgacaagttgtcactcgaactaaacaaacattctgattatgatataatcaatgactgctttacctttctttctaaggaaaattggtatacaaaacctactatacgatgtgtcggcaagaaagaaaaaaaataaatgtgtcgtttcaacgtatattatttgacactatatagtccattcatagcatttccttccctttattataaaatatgtaaatattttataataaaggaggacatatcaatgtcaagaaaaaaaacttatataacagattccgacaagttacaacaccttatttcaatatggggacagtacaaatccaccgccaacgattgtttaactttagtcgaaacagccaatcaagaattacaagcctaccttactaatcacattccactgtctaacccagactatggacatcttagaggattcagaagagcgaaccgatgtatgagtgattttattacaaaacttcccgcctatctcaaacagattgaagaagatagcagttgttcacctgttgatgaagaaacgcttgaaaagctaaaaataatagctcatgaagcaaccgagtggaaaattgcatacaataaagcagtcgcaaaatacaaagaactagccacagaatatgaaacaaccttttataataatgacggaacttttgatataacgcgttggttagaatagtacaaaatccccccaaggagtttttctctttgtggggattattgcaattgtatcaattactgaaaaaggacttgcatatttcataactactgcaagtccttttgtttccattattaacctatttcaatataattgttgccccaccttcataaaaaaatccatttgcaacttccatatcaaaaacgtcatttgcaccgaatgatgtcattccaatctcttcgcttgtatctggtatcagagttcttaaatacgacaatggagtactataatcgcccaaatctaatacatagatttcaccagcacctccttcttcatctattcctttcggatcatgtgaaaatatataccgtttacacataacatcaacctgttcttcactgaccgtccactgatctttccagctttctggaacataaacgtcaaaatactcattggaataagatgcctccaattgaccttcatccacttcttctgattcttttgttgtttcagattctcctatccattcttcactagaatctgttccattcaatgtttccaaatccttctcccagttagcactagattcaaaatgcttttcccatatagggtcaagcttcacttggaaaagaggttgtttttcaagattattatctaaaaccggaacatctacgaccaatgtacccgctattttaggtttgagtgacatatctaaccttcctgcaaacccatccaaatcttttctgtcagatactttaaccactccactgacttctcctgatattcctattgaaaaatccattccacaacttccatataattttgtaattatatgtacttctggtccaccagacaacttacctgaagcagaaacggtgttccattctattccatccgtacttggtttagattcgttcaactcctcaacttttcccgttctgctatcatattggaaaccttgtttcgtttcgtttttgaattcaaatatcagtcctatgtttccttccaactctggtttcactccaattgaaaatttcaaatcattcgtcaagacaataggaattccgccaactaaaaattgatattttggaagtgttttttcataaaaaattttttcgatttcatctttatatgtttcgctacagccaaaagctattttcgaaccttcttctgttcgaactgccattccaccttttatatcaccatgcttaatatgaatatctacttcaacccacacactaattcccatttctcctgaaatcttaagcggaggatttttttcttcatacgtttgtgcaaaggcgtaattcgttccattatctccttcctttgctttacatagtttagtctgtatttttgtatcttttagattaattgatgaattttctctcacatagctttctgattctattccattttcagtaagcattattctttgatatatatctgctttttcaaatacgtctgttaacaccgctggttcagttttcacttcatagctagaattatttttctttatttctataacttttcggataaaaccatttggcgctgcatccgtaattcctgatacaatcacatctcctttcttataatgatttggttttgattcaaaaataatactgttatcattcacttctataggttgttcgtccttcttattatccgtagtaataatctttacatttttctttatgacaatattatcatcttttgaagtgttattattggaatttatttttctataccctaatatcgataatataataactatcaataatagtactacaagtaaaattactcttcttaaccattttttcaatatctaattttctccctcatcagtgtttcattctatttctatcttactttttagtcccaagtgtttattttccatgaatctccatctttgatacaatgtaagtctaactttgtatcatactcatgaacaaaagagccgcttccatcaccatcaataattattatatttccattttcatatgacatattgtatcgatacgttaccctaacacgtatagttaattcattttcattagtatatttcaatgtatctatatgggtacgtgtgatatctttaaactccacatcatatgtctttacgccatataccttttcaagttcagcttctctcgtcccattcaaatcactattatcagatataaattcttctgcattattatttttaaaatattgattcaactggcttatatcacctttttctaaagaaactgttacaatttctttgcatccttcgcagatatctttttctagctcatctctgtacttcttttttaaggcatccactccaccattagtaaaatctatcgtgtttctatcatacgacctcttatccccttcgaatattggatgttttatatattttacagtttctccattcaaaatcacttccccatcttcaaacattgaatgcgtaactttaatatcataatctacatctggtaaaacaacaactttgtaaatatctacatgattatcctcatccacctgactttcaggtttatcatttaattctactccatcgatatatacttttgcaccttcataaacttctatatgtcgttctgcatatatgtcctctaaaataattttattgtctttctttcctacctcaattttttctgtatcttcacctcctgatgtctcaacaattactttataggtaattgtatcttctgtttcatttgcctgtgtataagtacaatttacgacatcatcatattcttttgccatcttatcataataattagattttaattcttcaatctttttatctgtaatgagattactttctggaaaatgtacaataccgattatgtctccatagtttccatcaacaaggatcttgcaatatttatctatcgttttttctggacttccttttttattattaataattatagttcctcctaaaataaccagtaatattactgctagtccaatagctaccttttttttcatcttttttctcccttcatctgtttaaatttttcttttttgacatttagtaaatgtcatattttattcaattttatcatatactttttgaattgacaattagtgaatgtcattttagaaaggagtttatttatgtacaaaaataaatcccccaatggtagcaataacatttgcggacataaaatcaaagagttacgattacaacttccagaaaaaacctctcaacgtaaattcgctgacatgcttcagatacaaggcattgatatcgacaaaaatgccattcagcgaattgaatcaggacaacgatttataactgacattgaattaaaagcaattgcatctatcctacatgtaagttctgacacactattagatattaatttttctcaaactaaaaaacggtaaaggaatatctatcctctaccgtctaatttttctatatggagcttcaattaatattcattgcttttcattaaaatcgagtgccacagcgagtgccaattttttctaaaaaatatcaatttatatcaacttacgttcttctgtaaaacacttattcttcatattttatcccgatttattaacattttagagtttgtggaaaaatatatgaaacttaccagcatatttcaataccaagtttcattttctctatttcctccttaaaaccttgatttctaaagctaaatccacaaggtctatttctcttattttctgttatgtgactctttcacaaaaagaagccccaaaatagcatctaatattatactataatggggcttgaatttcaatctctcgtctccatcaaaatcacttttccaaacacgaaagagatcttcacttcatcttcaccttctgcaaactcattactcacacacaagctgtctcctgatgagagcaaatgattctgcaatggatattttgcaccgctgatacagaaatcctcaaccggaagttgcatcggaaatactgaaaaatactttccaaaagcttcttctctgcgaattgcgattccatgatcaagcagacgaattctattatgactgtctaagatcatcgcctgagatcctgcttcaagtgcaatattcaggcactgaacattagcccagaaatgatccagacgatttcctgttcctccaagaatccagatttcttttcttctgagtccaagacacatacgaagtgcaatctccgtatcagacgcatcctttaccggattgaactcccggatcggtacacttgcttcttttctataataatcgattacttcttccggtacactgtcaaaatctcctacaatgtaatccggcttgatcttatgttcataaagaaatgcgagtcctttatctactccgataataaattctgtctcttctgcctcaagaatcggaaggacaaaatcttcttccagcattcccccgctcacaataactgttctcttacacattgccgtttaaaatctccataaactttgctgtattatctttgatatcacctttaaaaacgcctgaacctgagaccattacattcgctccggctgcaagtacttctgccacgtttttatgatatattccaccatctacttcaatatcagttgtaagtcctttttcattcagaaggtttctcaattcactgatacgctccagtgattccggaataaatgcctgtccgccaaatcccggttctacagacatgatcagaaacatctctgcctgatccagatatggaagcagtacatcaaccggtgtctttggtttaatagaaattcccactttcgctcctgctgcatggattttatcaattgttgcctgcagatcttcacatgcttcataatgaactgtaacgatatctgctcctgctttcacgaattcttccacataacgaatcggttctgtcaccatgagatgaacatccagtgtctgtgttgttgctcccttgatcgatgcgagaacaggcattccaaaggaaatgcttggaacgaacattccgtccatcacatcaaaatgaatatactctgcgcctgcttcttctgttaatttcaactgctctcctaaaatcttgaaatctgctgagagaatagatggtgccaaaatatttttcataaacttaatacctctttctttcctttagttcacggtacatctccgtataatcttcatatctgatcttatggatcttcccttcttcaactgcctcttttacagcgcatccgggttcatgaatatggtcacagccattgaacttgcactgtccttcaaacggtgtgaattccggaaaataatattttaaatcttctttttcgaaatcattgacataaagagaactgaatcccggagtatccataatataagaatcttctccaatcacgatcagttcggaatgtcttgttgtatgtttcccacggtcaatcttcttactgatacttcctgtctccatcttcacttcagactgcagaagattgatcagggatgattttccaacaccggaaggacctgcgatcgaagttgtctttccttttaaaagtgattttaactcactgatattttcttcttccttagcacttgtgaagattaccggatatccgcatccggtataaacttctttcaattctgcaatttcaggatggcttgcaatatccgtcttattaaaacataatacgacaggtatctcttttcgttccatcatgacaagaaaacgatctaacagattataatgtggtttcggttttgtcactgcaaacacaaccagtgcctgatcaatattggctactgccggacgaatcaactcattcttacgcggcaagatctttgtgatatttcctgtcatttctttttcatcaagtacctcgatcacagcatcatcaccgaccaacggcttgattccgtcttttcgaaaagcaccttttgctttacactcaaaaattccggattctactacattcacgtagtagaatccggcaatcccttttattatctttccctgcatatacttgctctctgttatcattgattcgtgttctcttctgtcccggaatcatttccggaatctccactatccggatctgatggctgagatcctttgctgaccatatactggacagttgttcctttttctacctgcgtaccactgctgacagactgatagaatacctgtccttctggatattcatcactataatcttcaccaatatactccggtgtaagtcctgcctgcttcaacagtttttccgctgtattctggtctttataggaaagatccggtactgtaaccaccgtcatctttggtcctttgctcaccacatatccgattgttgtacctttagatacttcttttccggcatctgtgtcctgtgaaataataactccttcttctacagtatcactgtaatcttcagttgcatttccggacaaacctgcctgtgaaagtgctgcttcagcatccgactgggactttccggtaagtttaggaactgttgccggctgatttcccttgcttattacaagagtgaccgttgttccttcttttacttctgcaccttcactcggactgacagaaacaacttctccctgttccacatcatcactgtagaccggatcacctttcttcacaacaagattcttatcctgaagtgctttttctgcatcagcttccgacattccaacaacatttggaatcgttgtcatcttagcttcttcaccactgctgatcacaacattgactgttgtatgcttctttactttctttccatcagcaggatcctggctgatgatctttccttttgcaacagtatcggaaggcgcagttgacttatggattccgagatcatatttgttcagttctttctgagcttcctcatatgtcttgcctgtcacatccggtacttttaccatctctgaatctgtttgttgtgtagtcgttccttttccacctttaaatacgcccactgcatttcctacaaggaacatgatcaaaagtgcgatcacaacaccggcaacaaccataagaatcttcatgatcttcttcgtgtctttattcacttcatttttcttacggcgatcatcataacggtctttgcggcggtcgtcgtaatcatcatcatcatagcggcttctgcggcgatcatcataatcatcgtcatcatcataacggcttctgcggcgagcacttgacttttaatcaagttgtccggggttcgaatccccgcacgctcactggaacaagcaaattgcttgttctatttttttcttaatcaataattgaataagaaatatgcggatgtggcggaattggcagacgcgccagatttaggttctggtgtttacgacgtgcaggttcaagtcctgtcatccgcagtaaattttttccccggaagtgctgatcaacattgcactttcgggattttttctatctgaaaaccagtatgaaaaaagaagccgcacattaaagtgcaagctccttttctttcttttcccaatcaataaacatcataaagaatgaaattaataacaagaaggaacagccaagaattgcctttgtctggaacagctgaactgctgcattaccgatcactgcgccgacaataaagcaggcaatgattccgtaatacagaagacttgtatccaaaaaatgtcgttcttttgtatggaaatagtggtgcaggttctctgttccactgcgcagattaccgatgcacattgtagttgcgattcctttgccatgaatcttgcgaaaactttcaacctgaattccacaggcaaaagaagttaatgcattggccggaagattcaatgctgttgggaagaaactgactgcgatcaggattagtgcttctgccagaacagaaatctgtctccagtgaagcagatttcctgccttagcccggacaacttcagcaagagcgattccaagtgcaaaggcgagtacagggaaaaggtatttcattgtgttctggaagtctccctcagagagatgtaccccaaagagaagcatgtttccagtctgtgcattggcaaatacttctccacgctccatataagagtaagcatccatgaatcccccggaaagtgcaaggattgctccaagtcggatagattcagaaatttgaaatttgtgtttcatagatatcacctcattttcgtgtgtagtacctactgtcatgattgaattactgctttctggcggaaagcagtaatattaagccatcaattattatagaagtgacagtagtggctgtcaagattctccgggtgagaactttacatcaaaacaggtagacaatatgtcgaaaaaaatcgaaaattcacttgcacctccggaataagtggtatatactagtcaagaatgtttgaaattacagtaatctgcattcaggcattgtgcagatttctgtgttggcttttattattactcgtattcgatagacagatggaggtaaaaaacatggtagaaaagaaagtgaagtttatgtcagcagggcagatcatgacattttgcaacacttgtcagaaattaaaatcagacgttgatgtaactgatatggcaaacagaaattatatcatcgatggtaaatcccttatggggttaatgtctattaagctgggactgccaatgcgtgtagttgtgaatggacaggatgaagaagaggcaaatgaatgtttttctaactatgagtttgaataatcgggccgaaaagaattgacgaaaacaaaatatggcatattaaaaggagagacggtcagtctgtaaatgaagttttgacacacatttatagactgaccgttttgttgttcacaatattgacaaaactatttggtatattaaaaggtaattaaatgtagaaatgacctggtacacacaaatataagttaggagaaaagaagatggaaagagcaaaaatattagttgtggatgacgagagcagaatgagaaaacttgtgaaggatttcctcacaagagaagggtatatagtattagaagccggagatggaatggaagcaatggatcttttttacgaagataaagacattgccctgatcattttagatgtaatgatgccgaaaatggatggttggcaggtgtgccgtgaggttcgagagacttctaaagtgccaatcattatgttgacagcgcgttctgaggagagagatgagctgcagggatttgaacttggtgtggacgaatacatttccaagccattcagtccaaagattcttgtggcaagagtaaatgcgatccttcgcagaactttgggagcggtcggcaatgattcgctggaggcaggcggtattgcgattgacaagtcagcacatatcgtgaagattgatggaacaccggttgaacttagctataaagaatttgaattgttgacctattttatagaaaatcagggaattgcgctttccagagagaaaatattgaataatgtatggaattatgattattttggtgatgcaagaacaattgatacacatgtgaagaaactgagaagtaaattaggcgataagggcgaatatatcaaaacaatctggggcatgggatataagtttgaagttcagagcacggagaaataaatcagatgaagaaagcaaaaagagaactgaaatatacgttgagcggacagatgacagctatttttgttggacttctagtgtttgttctgatgttagttttcattgttaatacggggtttcttggacgatattatatgtctcataagcagaaagatctgattgagatgtatgaggaaatgagtgaagcagtgaacaatggaaatcttggaaatgaggcagtgcagaagaaacttgtggcggaacttgaaaaaacgaatattgatgtctgcgcgatggatatttctgacgatggaaaggttgtatttacaaatgtaaaggaagaaggtttcctgtacaaacagatgctccgtattttcttcctgaaagatgatgatcaggaaaagattctcaagcattcggatgattatgtggttcgtaaaatccaggatccacagagcggtacggattatctggaaatgtgggggtatttaagtgatagtgtgtttgtcacaatgcgaagcccattggacagtattcgtgaaagtgccaatcttgccaatcagtttctgatttatcttggaattttcggaatgttctttggaggaatccttgtatggattttttcacgaaggattacaaaaccagtgttggaactggcaagactttccgaagatatggcaaatctgaattttgatgcgaagtatacgagcggcggaaagaatgagattggtgttctgggcgagaattttaataaaatgtcagatcagctggaaaagacaatatctgaattgaagactgcgaataatcagctgcagcaggacattgagcagaaagagaaacttgaaaatatgagaaatgaatttcttggaaatgtttcccatgagctgaagacgccgatcgcattgatccagggatatgccgaagggttaaaagaaggaatcaatgacgacccggaaagtacagagttttactgtgatgtcattattgatgaagcaggaaagatgaaccggatggtcaagaatctgctgacactgaatcagttggaattcggtacagatgaagtggaatttgaacggtttgatattgtgaagcttgtgaaaggtgttattgcaagttgtgatattctgatccaacaggttaatgcgaatgtagattttattgctgatgagacagcttatgtctgggcagatgagtttaagacagaacaggttgtacggaattatcttacgaatgcgattcatcatgtcggaaatgagaagcggatcgaagtgaagatcgtttcaatggatggaaaagtatgtgtttccgtctttaatagtggaaaaccgattccagaagaagatgtaccaaaactgtgggataaattttataaagtggataaagcacatacacgtgaatatggtggaaatgggattggactttcaatcgttaaggcaatcatggaatctttccatcaggggtacggcgtgaaaaattatgacaatggagtcgaattttggtttgaactcgacgcaaagtgtggtaaagtatagaaaatagatactagataatagatactagattacagataagaggtaggctaatgatagcaataattgattatgatgccggtaatatccgcagtgttgagaaagcattgcttgcacttggacaggatgttatagttacagcggacagagatgagatccttcatgcagataaagtgattcttccgggtgtcggtgcatttggagatgctatggagaaattaaaacagtcagggcttgatgaagtaatccgcgaggttacagaaaagggaacaccatttcttggaatttgccttggattgcagcttttatttgagcacagcgatgaggctccgggtgtagaaggacttggaattctaaagggtgagatcttaaggatacctgataaagaaggatataagattccccatatgggatggaattcccttcatttagagaatgatggaagactttttaagggaatcgctgagaattcttatgtatattttgtacattcttattatctgaaagcagaagaggaacagattgtcaaggcatcaacagagtatacaacacatatccatgcgtctgttgagaaggacaatattttcgcatgccagttccatccggagaagagcagtgatgtaggactgaagattctgaaaaactttgtagagctgtaggaggagtgcgagaatgtttacaaaaagaattatcccatgtctggatgtgaatgccggacgtgttgtaaaaggtgtgaactttgttgatcttcaggatgccggagacccggtggagattgcaaaggcatatgataaggcaggagctgatgaacttgtatttctggatatcacagcttcttcagatgatagaggaacagttgttgatatggtacgaaaggttgcggaatgtgtgtttattccgtttactgtcggcggaggaatccggacagttgatgatttccgtgcattgttaagagaaggtgcggataagatttcaatcaattcttctgcaatcaacagaccggagctgatccgtgaagcggcagagaagtttggaagccagtgtgtagtagtggcgattgatgcaaagaaaagagcagacggaacaggatggaatatctataagaacggtggacgtctggatgtcggtatcgatgcagttgagtgggcgaagaaagtagagtcccttggtgcaggtgagattcttctgacaagtatggacggtgacggaacgaaggctggatatgatctggaactgacacgtgcgattgctgacagtgtatcgattcctgtaatcgcgtccggtggagccggaacgttggagcattttaaagaggcattgacagacggtggtgcagatgcagcattggcagcatctttattccattataaagagctggaaatcaaagaagtaaaagagtatttgagaaacgaaggaatttctgtcagactgtagagaatggttaagcagaaagaagaggagagcaggaactatgagtggtttgaatggagactggtatgaggcattgaaaggagagttttccaagccttattataggaaattatttgagacggtaaatgaggaatacaggacaaaattgatctttccaccggcacaagatattttcaatgcatttcatctgactccgctgaaggatgtgaaggttgtgatccttggacaggatccttatcataataacggtcaggcacatggattaagcttttccgtgcagaaaggtgtggatatcccgccgtcacttgtgaatatctataaagaactgcatgatgatcttggatgcacgattccaaatcatggatgcctgacaaaatgggccaagcagggtgtgttaatgttgaacactgtgctgacagtacgagcacatcaggcgaactctcacagaggaatcggatgggaagaattcacagatgcagcgattctggcactgaacagccaggatagaccgattgtctttattctgtggggagctcctgcacagaggaagaagagaatgcttacgaatccaaagcatcttattctggaagcaccgcatccaagcccgctggctgcttacagaggtttctttggaagcaggccatttagtcagacaaatgcatttctggagaagaatgggattgagccgattgactggcagattgagtaaatcatagtagcaaagtattaaaaatagacgtctgctggccaaagcagggacgtctattttttatgtgtataattcaaaattaaaacaatcaaactggctgtcgtcagaataaccatcaatcaaagagaaaaatgtctatatttatattgacaaaactaaaaacctagtgtactatctaaccatagcactgatacagtaaatgcaaaaaagataaatggaggaatcacatggaatataattcaggaagtccaatctatcttcaggtgatcaacgagcttaagaaaaagatggtaaagggcgagttgaaaccgggtgagaagatgccatcgaacagggagcttgcagttttgtataaagtgaatcagaatacagcggcgagaatctaccgggagatggagatggcaggatattgttacacgaagcgtggaatcgggacatttgtgtcggaggaggagcatatgtttgataatgtgaagaaagagatggcggaagagttgttgaagaattttgtacatgagatgcatgatcttggatttcagaaaggtgagatcatcgaacagatcgccgattatgaggaggagtagaaatgatgttagagtacagaaatatcacgaagaaatttggaaataaagaagcggttaaaggacttacattgaacttgaagaaagggacgatttatggtcttcttggagaaaatggaagtggtaagacaactctgatgaagatggcggcagggctgacaaagccgacagaaggcgaaatcttatttgagggacatcagcttagttattatgacaaagcgtccatcgcatatatgtctacggaaccatttttctatagctatatgaaggtaaaagatgtagaagaatattatgcagatttctttgaggattttgacagagagcagtttagaaaaacaattgaacgcctgggcttgaatgaagagatgaaagcatctgcaatgtcaagcggaatgaatgccaagctgaaagcggcagcgacattggcgagaaaagcagatctgattctgttagatgagcctttgaacggagtggattataaggcaagagaagagatcattgccctgattctggaagaggcggacgagaaccgtacaatggtgatttccacacatctgatcgaagaagtggaaagctttattgaggatgcgatttttataaaagatggacatcttgtagatgtcgtaaatgttgagacagagagaatgacgaccggaaattcacttgcagagctttatctgcagaagatgtaaggagggagtatcgatgggaaaattaatgaaatatgaatggaagaaacagcggacttcgagaatgattgttatggtagctttagctgtctgtgtgcttacatttcttggaggtatgctggttgaaaaggatgcattgatgggaatcagtgcaacgcttttattagtcggatcgtattttgtagtgttctatatgggaattgagagtattctgattctgaacagagatttgaaaacaaagcaaagctatatgatctggatgactccgaaatccgtatgggaaattcttggagcaaaatttgttgtagcgatcgcacagatgtttttcgtgtttgtactttatgcgattgccggactgctttgttttgtagggacgatccagtatgtcggagaacttggaaatgtatttgcgatcataagagatagttttatacgagtgtcaggcgaagggcagctgatcgcacagattgtctggaatcttctctgcatctttgtcggatggacagaggttgtgatggttggttatcttgcggtaatcgtttctcgaactattttaagggattcaaaatatgcaggaggaatctcaatcgtagctttctttgtgattatatttataatagaaaagatttataatctgattagcaatgtacttccgaatgtagaagtagcaggaaattcattctttggcgtcggatatcttgtatactacattataatctgtgtagcggtatttttacttagtggatggatggcagataagaagcttagtgtataagaatagatagaaaaacactccctgatttgtggtggggagtgttttcgagcatagtgttctttaaataagaatcttcttcatatctttcggtaattccgctgtgaattccatcggctcctttgtgatcggatgaataaaggagagcttccaggaatgtaatgcctggcggtggatgtattccatatccggattatatagataatcaccgacaagtgggaatcctaaatattgcatatggacacggatctgatgggtacggccggtctctaagataagagagacaaggctgtgcccgtttttttcttctacaactttataatgtgtgactgcacgctctccatgcttgaagtctacttttcgctcaatcatggaactgccggtgcgggcgagtggtgcatcaatcgtgccggatggaggtgttacactgccacggacgatcgcgagatattcacgcttgatctcgtgtcgtgcgcccatggaagataggatgctggaactgatcaggtgcttggcaatgacagtcagtcctgaagtgtcacggtccaggcggttcgtgcagcggaagataaaaggctttccctgctctgtataataccacattagtccatttgccagagaattctcataattattcagtgatggatggatcggcattccggcaggtttgttgacaacaaggatatcttcgtcttcatatataatgctaagcggcagttcgacaggaggaatattcggtgaactttcattttcctgaatatgtactgtgagaatatctccagtagcaagtggtgaacgcatatattcccagactccgttttttaaaatgctttccggcatcttttttaactgagtgatgttctggtaggagtagccctggtgacgcaggaactgctcgatacgcaggccgtccgcttcttctgttatctgatagttgatcgtacgatccatctttttctatcctgtcgtgtctgatagcataaaaacagacacatcctttctgatttgactctttatgaactcttgtatcatacacaaaattttcaaaaattacaataatcttgaaatagtgttatgtttcttggaattttattatatcttattttggcactttttattataataacactatcaagaaaaacaaagacaagtagtaataaaaggaggattctattatgaagaagaaaaagattcttgcacttgtacttgcagcttcaatggcaggcggaatgcttgcaggatgtggaagcacatcaggcggagatgaaacagcgaaaggagataagtcatccggaaaagtttattatctgaacttcaaaccagagcaggctgatcagtgggtagaacttgctaaagagtacacagatgaaactggcgttaaggttgatgtgcagacagctgcatcaggaacatacgagtcacagctgaaatcagagatggcaaaagacgaggccccaacattgttccaggtaaacggaccggttggacttgctacatggaaggattattgctatgacctttcaaaaagtgacgtttacaaagacgttgagtctgatgactatgtattaaaagatggtgatgcagtagacggaatcgcttatgttattgagacttatggtctgatctacaacaaagcacttctgaacaaatacttcgaactgccggatgcaagcatcaaatccatcgatgagctgaataacttccaggcacttaagacagctgcagaagagattcaggcacataaagatgatcttggagtagaaggagctttcacttcagcaggaatggattcttcttctgactggagattcaagacacaccttgcaaacctgccaatctactatgagtacaaggcagacggaattgataatacagatgctatcaagggaacataccttgacaactacaaacagatctgggatctgtatctgaacaactctacatgtgagccatctatgatctcttctaagacaggagatgacgcagcaagcgaattctcacttggtgaagcagtattctatcagaatggtacatgggcttacaatgatatcaaagataacgaagtagcagaagaagatatgggaatgcttccaatctacatcggagttgatggagaagagaaccagggactttgtacaggatcagagaactactggtgtgtaaataaaaacgcttctgaagaagatattcaggcaacacttgatttcatgaaatgggtagttgagagtgacgaaggccgtgacatgctggcaaatcagatgggattcgtaacaccgtttacaacattcgcagattaccttccggacaacccgcttgtaaaagcaaatgccgagtacacagaggctggaaagacaccagtaagctggaactttacaacaatgccatctgagaactggaagaacaatcttggtggtgctcttctgaactatgcacagggcacaggcacatgggatagtgtacagacagcattcgttgatggatgggctgaagaatacgcagcagcaaatgaataaaaaaggcttttcacaggaccgacagataaaaaggctgtgaaatagagaaatagtatgcagcctgccaacgagaataccgggggcaggctgaaagtgtgttattagaagtgtaaaaagagacagacctttttacagaaagagagacaggaggagaagaacatgcaaaaagctataaaaagatattttccggtatttgtattgccgacgctgattgcattcacgataggtttccttgcaccattcgtgttaggtgtatacctttcgttctgcaagtttacaacggtaacagatgccagatttattggacttggcaactatgcaaagatactgggagatggggatttccttcactctctctggtttactgcattatttacgatcgtaacagtattactgatcaacattttcgcttttgcggtagcaatgcttttgacaaagaagattaagggaactaatattttccgtaccgtattctttatgccaaatctgatcggtggtatcgtacttggatatgtatggcagctgttattaaacggtattctggcacatttccagaaaacacttacatattcttcaaaatatggtttctggggattagttatcctgatgctctggcagcagattggatacatgatgatcatctacatctcaggtattcagaatattcctggagagctgatcgaggcagcggagatcgacggagcaaataaagtacagcttttaagatatgttacaattccgatggttatgccatccatcacaatctgtactttcctgacacttacaaacggattcaaacttttcgatcagaaccttgcattgacaaacggtggaccggacaagatgtcagaaatgcttgccctgaatatttataatacattctatggaagaaccggttgggaaggtgtaggacaggcaaaagcagttatcttcttcattattgtaggagtgatcgcattaattcagaataaaatgacaacatcaaaggaggtgcagcagtaatgaataaaaaagtaaaacatggcacattattaaccgttatttttacagtactcagtctgctgtatctgtatccgatcgtactggtatttatcaactcctttaagaaaaaagcctatatcagtaaagccccgttcgagataccgaccggaaagatgtatgtcggattagagaactatatccgtggtattaaacagacaggattgattcaggcatttggatggagtttgtttatcacaatcttatctgtagcagtgatcatcttatgctgctccatgtgtgcatggtatatctgtcgtgtgaagacaaagttcacaaaagtcttatatatgctttgtctgtttgcaatgatcgtaccattccagatggaaatgtttacattatctaagattgcaaatatgcttcatatgggaaatccatggggactgattgtgatctatcttggatttggtgcaggactttccgtctttatgttcaccggattcatgaaatccattccactggagattgaagaagctgcgatgatcgatggatgtacaccaatccagacattcttcaaagttgtacttccgattgcaaagccgacttgtgtaactgttacaattcttcaggcaatgtggatctggaacgactatctgcttccatcacttgtattggatcagagaaaatataagacagtgccgatggcagtccagtatctgaaaggtggatatggttccgtagatatgggagcaatgatgggaactttggttcttgcaatcgtgccgatcatcatcttctacctgttctgccagagatatattatcgaaggcgttgtagcaggagcagttaaaggctagttactgttcactcccgtgtcaatcactccgctgattgacacggaggatgcgtggagcacttgacttttaatcaagttgtccggggttcgaatccccgcacgctcactgaaagaaagcagtaatctattatgattactgcttttaactttatataaataaaatatggcatcaggagaatctatcattattcagataggttctttttacaaataagaggttattatggaatatttatatgaaaaattaactgcatatggaaattcagattattatgcatttcatatgcctggacataagcgtaacatggagctcatgagagccaggttaccatataatattgatataacagagatagatggatttgatgatcttcatcatgcagaagaactgttgaaagaattacaggagaatgcagccagagtatttcatgcggaagagacgcattatctgattaatgggagtacagtcggacttttgagtgcagtgatgggatgtacggagcgtggtggtagaatcttgatggcaagaaattgtcataaatcggtatataatgcggtatatatgaatgaattacgcccagtatatatttatccagagttttcggaagagacagatcttaatggtgagatccatgtagaccagataaagaagttacttgaagaatatgaagatattcaggcggttgtcattgtttcaccgacttatgaaggagtcgtgtcggatattgaagcaattgcggaaatcgtgcatgaatataagattccgctgatcgtcgatgaagcgcatggtgcacattttggatttcattcatattttccgcaaaatgcgaatacacggggggctgatgtggtgatccacagtcttcacaagacacttccgtctttaactcagacagcattgcttcatataaatgggagatatgctgatcgtgaaaggataagaaattatttgcatatgcttcaatccagcagtccttcttatattttaatggcatccattgatgagtgtgtccgggcaatggatgagtgcagagaagaaatcatggacacttatgttgagtgtttgcagcaagcaagagagagactgaagcagttaaagaatataaaattaattgaggcagaacattatgacaggtcaaagatagtattatctgtaaaaaatcttaagaatacagatggggaagttttgaatggaaaacgatttcaggaaatgctgagatcttatcatttggagatggagatggcttccgggtcttatgtgattgctatgacaggaccgggagatacacaagaaggaatggacagattggttcaggcagtgatggagattgataaaaatattctgtgcgaagagctttcagggaataatgaggatcatactataaaaaatatttcttatgaaatgattccattagaacaagcatattcttcctttgaagcagggagaatggaaggtgagagtgtgaaatggaatgaggcatcaggaagaatctcattggaatatgtctatctttatccaccgggaatcccaatgattgttcctggagagagaattacttctactattgtgcaaaagatggtaaaatataaagagatgggtttttccattgaagggctaagccaggagaattgtttattagttgcggggaatccagaataaagaaccgacaggctggaaggtgagaatacgaatccagatgcatgtttaagagcaggagaaaaagtatgggtaaaatattttatattatgggaaaaagtgcttccgggaaggatacgatttacaaagaattgatagaaaagatgcccaaatttcattcaatcgttccatatacaacacgtccaatgcgtgagggtgagaaggacggagtggaatatttctttgtcgatcaggaacgatttgatgagatgatggacgaggagaaaatcatcgagtttcgttcttacaatacaaagtgtggaatctggacttattttacagcagatgatggacagattgaattgtggcagtatgattatcttgtgatcggaacaattgagtcatattatgcattgaaagaatattttggtgatgatgttatggttccattatatatagaagtagaagatggattaagactgtcgagggcgttagaaagagaacgggcacagacgaaaccgcagtatgcagaactgtgcagaagatttcttgcagatgcagaagatttctcggaggagaatctggaaagggcgggaatcaagcggagatttcaaaatattgataaggaaacttgtatggaagaaattttgcgagaaataaacgtgaatttatgatatacttaaatggtagttcatagttttgtaagaaaatgatgttaaaattatgaatatactattgttaggtggataattgtgagaatattatccgctaaagatgaaataagatacacggcaggtgatagaaatgagtagttttaaagatgtagtagggcacaaaaacataatcaagtatatttcgagcgcagttcaggctgatgcagtatcgcatgcatatattctgaatggcgaaagaggatctggaaagcggcttcttgcgaatctttttgctatgagcctgcagtgccagaatcgtgcggaagacggagaggcatgtggaaaatgtcagtcttgtaaacaggcacagagcggcaatcagccggatattattaaggtgacacatgagaaaccgaatacgatcagtgttgatgatattcgtacacaggttaataatgatatcgtgatcaagccgtacagcagcaagtataagatttatattattccagaggcagacttaatgagtgcccaggcacagaatgcattgcttaagacaattgaggagccaccggaatatgcggtgatcatgcttctgacagagaatgcagaggctttactgccaacgattcgttccagatgcgttatgatgaaacttcgtaatattaaagatcagctcgtaaagaaatatctgatggagcagatggagattcctgattataaagcagatgtctgtgtagcatttgcccagggaaatatgggaaaagcgattatgcttgcgacatcagaatatttcaatgagattaaggaagaagttgtacatttacttagaaatattgatgagatgaatgtttcagaactgatggatgcagtgaaaaaatgtatgacatataagatggagattaacgactatctggatatgatcgcaatctggtacagagatgtattaatttataaggcaactaagaatgtagacagagtagtattttctgatcagctgagatatatcaaggcgcgtgcaagtaagagctcttatgaaggaattgagaatattttgtacgcaattgaaaaggcgaaagccagactgaaagcaaatgttaattttgaactgacaatggaactgctcttgcttacaataaaggagaactagatacatgacaaaagtaataggaataagattccgaacagcgggaaagatttatttcttttccccgggagagtttgaaatcaaacagggggatcacgtaatcgtggagacagcacggggaatcgagtacggacgtgttgtcagtgcaccaaaagaggtggacgatgattcagtggttcagcctttgaagtctgtgattcgtattgcaacagagcaggacgagaaaacggtagagaagaatcgtcagaaagagaaagaggcttttaagatttgtcaggagaagatccgcaagcatggactggatatgaaactgattgaagcagaatatacttttgataataataaagtcctgttttattttacagcggacggacgtattgattttcgtgaacttgtaaaggatctggcagctgtgttcagaacaagaattgagcttcgtcagattggggtcagagatgagacgaagatccgcggaggaattggtatctgtggacgtccattatgctgcagcacgtatctgacagagtttgcagcggtatcaatcaagatggcaaaggaacagaacctgtctctgaatccgacaaagatttcaggggtctgcggaagattgatgtgttgcctgacgaatgaggaagagacttatgaagtgcttaacagtcagttaccttctgttggagataatgtgacaacaagtgatggattgaccggaacagtacattctttgagtgtacttcgcagacttgtgaaagttattgttaatctggagaatgacgagaaagagattcgcgagtataaagcggatgatctgaaattccgtccgagaagaaagaaacagaaagtatcgaaagaagagcagaagaaacttgctgcacttgagcggatggagaagaaagagggagcttcgaagttagatgacaaataatctgagaccaggcgaacgtctggatgatctgcagcttggaggattagaattgatccagaatccttcaaaattctgttttggagtggatgcagtatttctctctgattttgcaaaagtaaagccgggagagaacgtgcttgatatgggaaccgggaatggaatcatcccggttctacttgcaggaaagacgaaaggaaagcattttacagggcttgagatacaggctgagactgcagaaatggcaagacgcagtgttgcacataaccatctggaagacagaattagcattgtaaccggagatattaaagaggcggcagaacgatttaagccggccttttttgatgtgatcacaacgaatccgccttatatgttagcggatcatggacttcggaatccagatgacagtaaggcaattgcacggcatgaggtgttgtgtacactagatgatattttaagagaaagtatgcggcttcttcaggataaaggcagattttatatgatccacagaccgttccggctgacagagattttgacgaagatgcatgaatataagattgaaccgaaacggattcagtttattcatccgtatatagataaagaaccgacaatggttttggtggaaggaatgcgtggggcaaaacccagagtgacaatagagccaccaatcattatgtatacgaaggatgggactttactgcagaagaacggaaataattctgaaaaacaaagataactgaacagttacaaagtcatgggagatgaagatggcaggaacattatatttggtagcaacaccgattggaaatctggaagatatgacatttcgtgcgatcagaacattgaaagaggtggatctgatcgcagcagaagatacaagaaacagtattaagctgttaaatcatttcgaaatacagacaccaatgacaagttatcatgaatataacaagtttgataaaggtcgtaaactggtggagaagctggaagaaggactggatattgcggtaattacagatgcaggtacacctgggatctctgatccgggagaagaactggtgaaaatgtgttatgaaacagggattcgagtaacttctgttccgggaccggcggcatgtgttacagcgcttacaatgtcaggacttccgacaagaagatttgcatttgaggcatttcttccgacagataagaaagagcgggaagaagttttaaaagagatggctgctgagacaagaacgatcgtaatgtatgaagcaccgcatcgtctggtaaagactttgaaacttctttcagagcgtctgggagatcgaaaagtaacggtttgcagagaactgaccaaaaggcatgagacagcatttcaatcaacacttgaaggagcagtagcttattatgaggcgaatgatccgaagggagagtgcgtgattgtaattgcagggagaagccgggaagaaatccgtcaggaagaaaaagcgcgctgggaagatatgagtattgaagatcatatggagcattatatttctcaggggctcgatcgcaaagaagcaatgaaaaaggttgcgaaagaccgcggcgttcagaagcgagaaatttataattacctggagaagcaaaaatcataagaagcatgttttgagagttgccagggtaaaaaaggagaggacagcttaaatgctgtcctcaattacttttccgtctttcataaaaatgacacgagaattcagggaaacggcttcttcgtagttatttgtgacataaagaaccgtaattccaagctctttgttaatcttgagaatatcatggatcatatctttccgaagatcatcatcctgatgggcaaaatcttcatctacaagcagaacttttggatggcagacaatagcccgaccgagtgcaacacgctggcgctcagaatcagaaatagaacgaatttttttcgtaagaatgtctgaaattccaagaaaagcggcagcagtctttacgcgggtattgataactgtacgcggaagatcacgaagcttcagtccaagtgccatattatcatagacattcatgtgcttatagagaatgtaattctgaaatgccatggcaagcttccggtcgcgtggaagaatgtcatttaaaaaggtattatcaagatagatctttccggaagtaatatcttccaggccgccaatcatacgtaaaattgtagattttccgcatccgcttggtccgtggaatacaacaaattcaccgtcctcgatcgagaggctgacatcgtctacagatacgaatccgttcggatatacttttttcaaatgttcaaatattaagctggccatacacaacgcctcctgtatcttatatagttgtattttatcacaaataaagaggggatgcattactgtttggaaacaaatttcagcgatgtataaataaggaagccaatgcataaaattagagaaataactgtcggagtctgctatgttgattcaattttggaaaaggcggaagaagcagtgtgtaagtattgtatgtagtatcagtattcttttcagtgctattttctttttaaacggttgtgaagcaacatttttagaagaaaaaaagagcagtaaagatgtggagaatgaaagatttacatcgtttacagaaaaattgttttgcaaagaggtggctgcaagccagatcagtctgcactatacattaaaagagccagaagcgtatgggattgataaagcggatacagcatatggaacgatacagacagacagtactcagattaagacagcagcggagaatatacagcaggcattgtatgcattttcttatgaaaaactgaatgtaaagaataaaattacatacgatctgttaaagcaatatctgagaagtttgagagaagaagcagattatctgtattatgaagaaccgttaaatacagtcaatggagtacagacgcagattccaattgtattatctgaatatcagttttatgacaggacagatgtggaggtgtatctggatgttttaagtgagacaagggattattttcaacagatcattgcatttgaaagagaaaaagcagacaaaggattgtttttgtcagatgaaatggcggatcaggtgttagaacaatgtaatgcatttcttgcaatgggaaatggaaattatctgtactcgacatttgtgtccagaattggtgaattacaggaactgtctgaaaaagaaaagagtgattatattcagcagaacgccaggcagatggaagagcaggtttgtccggcgtatgaggatttgatacaggcggttaaggaattgaaagggaagggaacgaatgaaaagggattgtgttattttccggaagggagaaaatactacgaatggtatatacagcagagtgtaggagtgacagacacgattcaagagcttgagcaactaacacgaagacaaatttcagaagatattaccggtatggaagaagcagtcaacgaagcgaagcaggcagcagcaatattggaagataggaaagcagaaagaattttagaaaagttaaaaaaagggatagggactgcatttcctgagattccaaaaacttctctgcagataaaatatgtaccggaggaaatgcaggaacatttaagtcccgcattttatatgataccggcaattgactatacagaagaaaatgtaatttatgtaaaccaaatacagatgcgagatgatttggcactgtttacaacgttggcacatgaggggtatccgggacatctgtatcagacaatattttttgaaagcacgaatcctgatcccatcaggagtattttaaattttggcggatatgtagaaggctgggcaacttatgcggagatgtgcagctattatctgatgccgttatctaagactcaggcagcaattcttcagaagaacagttcagtgattcttgcactttatgcattggcagatatgggaattcattacgaaggatggagcagaatggacacagtagaattttatgcgagatacggaattaaagatgccgaaacggttgataaaatctataatctgattctgggatcgccgggaaattatttgaaatattatatcggatatataaaatttctggagttgaaaaaggaatggataaaatctggaaatcaatcccagaaagaattccataaagctgtgctgagtgtgggtccggcgccttttgaaattgtaggaaaatatttttctctgtgattcattctgtgttataatatccacaggcacaaaataataagaggcggtgtctcaagaaaagagtcactgcttttttcatttattatagagaaactatttagaaagacaggaggacgtgaaaaatgaaattaatgattgcatctgatatccatggttcagcattttattgcgaacagatgattgaggcttataaaagagaaggcgcagacaaattattattgttaggagatattctttatcatggaccgagaaatgatctgccggaaggatatgcaccgaaggaagtgatcgcaatgcttaatccaatgaagaaagaacttctctgtgtgagaggaaattgtgatacagaagtggatcagatggtattggagttcccaattctggtagattattgttatctgaatctgtcgggagatccggaagaaaagaacagtgatgttacaatatttgcaacacacggacatgtgtataatccacataagcttccgatgctgaaagacggagatattctgttgaacggacatacgcatattccggcatgtgaggaaatccttgatatgaacggtggaaaatatcagtacttaaatccaggttctgtctcgattccgaaggaaggatccgagcacagttatatgatttatgaaaacggtgtatttacatggaagaatcttgcaggagaggagtatcagacatggaagaccgtttcgcactcttaatcgatgcggataatgtatctgcaaaatatattaagccaatcctggatgaattatctaaatatggaaacgtgacttacaaacgaatttacggagactggacaaagtcaaacagtgcgagttggaaggaagaacttcttcaaaattctattacgccgattcagcagttcagttatacacagggaaagaattctacagattctgccatgatcattgatgcaatggacatgctctatacaagtgaattggaggggttctgtctggtatcaagtgacagtgattttacaaagcttgcaagccggcttcgtgaaagtggaaagatggtaatcggaatgggcgaggacaagacaccgcttccgttccgtaaagcctgtgatatcttcaccgtattagaggtgcttctggaagataacacgatagagaaggaagagagcgaaggaaagtcttatcatccgcatgtgtttggaaggggacagaagaaaatttccggtgcttcattatcattgtcgaatggaagaggttcaaaagaaaagattgaaaaggtatcaaaggaaaaaatagaagaaatcgtagttaagatcattacggaaaaccagaataacgacagggaaaccgggcttggtgaagttggaagccggctggtcaaagtatatccggactttgatgttcgacgttatggttacagtttgttatccaagttccttgaaactttaccgaaattaaagctgatccaggaaggaacgaaagtttcagttactctgtatgaagataagagtaagaaagatatgcttgaagagtatattatccgacagatccagatgacaggggatcaggggatctctcttggaacactggggaatcgaattcgtattcagtttggtgattttaaagtacgggattatggatactcacaatttaagcagtatatacaaagttttccaaaggtagaattgatcgaagatggagagcgtacccgcgctgtttatgtggaagattaaaagtagagagaataagatacagaaggggtgctgattaatgataaagaaatggaacgcagtatgttcctggatgcttacgttattcttacttggacatatgcttaccatgtccattcctgtgttgacaggtggacaggattattctgattgtcagatactcgcaggagggattgtggcgacagttttgattcatgtagttctttgtattgtaagttattatccaagacgtggagtacttaattttcacagatacaggaaagagaattggagattaattacgcagagaatcagtggaattgttatactgattttattgtatccacacatgagagtacttcatcttataataagtggagcaacattttctggtggagcaaagtttcttgtattagtgacggagattctctttgcaggtgcggcatttctgcatctgagtgtatcgttcagccgttctatgctgacgcttggtttgttgaagaacgataggatggagaagcttgtggattatgtaacatggatcatctgtggattattaatggttcttacggtggctgcgcggataagattgtaggaacaggtgagatttttaggaaagagaagatgacaaatgaaggtattgattataggaaatggaattgccgggatgtctgctgcaatagaagcagcagaacttgatgatgaggtaattcttgtatcaccgattcagtcagaacgtacacagtcagttatggcagcagaaggaatcaatgcagtagttgataccgcagaggaggattctgtagtgtggcatgcgaatgatacgctggagagtggatgttttcttgaaaaagaagaggatgtgagaaatctctgtgagaaagcaccggaacatctgaaatggctggatgagatgggagttctttttgatcgaaatgaagatgatacatggaaagtgaaagcttccggaggacagagtagaaaaagaactgtttatgcaggggattccactggaaaacagattgttacggcaatgacacagaagtgtcttgagtatgagattaaaggtaaaatagaaaagaaaatcggattgtatttttattccgctcttattcgggatgaaaagtgttatggagcgttattttataatccagaatctaaaatgttgattccggtttatgcggatgcagtaatctgtgctaccggtggaatgaacaagctatatggaaaaaccactggatctgaattaaatgatggttatgtgacaggaaagctttttttacagggagtgcagctgagaaatctcgaatttatccagtattatccgaccacggttcagagaggaaataagagggttataatctcggaatctgtcagaagtgaaagttggagactttattataagaatagaagtcacagtgtttatttcatggaagaaaagtatggtacggaaggcaatctgatgtcaagagatcttgtcgcaagagaaattgcaatgtgtcccggacaggtttatctggagaatgcaaaagaatcgatccctgtaacgccggcaatccatttctttatgggtggtattaaagtggacggaatgcatcagacgaatattgcaggattgtatgctgtgggagaagctgcgtcaaaatatcatggtgcaaattgccttggtggaaattcattgatgacagcagttcattcgggaagaacagcagcgcatgcggtgcatgagggacagggtcagccgatgtgcgaagaattgtttgttccttatattgagcatgagcaggagaaaattgatcgtatggaacagatgtcagagtatcggggcaagtattcagcgacagcaacactgcgtaaattaatgaagatcatgagttatggcatggatttgatccgtgatggagaagttcttcaggatagtatttacgcattggattccagcttgaatgagctgaggacatttccgattgatccaatggtatctgtttatgaaaattacagattatatccgatggctgttcttggaaaagcgacacttatgagtgctgtggaaagacgtgaatcaagaggagctcatttccgaaaagattttccaggtgaaaaatcagaattcatgaaatgttccgttgcagagtttaaagacgaaaaaatcaggatttattttgaacaggagtcaggagaaaagggaggcgctgtgagatgaaagtaagaatcaaaagacaggatgaccgaagatcagcgccgtattggcaagtttttcatttcagaggagagggaagaattacagtagccgcgattctcgagaagttaaatgaacgtgaccagctggaagatatcaaaggaaaacaatgtagaaaaatccgttgggaatgtggttgtatgcagaaaatgtgcggaagttgtgcaatggtgatcaacgggcatccggcattggcatgtggagtgttcattaatacagatgatacagagattttaaggctggaaccacttacaaaatttccggttgtggaagatctgattgttgacagatctgtgatatgggaacgccagaaggaagcactgatgtaccttggaattcggaaacatccagatccgaaagagcatgatcatcagtattcggcagcaaagtgtctgaaatgtggactttgtctggaagtatgtccgagttatcttggggcaaaagatgatttctatggcgcagagtttgcaaataatgcgtatcttctgcattcttccagtctgaatcgaaagcgggcattggagaaacagtatgaagaacattttgcgaagcaatgttcgaaatcactggcatgcagagatatctgtccggcgcacctgcagacgttgtcgtcgatttcttatatgaatagaagataagaaatgagtcgggtattattcgctggatgcggtttctcagtgagaaatgcaaggagaacttaaagaaaatggcagaaaaagagaattaaaatctataaggggcgggtacagtacaatgtatccgcctttaaaaataatgagttgttaaataaattgattggcataacgattaataattcttcaaatatctaataaccttttcggtcacagcgttctgatactttccttttctccagataacaccaatgcgctgttcaattgcaggaaagacaggtattccgacaagttcaggatacatatccaccatagacttatacaaaaaacagccaatatgattagtctttaccatattgatcagcgttgtgatctgactggtgttcagaacaatgtgtgggtttactcctgcggccttgaactgacgggtcagtgtcataacctgaacagaatcagtgttaaacagaaccaatgactcatcagtcagcatgtttaaaagaagcgtggattgttctgcaagtggatgatcctttgatacgcagaagagcagatcttcattatcaataatatgaaggttgcatttatcaatcgcagactgttctgcattgacaatcgcgaggtcaagtttctcctccagaacaagttcacaggctttgatcgatccatattcatataggcggaaatctacgtcagggaattcttccttcaaagaaagatacatatccggcaggtaaatggttccaagcattggcgggattccgatgcggacaggtgtaatctgcttacggagttcgtgcagttcagatctgacagcatccgcatgagccaaaagttcttcggcattttgatagaacttttcaccttccggtgtcagagtcagtttattattgtttctatagaaaagattcacgccgaattcttcttccaaagctttgatcgcgttagataccgaaggctgggtaacaaaaagctctttggatgcgcgggtgatgttgtggtatcttgcagcaacacagaaatattcgagttgtgtcagtttcatttgtaaaaacctcctatatctaaattattgcgtactaaaggtttccatagttttttcttatagtaccatatttttttcagaatgtacattttcgattgtattttctataatacaaccatagcagagaggtaatcgaaacggccggaaattacttaaagcgaagctaaaaataatagctgaaaaagttaagaagtaaaagaaaaacagaaacaaaggaatggaggaaaacatatgagtccatcaacaataactcttctgtttctcctgtttgcggtaatcatgtttgtattagaaaagataccgcttggagtaacatcaatgattgtctgtatcggtcttgtagtgactggggttttagacgtgaaaacagcctttgcagggttcattgacagtaacgtaatcctttttgtagcaatgtttatcgtaggaggtgcgttatttgaaacaggaatggcgaataaaatcggaggaattgttacgaagttcgccaagacagaaagaatgctgatcattgcgattatggtgatcgtaggattgatgagcggaatcctgtcaaacacaggaactgcagcagttctgattccggtagttatcggaattgcagcaaaatcaggatacaaaagatccagacttctgatgccgctagtatttgcagcagcaatgggaggaaatctttccctgatcggtgcaccgggaaacctgatcgcacagagtgcactcggtgaaatcggactaaaatttggattttttgagtatgcagttgtcggtatgccgatcctgatcgtaggaattattttctacgcaacaattggttacaaactgcttccaagtcacgatgtgaaggatgacggagcttttgatacaacaaagaatttcgataatgtgccgaaatggaaacagtggttatcactgattatcctggtatttacattgctggcaatgattttcgaagataaaatcggtatcaagctttgtatttccggtggaatcggagcactgcttctgatcctcacaggagttatctcagagaaggatgcgcttaagtcaatcgatcttaagacaatcttcctgttcggtggtacactttccctcgcatctgctcttcaggagacaggagccggagaagtgatcgctaataaagtaatcggagcgttgggtgcgaacccatctccatatatcctgacacttgttgtattcctgctgtgttgtatcatgacaaacttcatgtcaaatacagcaacaacagcactgatggttccaatctgtctctcaattgcacaggggatgggagcggatccaagagcggtactgatggcatgtgtaatcggtggttcctgcgcatatgcaacaccaatcggaatgcctgcgaacacaatggtagtcggagccggtggatataagtttatggactatgtaaaagcaggattcccattgatcatcattgcaacagttgtaagtatgattatccttccaatcgcatttccattcttcccgtaagaagacatgttgttggagtgagatataaaagaaactataaaacaatgaactaacctaatcatcaaagttactggaaattgcagcagtaatgaaaggagacctaaaaatggataaaaaagcacaggtagagcagcttactacttatatggcgaactttgtttcctatattggtaaagtactgccggatgacatcaaagcaaagattgacgagcttgcagaaaaagaagacagcccgctttcaaaggttatttatcagacaatgcagaagaaccaggttcttgcaaaagagctgaacagaccaagctgtcaggacacaggagtattacagttctgggtaaaatgcggaacaaacttcccactcattggagaactggaagcactcttaaaggaagcagttgtaaaggctacatttgaagcaccgcttcgtcataacagtgttgagacatttgatgagtataacacaggaaagaatgtaggaaaaggaacaccgacagtattctgggatatcgtaccggacagtgatcagtgcgaaatctatacatacatggcaggtggtggatgtacactgccaggaaaagctatggttcttatgccgggcgaaggatacgaaggagttacaaaatttgttcttgatgttatgacatcttacggattgaatgcatgtcctccgctgcttgttggtgtcggtgttgctacatctgttgagacagcagcattactttccaagaaagctcttatgagaccgcttggaagccacaatgaaaatgaacgtgcagcgtctatggagaagctgcttgaggatggaattaacgcaattggacttggaccacagggaatgggcggaaagtattctgttatgggagttcacattgagaatacagcaagacatccatccacaattggagttgctgttaatgttggatgctggtcacacagacgtggacacattgtatttgataaggaccttaactacacaatcacaacacattcgggggtgacattataatgctggaaataaaagatggaaaaaagattttaacaacaccagtctcagctgaggatctcaaagatattcatgcaggagatatcatttatctgaacggaagcatgacaacttgccgtgacgttgcacacagaagactcgttgaagaaggacgtgagcttccggttgatgtaaaagatgcagcaatcttccacgcaggcccaattatcagaccacttgagaatgacaaatttgaaatggtttctgtaggaccgacaacaagtatgcgtatggaaaaatttgagtatgaatttgtaaaagagtccggagttcgtgtaatcatcggaaaaggtggaatgaaagaaaacacagagcgtgcatgtaaagaattcggagcaatccactgcgtattcccggcaggaaatgctgttgttgcagcaacagaagttgaggaaatcgttgatgctcagtggagagacctcggaatgcctgagacactgtggcactgccgcgtaaaagagttcggaccactgatcgtatctattgacacagagggacgcaacctgtttgaagagaacaaagtagtcttcaatgagagaaaagaaaaagcgatcgaagaaatctgcaaacatgtaagctttattaaataagttgtgtcaggacattaaagtttactcgaaaaatctgagccgctcatgcctgaaaagcgactcagatttatgaaatcagaaattaaaccaattttactgccatgtaaaaatataccataaaatataagccaaatgatctgttcggccagggacagataaaaaagatatcggagcacacgaaaaatgtaagtgtgtttcgatatcttttttgttttgcaaaatctatttattttgttccgaaaatgcgatccccggcatccccaagtcccggacagatgtaagcatctttgttcagttctctgtcaatatgtcctacgtacagctgaatatccggatgtgcttccatcagacgttctacgccctccggagcagcaatgatagccatgaatttgatcttctttccgccatgttgtttgataaaatcaacagcagcaacagcagaaccacctgtagcaagcataggatctgtaacaacaatcagacgttcagagattgggcttggcagtttgcagtagtattcgtgtggctcatgtgtctcctcatcacgatacagaccaatatgaccaatctttgcagtcgggactaaagcctgaagaccgcttaccattccaagaccggcacgtaagattggtacaatagcaaagttcttgcctgcaatctgtggtgtcatacatttttcaatcggtgtttcgacttccacatcttctaatggaaggtcttttaaagcctcatatcccattaacatagcaatttcttctaccagcgcacggaattcagcagttcctgtatttttgtctcttaatcgggaaatcttatgctgaatcagtgggtgcttcatctcaattacattattcattttgaattcctccatccattttctgccccctattataacgagtttcttgttttgagactacccctttttttaataaaagggactttcgaacaagattattgaaagtttgtcgagttttatttcatgcaatgaataggtagcttgagttttacaagatattagagtaaagtaatattaaaagaagtcaagaatttctacaggtactgttcaaggtagttgtgccctcaatggcataagatatgaagtggtagagaggtgaaaaaattatgaaaaattattcagaagatccgagcagacaataccatattcaggtagcaaaaggagaagttggacgttatgtgatcatgccgggagatccaaaacgttgcgttaagatcgcacagtattttgatgatccggttttggtagcagataacagagagtatattacttatacaggaacactggacggagtaaaggtaagcgttacatctacaggtatcggtggcccgtctgcatcaatcgctatggaagagctgtacaaatgtggagcagatactttcgtaagaattggaacatgcggaggaatgcagacggagattaagagtggtgatgttgtaatcgcaactggtgcgatccgtatggaaggaacatccaaagaatatgcaccgatcgagtatccggcagtagcagatcttgatgtcacaaatgcactggttgcagcagcaaaagagaaaaacttcacacattatacaggtgttgttcagtccaaagacgcattttacggacagcatgagccagaaaaaatgccggtaggatatgaacttatcaataaatgggaagcatggaagatgatgggatgccttgcatctgagatggaatcagcagcaatgtttatctgtgcatctaaattaagagcaagagcaggttcttgttttcttgttgttgcaaatcaggaaagagagaaacttggtcttgagaatccagttgctcatgatacagatatggcaatccaggtagccgttgaagcaattcgcaaattgatcaaagcagaccaggaaaacaaataagaaaacaggtagtagcatatgaaagaaaagaggaggctgtgatggaacaggttatggttgagaaattgatcgatacagcgattgagcaacttaagttttcctatacaccttattcgaattttaaagttggggcagcgcttttaacaaagagcggaaagatctatacaggatgtaatatagaaaatgcatcttatacaccaacaaactgtgcggagagaactgcattttttaaggcggtaagcgaaggtgttcgtgattttcaggcaatttgcattgtcggtggcaaaaatggaaaattgacggaatacactgcgccatgtggtgtatgccgtcaggtcatgatggaattctgtaatccgaagacattccagatcattcttgcagtggataaagaacgatatgaaatttatactttagaagagctgatgcctcttgggtttggaccattaaatttggtataatatatacgaattaaaagctgacaaaggaagggggatttaacaatgacaagggaagatattataaaattgccaaaggtggaattgcactgtcatctggacggatcactgagtcgggaatttgtgggaaagagactgggaagaccggtaggaaaagaagaactgagtgtgtcaaatgactgtaccagtcttgcagaatacctagaaaagtttgatctgccggggcaatgcttacaagatgaagaaggtcttgaagaagccggttatgatgtgcttagaagtatgaaacaggagaatgtgatttattctgagatccgtttcgccccccttctttcagagacagatgatatgaattgtaacaaagtgatagaagcagtcctaagaggtcttgaaagaggcaagaaagagttcggaattgacttcggcctgattgtatgtgcgatgcggcatcacagcgaagaaatgaactggcgcatgatacgtacagcgagagaatatcttggctcaggattgtgtgcagcagatcttgcaggagcagaagccatctaccctatgtcagagtttaaaaatctgttccagaacacccaaaagattgggatgccgttcacaatccatgcaggggagtgtggaagtgctcagaacatcatagattccgtggaagctggggcaagaagaatcggtcatggaattgcaatgagaggacatagtgatctgatcaaagaacttgccgaaaaaggaatcgggatcgagatgtgcccaatcagtaatctgcagacaaaagcagtagcaggaccggaggaatacccgatcagagagttcttgaatggcggtttaaaagtaacggtcaatacggacaatcgtacggtcagtgatacaacaatgacaaaggaactggaatttattcaaaacacatacggaattcaagatgatgaaatctatcttttaatgaagaatgcagcagatgtggcttttgcggaagattatgtaaaagataaattgtatcggataatgagggaagtttatggcgcataagtatttacacgaaatgttaccggttttcaagttcagaaaacaaagaaaaggagtgtggaaattatgtataagaaattagttacatgtcttgaaagtgtaagaaagaagatcgattttaaaccagaagtggcactgattctcggatccggacttggagacttcgcagatgggatcaagattgagcagaccatcgattatacagagattgaaggatttccggtttctacagtaaagggacataaaggacgctttgtatttggttatgtagaggatacaccggttgtgatcatgcagggacgtgttcattattatgagggatataagatgtctgatgttgttcttccgacacgtctgatgggaatgcttggggcgaagaagattcttcttacaaatgcggcaggtggatgcaatccatcttataaagccggagatttcatgatgatcacagatcatattacaacaggagttccaagtccactgatcggaccgaatattgatgaacttggaacaagattcccggatatgagtgaagtgtacagcaagcgtcttcaggatgtgattcgtaaatgtgcagcggagtgtggcattgagattcaggaaggcgtttacgttcagtttacaggaccgaactatgagacaccggcagaaataagacttgcacagagctggggcggagatgcagtcggaatgagtaccgcatgtgaagctatggcagcacgtcatatgggtatggaaatctgcggaatttcctgtatcacaaatatggcagcaggaatttcaaaagttgaattgaaccataaggaagtacaggagacagcagaccgtgtagcaaaatcatttaaggaacttgttacaaaggtcgttgtaaacatgtaatggggtgtgatttttatgaaaaaatataatcgaatttttacaattgtgatcgattcattcggagcaggagcaatgccggatgctgcagagtatggggatgcaggaacagatacaatgggacatatttctgagtctgtggatgaatttcatattccgaatcttcagaaacttggaatcgccaatttgcatccactgaaacaggtggcaccgatagaaagaccgatgggatactattctttcctgaaagaagcaagtaccggaaaggatacgatgaccggacattgggagatgatgggacttcatatcacgaagccatttaagacatttacagagacgggatttccgaaggaattgattgacgaactggaaaagagaacaggacataaggtaatcggaaacaagagtgccagtggcacggagattcttgatgaacttgcagaagaagagattgcaacaggtcatatgatcgtctatacatctgcagattctgtattgcagatctgtggaaatgaggagacattcggactggatgagctttaccgctgctgtgagattgcacgtgatattacgatgaaagatgagtggaaagtcggacgtgttattgcaagaccttatgttggaaagaaaaaaggtgagttcaagcgtacaagtaacagacatgattatgcgctgaaaccatacggaagaacagcacttaatgcactcaaagatgcaggatatgatgtgatctcagtcggtaagatttttgatattttcgatggagaaggtctgacagaatcaaataagtccaaaagttctgttcacggaatggagcagacaatcgaaatttcaaaaagagatttcaaaggcttgtgctttgtaaatcttgtggattttgatgcattgtggggacaccgcagaaatgtgaaaggatacgcagaggaacttgaacgatttgatgtgaaattaggagaatttcttggtggattgagagaggatgatcttctgatcattactgcagatcacggaaatgacccgacgcacacaggaacagaccatacaagagaaatggttccgttttttgcatattctccatctatggaaggatacggaaaactgccggattcagatacatttgcagtgatcggtgcaacgattgcagataatttcgacgtaaagatgccggagggaacgatcggagcatctattttagatgaactgaaatagaatagctgagaacgaaataatacaaaaagcaaattctttggagtttgctttttgcattttacggaagtgaaaaaatgtagtatagtaaatttgaattgagcggtacggcaaaatgcggaggttgataatttccaccttaaggtaatgaagtttagaacaaggagacagagaaaaatggatgaaagattgaaacgacagcttgattttgcattggaaatagataaggaaaaaaacattctgagacagacacatctctcagagcatggcagacgggaaaacgatgcagaacatgcatggcatatggcgatcatggcatatcttttcagagagcattcaaacgaatcggtggatattgcaaaggtaatgctgatgtgtctgatccatgatattgtggagatcgatgcgggtgatacgtatgcatatgatacagaaggtttgaaaactcagaaagcaagagaagatgcggcgaaggaaagaattttttcaatccttccggaagatcagaaacaagagctgatttctctttttgatgagttcgaggcatttgaaacagcggaatctaagttcgcacatgcaatggataatctacagccgctgatgctgaataacagcaatggtggaaatgattggaaagagcatggagtatgtgcagatcaggtttatggtcgtcagaggaagacgagacttggatcggaaaaaatatttgaagttgtagatcagattatccaggaaaatgtaaaaaagggaacaattaaagagtaaaatgggaataactttcttataaaatgagaggaatgtggaaaagaatagcagctgtctaacaagtgtgttgtgagaacagctgctattctttttgagagggcaaaaatcaggtgaaaaactatttataatccattaccagaaacattgacttgattgcaacgatttcatcatactcttctttttcaactgttacattagaattcagagctttcaaatcatcttttaaaaccgtgagtgcttcaggaatcgtttgtgcacggccatccttcatgatatcctgcattctctttaatacgaccggatgtgcgtaatgtgctggaaccggaaagtcaggatatttctggatataggcttccatttgctggatggatcgttccagctgattttcgatatattttttattgtttttggaggttggcaatacattcgctcctgcgaacaggaaaattgctgccaatccaaataacaggaaatacataccgaatccggcatgagtcagaagggagtagattccataaaggaatgctccgatacccaatattacaacagcaagagcgacccatttataagcgggattgcttctgtcataggttctctttttcttcgccgacaggctcagatccatgtagtaatcggattgctttttaagataattttctgcgcgttcaagcttagtaagccgctttttgatttcttccggaagaatgcgttcgcgctgcttttcttccagccattttcttttttcttccagttttcgctcggcttctatgctgtgcagcggaatctgaggaaatctttcttcaatataagccaaaaggcgatctacatcttcttcatgtttgaagttacattgtttttcttttccattttcatatacaactacgagataggataacgttccaaatgctccttttcctgtaaaaccacctttgctcatggcaattcttttaaagattctttctatggaagaaattggtatgtaataacgtctgtcaaaataaaaactgtttaaataaattgctttttccccaacaccgcaagggcctatttttttgcagttttttttgtcagtggttaattcagcatccgggattgttacagttccaagtcgttgtggtttaaacataatatcatctcatttcatttgtatattttaaaagaactgtgaaaaacatgatgtctgtctgtttttcacagtcctatagtcttaagcctgttttctggcaggttttcttgttgcccagataaagattccaaggaacaatgctgccaggataattcctacaggataagcaactgctgtagagaatccaagacattcatctgcacagaagaaataggtcatggaaacggcactcataaatgttgcaggaactgctgtgatccagtaattcttcttctcgcggaacagatacatacttgctgtccacaaaacgatcattgctaaagtctggtttgtccaactgaaatatctccatacaatggcataatcaagatgtcctacaaaagcaccgactgccagaagcggtacacagagaaccaatcgtttctgcattttattctgatcgatcttgaaccagtctgcaagtacaagacgggcacttctgaatgcggtgtctccggaagtaatcgggcatacgataacaccgatcattgccaatgctacaccgatgcttcccattgttttaatacaaacatcgtaaatagcggctgactgaccatttgcaagaatctcacttaatccagtgtttagaccaccagttactttgtaaattgcacaacctgcggctgcccagatcagtgcgatcacaccctcggctaccattgctccgtagaatacgaaatgtccctgtttctcagatttcatacaacgagccatcagaggggactgtgtagaatggaaaccagaaatagctccacatgctacagtgataaacatgaagctccagattggttttccgtcaggatgcatatttgtaaagtggctccagatttccggaattgtataattcggatttgtgaagataccgatgataacaccaagagccatgatgatcagacagataccaaaaatcgggtagatgcgtccgataatcttatcaatagaaataaaggtcgcgataaaataatataacaaaataatccaaagccagaattcaggatttgcaagaagtccggtgatacctttgttcccaagcaaagtgacgatcaagccggcaggacctactgcaaatacagtaccaaccatgacaagaagtactacactgaatacacgcataacatttttcatgacatttccaagatagattccacatacctcagaaatcgatgctccgtcatttcgttcagaaagcataccggagaaataatcatgcacacctccggcaaaaattgtaccgaatgtaatccaaaggaatacgactggtccccataaagcaccctgcatggcaccaaaaataggtccaagaccggcaatgttaagtaattgcacaaggaataacttccattgcggcataacgacataatctactccgtcattgattctgacagcaggagtttctctgtcgtcaggtgcgaatgtgttctcaaccacctttccataaacaaaatatccgccaataagtaacgctaaacaaataataaaactaatcatacaaacacctccagaaaacataaatgttagcgcttttcaacccacttatattataggattgtttataaaaatttcaaggtttttagacaaaatttatataatctctctaaaaaaatcaagaaaagtatcatttgtagctccatgactggcgattgtcgcatcggattgttataatagatgaaataaggccatcatgtttggcgtgctgataagaaatatgcaatgaaaaacacagagatacattttcgtggagggatacgttatgataactttaaatgattatctgtattcgggcgataccatttttaaggtgctgcagaattacattacagatctaagggaagatgcacgaaagacaaaaaatgaaattgatctgatacattgtaatttcctgattcagatcagagaacttttggaacataatgaattccttacgacccagtcacagcaggttcgggaattctataaatatatgacaaaagaatatccatatcttgcatttacagtaaagggaagaatcaagtcgttgatccgtgcggaagagaaatttaatggttatattgtcaagtatatttcagattattacgaagaatatggaaagtatccgacaacggcagagttaaagcgcagtcttagctgctttcgagacttgatcgcataccggatcgtaatctccatgccgaaatgccattatgaaaatgaagaagaacgtcagattgcagagctggagtgtttgtatgaaatagcaaatgtactaccgggttttcttgaggaaagagggtttacagcggagccggcaaatggtgtgatggaaagtcattcaccactcatggatgacaatgtcagaccatattacagagattatatttcagacagccagccggatgaataccagtcactgcacattacattctatgataactgttcaagaagttatattgaggttcagatccgtacaaagcaaatggatgatattgcagagattgggccggcaaaccatctgggatatgagaaaaaacaagagaaagagcgcgccagaagaaatgcgattccaagaggtgagtgcatttattttgatgaggcgtatgagcgcggaatgaagctgttgggattggatctggcgaagctggatgtaaatatgtttgcagcgatgaataacagtttgatcaatgacggatgtggattgtttcgaggaagactgatcttgccgtatgagcatttgtcgagatttcagaatgatttgattgattagaaagaaggaattacaaaggagaaagtgtttgatgggggacaacaagaaaaaatggctatggatcagcctcggaatagttgcaggaatcttggttttagggtacataggaaccgctttgtattttatgagtcattttcttccaaatacaaaggttaacgggaaagatttttcatatgctaaggaagaagatgtggcagattatctgaaatcagaagttaagaagtatgaattgaagattacagaacatgcgggactttctgatatgattacaggaaaagagatctctgttgaatataaagagaatggagtgatagataaactattaaaggagcagtccgtttttctgtggccggcagcatggtcgggagagggaaaaggattgtccatcacggcaagtgcagattatgatgagaaagcattagatgcgaagattgcaagtctgacagctatgacaacagaacaggtacagccgatatcttctatgccggtgtttgacggagaaaagtttgttccgggagacattacggaagggacggcaatcgatgcagatgcattgaagaaagcggtagtccaagcgatagagggactgcaagagcagttgaatcttgatgaagcaggatgttatgtacagccgctatatacaaaggagtcattggaagttcagcaggcgtgcgatgcgatgaatgcatacctgaatgcgagtgtaacttatgagatgggacttgatacaccggttgtagttgataaaacaattatttcacagtgggtgacagcagatgagaattatgtggtgacatttcacccggaacttatacaggaatgggtgacgcagtttgcacagcagtatgatactgcaggaaagaccagacaattcactacaccggatggaagagcaaccgaagtttccggtggaacttacggttgggagattaatgaaaaggcagagtatgagacacttctcgcgaatgttgaaagcggagaaacaataagtcgagagccggtttatgtggaaggaaagactgcggcatcgcatggtgcgcaggattggggctccacttatgcagaagtcgatctgacgaatcagaaaatgtggtatgttaaagacggagaagttttaatgtcagcagatgtagtgaccggacttccgaaaggcggaagaagtactccggcaggagtttatacgattttggaacgaatgcagaataaagtactgcgcggtaatttaagaccggatggaacaagagagtatgaaactcctgtaaaatattggatgcgtgtaacgtattccggtgttggttttcatgatgcaacatggcagagcagttttggaggaaatgtatatacctacagaggttctcatggatgtatcaatatgagctattcggatgccgggaaattgtatgagttgatccaggttggagatccggtaattatgcactattaagaaaaataataagaaaaatcaaaaaaatctgccaatcggcagatttttttgtatactagagagtggctaaaaattgtaaaagaggtaaaaaaattgaaaaagaggtatgtaaacaatttaatacttctgataatcgcgcttatttggggcgcagcatttgttgcacaaagtgctgggatggactacatcggtccattcacatttaacagtgccagaagtatacttggtggaattgtattgattccggtgatttatgtattgaataagaagagaaaggatgagatatcacaaggaaaagaagttatacaaaataagaaaacacttatcatcggtggtatttgttgtggatttttccttatgctgggaagttccttgcaacagatcgggatacaatatacaacggcgggaaaagcaggatttatcacggcattatatattctgattgttccaatcctggggctggccgttggcaaaaaggccggaattaaagtatggattggtgtggtacttgcagtgatcggaatgtattttctgtgtatgacatcaggattatccattgcaaaaggagatttttatattttactgggttctgttgctttttcattccatattcttgtgatcgatcatttttcaccaaaggcagacggagtgaagatgtcctgtattcagttttttgtttgtggaatcttatgtatgataccgacaattttatttgagcacccggaaatttattctatattgcaggcctggaagccaattgcttatgcaggaatcctgtcttgtggagtaggatatactttgcagattgttgcacaaaaaaatacagacccgacagttgcatctctgctgttaagtcttgagtctgtattttcagtacttgcaggctggttgattcttggagaaaccttgtctccaagggaactttttggatgtgcccttgtatttgcggctgtgattcttgcgcagcttccggagagaaagcctaatctctcatgtagagatttacaacgtgaagaatcccgtcctcatcattcgactttgtgataaagtcagcagattctttgacgaccggctgggcattctccattgctacaccaagaccggcatattcgatcatggacagatcattgaagccgtcgccgcagcagatcatggaatcggcggtgagaccgatactgttcagaagcttctgcagagagtgtgctttatcgatattctgaggcatgatctctaagaagaatggttcagaacggtagatgttgagcagcccgtggtattgtttctgcagcttcggcatcaggtcttccaggatggaaggttcacctgggataagcattttattgacagggaaatcaagtgcggcagggaagtcctcaaccggacagatctccatgctgttgatggcggcttctttctcagtgtattcattacttttaataccggagaggattactttatccgtataagagataaggtccaatccaggatattcttttaccgcctcgtaaatcggacggatgacttcctgtgggataaccttattataaataattgcattgtcagaacagcgggtgattctcgcaccgttaaaggagagcatgaatccgccgtattcttttagatataattcctctgccagaggtgcgacaccgttgatcgggcgaccgctggcgaggactactttttttccattctgttgaatttcaatcagagcgtcccttgtagggggcgttatttctttttttgaattggtcagtgtaccgtctagatcaagtacaatcacttggtatttcatactaattaaaactccattccgtcgtatgacaacagtaattaatgatgtgcttcattcagcagcttggtttttgtatcgtacagtttttgggaaagatccacatatactttatgtggattgaagagacgttttgtctcatcccaaagcgtctctttttcctgacgacagaactcggcaatctcctttacagatggggactcatacttacattctccatgctggaagattgggacaagcagttcacgcattgtgtaggttccacccggaagaagtgttttcttccatgtagcatttgggtcaaagagaagaagatcttcccctgtattaaatgtctcatcagcaaagcagatcagatcggcacgcagcataccagtctctttgtcgtaaatgcgatagatagttttatttcctggattggtgatcttttcaatgttttcagaaattttaatctttggctggaattcgccttctgcgttttgaatagcagccagtttatatacaccgccaaaggatgggcagtccttagaggtaataagattcgttccgacaccccaggaagaaattgcagcgccctgcatcttgagatcgtggatcagaaattcatccaggtcgttggaagcggcaatgacagcatcctggaatccggcgtcatccagcatcttacgcgcctttttagaaagataagcgagatcaccggagtcaaggcggataccgtagctcttcggtttgatgcctgcttcgcgcatctcggtaaaaacacggattgcattcggaacaccggatttcaatgtgtcataagtatcgacaagcagtgtacatgcatcaggatacaatcttgcatattctttaaatgcagtatattcatctttgaaagtcatgatccaactgtgtgcatgcgttcccataatcggtacatcaaacatttcgccggcgagtacattggaagttccgacgcatccaccgatcacggcagctcttgctccgtacagtcccgcatctggtccctgggcgcggcgaagtccgaattccatgataccgtctccttgtgccgcataaacaacacgggaagctttcgtagcgatcaggcactgatgattcagaattgtaagaattgctgtctcaacaagctgagcctccatgatcggagctacgactttcagaagcggttctcttgggaagatgacgcttccctccgggatcgcataaatgtctccgctaaaatgaaatccgctcagataatgaagaaaatcctcactgaacaatccgagccctcttaaataatcaacatcttcataagaaaaattcagatttttaatatagtcaataacctgatccagtcctgccatgacggaatatccgcctttgttcggattgtcacggaagaaaacatcgaatacaacggtctgattttcctgtgtttcaaaatatccctgcatcatagtaagctcatacaggtctgtcaataaagtaagattttgtgcactcatactaatatcctctcttaaaaatactgcctcagacaggctgtaggcagaaagattgctctcacattgaagtaattatacataattcagaaaggtaaatcaattcatagaaaggatatgttaaaaaaatatcaaacgaagaatcaaaaaaattgatgagattcgattgacaacagcatagaaaataccttaaggtatagaaaacatattaaaaaatgggccgcgtaagccagcggcagaatggagaaaagatgagattaggagtaaaacaggtacttacggtagtaaagctggtagattttggagtatatcttggaagtgacgaggagcgtgttcttcttccaaagaaacaggtcccggacggaatcgaactgggagatccgatcgaggtattcctctataaagattcttccgatcgtatgatcgcaacaacgaatgagccaaagatcactcttggacagctggctgtcctgacagtagcggatgtgggcagaatgggtgcttttcttgactggggacttgagaaggacctgttccttccatttaaggaacagacagagaaggtagagaagggcgaccgctgtctggtaagtctttatgtagataagagcgagagactttgtgcgacaatgaagatctatcatcttctgcagacagactctccttataaaaaggatgatattgtaaccggaacagtttatgaggtgaatcgtgatctgggagctttcgtggcagtagataatctgtattcggcattgattccgaagagagagatgtatggaagaatgtatccgggacaggagattgaagcacgtgtggcagcagtcaaagaggatggaaaactggatctaagtgtccgtggcaagattccggagcagatggacaaagatgcagaattgatcctggaatgcattgagacttgtgggggtaaacttccattcacagataaagcagatccggagcgcattaaagcagagatgggaatgagtaaagctgcgttcaaacgtgcagttggaagactcttgaaacagaagaaaatcgtgatcaaagaggacggtatttatagtttgtaaaagcaatctgcaaacgaaccgttacgtgttagagaaagtgactatgacttgtaggaagtgttgtttcaaatagaaaaaagtgtgaggttttatatgctgaaaatgagaaaaatagtgattcttcctacttgtaatatgttttaaatacgttataataacattaggaatgagaaaatgataggtaatatcattcccagatgaatttaggaagtaaagttataattaaattgttaaaagaaaggggtatttagaatgaaagttcagaatattacagatgttgaaggattttttaaggtagtagattcttgtaaaggaagagtagagttagtaacaggtgagggagacagactgaacctgaagtctaaactttcccagtatgtatctatggctaacattttctctaacggagagattccggagctggaagttatcgcttacgagaaagaagatacagataagctgatccagttcatggtagatggtggaaataaataagatttaacattttaaaatttccataaagagtgtaaaatgaagggaagggattctgacctgtgtatcaagtcagagccttcccttttcttagttaaaatttgatcattgaggtgaactatgagttttgcacatttgcatgtccatacagaatttagtctgctggatggatcgaataagataaaagaatacgtgtccagggtcaaagaacttgggatgaacagtgcggcaattacagatcacggtgttatgtatggtgtgatcgatttctatcgggaagccaagaagcagggaatcaatccaatccttggatgtgaagtgtatgtggctccgaattctcgttttgatcgcgagatcacaggaggagatgacagatattatcatcttgtgcttctggcagaaaatgaggaaggatatgcgaatctgacgaagattgtttcgaagggatttgtggaaggttattactataaaccgcgagtggataaggaacttctgcgcaagtaccataaaggtatcattgctttaagtgcctgcctagcaggtgaggtggcaagattcctgacgaagggattatatgaagaggcgaagaagacagctttagagtatcaggaaattttcggcgaagggaatttcttcctggagttgcaggatcatggaataccagagcagggacttgtcaatcaacagctattcaaaatgtctgaagagacaggaattgagctggttgctacgaatgatattcattatacatatgcagaagatgcgaagccacatgatattctactttgtattcagaccggaaagaagctttcagatgagaatcgtatgcggtatgacggcgggcagtattatgtgaagtcagaagaagagatgctacgtctgttcccttatgcgaaacaggcgttggagaatacacagaagattgcggatcgatgtcatgtcgagattgaatttggtgtaacaaaacttccgaaatatgatgtgccggatggttatacttcctgggaatatctgcagaagctttgctatgaaggattggaaaagcgttacggtgatccttcggaagaattgaaagagcgtttgtcttatgaattggaaacgattcatcagatggggtatgtagattatttcctgatcgtgtgggattttattaaatacgcaaaagatcacggaatctcagttgggccgggacgtggatccgctgcaggaagtatcgtgtcctattgccttgagatcacgacaatcgatccaatccgttatcagttgctgtttgaacgtttcctgaatccggaacgtgtatccatgcccgatatcgacgttgacttctgttatgagagacgtcaggaggttattgattacgttacaagaaaatatggaaaagactgtgtggctcagatcgttacattcggtaccctggcagcacgaggtgtgatccgtgatgttggacgtgtaatggatctgccatatgcttatgtggattctatttccaaaatgattccgcaggagcttggaatcacaattgataaagctctgaaaatgaatccggatctgaaaaagttatatgatacggatgagacagtgacaaatctgatcgatatggcgaagcgtttggaaggacttccaagacactgctccatgcatgctgccggtgttgttatctgtcagaagccggttgatgagtatgtacctctttcgagggcagcagacggaacaatcacaacgcagtttattatgacaacacttgaggaacttggacttctgaaaatggacttcctgggccttcgtacattgactgtgatacagaatgcagtgctgcttgcaagaagaaagcagccggaactgaatatcaatcagatagattacaatgatcaaaaagtgctggattatatcggaaccggtaagacagatggtgtgttccagcttgagagtgccggaatgaaagggttcatgaaagaactgaagccgcataacctggaagatgttattgccggaatttcgctgtatcgtcctggtccgatggatttcattccgcagtatatccgaggaaagaatgacagttcttctatcacatatgattgcccacaactggagccgatccttgcccctacttatggatgtattgtctatcaggagcaggttatgcagattgtacgagatcttgcaggatattcacttggacgaagcgaccttctgcgtcgtgcgatgtcaaagaaaaaggcggcagtcatggagaaagaacgtaagatctttatttatggtgatgaggagacaggcgtaccaggatgtataaagaatggaattgatgaacagactgcaaataagatttatgatgaaatgatcgattttgcaaaatatgcgttcaataagtctcatgcggctgcatatgcagtggtttcttatcagactgcatggctgaaatattatttcccggtagaatatatggcagcgcttatgacatcagtcattgataatccgtctaaggtatctgagtatatttatgcatgtcgtcagatgaatattaagatcctgccgccggatattaataaaggtgaagcaaacttttctgtagatggcggggatatccgttatggacttgctgcaatcaagagtatcggaagaccggtgatcaaagcaatcgtggaagacagagaagagcttgggttgttccagaacctggaagatttcattacccgtctttcagcaaagaacatattaaataaacgtacgatagaaaatctgatcaaggcgggggcattggatacacttggcggaacaagaaaacagttcatgagtatctatgtacagatcgtagatcatgtaactcaagaaaaaaagaactctatggttggacagatgacattgtttgatctggtgagtgaagatcagaaagaagaatttcagatcaggatgcctgatgtgggagaatactccaaagaaacacttctcgcatttgaaaaagaagtgcttggaatctatgtcagcggacatccgcttgaggcgtatgaggagaagtggaagaaatccatttctgcgacaacggcggactttcagctggatgaagagaccggtcatacaaaagtgcatgatggggcgaaagaaattattggtggaatgatcacagagaagaccataaagcacacaaagacgaatcagatgatggcatttatcacggtagaagatcttttgggaacagtagaggttgttgtgttcccgcgagattatgagaagaacagagattatctggaagtagatagtaaggtatttgttcgcggaagagtttcggaagaagatgataagccgagtaagatgatctgtgagaaaattatcccatttgaacggacgaaaaaggaattgtggattcagtttcctgataaggcgacatttctggatgaggaacagattgtctatggatatctggcagattcagacggagatgatgaagttatgatctactgtgcgaaggaacgtgcggtgaaaaaactgccgaaaaacaggaatatcggtataaatgaacagattttaagcagattgatgaatcatttcggcgagaagagagtaaaagtagtggaaaaacctattgaaaacatattctaaataaggtagaatattggcggagttgataaaaaattgacaatgattggttttggcagtaatcagacatttcagagaaagggtggactaaaacatggcagaaaataaaacagtcgacaaagaaaaatatcttgatgaaatcgaagacagcatccgtacaatcggtgttctgacaagtggaggagatgctccgggaatgaacgcagcaatccgtgcggtagtaagacgtgcacttgcaaaaggacttaaggttcgcggaatccgcagaggttatcatggacttctgaaggaagagatcattgatatgtcagcacgtgatgtgtctgatatcattgagcgtggtggtacagttctccagacagcccgttgtaagacaatgcgtacagaagaaggtcagcagaaggcagctgcgatctgtaagaagtacggaatcgacggactggtagtaatcggtggagacggttctttcgcaggagctcagaagctggcaaatctgggagtaaatacaattggtattccaggaacaatcgaccttgatattgcatgtacagattacacaatcggatttgatacagctgttaatacagcaatggaagcaatcgataaggttcgtgatacatctacatctcatgagagatgcagtgtgatcgaggttatgggacgtgatgcaggatatcttgcactgtggtgtggtattgctaacggagccgagaaaattctcatgccagaggaaaaggactatgatgagaaagcactgatcgaagatattcttgcgaacaagaagcgtggtaagaagaactacatcatcatcaatgcagagggtgttggagattctatcaatatggcaaagagaatcgaggctgctacaggaattgagacaagagcaacaatcctcggacacatgcagcgtggtggaagcccgacatgtaaggacagagtatatgcttctacaatgggagctatggcagtcgaccttctttgccagggaaagacaaaccgtgttgtaggatacaagaacggacagtttattgattttgacattgaagaagcacttgctatgaagaagacaattccggcatatcagtacgatgtagcgaagactcttgctctgtaaaaatgtgaaatagcattgcaaatatcactttgagttattataatagaatagcaatggttaccagatgactggtaatgaaatataacattcagccatgcagcctttgtaagaaggttacatggctgaattgtgtatctgcgataagataaaaataactgataaggatagattaaggggagaactttgacggacatgaagaataaaaagatggcaccgatcggggtgtttgattcaggagtcggaggactgactgtagcgagagagatatcaagacaattgccgtatgagaacattgtttattttggggatacggcgcgtgttccatacggtagtaaatcacaaaacacgatcattcgtttttcagaacagattatccgtttcctgaggacgaaacaggtgaaagcaattgtgatcgcatgtaatacggcgagtgcgcttgcattggatgcagtgaaggatgagtttgaccttccgatcattggagtagtcattccgggagcgagagcagcggtagaagctacaacgaatggaaaagtcggtgtggtaggtactgaagcaacggttcagagtggaatgtatacgaaagtgattcagggaatgaatcctaagattgaagtgattgagaaagcctgtcctcttttcgtaccgttagtggaagagggattcaaagaacatattgtgacaagagagattattgagtattatctcgaatccatgcgcaatacagatattgatgcgatgatccttggatgtacgcattatccgcttctcagatctaagatcagagaatatatgggggataagattcagattgtgaatcctgcatatgagacagcgatggatctgaaacgtctgttggaagaggaagagatggcgaatgatgagacgacagaacatcatagtgagtattccttctatgtcagcgatgcggctgagaagttcaggaagtttgcgaatacagtgatgccatttgatgttccgacaacgaatgtagtaaatattgaagagtattaattagtaattttgaatcaggaaagttatttcgtgcttgtacgttggttgcggaaagactgacggaacgaaattttcctgattcttttctatggagaattcatttatgacaaaagatgtattggtaagtatttccggaatgcatgaggagattgtggcggtcactccggaggtagaagatgatgagaacgaagcaatcgaagttgtgacaccagcaacatattatttgaagaacggaaaacattatattgtctacgaggaagttgtagaaggaacttccggagtgatcaagaacagaattaagattaacggagatgaatgtgtagagatcgtgaaaagcggtctttcaaactctcatatgatctttgagaaaaataaaaagaatcagacattttataagacgccttatggacagatgctgatcggagtgaatacgagacaccttcaggttgattttgaagaagataagatagcggtccagattgattatgaactggacgtaaatcatgaaccgatggcagactgtaagatacggatgaatattgtttccaaggacagtggaaagttttcagtgcttagttaagatacaagaacgccgaggcatttttggataagcaggcggaaaaatgaaaaagataagaatgagaggataagatgatggtaataacactgatcgagaaagtatattcgtttttatggggcgatctgtttcagataccgcttccaggcggcggaagtgtgggaatatcacttctgattattctgttgattccaacaggaatttatttcacaatccgtacaagatttcttccaatccgtcttttcccggagatggtaagatcgttgaatagtaaaaaagggaaagaggatgggttgtctaattttcagacactgattgtatcaacagcaacccgtgtgggaatggggaatctggtaggtgttgttgcagctatttcagccggtggagccggagcagtgttctggatgtggatcacggcactgatcggttcttccacagcatttgttgaggcaacacttgcacagcttcataaagaaaaagatccgttgtatggaggatatcgcggaggtccggcatattatatccatcactacatggaagaacatcaaggaaagaaaaagagatattcagtgatcgcggtattgtttgcaatttcaggattaatctgttggtgtggtattagccaggtgatcagtaattcagtgacgtcttcgtttgaaaatgcattttctatcccaccgatttatacaactgtgattttggtggttctggcagcagtgatcgtgcttcgaaagaatgcaacagtaaaggttctggatgttgttgttccgattatggcagtgtgttatttcctgatcacagtatttttgatccttacgaatctgtccagcataccgggtgtgttctcacgtatttttgaggaagcatttggagtccgtcaggtggcagcaggtggttttggagctgttttgatgaatggagtgaagagaggattgttctcaaatgaagctggttcaggatctgctccatgtgcagcggctgcggcagagtgtgatctcccggtaaaggcaggacttgttcaggcattgggcgtatttatcgacacaattgtaatctgcagctgtacagcgatgatcatgttgcttgttccacaggatcagattgagggacttgcaggaatggaactgcttcagacagcgatgagatatcatcttggagaagcaggggtgatttttatcgcagtgatgctgttcctgttcagtttttctacatttcttggaattctgttttatgcaagaagtaatgtggcttatctgtttggagacaactgggcatcccagacagcatataaagtgctcgcgcttgtgatgttattcatcggaggaatcgcagcgtatacatttgtatgggatctgggcgatgtcgggatcgggctgatgacggtattcaatacagtgatcctgtatctgatgggtggtcaggcgttggatgagctgaaaaaatatgaagcagtgagaaaagaacaaaagaacaagaattaaaaaaataagttcagtcgaattgtttgactgaacttattttaatggtgtttttatttttctttctttgagaaaaatctttttttcttctttttctctggaatatcaagaccaccgcggacactcttaatgcctgtgatatagataccacttacaacgactttcgcttctttcttcaccggaagaacttcgaaaacctttgcatcacacatcagagtcataacctttggtccaacctttgcttttacaaccggtactttagaacgtcttaaatactttggtgtattctcaagaacaacggccgggagtcctgcatcttttagcttcatcttctttttatcaataatgagcatgctgacggtctgcgcaactgcgtccatctgctgctgttgttcagcctgcttcttctgcgctttctttccgaagaaatagagtgctacgcaaaccccgatgagaactacgaggacgatgagcatgattatcataggtgtactcacgataaaaccctcctatatactattttccgcttaattcgcatttaatattgtaacattctttattacaaagtgcaagcagacaggggacaattttacaatttggggttacttttaagacgtaaaccgagtatactatgtattatggtggtttattattgtttgcagaaagatagcagcgctggcgttactgttcactcccgtgtcaatcactctgctgattgacacggaggatgcgtgttttgacttgaatgcatctcgccccatcgcaattttatttggcggatacgccacaccgacgaaatgcgtagcattttggaggttgactctgaacagttactataatatataatatataatatataagaaaggacttataacttatgaatgacgcattatgtgaacatattgtagctagaaaatcaaaaccaatggattttgttatccgtgttcttattattgttgtgatcgttgcaatcgcaatcggaggaatgccatttcttggattctttgcttttgctcttgcagcaatcctggctttacttgcttattattttgcatttccactcttaaatgtggagtatgaatattcccttctgaatcacgatctggatattgatgcaatttacagcaaagagaaaagaaaatccaaaataaacctggatattcagaatgctgagattattgcaccaaaaggatctcatcgactggattcttatcatccggaaacaacttgcgacttttcatccggaaatgcaaatgcaaaggttttcgcaatcatgatcccaatcaatcagaaaatgacttgtgtttatattgaacctgatgaaaagatgattgaacatatgaaacaatggatgggaatgaagatgttcgtagattaatattgaatgtttgtttctaactcagacaagtaccacaatcagtaactactaattgtggtacttgttttttcttttctgtctggttgtagattacgaattgcaattacatacttaaaacatcataatcttatttttcagcaacatctgctatatatttacatgcggcaagtgcagctactgcaccgtccgctgccgctgttgtaagctgacgcacttcttttgtccggcagtctcctgctgcatagattcccgcttctgacgtcttgcaatcttctccggcaacaataaatccactctcatctaactgaacaacatcagcaaatttttcattctgtgcaatctgtccgacagctacgaaaattccggaaacagcaagttctgattcttctcctgttactttattcaaaacccgcagactttccaccatctgctctccacggatttcctgaacagttgtatttaagataaactctacattttctttttcttgcaaacgttttacaatctgatcttctccccggaattcgtctcttctgtgaatcagataaactttgctacagtaatttgacagaaattctgcatcctggagtgctgtacttccacctccgacaactgcaacttctcttccccggaaaaacattccatcacaagtcgcacagtatgaaactcctgcgcctgtcagacgttcctctcccggaactccaagatggcggtgtgtcacaccagttgcaagaataatgcttttgcattcatattctttttccgttgttacaatcaccttataatccgcttcttcacggatacctgtcacctgctccattatggtctgtgttcccagctttactgcctgatccatcagattcatagagaattcactgccgctcacacttgcaattcccggataattttctacattcggagaagatgtgatctgaccgccgaaggttgttccctcgaagagtacggtctgctttcctgcacgctggccatagatagccgcagtcatccctgcagttccgccaccgatgattccaatatcataaatttccatatttctcctttcccaacaaactgtttctacattttctgattgctgtaattcattttttcatttacgctaaactgtaatatgtttcaatcacttcttacatatttctggacatatctgcgcaaactttctctgcctcgatcactgcgcttctaagtccaaatttctcaagtacacgtactgcctcaatcgttgttcctgccggtgaacacaccatatctttcagttctcccggatgctttcctgtctcgagtaccatctttgcacttccaagtactgcctgtgctgcgaactgatacgcctgtgatctaggcattccctcagctaccgctccgtctgccattgcctcgatcatcataaagatatatgccggtgaacttccgctgactgcaacaactgcatcgatcaaatgctccggcacgatttctactttaccaaaagaactaagaagctccagtgcatagttcttttcttcttctgtcactgcatcattcgggcatgccgctgtcattccctctccaactaatgctggtgtattcggcattgttcttacaatcttaactttctttccaaactgctcttcgagccatgcgagagtcttgcccggtgcgattgtaataatcagctggtcttctcttactgcatctttgatctcagcaattgtctgtgcatagaattgtggttttacagagagaactaatacttctgctttctgtgttacttctatattatctgctgtcacatgaattccatgctcttttttcgcacgttcacgtcctgcttccataatatctgaaccaatgatctcttccggggcaataattccctttttgatgattccgcccatgattgctcctgccatatttcctgttccgataaatcctaatttcatgatcttaagtctccttttcttttaccattactgttctaagaaccgtgtccagtaaccttttatctacatgtatccgtctctcacccagaattttttctcatcctctaatggaatttcttctgtgtccatccagtcgattgtaataaactgattcctgttcagcccttttagcagttcattgatcagccattcccgtccctgaacttccattgtaacggttccatcccattcgttctgaacccagccaaccagatttagtgaattcgccagatatttcgctgtatagcggaatccaacaccctgtacacgaccgtgaaaaacaatgtgctttctaacttctgccatatctgatcactcccttgaagcaatttatgttgtacactaccgttattctaacatatttttttaccttgtacagttcttttcggtaaacagtccctgcttcctgtgttataatgggaataacttttttgaaggagggcttcgagaacgaatgagtaattatgaaacatcacagacttctgatctgaaagaattgataaataaattacgagatacacagactctctctaaaaatgaatggattcggctaattgacggaagaacccctgaacttgccgactatttatttgaaaatgcgcgcaaagtacgaatcactcactatggacataatgtttatgtccgcggactaattgaattcactaactattgtcgtaacgattgttattactgcggtatccgcaaaagtaatctgaatgcacatcgctaccgtcttaccaaagaagagattcttaactgttgcaaaaccggatatgaacttggttttcgcaccttcgttcttcaaggtggtgaagatggctggttcacggttccgcgtctggctgatattgtctctgacatccacaaaaactggccggactgtgcaatcacactttcagttggagaaatggaacatgatgcataccagactttattcgatgccggcgctgaccgctatttacttcgccatgaaacttataatgatgcacattaccgtaagcttcatcctgcttccttaagtgcgcgtcaccgtcaaaactgtctgtgggatttaaagtctatcggctatcagattggaaccggattcatggtcggtgcacctttccagacaactgagaatcttgcagatgatatgcttttcttaaaagatttgaatccgcatatggttgggattggtccttttatccctcaccacgatacacagttcgctagtgaacctgccggaacactggaattgacactttatctgctcgggctgatccgtcttatgctgccgaaagtacttctcccggcaacaaccgccctcggtacgatttctccaaccggaagggaacagggaattctcgcaggagctaatgtcgttatgccaaacctttctccaacagaagttcgcaaagattatctgctttatgataacaagatctgcaccggtgatgaatcggcacagtgcaagaactgcctggcccaaagaatggagtctgtcggatatcatgttgttgtagaccggggagattccttgaataagtaaaaaggaggttactgttcactcccgtgtcaatcacttcgctgattgacacggaggatgcatggcagtcgccaaggtctcgtgcaagcacggactttggctcgttgctcgcgtaaataaaaattgcgggatgcaggaaacatgcattccgcacaaacttggggaaagaaaaggagaggataagatgaaactcatcagaacagaggatgcggtcggcagtgtgctttgccacgacattacccagattattccgggagttgtgaaggatgcggtcttccgtaaaggacatgtagtgacagaagaggacgttccggtactgctttctgtaggaaaagaacacctctatgtatgggagaagcaggaaggcatgcttcatgagaatgatgcggcagaggtgctgcgtcaggtatgccagggagagcatatgaatgcatctgaggcgaaagaaggaaagatcgaactgactgcacagtgcgacggccttctgaagatcaatcgcgagaaattaaatgaagtaaatgcgctcggtcagatcgtgcttgcatccagacatggcaatttcccggtgaaaaagggagataagatcgtaggtatgcgtgtcgttccgctggtgatcgaggaagagaagatgaatcatgtgaaagaactctgtggggaagagccgattttcacaattctcccgttccatcagatgaaagtcggaatcgtgacaacaggaagcgaagtttatcatggaaggatcacagataaatttactccggtcgtaaaagcaaaattagaagaggcaggcatggaagtacttggaaatgtactctgtgacgatgactctcagatggtaacagatgcgatcaatgaatggatcgctaagggcgcggaatttgtagtttgtacaggcgggatgagcgttgatccggatgacagaacaccattatctatcagaaatgcaacggatgaggtgatcacttacggtgcgccggtacttccgggtgcaatgttcatgctggcttataaaggagagattccggttgcaggtcttccgggatgcgtaatgtatgcaagaagaacaatctttgatctggtgcttccgagaattgcagcaggcgagagattaagtgtagaagatttcacggtgcttggagaaggcggactttgcctgaactgcgaagtatgtacttatccgaattgtggatttggaaaataataagatgaaggagaattggggaatgaattcattttatgtaaatctgcaggatgagcttgcagaagcaaaagaagagctttgggcacagacgcagattgacggtgcagaagctggaaagaaaactctgctgaaaggtgaaccgaagaatacagatagcgtttttacaaatgaaaacggtgagcgcattttccaggagcgtatcagccgtccggcgaagctggtgatctgtggggcagggcatgtatctatgccaatcattcgcatgggaaagatgcttggattccatgttacggtggtagaagaccgtccgaaatttgccgatgatgcgagaagagcagaggctgaccaggtctattgcgaaccatttgaagatggtcttgcaaagatcaaaggagatacagatacatggtttgttattgttacaagaggtcacagatatgacacagattgtctcagaacaatccttggaaagccaagagcttatgttggaatgatgggaagtaagagaagaactgcaatcgtaaaagaccagctggaggcagaagggtttgagagagatgtgcttgaaacagttcacacaccaatcggtctgaagattgctgccgagacgccggaagagatcgcggtatctattatggcagaaatcattcagattaaaaacagtcgtgcaaagagcggtggatattccagtgaacttcttgaagaaattctgaaagaagatgagtgtggaaaagtgcttgcgacaattatttccagaaaaggttctgcaccacgtggcgtaggaacaaagatgcttgtatgcggagatggaaggatcatcgatacaatcggtggagggtgtgtggaaagtgagattattcagaaagcactcctcatgatccgtacggagcaggaaggattccaggtatgcaaggtagatatgacagcagaggcagccgaggatgaaggtatggtctgtggcggcgttgttgaagtcatgctcgaaagggtaaaataagcgctctgaaaaaagttaaaatgatagtagtaattgaaattggagaataagaaagatggatgatatcaaaattttaaaaggaaatattatctatacaaagacgaaagatgaatttgagatatgcgaacacggttatcttgtgtgtaaagatggaaaagtagaaggaatctatcagacacttccattccgacttggaggggaaccaattgaggatcatggagattgtctgatcattccgggaatgacagatctgcatatacatgcaccgcagtatacattccgcggtacagggatggatctggaacttctggagtggctggagacgaatacatttccggaggaagcaaaatacaaggatgtattatatgcgaatgaggcgtatgcgaagtttgccaagaacttgaaacatagttcaacaacaagagcatgcgtctttgggacaattcatagaagatcgacacttgttctgatggatcatctggaaagaagcggtctggtcacgatggtcggaaaagtgaatatggacagaaattcaccggatgaacttcgtgaaggtacacaagagtctgcggaagaaacagttgaatggatgaaggatgtgcagcataaaaagtataagaatacgctgccgatcctgacacctcgttttattccgagctgtacggatgagcttctggatatgctgaagatggttcagatgcgttatcagattccggtgcagtcacatttatcagagaatttatcagagatcgaatgggtaaaagaactttgtccgtatgcagagttttatggagatgcatatgatcattttggtctgtttggagcagatgcaccgacggttatggcgcattgcgtatacagtacggaagaagagatccagagaatgaaagagaacggtgtgtatgtagcacattgtccggaatcaaatgagaatctttcttccggaattgcaccggtaaaacgttatctggaagaaggactttctgtaggacttggaagtgatgtcgcaggaggatcgacagagaatcttttccgggcaatggcacatgcaattcagatgtcaaagatgcgctggagacttgtcgatcagaaatatccggcattgaagtcagaagaagcattctatatggcaactaagggtggcggatccttcttcggaaaagtcggaagttttgaagaaggatatgaattcgatgctgttgtattagatgacagcagacttgaatcctcccgtcagatgagtgtgaaagatcgtttggaaagaatgatttatcttgctgatgagagagaagtgaaagcaaaatacgtcagaggaaataaaattatataaaacacatgaaaaaacctcaggttcgggtgttgcagcaccgttctctgaggttttttcattttctattttaggagttttaagtaattgacttattcaatcgatttttcaatattaaaggtggattcttgttccagtctcaccaagaattccgtcttttgctttctcaagcagtgtgatcagtgactgtcttccaggtttggattcagcaaagtcaagagctgcctgtaccttaggaagcatagaaccaggagcaaaatgtccttcttctacatactgtttcgcttcttcaactgtcacatcgtcaagccatttctcatccggctttccgtagttcagtgcaactttctctacagcagtcagaatgataaggaagtctgcgtcgagctctttggcaaggagagcactggcaaagtctttatcaataactgcacttgcacctttcaggtggttgccctggcgcataaccgggattccaccgccgccacaggcaataacaaggtcaccggagtcaaccattgtacggattgtaccgatctcaacgatctcctgcggttttggagatgctacaacacgacgatatccgcgtcctgcatcttccttcatgatataatcatatttctcagccataacatcagcttcttccttagaaaggaatttaccgattggcttggatggtgtctcgaaagccggatcatcagcatccacgcgaacctgagtgatcattgtagcaactgggatatcatgaattcctctgttgaacaattcttctctcagggcattctgcaggtcatatccgatgtaagcctggctcattgcaacacatacagaaagtggtgtgtttggctgtttctcatcctcatgtgtcaatgcgatcatagcgttgttgatcataccaacctgaggaccattgccgtgtgctacgactacttcgcagccttcctgaatcaggtctacgatcgcgcgtgctgtaatcttaacagcagccatctgctcaggaagagtattgccaagggcatttccgccgagggcaatgacaatacgttttttcttttccattttaggatcctccgtatttactgtaaaggtattgtacaggtctgaaagattcaggcctgtacaataagttactaattaaggtaactatgaaactatttttgtctgagaaatttaaacttactcaaaaattctggacattcctctttcttcgagcttcttcaggatttcctgtgggttctcgaatttagcaaggaagatcatagctgcgatgatgtatggtttgaagctagcttctttgtaaagtggatctctgtaacgatcgaatacggaagcgtcaacttcaccttcttcacagcttacgcctgagatgtcagctggcagacagtgcatgtaaagagcttttccgtcttttgttgtagccatgagctcttctgtacaagcccagtctttgtgctctgcattctgagcaagaagttctttctcaagagctttgataccttctgtatctccgtttccataaagctctgtacgtttttccatagctgcaaatggagcccagctctttggatatacgatatcagcatctttgaatgcttcagccatgttgttagtcttcttgaaggatccgcctgatttcttagcgttctcttcagcaactttctcaacatcctcgaatacttcgtatccttctggatgagcaagaacaacgtccattccgaaacgtgtcatcagaccgatgactccctgtggaacagaaagtggttttccgtaagatggtgagtaagcccatgtcatagcaagttttttgcctttcaggttctcaactccgccgaactcatggatgatgtgaagcatatcagccatacactgtgttgggtggtcaatgtcacactgaaggtttacaagtgtaggtttctgctcaagaattccgtccttgtttccttctgttacagcgtcaacaacttcgtgcatgtatttgttaccttttccgatgtacatatcatcacggataccgataacatcagccatgaaggagatcatgttagctgtctcacgaactgtctcaccatgagcaacctgagattttccttcgtcaagatcctgaacctcaagaccaagaaggttacaagcagaagcgaaagagaaacgtgtacgtgtggaattgtcacggaacagagaaattccaagtccgctctcgaatacctttgtggaaatgttgttctctctcatgtaacgaagagcatcagctactgtaaatacagcctcgatctcgtcgtctgttttctcccatgtaaggaagaagtcaccattgtacatctctttgaagttgagtgcgttcagtttgtcaatatatccctgtaattttgcgtccatctttaaaatcctcctgattaaaatgaattatttgtttttaggtttattagccaaggcagttccggccggaaattatccggtcagaacgccataggttcaatgaattggttgcgtgatcacacgcaaatgcgttagcaaatactgaattactcagcgtaagacagtggaagtgcagcgtatactgcagcacatgttacgagatcctgtttccatgtcatctcgtttggtgcatgagcctgagcctctgctccaggtccgaatccgatacatgggataccgtttctacccatgatagaaacaccgtttgtagagaatgtccacttatctgtcagcggacgagcctgacgcatctcaagtgtgtcagcagcgccgattctctgatctccgtaaagtcctgtgtaagctttctcaagagccttagttactttgtgatccttcggaatagcccatgttgggaagtagcactcgatctcgtatacacatcctgtgtaggacggacgatcatagttgtacatagaaacaacaacgtcatcaccgtatttcttaacgcttggcaggttacggatctcatctaagcagctctcccatgtctctccgaatgtcatacgacggtcaagagatacagcacaggaatctgctactgcacaacggcttggtgatgtgtagaaaatctgagatgttgtaactgttccacgtccaaggaaacgagcctcttcgtagtcagggttgaatttcgggttaagcattttaacaagacctttgatctctgtctcgtcagcgtcatcgttctcgttaagagcacgaacatcctgaagaatgtcagccatcttgtagatcgcgttgtctccacgctccggagcagaaccgtgacaggaaactcccttaacatcgatacggatttccatacgtcctctctgtccacggtagataccaccgtctgtaggctctgtagaaactacgaactccggacgaatcttgtcttcgttgatgatgtactgccagcaaagtccgtcacagtcttcttcctgaactgtaccaacaaccattactttgtatccttctggaatgagtccgagatctttcatgatctttgctccgtatacaccagatacgataccgccacactggtcagatactccacgtccaccgatctctgtctctgtctcgtatccatcgtatggatcgaatttccagttatcgatgttaccgatacctactgtatcgatatgtgcgtcaaatgcgatgatcttgtcgccagttcccatgaatcccataacatttccctgtgggtcgatgacaacttcgtcaaatccaactttcttcatctcagcagcgattgtctctacgtgagctttctcatcacagctttctcccggattttttacgatagcacgaaggaaagcagtcatgtctttctcatagccttttgcatactctttgattttgttaagatccattgttcttctccttttgaaataaaatcttgttttggtgttacagtttcttcttattgtattgcgagaaatgattatctctcatttccgtcccagacaattgatttgtatctatccggatcagtgtctccctcagtagagaagagaagtacttttgagttctcatccaatccgaggtgctctctgagcggtttgtactcatccattgtcatgatgcacgcaagtgttccaaacggtgcggctccggattctccggaagtaacaggctgatcacctttgaaaggtgcagcaagcatacgcatacctttggcagcaacccagtcaggtgttgcgataaatgtatcaacgtggtttttcaggatatcccatgaaattgtgttcggctctccacaagcaagaccagccatgattgtaaccatgtctccgtctacgatgcggatagctccgtccttagcacatgctcctttgtaaaggcatgcagcaggcgcagcttcaacaacaacaactttcggtggattttccggatagcggttagcgaagaatccctgaactgctccggcaagtgaaccaacaccagcctgaataaatacatgtgtcggacgctcacatccagcttcatgaagctgatcatcagcctcgttagccattgttccgtatccctgcatgatccatgccggaatctcttcatatccgtcccaggctgtatcctgaaccattacgccgttctctgtcttctctgccatagcgttagccatacgaacacattcgtcgtagttttcctcttcgattgtagctttcgctccttctttcaggatgttgttcagtcttgtctgagtggatcccttcggcataagtactacagctttctgtccaagcttgttcgctgcccatgcaacaccacgtccgtggttaccatctgttgcagtgaagaaagtagcctgtccgaattctttacgcagttcgtcagatgtaagaacgttgtaaggaagttctgaaacatcctttcctgtctgctttgcaatgtagcgagccattgcgaaagatccgccgagtactttaaatgcgttcagtccgaaacgataagactcatcttttacatagacctctttcagtccaaggtatgcagccatgtgatccagttttacaagtggtgtaacactgtactgcgggaagctctcatggaatgcgcgagctttcgctacattctcaagtgacattacctgaagctgagagtcatctgtttttggcatttcgtttactgcccatttgatagtttccattatagtgacctccttaaattaatacgtgtcatttgcccatgtaactgtaaagtgtgaatttcgatatccccaaatacgaagaaactttatcgccggactttgtaataaggaaagcaccggcatgatccagatactggacaacagcaactttgtcatctttgttcatcattgcaactggctttccgacctttgcaacggcctgctcgatcaacaaatccagaagttcatttacattatgtgtgatctgccgtggcgaatcacctgtaagatccggaagattgtctttcgtagcgatcaaagactgaattgctgtactcgcagctgtaaaagctgtgatgtcatagtttaatgagaagatgtaagagattgatccgtcatcgtctcttatatagaaggtactcgatttcaggatccgtccatcttctgttttagtaagataggaaagcttatcatgaatcgttgacggatccgactgaagtgtctcaagaacaattcctgaaggaccatctccggtctgtcggttcgatacatgtccgttctcgatgtacacgatcgatttctccagatcttttgtcttcaaatcatgaattgcaatctcacaggaacttccaaattgaattgcaagtccgtgtgcaagctgcttaagaaaatctaaggtatggcgcatatgtccacctgcctttctacatgctttctgtcttcataatcccataatatcataaaaatcacgatagtcaatacctttcctaaaaattttttaggtaacaaaaaacttttttagatttcttgttgcatttagacaatttagatgttattctatgtgtatcagagacgttgatgtacgaaatgcacataacaggcagatggcattttaacatcaaagtgtagaaattcataaaaaggagaggttacaattatgttgatcttaggtaatggtagagttgtgacaagaaaccctgaatgtccttatatggaagagggcgcagtagcaattgatggtaaagtaatctgtaaggttggaccaacagatgagttgaagaaggcttatccagatgcagagtttattgatgcaaaaggcggagtgattatgccggcattcattaatactcatgaacatatctatagttcttttgcaagaggacttgctattaatggatacaatccaacaggattgctcagcattcttgaaggaatgtggtggacactggatagaaacctgacactgaatgatacttatttaagtgctatggctacttatattgattctatcaagaacggtgtaacaacagtatttgaccatcatgcaagttttggagctatcaaaggttccttatttgaaattgagagagcagcgaaggaaacagggattcgttcctgtctctgttatgaagtttccgacagagatggaaaagacaaggccagagagtctgtaatggagaatgcagaatttattcgtcatgcactgaaggatgacagcggaatgatcgccggaatgatgggtatgcatgcacagttcacaatctcagatgagacaatggaacttgcagcagcaaacaaaccggatgaagttggttatcatattcatgttgcagaaggaattgaagatctgcatcactgcctgaaacattatggaaagagaattgttgaccgtctgatggacttcaatattcttggagagaagacactgcttggacattgtatctacatcaacccacatgagatggatctgatcaaagatacaaacacaatggttgttcataatccggaatccaatatgggaaatgcctgcggatgccctccgacaatggaacttgtacacagaggaatccttacaggacttggaacagatggatatacacatgatatgatggaatctttcaaagtagcaaatattcttcataaacatcacctttgcgatccaaatgcagcatggggagaagttccgaaaatgctgtttgagaacaatgcaaagattgcaggacgttatttcgaccagaagctcggagttcttgaagaaggcgcagcagcagatgtgatcattgttaattacaatccgctgacaccaatgaatgagaataacatcaatggtcaccttgtattcggagtaactggacacgatgttgtgacaactgttgcaaacggtaaagtattgatgaaagacagaagactgacagagattgacgaagcgaaagttatggcagactgcagacaggcagcagccgaacttggaaaacgtatcaatagtcgttaggcttagattgacggatactgttcattaatgttaacatatataacagatgtggacagtatctttgatcgcacatttcgtcaaaactaaccggaaaggacaataaaataatgaaagaaaagaaatcagaagcacctcgcagaggaaacgaagaactgtttaagtgggatggtaacccgacatttggtcagatacttccgcttgctgcccagcatgtacttgcagcagttgtaggatgtgttacaccggcaattctggttgcaaatgcagcgaataatgcaggcggaaatgtaaacatgggtctcttgatccagatgtcacttgtatttgcagcattatcaacattccttcagctgtatggaaataagatccatcttggatccggacttccggtcatcatcggtgtaagttttgcttatgttccgacaatgacagcaattgcagcacaggctcaggatgttaacacgatttttggtgcgatgatcgtaggtggtattgtagcaattatcgttggacttactattaagcagatcagaaaggtgttcccaccactggtaatcggaactgttatctttgcgatcggtctgtctctttataagacagccattaactacatggcaggaaactccgcgaacacatatgaagtgatcgtagagcagagaggtcagacagcagcacttgtttatggttcctggcagaactggcttgtatcccttgtaacactggcaatcgtaatcggtctgaaccattacggaaaaggacttttcaaacttgcatctatcctgatcggtctggtctgtggatatgtacttgcactgtgctttggaatggttgatttttcagcactttcaaacgcaggttggttccagcttccacaaccgttcgctttcggtgtaaaattcgatatctcagcgattatcccgctggcgattttattccttgtcaattccattcaggcaatgggagatttctccgctacaacaagtggtggtatggatcgtcttcctactgaccaggagctcaacggtggtatcatcggttatggtatcagtaatatcgtaagtgcatgtttcggatgtcctccgacagcaacttacagccagaacgtaggtattgttggttctacaaaagttgtagcaagaaaggtattttcactttcagcatttatccttctgattgcaggactgattccgaaattctcagcacttctgagaacaattcctcagtgtgtacttggtggagcagtagcatctgtattcgcaggtatcgcaatgacaggtatcaagcttcttgtaagtgaaggtatgtctacaagaaatacaacagttgcaggattatctattgcaatcggtatgggtgtatccttaagtaacggatgcttaaatcagatgacatcaacaatttacgatggattaggaatgacaatgggacttgagaacttccagtccatcatcaataacacatttgcatcatcaccggttgtactggcgacaatttttgcagttattttgaatctggttcttccgaaagatccaaagccggaggaaaaataaaaggaaacagatctttgagaaaagacaggttcttggggaatgatctgtcagtgatttcaaagatttaatcattacggaagaacctgccgatggcaggttttccgtgataaaagaaaaaaagagaggtaaaaagtatgagtgaaattatgagacctatgtcatttgaacagcttttaaactggacattgacagagtacaaagagaatggaacagtatttggagagcgtcatccatatcatgcggacagcaagttcaaccgcacaatcttcggacgcgatcttgagacaccaatcggaccggcagcaggtccaaacactcagctgacacagaatattatcgcagcttactacacaggaagccgtttcttcgagctgaagacagttcaggtaatggacggagacgagcttgcagcatgcatcaacagaccatgtatcaaggctgatgacgagtgctacaactgtgagtggtctacagagctgtttgttccacaggcaatggaggagtacatcaaagcatggttccttctgaaagtgatctcaaaagaattcggacttggaagcatggacggattccagttcaacatcagtgttggatatgatcttgccggaatcaaatcagagaaggttgacacattcctgaacacaatgcagcatgcacaggattcagagattttcaagcactgcaaggcttatcttcttgagcatgttgacctgttcgagaaagtgacagcagaagatatcgaaagcatttccggtgatatctgtaattctgttacaatctctacacttcacggatgccctccggaagaaattgagaagatcgcaatgtatctgatcacagaaaagggattccatacatttatcaaatgtaacccgacacttcttggatacgagtatgcaagaaagacaatggatgacatgggatacgattatatcgcattcggtgacttccacttcaaagacgacctgcagtacgaggatgctgttccgatgttgaacagactgattgctgtctgtcaggaaagaaacctggagtttggtgtgaagatcacaaacacattcccggttgatgtaaaacagaacgaacttccaagtgaagagatgtatatgtcaggaaaatctctgtacccactttccatctccgtagcaaatatgctggcaagagatttcggtggaaaactgagaatctcctattcgggtggtgctgatttccataacatcgaaggaatcatcgatgcaggaatctggccggtaacaatggctacaacaatcctgaaaccaggcggatatgacagactttgccagattgcaggacttcttgagaaagaaggcgttgtattcacaggtatcgacgctgccaagacagagaaactggttgaggaagcaaagacaagcccatatcatgtaaaggctgtaaaaccgcttccgtccagaaagatcaacaaacaggttccgctgatcgactgctttatcgctccttgtaaagaaggatgcccgatccaccaagatatcacaacatatctgcagcttgtagaagctggtaaatatgaagaagctatgaatgttatcacagagaagaatccacttccattcattacaggaacaatctgtgcacatgcttgtatgggcaaatgtacacgtaacttctatgagtcaccagtacatatccgtgagatgaagcttgaggcagctcagaacggatacgaagcactgatgaacaagctgacagcacctgcaatcacaaaagaaggtaaggcagcagtgatcggtggaggaccggctggtatggcagctgcttacttcctgcgcagagctggaatggcagttacagtatttgagaagaacgacgctctcggcggtgttgttcgccacgtgatcccagaattcagaattccgggaacatctattgataaagatgcagcacttcttgagaagatgggcgttgaagttcgtctgaacacagaagtaaaagatacagcagcactgaaagcagaaggatttacaacagtgatccttgcagtaggagcttctgagcctggagtattaagacttgagcagggtgaagctaagaatgcactcgagttcctggctgacttcaaggcaaatgacggaaaacttgatatcggtaagaacgttgtagttatcggtggtggtaacacagcaatggatacagcaagagcagcaaaacgtacaacaggcgttgaacatgtatatcttgtatacagaagaacaaaacgctatatgccggcagacgaagaagagctggtaatggcagtagaggacggcgtagaattcatggaactcctttctcctgttaaacttgagaatggaaaactgatctgcgaagttatggttcttggcgatatggatgcttttggaagaagaggcgttgttaagacaggagaactcaaagagatcccggctgatacagtgatcgcagctgttggtgaaaaagttccgactgctctttacgaggcaaatggaatcaacgtaaatgacagaggacgtgctcttgtaaatgaagagacattagagacaaacgtagagaacgtttacgttgttggtgacggacttggcggaccggctacagtagtagaaggtatccgtgatggtctcaaagctgctcaggcagtgatcggagagactcttgtaagagatttcgatgcagagacagatgaagctgttgtatacgagagaaagggtaacctcgaagacgtacgcgaagacagcacagaggctaagagatgtcttaactgtgcaggaatctgtgagaattgtaaggaagtttgcccgaacagagcaaatgtagcaatcaaggttccgggactggagaaacatcagatcatccatgtggattacatgtgtaatgaatgtggtaactgtaagagcttctgtccatacgacagtgctccgtacctggataaattcacattattcatggacgagaacgatatggcagacagcaagaatcagggattcacagtactggacaaagatgcagtacactgcaaggttcgtttctgtggagagattctcgactggacacttggagaagagacaaagattccggaagcacttcagaaagtaatggagactgtttgcaaggactacacatatctgttaagataatagcagaaggtttatgtgagattgctccggtggaaattgagtgagaccagagtgataatatgtgagatagatagctcacaggcatttgcctgtgggctatcttcttttcaaaagacgcagaaatatagaaagaagggatctgtaaaatgataagctatttcagagatgacagactttgtgaagcagactctttcttatcggtagtaaagcctgactatacagaatgtccgatgatagctgctgtcggtgcgggaggaaagacctctacattgagaaggcttgcagaagagtatgcgctgatggggaaaaaggcaattgttcttacaacaactcatatgagagaagagacgactccatggagttgtgtggctgaagaggaagagtggattagtaaagggaacgagctgcttgaacgagtgaaggaatgccttgaacaatatggacaggcctggattggggcaagagcgaaaaaagggaaaatgagctgcgttccggagttgattctggcagagatagaaagctggaatgtgccattacttgttgaagcggacggagcaaggatgctgccgttaaaagtaccgggagaacaagaacctgtgctcctgccacagacaacacatgtattttctgtttatggaatggacgctttgaatcaaaagctggaagaaatctgctttcgaagtgaaaaggcggcagagcttcttggaaaacagccggaagatcaggtgacagaagaggacctgataaagcttgcatgtcatgaacagggcgggcgaaaaggctgtccaaagcaggtggagtatattgttgtgttgaataaggcagatacaaaagaactgcaggaaagagcatgtaagattgcaaagtgcttgtatgagaatggaatcaagaatatatttgtgacatcttatatgctgtaataaatattgtagaaaaaaagtgcagagattattcttaaatgtaaataaattagaaaataacggagaatcatagaagattctcaggaaaatagatgggaagtattgagatgaagatattgattaaaggtgcgggagacctggcaacaggaatcgcatccagattatatggcgcagggcatcagatcatgatgacagatattgctgtgccattgacggtccgcagactggttgcattttccagagcggtttatgaaggcgaggcagttgtagaagatatgacagcacgcctggcaaagaatcaggaagaagcagagaagatcatggaacagggagatatccctgtgatcgttgatccaaaggcagaatgtgtacagtggtttcagccggatgtgatcgttgatgccatccttgcaaagagaaacctcggaacaaagattacagatgcaccgtttgtaatcggagtcggacctgggtttactgctggagaagattgtaattgtgtagtcgagacaaagagaggacatacactgggtaatgtgatctgggacggaagtgcgatcccgaataccggagttccgggaaatgttgggggatattccattgagcgtctgattaaagcatccgcagatggagtgatcgaaccgaaggctgtgatcggcgatctggtacgaaaaggacagattgttgcaattacaggcggagaaccggtttatgcgctgatagacggtatcgttcgtggaatgcttcagccaggtgttcaggtgacgaaggggctaaagatcggagatattgatgctcgtgcaaagcaggagcattgccggacaatctcagacaaagcaagggcgatcggcggaggtgtgctcgatgcagtctgcagttatgaaaagagcagaggaaaatacgcattgatcttgctggcggcaggtcagagtgttcggttcggttcagataaactaaaagcagttgtagaaggtgaagcaatgtatgaaagtgcgatcagccgatttgaagcatttcagggattcaagtcttatgtagtgacaggaaaagaagagattacactttcagcagagtcagcaggctgcaccgtcgtatgcaataaagaaccggagaagggaatctctctttctgtaaagctcggtctgacaaaggcaatcgaggatgcggaagaaaatggaacaccgcttcgaggagtcctgttcagtgtctgcgatcagccaagattaaaaaaatccacgattcagagaatcataaatacagcatttcataatccgggaaagatcgtttgtgcaggagaaggaacaagaaatggtaatccggtcttgtgggataagagattctttgataaacttttggagttagatggagatatcggtggaaagaagatattgaaagaaaacttagattcgctgaaaattgtgccggtacaggcgggagaacttcaggatattgatcgcaaagaagatctcggaacggcataatgatagaattgctggttgcatatagtgtgaacagtaataaaaatagtagcggtgagctgaaaggagaatgcaaatgcgggtaggagcagtgattgcggcagcaggaaaatctggtggatataagagttatgataagatgaagtcggtggatggaatccaggttctgcgtcagatgattttaaatttcaagagagcaggcgtggatgagatcgtgctgatcacaggatatcaggcggagcaggtggagaagaaactggcgaagcttggtgcagtattccttcgcagtgaagattatgagaaggaagagatgatcacgtcagcagttcgagggatgaactacctgaaaccgcgctgtgagaaattcttcttctgtcctgcaggagtttctcttttcacagaagataccgtacgtgtattgatgcaaaaagcgaaagaaaatgaaaacgatcatgagaaagtctatgtacctgtctgggaagaacgaaaaggacatccgatcctgatggatcgcagtatgatcgatcagtttgcttcttatgaaggtgaaggtggacttaaaggcgccatggatgtgctgaatgtagaacgcattttcgttccggtggaagacaacggtgtagcgatttactccgaacagggagaacctttccgtgagattttcaaagagaaggaaaaggagagaagaatccgtccgagagtgaagcttcagttggagaagaatgagaacttcttcggtccgggaattgtattccttctgcgtcagatcgatacacttggttcggtaagagacgcctgtgcaaagacaggaatgtcttacagcaagggctggagcctgatcagaagtgcagagaaagaactcggatataccgtcgtagagcgaagtccgggaggcaagcatggcggtgtggccagtgtaagcgaagcagggaaagacatactcagaaaatatgaactgctggaaaaagatgtggtgaaatatgcagagaagagatataaggatatctttgaatcataattcagtcaatgaaaaaaagttgtgtaaatcacaactttttttagaaaagcgattgttaaaataaaacaaatcggttataatgataacatcatttagaaagaaaagacaggaacaatcttatgaacaaggcgcctgtcaggaggaggtaggatgaaaaagagaattttagcagcaatgatggcagccgtaatggtgttttttatggctggatgtggatccaaagccgacgaaaagacagacgacacagcaaaaacagaagcaactgacaacaaagtcagtgatgaagaagaaacagagatccaggtatttattgcagccagcttaaagaatgtaatggatgagcttgcaacacagtataacgaagagcatccgaacgtaaagatcacatacaatgcagacagttcaggtacacttctgacacagattgaagaaggatatgagtgtgatatcttcttttcagcagcacagaagcagatggaccagcttgagtccgacggtcttgtagtagacggaacaagagcgaatgttgttaacaaccaggtagtagttgtgacaagaaaagacagcggaacaaaggtaacaggacttgataacttaagcgaagcagaaagctttgcacttgccggtggaagcgtaccggtaggtaagtatacaagaaccgcacttatgaatatgggagttcttccgaaggtggatgatccttcagcaatcaaaacagaagaagtatcagaagcacttggcggacttgagatcagcgagcaggacaacgtaagcaaggttctttccgcagtagtggaaggatcttgtgaagttggaacgacttattactctgatacatatggattcgaggacgaactcgatattcttcagacagtagggtatgatctgacaggaaatgtaatctatccgatcgcacgtgtagtaaatgatgaggctgatgatgcacagaacgcagcagcagatgatttcatcaagtttgttctgtcagacaatgcaaagaaagtatttgagtcttattacttcgatacaaatgtagaataaagatagtgtgatggtaacggatgtgttactatagaagcagagggttactgttcactcccgtgtcaatcactttgctgattgacacggaggatgcgtgttatgtaatcatccacagagctattttgaagtacatgaagagaattattaaggagatgagattattatgaagaagaaagtgattaattcaaaaaaagcagtaatgataggctgtggctttgttggttctgcatcggtatttgctctgatgcagagtggcttgtttacagagattgtccttatcgatgcagataagaacaaggcagaaggagaagcgatggatatcagtcatggtattccatttgcgagtccgatgaaaatatatgccggagattatgatgatgtggctgatgctgcaattgttgtcatatctgccggagcgggacagaaaccgggagagacaaggcttgatctcgtaaataaaaatgtagcaatatttaagtcaatcattcctgaaataacaaagagaaattttgcaggtatcatgcttgtagttgcgaatccggtagatatcctgactcaggtagccataaagttatcaggacttccagaaaacagggttattggatcgggtactgtgttagatagtgccagattaagatataagcttggtgagcatttatctgtggacagcagaagcgttcatgcatttatagtaggtgagcatggagacagcgaagttgtagcatggtcatcagccaatgtatctggtgttccattaagtgaaatgtgtgaaatgcgtggacattacaagcacaaggaaaacacggcagaaatagctacagcagtcaagaacagtgcgtatgagatcataaacaaaaagcacgctacttattatggaattgcaatgtctgtaaaaagaatctgcgaagtgattatgagagatgaaaaatcaatacttcctgtatcacacatgattcatggagtatatgatattgacggagtatcgttaagtatgccagctattgtaggtgcagatggtattgagtctgatatacctattaatttaagtggcgaagaagcgttaaagcttaaggaatctgcagattcattgaaaaagattatggagacaattgaattataaattttacacatggacggagaaaaagacatggaagtaaggtactgtatctgtaagcattgtggaaacattgttgaaaaggtaaaggataagggtgtacctgtaattgaaaagtgcgaacataaaaacagtttcatcaatattctcctttatatataaattacgatttatctatttgcataatcaatcaaaatcttcttacaactactacaacgataagcttcacaatgagggattcctcctgaacctttactcaattccagatcgtccgatttttttatacgaaaaacttttgtcagattatcaactgcaaaagtaatgtctcgtgaactcattaggtatcctctaatcatttcatcaccacaatatggacatttcatgccgagtcacctcctataaattccgattttactttgtgactatgacttttccttccgaatccagaagaggtgtaatactggctccaaatccggagttccaacaaaggtaattaaccccagtcttcttatctacaaggatttgacgaattccttcatctttaagccaactcccgtctctgaatgtaacttcaaatctttcttctttctttgccatgtttatttctccttttttcaagcgttaaataccgattttcttgattctgcaaactttatcgtcttgttccattcttatcaaaattcttttttaatgctatttctgttgggagaatagacccaattaaaggaataagttgaacaccacaaataattcctcccatactcccaacacaatcttcactttttccaattactaaaagcatgaatattactgttatcggcaacataaccattccacagacataccagactttaccgcaatatttatgagcaaattcccatgtgtctttattcttgccattcaaatcatatcacactatcagacatatttccatttcgatttactcagtcaagtcacttcgctcagctacatttcctgtcggcttgcttctgtaaccgggctacgtcgaggctttttcaactgagcaatcggattcgcaggcaagtgtatgaggcagttattttgaaaacgctgtactagcatccggttattaagaagtctcttcaaacttactacaccagtaacatgaagtagtaatataaaaagctttcggattttttcatttgaaccgaaagctttttatttcatcatcttctattatatctatcttcctgtctaaccggcactctgaccggtactggttctggcatcagtcccgggatcagacgattcataaaatctttgatcttcttccctgcttttgtattgatccatctataatattgttctattgtcatactgttctacctcctattcaggtctcctatcataagtaaatgatctgcatttctgctatatatacctatgccatattattcttttctgacatggctgtattttatcagatgattttctttttgtcagtgcatttaccgcttattttagaattgtttatacttcttttatgaagttttgaacacatttatctttgtcatcatttgacataggagcaatctgattttatagaattttcatttccccacatttgccacattctcccagatatgttatgattgtaactgttctattgtgattcatttttgcatcggttatgatactgattaacacagacaagatatctttcagaataagaacaagaatatcagaaatggggagtttatatgttatctacatcgaaagaacctgccgcaaaggagaaggactctgctgtgaaagaacttttccaatggctgatcgccattttagcggctgttgctattgctttatttgttgataattttctaatcgtcaatgcacaaatcccttccggttcaatggaaaacaccatcatgaccggagatcgtgtggttggtaaccggctttcttatttaactaaggatcctgagcgttatgatgtaatcatttttaagtatcctgatgacgaaagccagctttttattaagcgtatcatcggactgcctggtgaaaccgtggagattcgtgacggtcacatctacattgatggctcttctgaaccgctcgaagatgtagagacgaaagaatacatggtcggaaattatggtccttataccgtaccggaaggatgctattttgtgatgggagataatagaaatgattcgaaagattcccgctactggattaatccatatgtatccaaagataagattcttgggaaagcagtctttcgttactggccaattacagaaatgaaaacgattaaataattttcaagggcagatctgactcatacgagttaaatctgcccttactatttacatcttataacaacctttttcagaaatcacaaaatccatccgcagatcatgttcctccaccggaatttcgtctacaagcagttcctccctgcaaagtgctgctttcacgcaatgcgtcttttccagatatctgtcgtaatatccacctccgtgaccaaggcgtcttccgcttctatcgcagctgatacatggaatgaaagcaaaatcaattgcttccggctgaatcaatctttccgggtcttcttttggttcaaggattccatatgcacccggatacagctcttgtaatgagtggatctcgtatacgttcataattccttttcccgtacactttggcactccaagatgctttcctgattgaagaatatcttgcaatatagaaaatgtatctatttctttctctgtgctcacataacagaacacacagtctgcgctcttgtattcattcagttccaaaacgctttctgtaatctttctgtctgcttcttttctgtatttttctgttgtaaaagaaagtttttcttttatttttcttcttaattctttcttttgaatcattttctcttctgtttttctttccaattcttccactcttttctcttttcgcttttttctttttttctcttgtttaactattttcttcttcctgttcttctccgacagattcaatcagcaggtgatccagattttgcaggtctgcttttctgatttcatattttccctctttatctttttctacatgaagaacaattttatttggttttccgtacttcagccctttttctgccgcctgacttaaaacctcataatagatctgataaatttctgtctgcatctgtgtttcttctggcatagcctgtccgttcatcacatcatttgaaacttttgtggcgtattcctgcgccttctcctgaaattcagcataagtatccttcagcaatgtgattggtttcactgtaagaacaacctgataagttccattttcttccctggttgcttctcctacagtataagatgtcttctttgcaagatctgcaaacagttctctatattcttctgtcatctcatctgtcattacatgctccggaaatttttccattgtataagcaagattatcttcgaaaacctgttttgcttctttctcggaaatgccggtctgttttatataggattctgttttctgcttataagatacatctaaaaatgcctgtacatattcctgcggatcaaaacggtttatgtaacaatagatcattgttgctgttgctgcgacgataattgcaaccattataactcctactataaaacgcttcttttctttttttcctgacatcaactttacctcttttctaactgtaatttgaataacttatttgtaactgttcagagccaagcaaaatttcaaaaacaggtataaaatgcttgcattatgttactgttcactcccgtgtcaatcactccgctgattgacacggaggatgcgttgctggtcgcacatcgtgtgaacagtaacacggtaatggtaacagcaatatagtaattgatagaatgattggagagcagttatgattagagaatgtacagagacagacagagaaatactgggaagttatctggaagaagacagttatggacaggaaatctttcatctgattgatgaattcggatttgaacagaaattccagtccgtttatatggatattgaagaagaacagtgcaaaggtgtttatcttatgatttacaaaaatgtactgctttattcgaaagagaaccaggtggaaattgatttcctggagcagatgctctctgtgcttgtgccggagatggtgattggacgaaaggataatgtgaatattgtaagctggcttctgacagactaccggatggataccgtagatcagatcccggagctttgtgatgaggaaggcaatgcgttgaagagggacacccggaagaaggaaggacaggaatggggcgtcctgtataaggaggactagaagagcgatgaagagaatatttattgacggactcagcggaatggcgcagggcttgtttgcaacattgatcataggaacaatcatccagcagataggaatgtttgttggaggaaattatggagatttaatttatttgatcgggaaagttgctgcagcgcttacaggagcaggtattggtgtcggagtggcaaggaagctggaggctcagcagcttgttacagtttgtgcagctgttgccggtatgatcggagcattcgcggggaaaattctggcaggtcaggtacttgtagatgggaatattgtattagccggaccgggggaaccactgggagctttcgtggcagcttatgtggcaattgagattggaattttagttacaggaagaacaaaactagatattatcctgacaccattgatctgcattggagttggtggagttgttggattgtttgtcggaccaccgatttcttcctttatgaactggctgggttctttgattaactggggaacagaacagcagccgttccttatgggaattgtagtttcggtcttgatgggaatgatcctgacattgccgatcagctccgcggctttgggggtaatcctgaatctgtcaggtcttgcagctggagcagctacagttggatgttgttgcaatatgattggattcgcagttgcaagctacagagagaataagattggtggatttttggcacagggaattggtacttctatgcttcaggtaccgaatattatgagacatccattgatttggatcccatccattttgtcaagtgcaattttaggaccggtaagtacaatgttactccatatgacgaataatgcaaccggatccggaatgggaacagccgggctggttggtccgttgatgacgtggcaggtgatgatccagacagaagatccgatgattgttctggtgaagatcattgtgatccagtttgtacttccggcagtgatcacacttggaatttcagaatttatgagaaagaagggctggattcgccagggagatatgaaactggagctgtaggcagaaaatggattacagagattggaaagatactattacagtaacactaaaatatctctaaaaaagaagtgaattctgtgacagaaaaatgggagtatgttatacttaatatatataaacagaccgggggatgactgctatgagaagtgaacaacaggtagaagctgcgctaaagagttatgaagatgttgacagctggaagacaatcattttcctgtataatgcagcgttgaaagaagttggtacaaagctggagattcttaatgatgaatttcagcatgtacatcagtataatccgattgaacatattaagacaagaatcaagacaccggacagtattgtgaaaaagctgaagaggtatggacatgagacgtccatagagaacatggttcgctatgtgaatgatattgcaggagtaagattgatctgttcatttacatcagatatatatcgtctggcagagatgatagggaatcaaagcgatttgaaagttctttcaattaaggattatattaagaatcccaaagaaagtggatataaaagttatcatatgttagtttctgtgccgatatttctttcggatagtgtagtagacacgaaggttgagattcagatccgaaccattgcaatggacttctgggcaagtcttgaacataagatctactacaaatttgaagggaatgcaccggagtatatcagcaaggatctgcaggaatgcgcaaagatggtatcagagctggatgataagatgctttcattgaatgaggcaattcaggaatgcattgcccaacaggataaggatcagattcggatgaatgaagaactgatgaatgatgtgtgcagagatgttcttggaaataacaaagaatataaagattcgaaagtacaggaaaaagtgacagagattgtaacataagacagtaatctgtagaaaatataaaactgtaataaacgaagtgagctgtgggaaatgagagattcatattttcacagctcttgttgttaaaagtgattgtgttactgtttatacgatgtgcgaccagaaacgcatctcgttatttcaaatcgcctttggcgatggggcttgatgattttctataggttcggtatactatagcaatagaagaatggaaaatatgaaagatatttagcatagaaagatgaggaaaatagatgatgataagaaaaaaactggcagtcttgatgttggctggtgtgacttgtttagcatccggctgtgggaatgcggtcaaggacggaacagaggcgcttggtgaaggaagatatgatgcggcagagatggcatttgaagaggcaactaagaatgagaataaagaagttgcggcagatggatatcagggacttgggatgacttattacgagcagaaagagtatgacaaggcattggaagcatttcagaccgcattggatcagggagcagagcagacgcaggaactttataatctgatcgcagtttgcgcaatgaagacggaagattatgcgaaggcactcgaatgtttccaggctggaatcgcacttgcagaaagcaagacaggagatgacaaaacgaaagcagatacagcacttcttcaagaaatggaatataatgtgattgtctgctacgaacaacaggcagactgggaaaatgcaaagagtgcgatgaaacagtatcaggcagatttcccggaagatgattctgtgagtaaggaagcagagttccttcagacaagataaaaaggttactgcggtcagcagcagggcaggttgcatattagcagatcatgataagtagataaggaaaagaaaatatgatatcaatggatgaaataaaagagagggtaattctcgttgcggtagatacggatggatctgatcaggcagaacgatccctggatgagcttggagagcttgcgaagacagcaggtgcagaagttgtcggccgtatgatccagccaagagaaaatatccatccgggaacttatataggaaaaggaaaaattctggaattaaaggaattattgtgggagacgcacggaacaggaattatctgtgatgacgagttgacaagtgtgcagatggggaatctggaagcagaactggattgtaaaatcatggatagaacacttctgattcttgatatatttgcagccagagcagtgtcaggagaaggtaagatccaggtagaattagcacagttaaagtaccgtgcttcaagactggccggacttgggaaatcactttccagacttggaggaggaatcggaacaagaggaccgggagagaaaaaactggagatggaccgccgtctgatcagagaacgtatcagcagactgaagaaagaattgaaagatgtagagcgccacagagaattgattcgtggacagagaaagcagtccggactgaaagtagcagcattagtaggttatacttcagcagggaagagcagtattgagaatgcactgacacaggcaggagtattggaggatgcgatgcttttctcaacattggatacaacaacgagagctttgacactggataacacacaggaaattcttttgacagatacggttggatttatcaacaagctgccgcatcatttggtagaggcatttaagagcacactggaagaagcaaagtatgcggatattatcgtgcacgtagttgatgcttcgaatccacagatggatgcgcagatgcatgtagtttatgagacactcagacagcttggagccgaaggaaaaccggtcattacgctgtttaacaagcaagataaggttgagaatccggttaatcacaaagatcttcaggcagattattccattgcgacatctgcgaagaccgggcaggggctggaagagtttaaacaggcgttattggagattatccgtaaagagcagatttatattgaacgcttatatgatttcagtgaagcgggcaagattcagctgatccgcagtaaggggcagctgttatccgaagaatatgtgccggaaggaattgaggttaaggcatatgtgccgcaggatatttatggaagattataaatgtgtctggaattctaatgttatagaataagaaaaatagatagataacaaaaccgtaagaggaagcaggaaatgagcttcctcttacggttttttttcttataagaacagtgggaaaactgttcttggaattgcgtgtgatattatatggtgtttctctaaagttatatcctactgtagatacggtgttgccgggctctctgggtaacttcccatggagacaagcagctgaagccctacatctcttgcggtgaggactgcattcttaacagcatccgcatcaccggttaccgcgacgatcacttcgttcgaatggcttgttccctggtccggggtcatatacttgatgacttcaaccggggaagacttcaccgcaaggtcagccatgacaagtccaatagcagcaggggaaccgcagaagaatccaaaaggttttccaatcggggcgttgaatgccatatgaagtgctttgtctgcacaggcagagaaagtgaactccagatgtccggcctggctgatgtagagttcaccggcatatttgccgatatattcaagcgcaatgtcaactgcacggcgcacgtcagagacgttgtctccgccgatcacgatgaaacatccgtgtccgccccagccttttgtatcacgaggaagctcaatagagacaatctccgtgttcgttgacttgacagcttcgtctgctgcattgatctgtccggctgcacctgttcttgaactgatcaggccgagactcttatatgccttcttcagattcatcttctcaagaagagaagggtcaattcccgggataacaagtccgattgtatccaaaacggttgttccaacgaattcagtaagggaacaatcctgtgaaatctgttcaatgtgatgtacgtctatcatatgaatcctccatctattccaataatctgtccggtcatataagccggcgtatctgtgagctttaatgcaagctcggcaacttcctccggattggcaaaacgtccggaaggaatctcatccataagatcttggcgttcctcttcgttcaaacgaccattcatttctgtgtcaatcacaccgcaggcgattgcattcacctgaatattactcggtgcaagttccttggcaagtgctcgtgtcaatccgtgtattccggattttgttgcggaataagcaacttcacaggaagcaccgacagttccccacatagaagaaatattcagaatctttccacattttttagataccatgtatggaatggctgcgcggctgcagtagaagacggaagaaagattcgtggcaagaatcttatcccagtcattgtcagtcatgtcagtcagaagtccgaaccaggcgataccggcattgttgatcagaatatcaacgccaccacactctttttcaataatctgaaaaatcttccggacttcgtcggggttactgacatctccgggaactgctgtacaggaaccaccgtctgagagaatctcatgtgcgagctcttctaagcgttccacctggtggacacagttgagaaatacgtgataaccggccttggcgtatgctttcgcacaggcacgcccgatgccgcgggaagaaccggtgatcagtatggattttttattcataaaagaaaacctcagtctttctgagcccttaaataagcggctgatttggagagtgatcatgataaaattctaatgattactcagatacaataactataacataaaatggattggatttcattgtctttcgtaaatggatatgctaaaattttagaaaagggcgttactggatacagtaattaggatagatttgatgatttcggaagaaggagagaacacaatggcaaagacaaaggtaatctgttttacgaataataagggaggaagcggaaagaccacaacttgttcaaatgttggatttggtttgagagagcttggaaaaaaggttctgatgatcgacggagatatgcagctgaatctctccctttctttgtttgacgaagatacagtgcttgcatatgcacagagtgacaaaaatttgtatgaagcaatcaagcgacaggatgatctgacagattatatcgtgaatacaaaatacgaaggacttgatctgattccgtcttctacattgatgagttcgattgaatacgaactttttacaaaatggcagagagagtatattttgaaaaaaggattgaagaagatccgcgagtcagaggtttatgattatattctgatcgatgcaccgccgacacttggtggatgggtgatgaatatcctttgtgcgtccgattatgtgatccttccggtagaggcatctccatggggactgtttggtcttggaaatatgtttgaattcctggacggtgtagaagaaattgcaccggatctcaagcttggtggaattgtgatcacaaaggttgatacaagaaagaattatttcaaacagacattagagactctgcaagagttagatgatgtgaaagtatttgatacttacatccgcgtggacagtggaattgagtggtcgcaggataataatgcaccggtgatcgcatataagaagagcagtagaagtgcgaaagagtacatggaattaacgagagagattgcagctacattaaaaggataaaccagaaaggcaggcaatagatgcatcaggaactgatccgggaactggcgatgatcacagatgaggaacgccggatccttgaaggaaaacaggagatcgatccacagctttatacagaaaagaaggaaatggttgtggacagtgcgaaacttctgaagaaggggaagttgatccaggtcagaccgcatactcgctttgtacatttcccggcgcatacacacaattatatagaagtaatttatatgtgccagggaacaacgacacatatcgtgaatggcaatcaggttgtgctcgaacagggtgaccttctgtttctgaatcagaatgcagtgcaggagatccttccggccggagagtatgatattgcagtgaattttattgtcctgccggagttttttaacacagcattctctatgatcggggcagaagaaaatcagctgaaagatttccttgtcggggcgttgtgcggaagagatgaagagacatcttatctgtattttcatgtggctgatattctcccggtgcagaatctgatcgagaatatggtctggacgatcttctatgacatttccaataagcgaagtagtaatcagatcacgatgggacttttgtttcttcagttgttgaattatatggataagatggaagccggcggacgcaaatttgatacagagattatggcgaatgtgtatcgctatattgaggatcattttaaagaaggcacgctgtcagaactggcggtagagatgaaagtggatgtctattggctgagtcgtgagattaagaagaaatcagggaaaacatataaagaacttcttcaggaaaagaggatgcagcaggcagtgtatcttctgataaacagcaggattgcggtgtcggacattatagaagcagttggatacgataatacaagctatttttatagaaaatttaaagaacgctacggaatcagtccgaaagaatatcggattgaaaacatgaattaaggataaagtatagagaggatgctatttttcacagatggcatcttctttttttacgcgaatagtaaaccgaagactatactgaagtgagaattggcaattcgcatcaatgacaacgtatgaaaacagataaaaataaaaaaacgacgaaataaaattgcgaaaataatatcgaaatagcactatgcacaaaaggagataggatgtataatgaaacatatgtgaaaaatacaaaaaggaggggcacgatgttagatatatcctattacgaaaaaacagatgagattattgcacagtatacatgtgaagaaaagtctttgatcccgattatacaggggattcaggaagaatatcgctatcttccaccggagcttttaacttatgttgcggagaaactgggaatctccgaggcgaaagcttacagtgtggcaagcttttatgaaaatttttcttttgaggcaaaaggaaaatatgtgataaaagtatgtgatggaacagcctgtcatgtgcgcaaatctattccgattctggaaggactttacaaggaactggggcttgggaaaaagaaacacacaacagatgaccagttgtttacagtagagacggtttcatgcttgggcgcatgtggactggcaccggccgtaatggtcaatgatgaagtacatccgaaaatgacacctgagaaaatgagcgagctgatcaagaagctgcgggaggaagaggaatgaggatagaaaacagaatgcagctccagttatggagagaagagtgtaaggaaaagcggcagaaagaaaactgctgtattctggtctgtggaggaacaggatgtctggcaggtggttcagataaaatatatgcccgtttgaaagaactaacttccaatatggatcatgtaacagtcaaaatcggtgaagaaatcgctcatgtgggacttaagatgagcggatgccatggattctgtgagatgggtccgctggttcgtattgaaccttataactatctgtatctgaaagtaaaactggaagactgcgaagaaatttttgaaaagacgattcttcatggagaaccggttacaagattgatgtatgaagataatggtcatgtatatcagacacaggaagaaattccattctatgccaagcagacccgtctggtgttgagaaactgcggtcatattgatgcagagcatattgaagatgcaatggcggtaggagcatatgagtctttcgaaaaagctgtgtttgaaatgactccggaagcagtgattaagacggttacagatgcaggtcttcgtggaagaggcggagcaggatttccggcgggaagaaaatggtcacaggtagcgagtcagccggaaaagatccgttatgtagtctgcaatggtgatgaaggagatccgggtgcatttatggatcgaagcgttatggaaggtgatcctcaccgaatgattgaaggtatgatgctggcagcttatgcagtacaggcccaggaaggatatatttacgttcgtgcagagtatccgctggcagtacgaagactgcagattgctatcgctcaggcggaagagaaaggacttttgggagataatatccttggaacaggattcagcttcaaattacatatcaatcgcggagcaggtgcttttgtatgcggggaaggttccgcgcttacagcttcgatcgaaggcaagcgaggcatgccgagagtaaaaccaccgagaacagtagaacagggattatgggagaagccaaccgtattgaataacgtagagacttatgcaaatatcccgatgatcattaaaaacggagcagattggtacagccgtattggtacaccgcaaagcccaggaacgaaagcgtttgcccttaccggaaatgtaaaaaataccggattgatcgaagtgcctatgggaataagtttacgtgaaatcatctttgatatcggaggcggcatcaaggacgataaagggttcaaggcagttcagatcggtggtccatccggtggatgtttggtagaatctcagcttgacagtaagatggattttgactcactgtcaaagatcggtgccatgatcggttccggtggacttgttgttatggatgaagacacctgtatggtagaggttgcaagattctttatgaacttcacacagagagaaagctgtggaaaatgcgttccgtgcagagaaggaactaagcgtatgctggagattctggaacgtatagttgccggaaacggagaaatgagcgaccttgatgaactggaagaactggcagacatgattgaaaatactgccttatgtggtcttggaaagagtgcaccaaagccggttgtaagtacgattcatgcattccgaaaagaatatgaagagcacataatagataagaaatgtcgtgcgggagtctgttctaatcttcgtgtgtttaagattgatccggagaaatgcaaaggatgttcgaaatgtgcgaagaactgtccggtaaatgcaattacaggaaaaataaaatcaccatttacaattgataattcaaagtgcatcaagtgtggaagttgtatcgataactgcccatttggagctgtttatacagagtagggaggatagagatttatgggaattatgacaattgacggacaggccattgagttcacggatgaacctaatgtattgtctgtaataagaaaagccgggattgatatccctaccttgtgttatcattcggaattatctatctatggtgcctgccgattatgcacggtagaagatgacagagggaaaacatttgcttcatgttcagaaaagccgagagacggaatgattatttatacaaatacaccaaggctgatgcgctaccggaaactgatactggaactacttctggctgctcactgcagagattgtacgacgtgtatcaagagcggcgagtgtcatctgcaggaactggcgcaccgtatgggagttcatgagatccgctttgaaaatgtaagagagatacagccaattgatacaagttcacacgcaattatcagagatccgaacaaatgtatcctgtgtggtgactgtgtcagaatgtgtgataatgtacagaatatcaatgcaatcgacttcgcgtatcgtggaactgatgcacaggtaataccggcatttaataagaagattgcagaaacagactgcgtaggttgtggacagtgtcgtgttgtctgtccgaccggtgcaatcagtattcataccaatattgatgaagtgtgggaagctttggcagacaagaacacaaaggtgatcgctcagatcgctccggctgtacgtgttgcaatcggtgataactttggttatgccaaaggtgaaaatgtgatgggcaaactcgttggagtactgcatcgtctgggatttgatgaagtatatgacacatcctatggcgcagacctgacagttgtggaggaatccaaagagtttattgagagatttacttccggtgagaagatgccactctttacatcctgttgtccggcatgggtaaaatattgtgagaataaatatccggaattcgtgccgaatctttcaacatgcagatcaccgcagcagatgtttggagcagttgtaagagagtattataaagatcctgagaaaaatgaaggaaagaagatcgtatctgtatcaattatgccttgtacggcgaagaaggaagaaatcttacgtccggaatcttatacaaatggcaagcaggatgttgattacgtgctgacaacaacagaaatcgtaagaatgatccgtaaatccggtattgtatttgataaggttgagatcgaagcagctgatgtgccgtttggtatcggttccggaagtggtgtgatcttcggtgttaccggtggtgttacagaggcagtgctccgtagactgcagcagggacacaacagagtagacatggagtctattaaaaagagtggtgtgcgtggagacgacggtattaaagtgctgacttataattataatggaagagagattaaggcagcagttgtaaatggccttgcaaatgcagataaagtattgcagcagattaaaaatcacgaagcagagtatgattttgtggaagtgatggcctgccgcagaggatgtatcatgggtggaggtcagccggtgaatgcaggaccgagaaccagaaaagcaagaatgaagggcttatatgatacagatgtaaacactcagatcaagaaatcaaatgagaacccaatgattctttccttgtacgatactttgttgaagggaaaagagcatgagcttcttcatagaaatttttccggtaaataaagtatctggttgtggagaattacatttgaaatgaagatatacattttcaacaaaaatagtaattgaaaattgtacaaagtgcaaaagagaaccctaaaaataaaatacagtgcaaataaggacgctatttttcgtaaatagcgtcctttttttacatagaaagcgtggatataataaagccataagaaatgaacagtaatagaaaaataacaaggaggcaccaaaacaatgggcaattattatctagcagttgacatcggagcatccagtggacgccatatgctggcatctatggaagatggaaagatgaaactggaagaagtttaccgttttccgaatgggatggataacaaaaacggtactttatgttgggatgtagatcgtctttttacagaaatcaagaacggattgaagaaatgtaaagaacttggaaagataccgacaacaatgggaattgatacttggggagttgactatgtgcttcttgatgagaaggatcagatcctcggagatacagtaggttatcgtgacagtcgtacgaatggaatggatgagaaagtgtatgaaaagatttccctttccgcattgtatgagagaacaggtatccagaagcagatattcaatacaatctatcagctgatggctgtaaaagagactcatcctgagtatcttgagcaggcgaaagcaatcctgatgatcccggattacttccatttcctgctgacaggtgtgaagaaaaatgaatatacaaatgcgacaacaggacagcttgtgaatccgacgacaaatgactgggattatgaactgatcgatatgctcggatacaacaaagagatgttccagccggtatctatgccgggaacagtagtaggcgaatttacacaggacattcagaacgaggttggattcaactgcaaggttgttcttccagccactcatgatacaggctcagcggtacttgcggtaccaaccaacgatgacaatgccatttatatcagctccggcacatggtctttgatgggaattgagagaaaagaagcagactgctcactgagaagtatgcaggcaaacttcacaaacgaaggtggatacgatcaccgtttccgttacctgaaaaatatcatgggactctggatgatccagtctgtaaagaaagaattcacagaggatctttcttttgcagagatttgtgagagagcttccaaagagacgatcacatctttagtagactgtaatgatgactgcttccttgctccgaagagcatgattgaagctgtgaagaagttctgccgtgattccaagcagcaggtgcctgaaacagtgggcgagattgcagcagttatctacaacagtcttgcaaaatgttatggcgatacgatcgaagagattgaagcattaacaggaaaaaaatacactacaatctatgttgtcggtggcggtgccaatgcaggatatcttaatgaactgacagcaaaatatacaggaaaaaaagtttccgcagggccttctgaagcaacagcaatcggaaatattgttgtccagatgctacatgatggagtgtttaaagacctgccggaagcaagaacatgtgttggaaaatcgtttgatgtaaaaatatacgaaaatgtgtaattcaaattcacaaaaatggaggaagaaaagatgacaagatatgaatcagccaaagaaatctatgcaaaattaggagtggacacagacgcagcaatcgcgaaatgtaaagaaattccggtttctcttcactgctggcagggagatgatgtaacaggatttgaccacgatggccctctgacaggaggaatccagacaacaggaaactatccgggaaaagcaagaactccggaagaactgttagctgatatggataaggcaatgagcctgatgccgggtaaaaagaaaatcaatgttcatgcatgctacgcaatctttgaagatggtgaattcgtagatcgtgataaattagagccaaaacatttccagaaatgggttgattttgcaaaagaaagaggaatgggacttgattttaatccaacattcttctcacatccaatggtaaaagacggacttacactttcaagcccagatgaggaagtaagaaacttctggatcgagcatggaaaagcctgcatccgcatttcacagtattttgcggagcagacaggagttccttgtgtaatgaatatctggacaggtgacggattcaaagatattccggctgaccgtatgggacctcgtgtacgctacaaagagtctatcgatgcaatcctttccgagccatttaacacaaaccttgtaaaaccttgtgtagagtctaaagtattcggtatcggtgttgaggcttatacagtagggtcagctgaattctcactgagctacgctgcaatgaacaaagacaaatgtctgccactgatggacaacggacattatcatccaacagaagtagtatccgataagattccggcactacttacattcttcccggagattgctctgcatgttacacgtccgatccgttgggattcagaccatgtagttctctttgatgatgagacaaaagagatcgcaaaagagatcgttcgctgcgagaacggaattgaccgtacatatattgcactggattactttgatgcttccatcaaccgtatctccgcatgggtaacaggattccgcagcttccagaaagcactgcttgatgcactttgtcagccaagcgagatgctcaaagagcttcaggatacaaaccagatgagcaaaaaaatggttgttatggaacagtgcaagacacttccaatcggtgatgtatgggaagagtactgccgtcagtgtggtgtagaagctgaaggatggtttgacgagattcagaaatatgaggatgaagtgctgtctaagagagcataataaagagtgaaaaaatgggggatatcaggaaattgatatgccccatttttgttcgaaaatgagaagttggtcaaggagtatcctttttaaatcaaattcagatattccagcgcctggcggattccgccgtcttccaaggcgccggtcacataatcagcctgtgatttcaagtcttcagatccatttcccatagcaaccttaaatccggcagcctggaacattggcaagtcattattgctatcgccgaaagcaataacatccctcttttcgtatccaagtacattactcataacactgatcgcaagtcctttggaacagcctttcatgacaaattcaatcgttcttccaacaaaagatccactgtgaataatataatcataccatagggataattcctggcataatttctctggattacatccgggtgtgcgcttggcacttattttgttaaagtgaagattatgttcatttccacgaataggaagcagtttgtcaccgagttcctgagtgatcagatcagcaaaccagtctatgtcacttgtatattcatccagattatagtacatataatcattgccttccagtacagggataaaaccgtttgccttaatgatctctacggtcttccatgccaggtcggttggcatctcacgctcaaatacccgcgttccattatattcgatatatgctccaagattagcgataagtccgtcaaatccaatctccttcataagatattcaggaacaaaagcgtttgaacgaccggtacagatgaaagtcttatgtccgttttttctcaactgttgaagtgcaagttttgtatcttctggtgttccttttacaatatctaaaattgttccatctgcatcaaagaaaagacattttcccattgtaagtattccttctatattatagtattatctctcacctaaaaatcccataaacttacgtacagagtaattcaggataagatcctccggaatgtcagcttttcgagccaaagcttcggcatactggaagtcaccgatatgttcggtgccgtggctgtcactggagaacagaaccggataattaaagtgcttggacagattcaatattaagagatcggcgtaggtcgtatccccacgatatccatccggacttaaagaactgttattgatctcaagcagaacatggttctccattgcagcacggaaaagggcaaaataatctacagggaatttttcgtcatcgcaatgaccgatgatattaacattaggattctccatagtcttgatataagcacgggtgttctcatctgctgttccggatttaaaaattggacgatgcatacttgctataacataatccagagactctaaaatttcatcatcaagatccagttttccttcctgatccagaatatttacctctgcaccgtaaagcattctaacaccgagacgctttggttgtgcaaatgcaaggctgcggaaataagaaatgcgtccgccaccaagcgttttcggaccatgatcggaaattccaagcatcttaagcccagctgcattggcagcttttgccatatcagtcatggtcgcacaggttccgtgtccgctggcgatggaatgtgtgtggatatcaaattcataagaagccatataatccaacccttctttctaatcgttcacacggcagacattgtgttgattcattcgccatgccgcatatataccttaagtatgcggtattttaagtaaaatgtcaataaattcgaggtgaaacgtaaagaaaaaacaaataaaacacaacacgaaccgtattgggatttattgtaactttacagaaatataatgtgggatgtattgtgttttgattgactttgggggataaataaagtataataaatgttaatattggaagaaaggagtttaagagcaaaatgggactttatacttatgacagtactcccatcccgaagtcggacagaattccaaaactggtagaaaacctgtatgcgaagatgcctgagattgagtcggcgagagcggtactgattacggagtcgtacaaacagactgagaatgaaccaatgatcatccgtagagcaaaagcgttccagcatattttggagaatattccgatcacgatccgtgacctggaacttgttgttggaagcagtacacttgccccaagaggatgccagacatttccggagttctcttacgagtggctggaggcagagtttgatacagttgaaacaagaagtgccgacccgttctatatctctgagcagacgaagaaggaactgaaagaggcgaatgcttactggaaaggccgtacaacaagtgacctggctacagcatacatggagccggagacattacttgacattgaacacaatatctttacacctggaaactatttctacaatggtgtaggacatgtgacagttaagtatggtgaagttctcgagatcggattttccggaatccgcaagaaagcagaagatgagcttgcttctatgaaggtcagtgatggtaactatcagacaaaatcacgtttccttgaggcagtgatgatcagctgtgatgcagcaatcacatatgcccgtcgttatgcaaagcttgcacttgagatggctgagaaatgttctgatccggtaagaaagaaagaacttcttatcattgcacagaattgtgcgaatgtaccggagaagggtgcgacaggattctatgaagcttgtcagtccttctggtttgtacagcagctgttacagatcgagtccagtggacattcaatctcccctggaagattcgaccagtatatgtatccttattataagaaggatctcgacagcggaaagatcacaagagagtttgcacaggaattgctggattgtatctgggttaaattaaatgacctgaacaagtgccgtgatgcggcttcagcagaaggattcgcaggttacagtctgttccagaacctgattgtaggaggacagaatgaagagggtatagatgttacgaatgatctttcatttatgtgtattacatcatctatgcatgtattccttccaatgccttctctttccgtaagagtttggaatggatcaccacatgaattcctgatttatgcagcagaacttacaagaacaggaatcggactcccggcgtattataatgatgaggttattatcccgtcattggagagccgtggactgactttacaggatgcgagagactacaatatcatcggatgtgtagaaccacagaagtctggtaagacgaacggatggcatgatgcagcattctttaatatgtgtcgtccgctggaactggtattttcaaatggtgtggacaagggtgtacagattggtccaaagacaggtaatgttgaggatatgaagacatttgatgaattctatgatgcttataaagcacagatggattacgcaatcgcactacttgttaatgctgataatgctattgatatggcacacgcagagagagcaccgcttccgttcttggcaagtatggtcgatgactgtatcaagagaggaaagacactggaacagggaggagctgtatataactttacaggtccgcagggattcggtgttgccaacatggcggatgcactttacgcagtaaagaaactcgtttatgacgagaacaagattacaatgcatgatctgaagatggctcttagtacaaactatggaaagggtctgagcagtgatgatgttgcagagatggtatcagaagtggcttctgctatgaagtctgccggacagccggtaggcgagaaagaagttgcgacaatcctgaagactgttgttgcagcgacagaatcagatcaggtgaaggcgaatggtgagagaatcctcaagctgattgatgcagtgccgaagttcggaaatgatattccggaggttgatgcatttgcaagagacgttgcctatacttatacaaaaccactggagaaatacaaaaatccacgtggaggtatgttccaggcgggattatatccagtatcagcgaatgtaccgcttggcggacagacaggagccacaccggacggacgtctggcacacatgccggtagccgatggagtatctccgtcagccggtaaggatgtgaacggaccgacagcagctgcaaactccgtttccagactggaccactttattgcttcgaacggaacactgttcaatcagaagttccatccatcagcactgagtggaagagaaggacttgagaagttcgtaggactgatccagtcatacttcgatcagaagggaagtcacatgcagtttaacgttgtcagccgtgagacacttctggatgcacagaagcatccggaacagtacaaacatctggttgtacgagtagctggatacagtgcactgtttacgacattgtccaagtcactgcaggatgatatcatccgcagaacagagcagggattttaagaataagaaggagacagcatggaagaatatctgaagaccaaaggaagaatcttcgatatccagcggtattccatccatgatgggaatggaattcgaaccatcgtgttcctgaagggctgtgtgctcagatgccgctggtgctgtaatccggaatcacagcactatgagatcgagacaatgatggtacagggagaaccgaaagtgatcggtgaggacactacggttgctgaagtgatgaagacggtagaaaaagaccgtacgtattatagaagaaccggaggtggacttacactttccggaggcgaaagtctttgccagccgaagttcgcaagagaccttctacgggcagcaaaagaatcaggaatcacaactgcgatggaaagtatgggatgcgcaccatacagcacgatcgaagagattcttccatatttagaccagtatcttctggatatcaaacatatgaatccggagaaacataaggagttcacaggacgttcgaacgaactgatgctggagaacgcgaagaagattgcagactctcatatgacagagttgagcatccgtgttccggtaatcccgggattcaatgatacagagatagaaatccgtgatattgccgcatatgtccgcaaacttggcaatgtaagaagaatgcatcttctgccttaccacagactgggacaggataaatatgacggactgaaccgcccatacctgatgggggatgtaaaaccaccgacaaatgaaaagatggaacgacttctgaaagtagcagaagaagtttccggtgtagagtgccggatcggtggttaaaaataaaaaacacaatcagataatctacacgaagtcgaaaacagagaaaaaagtgaaaataatcgcaagaaacaacaaaaacaacggctgttaaaattgactaatgtgggattgtgtggtaaaataagtcaagaaacaacacaaaacaaaagttttgacacgattccaaggaggagaaaaaatgcaaaacgaatacgaaatcaaaaaagaaatgtgtgagatcggaagaagagtttacaaccgtggaatggttgcagctaatgacggaaacttttctgtaaaactgaatgaccatgagttcctgtgtacaccaacaggtgtcagcaaaggatttatgacaccagagtacatctgtaaagtagatgagaatggtaacgttcttcaggcaaacaaaggattcagaccatcttcagagattaagatgcacatgcgtgtgtacagagagagaccagacgttcagtctgtagtacatgctcatccactgtatgctacaacattcgctatcgctggtatcccacttacacagccaatcatgccagaagcagttatcgctcttggatgtgttccgattgctaaatatggtacaccttctacagtggagatcccggatgctatcgagccataccttcagcactttgatgcagttcttcttgagaaccacggagcacttgcatactcagacagccttctgaatgcataccacaagatggagtctcttgagttctacgcacgtctgttatggcagtccatgcagattggcggacctcaggaactgaacaaagagcaggttgagagactgtacgaactgagaagacagatgggtcttccgggaaaacatccggcaaacctttgcccgaacgcaaaagctggtaaaccaagctgccactcatgtggtggaaactgtggcggatcttcagcagcagctccggaaggaacagatgctgatcttgtagcttctatcacaaagaaagttatggaacagctcggaatgtaatctaacagattagtaaaggagcaatgctatgaacgaacaggaaatcaccagtgcagttcaggctgtgctggaacagatgaaggaagcggctccgcaacatacgcacaaacatgtctgtcaatgcaaaaagcatcagatgacattgaaacttgcgaatgccctgattgaaaaagtcaaggcagaagcagcgagggttggtgtgaatgcggttgtagcagtttccgacaaggcaggcagacctgtagccgtccaatgtatggatgacgcctacatagcaagctttgatattgcattaaataagacatatacttccgcgagccttaagatgtccacagcagagttgagtcagttgagtcagccgggacaaccgttatacggaattcagtttacgaatgacggtaagatcgtgatcttcggaggcggagaggtactcgaagcagatggtaagatcgtcggagcactcggtgtcagcggcggaactgctgagcaggacacagcaatcgcagcttacggaaaacaagtcttcaaggaggtattagagtgtctataaatgaacagatggttcaggacattgtacaggacgttcttgcaaagatgcagatcgcttctgatgtacagggagaccgcggcgtattcaaggatatgaacgaggccattgaggcagcgaaagcgtcccagaagatcgtggctaagatgtcactggatcacagagagaaagtgatctccaatatccgtaaaaagattaaggagaatgcagagatcctggcacgtatgggtgttcaggagactggcatgggaaatgtcggacataaaattttaaaacaccagctggtagctgagaagactccgggaacagaggatatcactacacaggcatggtcaggagacagaggtcttacattgatcgagatgggaccgttcggagtaatcggagcaatcacaccttgtacaaacccaagtgagacagttctctgtaacacaatcggaatgttcgcaggtggaaatacagtagtattcaacccacatccggcagcaatcaaaacatcaatctacgcagttaatcttctgaacgaagcatctgttgaggttggtggaccggacaacatcgcttgtacagtagagcatccgacacttgagacaagtaacatcatgatgaaacatcctgcaattcagctgatcgctgcaacaggaggtccgggagttgttacagcagttctttcttcaggaagaagaggaatcggagctggagcaggtaacccaccggcactcgttgatgagacagcagatatccgtaaggcagctgaggacattgtaaacggatgtacatttgataacaaccttccgtgtatcgcagaaaaagagattgttgcagttgattctatcgctgatgaactgatgcactacatggtaaatgagcagggatgctacctggcttccaaggaagagcaggatgcactgacaaatgtagttcttgcaggcggaaagctgaacagaaaatgtgttggacgtgatgcaaagacactgcttggaatgatcggagttacagttccggacaatatcagatgtattacatttgaaggaccaaaggaacacccactgatcgcaacagagcttatgatgccaattcttggtgtagtaagagcgaaagatttcgacgatgctgtagagcaggctgtatggcttgagcatggtaacagacattccgctcacattcattccaagaatgtagatcgtattacaaaatatgcaaaagcaattgacacagcaattcttgttaagaacggaccatcctatgcggcacttggattcggaggcgaaggcttctgtacatttacaattgccagcagaactggtgaaggacttacaagcgcaagcagcttcacaaagagaagacgttgcgtaatgacagacagcttatgtataagataacggaggtatagacaatggaaatgaattctgctaatgtagaagctgttgtaaaacaggtacttgagagcatgctggaaaagaaagttccagaagcagctccagcacagaaagcagcaggaaatgaaattccaaagacagctcatgtagctatgcttacagcacttgagcattttgaaatcaaagagtatccgatgccggaagttggtgacggagatattcttgttaaagttgaaggatgtggtgtttgtggaacagacgctcacgaattcaagagagacccattcagccttattcctgtagtactcggacatgagggaacaggtgagatcgttaagatgggtaaaaacgttaaagttgacagcgctggaaaagctctgaatcttggagataaagttgttacatgtatgatcttcaaggatgatccggagatcacaatgtacgacctcaacaaacagaacgtaggcggagctgatgtatacggacttcttccggatgatgatgttcatctgaatggatggttctcagattacatcctgatccgtgagggatctacagtattcaacgtaagtgatctggatctgaaatcccgtgtactgatcgagccatgtgcagtacttgtacatgcagtagaaagagctaagacaacaggaatcttaagattcaacagcagagttgttgttcagggatgtggaccgatcggactgatctgtatcgcagttcttcgtacaatgggtattgagaatatcgtagctgtagacggagagcagaagagacttgactttgctaagagaatgggagctgagaagtcagttaacttcaaagatttccagggaatcgatgcacttgcacagggagtaaaagatgcattcggcggacatgctgctgacttcgcattccagtgtacaggatcaccgatcgctcatgcaaacatttacaaattcatccgcaatggtggtggactttgtgagcttggattctttatcaatggtggagatgcaacaatcaacccacacttcgatctttgctcaaaagagatcacactggttggctcatgggtatacactctgagagattatgcaactacatttgatttccttaagagagcaaaagcaatcggacttccgatggatgatctgatcacacacgagttcccgctcgagcagatcaatgaggctcaccagacaaacctggctatgaaaggtcttaagattgcaatcatcaacaaataaggtgagagagtatggaagcagtaggtatgctggaagtattcggacttgcaacagcatttgcagcggctgacgccggatgtaaagcaggaaatgtaagactggagaacttcgataaaaataaacctgcgaatgcagacgaattgcctgtaccgttgatcgtaatggtcaagttccgcggacaggttgcagatgtggaggcagcacttgaggctgctacagcgaaagcagagtcaatgacaggaattgtcacaaagtataagatctcaagaccgactgaggacactgagaagatgcttaagcttaacgcatttgataaaggaacaccacacaaagtaacagacgaagaagtcgaagaaatttaggaggatattacaatggcaatggcacagcttgcattaggaatggtagaaacaagaggacttacagcagcaatcgaggctgcagatgcaatgacaaaagcagcagaggttacacttgtaggaacagagaaaatcggatccggacttgtaacagttatggttcgtggagatgttggagctgttaaagcagcagttgagacaggtgctgacgcagctggaagacttggagaactcgtagctacacacgtaatcccaagaccacacaacgacgttgagaagattcttcctacagtatagtttgaagtcaaacagctagaaaaggagcagtctcatgggaaaagcgtatggattctttgaaatcccaagcgttacggcagcagtggtagccgtggatatcatgtgcaagactgctgatgtgcagttcgttacatgggagaaaaaactaggtggaagacttgtcacgatcataattcgtggtgatgtatccgcagttgcgcaggccattgaagctgccgagcagaatggaatcaaaaaaccagtgagcacagtagtgatcccaagtcctcatgaggagatcttgagaatcattaacacaagtgtaaacaaggttgtataggaggcagctacagatggcagacgaaaaagaaaagaaaacaacaacagccaaagcgccagccaaaactgtacgcagagtaagaaagacggcgcaaaaggcagaaacggttcagaagaaaccggaagttcagaaggaggaacgcagaatgtcacaggaagcattaggaatggttgaaacaagaggacttgtagcatctatcgaggcagcagattcaatgttaaaggctgctaacgtagcactcgttggaacagagaagatcggatctggtcttgtaacagttatggttcgtggagacgttggagcagttaaatcagcagttgagtctggagcagagtcagcaggaagacttggagagcttgtagctacacatgtaatcccaagaccacatacagatgttgagaagattcttccacagatcaaataatagtcaaaggtaaataaagccggtacttttaggggattaagcgccgggcgctgatcccctgatagtgcttaaataagtaagtggagcaatccactttgcgaggagacacaaatatggataacagtaatgtggaattaattacaaaaatggttctcgaagcagtagagaaaaagaatgctgctcagtctggagaaggttttctcgttccaatcggagtgtccgcaagacatatccatctcacacaggagcatgtcgagattctgtttggagaaggctaccatcttacaaagttcaaagaacttatgggtggacagtttgcatcaaacgaaaaggttacaattgttggtcttaaattaagagcaatcgagaatgtaagagttcttggaccagtcagaaagaatactcaggtagagatttctgcaacagatgcaatcagcctcggtgtaaaagcaccaatcagagaatcaggaaatattgcaggaagcgcaccaatcgcgatcatcggaccaaaaggtgcggtgtatctgaacgagggatgcattgttgcgaagagacatattcacatggctccgaaagatgcgatggcagcaggagttcatgatggtgatatcgtatctgtaaaagcagataatgagagaggaaccatctttaacaacgtacagatccgtgtagatgacagctttacacttgagatgcacatcgatacagatgaagcaaatgcagcgcagattaagagcggggataccgtgaggattgtatcatgttaatgggaaaagttgttggcagtgttgtatcaacacgcaagaatgaaaacttagtcggaaataaattcatgattgtagaagtggcagatcatatgcgtcagggagcaaaacagatcattgcaatcgataagatcggcgcaggaatcggcgaatacgttctggttgtacagggaagtgctgcgagaatcggaagtggtatgccggaagcaccgatcgatgctgcaatcgttggaattattgacgaaggattaggactggagtagtgaaattatggatatgaaagaattaagcagcatattgcagcagaacggtatcgttggtgctggtggtgcaggctttcctacatatgctaaattagatgaacgtgcagagacaatcattctgaactgtgcagagtgtgagccactgcttcgacttcacagacagctccttgagaaatatgcaaaggagatcattgatacatttcatatgatcggcgagacagtcggtgcgaaagaagtcatcattggtattaagaaagcttacacagcaacgatcgaagctgtaaaggccgttatgggacagtatccggaagtaagacttggactgttggatgaagtatatccggcaggtgatgaggttgttcttatttatgagacaacaggtaaagttgtaagaccgggcggacttccaatcgaaagcggcgtagctgtattcaacgtagagacagtttacaatgtatacagagcactgaatgagaagacacctgttgaggacaagcttgtatcagtagtagctgaggtagagcacccaatcacagttcgtgttccaattggaacaccactggaagaagtagtagctcttgccggcggtgtaactacaaaagatgcagtttacttcgttggtggacctatgatgggtaatatcggaacaggagcgcagcctgttacaaagacaacaaatgcaatccttgttcttccgaaagaccatcacatcattcagaagaaattaaagaaaaactcaatcgatatgaagagagcagcagcttgctgttgccagtgtacaatgtgtacagacttatgtccaagacatctgttaggacatccgattgagccaaataaatttatgcttgcagcaacatgcaaggatgtacaggagccgaacatcttcatcaatacgttgttctgctcatcctgcggactttgtgagatgtattcctgtttccagggactttcaccaagaagtcttatggcagagtacaagggaggtcttcgtgcaaacggaatccgtcctccgaaagtagaagcaaaacctgtaggaccggaaagagaatacagaaaagttccgatggagagacttatggcgcgtcttgatcttacgagatataaccgtgaagcaccgcttgatgaatcagcagtgccggttaagacagtacgtattctgttaagtcagcatattggagcacctgcttctgcaattgtgaaagcaggcgacatggtaactaaaggacagatgattgctgaaccaggaaagggattaagcgttggaatccacgcatccgtgaatggtttagttacagaagtaaatgagaaatatattgtcatagaatctcaggaaggacgtgcaggcaatgagtaaggctattggaatggtagaatataagactgtttcagcaggtattaccgcagctgatgctatggtaaagacttctgaagtcagcataatcgaagcacagacagtatgtccgggcaaatatatcgcgatcattacaggtgacttaagtgccgttaaagcagcagtggataatgcaaaagagatgcatggtcttcacctgatcgacagttttgtgctcggtaatccgcatgagtccatcttcccggcaatttacggtgctgcacatattgaagacgtatccgctcttggtattatggagacatacgatgcatcttcaattattgtagctgctgatgaggctgcgaagacggctatcgttgatttgatcgagcttcgtatcgcacgtggtatgtgcggaaaatcctacatgctgctcactggtgaagtggctgctgtagaagctgcaatcgaaaaagctaaggaagcaatcaaagatagaggaatgttccttgactcttccgttattgctcatccggatgctcagattcgcgacgcaatcttataatgaactctgctttaatgtctgagggaattatagttcaataccagtaacattatattggacttaggacaggaggcagttagatgcttgcgatagagagaagaaatgaaatattagaaaaactgcagaacgatagaagagtcgtagtaagcgaactgagtcagatttacgaggtttccgaggagacaatccgaagagacctcgataaactggttcaggacggttttgccataaaaagctatggcggtgccgtgatcaatgaaaatgtgaatatcgagcttccgttcaacatcagaaagaatcgcaatattgttggtaaacagcatattgcggaactggtgagtgaacagatcaaagatggggacagcatcatgcttgatgcaagttctacagcagtgtatgttgcaaagacgcttctcgaacagggaaagaagaatcttaccgtgctcacaaactctgtggagattatcatagagctttttggggcgcaggattggaaggttctctctaccggaggagagtcaagagaaggatcctttgcactggtaggttatcagacagaccggatgcttcgatcttatcatgtagataaggcagttatctctgcaaagggaatcgatatgaacgctggacttacagattcagatgatctgcatgcgaataataagcgaacaatgctgacaagagcaaaagaaaaaattcttgctgtagacagcagtaagttcgatcaagtagcatttgctgagataggttcattagatcagatcacaactatagttacggatgcaaagccggaaacaagatggcttcagcattttgataagattggtgtaaaatgtatctatccaaagtaaggaagggcagttatgaaaagctttcagattaaaactagagtaaattttggagataatgcgctggatcgactggcagaagtgccatataagaagatcctgattgttacagacccatttatggcgaaaagcaaaaatctgaacctgattctcgatccaatcaaaaaagcaggtaaggaatatgatatctttcaggatattgttccggatccaccgattgagaagatcagtctcggtgttaagaaaatgcttgaatataagccggatgcaattgttgcagttggtggcggatcagcaattgactcctccaagtcaatccgtgaatttgcacttcgcgtagatcattacgcagaggtagggctgattgcaattccaacaacaagcggtacaggatcagaggtaacttcatttgccgttgtatcagacccggcagaacagagaaaatatccacttgtatcctgggaattgacaccggacgaggcaatcctcgatgcagaacttgtaaagagtgtgccaccggcgattacagcagatacaggaatggacgtatttacacacgcacttgaagcatgtgtaagtacagctagaagtgatttctcaacagcacttgcagagaaatcgatcgagttggttggagtattccttctcagagcatatctggatggaaatgatactcatgcacgtcagaagatgcattccgcatcctgtctggcaggactggcattcaactcagcatctctcggactgaaccatggtatggctcatcagttaggtgcaaagttccacatcccacacggacgtgcgaacgcaatgcttcttccacatatcattgaattcaacagtgatatcaataaacatagtaagagtcagaaagaatatcttccggctgttaagcgttatgcaaccgtagctcagatccttggactgagcagctacaatgaaattatgacagtcagatcccttgtaaactgggtacagtttatgttaaaagagatggatattccgctgtcaatctctcagatgggtacaatctcagaggaagagtacttcaatgcaatcgacagtatggcagatgccgcacttgaagatggatgtacagcaacaaacccgagagtaccaaataaggaagatgttattgaaatctacaagaaattgtggaaataataagtgtaaaaagaagtaaaaaagaagctgcgtattgtagcttctttttttacactctcttttgcttctatttttaggcatatttttaaagttctcgggtaacggtacctatttattaattgagtattatctgaaagaattgttgtatatactatatcaaatacctgggaaatggacaggaagcgcgaaatgaaattacctatttatatagaagcagcaatgggagtttttctggtagtgattctggcaatggcaggaagaaacggaatgattcctcagaaccagaaaaataatgttatgaaacagtcagaagtagaacagaaatcagattctgacatgcaaaacgaaaaggaagcagttgcggaagaggcaacagattcgatagaagaagttgcacagactgacagcgcagcaataacagcacagatgtgttctccggccggacagtatccggtcatgggggagagtgttgttacggtggatgaacttgcagattatttcaatcaatcgggatacgaatatccgtcggaagaactggcaaaaggcggggcagataccatagaaacattctgccagatctactgtgaagaagcagaggcagaagacatccgggcagaggttgcatttacccaggcaatgaaagagaccggatttcttcagtttggtggagatgtaagtgttgaacagtttaatttcgccggaataggaacaaccgggggaggagtgccgggaaattcttatccggatgtcagaacaggagtgcgggcacaaatccagcatctgaaggcctatgcgacagatgaaccgctgaatcagacttgtgtggataatcgttatgaatatgtgaaaaaagcttctgcaccttatgtacaatggctgggacagaaagagaacccggaaggagccggttgggcaacaggagagaactatgggtatgatattgcagggatgttgcagcatttacttctaaaagagcaaggttaagaagatatggctggacttccggcggtggttatgatattttaagatttcttaaagaaagggaaatcccttgacaaatcagcctttgacagctatagtagtaacagttaaaaagtatttaacaactatgtaaagatacaggtgttgaagaagaggagtacatcattacttcccacagagagaaccgttcagattgctaagaggatctggctgtgagacggtttggaaaaaggatgatggaaggtagcttcggaaccggaattctgaaaggtcgaagaggctggataggagttcccggagtcgttcacgttacagaacgaagagatgtatatgtaaagaacaaggttaatacaaacagtaacaagttcttacatatataaataaggtggtaccgcgagattttcgccctttacgtgaagtagagggcgttttctagttatagaagaaagagatatccacttttaaaacaatgagattgtggaaaacaactacaaaattaacataatatgtggaaaaaggagaacaatcatgagcaaagaactcgcaaagacttacgatccgaaacagatcgaagagaaactctatgagagatggtgtgagaacaagtattttcatgctgaagtagacagaagtaagaaaccatttacaacagtaatgccgcctccgaatattacaggaaagctgcatatgggacatgcacttgacaatacactgcaggatatcctgatccgttacaagagaatggaaggatataacgcactgtggattccgggaacagaccatgcagcaatctctacagaggttaaggttacaaatcagctcaaagaagagggaatcgacaagaaagaactcggacgtgagggattccttgagagaacatggcagtggaaagaagaatatgcaggaacaatcgagaaccagctgaagaagcttggtatttcctgtgactgggacagagagcgtttcacaatggacgagggatgttccaaagctgtagaagaagtattcatcaacttatacaacaagggatatatttacaaaggttccagaatcatcaactggtgtccgaaatgtaagacatctctgtcagacgcagaggtagagcatgaggatcaggacggaaacttctggcatattaagtacccgatcgccggaacagaccgtttccttgagattgcaacaacacgtccggagacactacttggagatacagcgatcgccgttcacccggatgatgagagatacaaagatatcgtaggaaagatggcaatccttccgcttgtaaatcgtgagattccgatcgttgcagattattatgtagacaaagaattcggaacaggtgctgttaagatcacaccggcacatgacccgaacgatttcgaagtaggaaagcgtcacaaccttccggaaatcaatatcatgaacgatgatgcaacaattaacgagaagggcggaaaatatgcaggaatggatcgttacgaggcgagaaaagcaatcgtagctgatcttgatgagcagggataccttgtaaaggttgttcctcacatgcatgcagtaggaacacatgaccgttgtggtacaaccgttgagccgctgatcaaacagcagtggtttgtaaagatggatgagcttgcaaaaccggcgatcaacgcactgaagactggtgaacttcgtttcgtaccggagcgttttgacaagatttaccttcactggcttgagaacatcaaagactggtgtatctcccgtcagatctggtggggacacagaattccggcttattactgtgatgagtgcggtgaattcgtagttgcgaaagaagcgccggagaaatgcccacactgtggatgtacacatttcacacaggatgaggatacactggatacatggttctcttccgcactgtggccgttctccacacttggatggccggagaagacagaagaccttgattacttctatccgacagatgttcttgtaacaggatatgacattatcttcttctgggtaatccgtatggtattctcaggatatgagcatacaggaaaagctccgtttaacacagtactgattcacggtcttgtaagagactctcagggacgtaagatgagtaagtctcttggaaatggtatcgatccgcttgagatcatcgacaagtacggtgcagatgccctgagactgacactgatcacaggaaatgcaccaggtaacgatatgcgtttttacaacgagcgcgttgaggcaagccgtaactttgcaaacaaagtatggaatgcatccagatttatcctgatgaatatggagaagaacgttgtagaggaaccggaagacttcctgctgaagccggcagacagatggatcctttccaaggtaaacagcctgacaaaagaaatgacagagaacatggacaagttcgagcttggtatcgcagttcagaaagttcatgactttatctgggatgagttctgtgactggtatgtagagatcgcaaaatatcgtatctaccatgcggaggaagattcacagtccgcaaactgtgctctgtgggtacttaagacagttcttggacaggcacttaagctccttcatccatttatgccatttattacagaagagatctacggagcacttgtaccggaggaagagtcattgatgatgtcaagctggccggtatacagagaggattggaagttcccatatgctacagaagttattgagcatgtaaaagcaatcacacgcggaatcagaaatatgcgtgctgagatgaatgttccgaataacaaacgtacaaaggtttatattatcagcagtgattcaaaactgcttacagcacttgaagcactcaaggaatctgtaaaaccgttgatgctggcaaacgatattattcttcactatgagaagaaagatgttgctgatgatgcagtatctatcgttgttccgggagcaacagtttacctgccgctggaagaccttgtagacttcgagcaggagagagaaagactgaagaaagaggaagagagactcaacagcgagataaagagagcacagggaatgcttgcaaatgaaagattcacaagcaaagcacctgcagataaagttcaggctgagcgtgataaacttgagaaatatacaaagatgcttgagcaggtaaaagagagaatcgatagtctcagataactgtggggggagaaaagctgcgaaaaagcaggaaactgtaaacagcagtttagacacagtatcaggtattagacggcaaaaagtcgcacggcagaaaggagctaagatcccatgccgtgcattttgcctataagaaagaggttatagatgaagcggattcatattaaaaaaccagatatcaaaggattttttacaaaggtcaaaaatctgaaaccagaagatatcaagagacactatcaggagaaaaaagcaagacgccagaaaatcctggaacagagaagaaacagtaaatttgcgaaaaagatgcagccggtttataagtggatgaacagattttcactcgtccttcattatctgctggcctgtgttttgaattttttgattgaggtgatctcaaggcattccttttttgaagcatggagctacatgacaggaacaccgctcgtgtttctgtttaacgcgtttttaatttttgcaacatttatgattgtttatctgttccgcagacgtgtatttgtcagaattcttcttagtgtattctggctgtttctgggagcatgtaacggatatctgctcctgaagcgagtgacaccgttcaatgcacaggacttgaaagttctgtcagatgccttggaactgacaagtaattactttaatggctttgagatcgtgatgcttaccattggaatcgcagctgttgttttgtgggtgatttccatgtggcgccgcggtgggcagtatactggaaagatgcaccgcattattgcagtgatcgctgttgtggcatccggatttgcctatgtaggacttactgatgttgcaatcgacaagcgagtgatctcaaattattttggaaatatcgcatttgcttacgaagactatggattcccatattgcttcgcagcaagcttatttaatacaggaatcaatcagccggccggttacagtgaagagacgatggcagagatcaacaaggatggatgtcttaacgtgagtgagacaagccgttcaaaagaggaactgccgaatatcatgtttgtccagctggaatcttattttgatccgacagaggtagaatggctgagattttccgaggatccgatcccaaatctcagaaagctttatgctgactattcttccggatattttaaagttccatctgtcggagcaggtacagcgaatacagagttcgaggtgcttaccggaatgaatatgcgtttcttcggaccgggagagtatccatacaagacttatgtgaagacgacacctcttgagagtgcggcaagtgcgctttcatcccttggatatggtgcagaggcacttcacaacaacggcggtaatttctacagtcgtgccaaagtatacaacaacatgggatttgaccattatacaagtaaggaattcatgaatatcttaaagacgactccgaagggatgggcgacagacgatattcttgttccgaacatcatggagtctttggacacaacagacggaacagactttgtatgtacgatcagtgtgcagggacatggagattatccgacagagccgaccttggaaaatccggagatcaatgtaaccggagtggaagatgaaggcaagagaaatgcatgggagtactatgtaaatgaagtccatgagatggacaaattcgttggacagctgatcgatgcaatcgagcagagaggggaaccgacagtgctcgtattctacggagaccatctcccgacacttggtctggaagcaaaagacctgaaaggaaaatatctgtacaatacgaattatgttatctgggacaatattggactggaaaagaaagatgggaatatcgctgcttaccagattatggcagaagtctttgatcgtttggatattcatacaggaactattttcaattaccatcagcagagaagacagacaaagaattatcttgctgatctggaattactccagtatgatatcatgtacggaaaacagtatgtatacaaggacagtggagctccgatcacagaaggacatatggtcatgggggtaaaggatgcgacgatcaccagtgttgtggagcagctgaaaggaacttatagcatttacggagagaactttacaaaacaaagtaaagtttatatcaacggagagaagcagacaacaaaattcctgaacaatacaagactggatctgaaagagtcagaaatcaaagatggcgatcagatcatggttgcgcagtgcggttcaagcaatacaatcttccgtacatcgaagacttatgaatatacaggaggccagcttgtagaagtgacagaccaggatacggatgttgagaatggaagacaggcctttgtagaacaaaaggaagaaaagaaaaaatgacctataaggaaatcgtaacctatatagaagaaattccgagatttacaagaaagcactctctggctcataccagagagatgcttctgtttttgggaaatccgcagaatggaaagaaaatcatccatgtagcgggaacgaatggaaaaggttctgtatgcgcttatctggatgcgatgctcagggcagaagggaaaagcaccggattgtttacttcaccgcatctggtgaaaatgaatgaacggattgttctgaacggaaagcagatcagtgatgagggtttctgcgaagtatttgaagagaccatgcaggctgtccgcaggatgcaggatgcaggattggagcatccgacatttttcgaattcttatttgcaatggcgatgaaagcttatgacagagcaggaatggaatacattgtccttgagacaggacttggaggtcggctggatgcaacaagttctgtagaaccggttgcctgtgtgatcacatcgattggtctggatcatatggaatatcttggtgatacagtggaacagattgcgggagagaaagcaggaatcatccggccggaagttccggtgttctttgcacagacagcaccggaaagtgattctgtaattgaaaaaacagcagaaaaagaaggctgtttctgtaaaaaaatagggaaagatgcgtacgaaattcttggaattgaagataaacatattgcattttcctgcgcaagtgcttattatggaactaccacgtggaaattaaataatattggaacctatcagccggggaatgcactgcttgcgatggaagtgatgcgttatcttttcaaagaaaacggtcatccacaagagtggagaacagcacttgccagggtgaaatgggcaggaagaatggaagagattcttccaaaagtatacgttgacggagcacataatgtgagtgccattcaggcatttgcaagaagtgttccgaagaatccagatggaaatattattttattttcggcggtaaaagataaagaatatgaagaaatgatttcgtatctatgtaaacatgctgatgcggaagaatatgtagtaacattgatcgacggagatcgagcgacagatgcacacattctgggtgaactgttccggaaatatacagaacagccggtgacagtgattgaatctgtcaaagaggcaatgcagtatgtattgcggattcaggggagaagaacggtatattgtctcgggtctctttacctgacaggaatgatcaaagagattatacaggaatctttaagcggatgtggggaggtttgattgcagatgcttaattatgaagaagaactcaaaaaattcaagccaagtctcgaggtggaccagattgaggaagctgtttacaaggaagatctgacagatatgcaggatatcgtaaaagaggttatggcaaagaaagaaaaaacggtgagaagatagaaagatagtggtgggtataaatggattacacaaagaagatcatgtatcagtcaaattcctggtacaatgatggactgcgcaaagcccaggtgagagatatgtccggggcaattgtttccttgcaacagagcctgcagtataacagggagaatattgcggcgcggaatcttttaggtcttgtgtattatggcataggggaagtttcagaagctcttgtggagtggatcatcagtaagaatctgtgcccaagagacaatattgcagattattatattaaaaatgtacagaattcagcgaatgaattagaatcactgaatcaggcaattaagaagtttaaccagtgtctggtttactgtcaacagaacggggaagatcttgcgatcatccagttgaaacaggtgatcgcgtctcatccgacatttctgaaggcgtatcagcttctggctctgatctatatacagatgaatcagaatacaaaggcaagacagattcttatagaagcaaagaaattagatacaacaaatgaactgacactaacctatttgcaagaagttacaaaacagcgtggcagatatgggaagaatgcagagagaggtttccggaaaccaaaaagtgcgacagtagaatacagtcttggaaatgagacgatcattcagccgaaacgttctaagatccgggatatggcacagcagcttgcatttgccaatatattgatcggaatggttcttggtgctgctttgatctggtttcttgttgctccggcggtgaatcagaaccgctcggagaagttgaataatcagatgcgtgcatacagtgaacaaatcaacacactggaagcacaggtgagtgcccagacaagaacactggatcagtatcgaacagccggagacgaggcacagaaagcagttgatcaggcaaaggcaacatctgacagctatgagaaactgcttcaggtttcaagtcagagccgttccggagaatatagttatacggatatggcagacgcgctgcttgagattacaagagattctcttggagacagtggaaaagagatgtatgatacactttctgattctattttcccaacagcatgcaggagaagatatgcagccggtgtagattcactggaatcagaggactatgatcaggcgattgagtacctgacaaaggttgtgaagatggacgaaagttataatgatggacaggctatttatcgtctggcacaggcttatcagggaaaaggtgatacagagaatgcaaagacctggtatcagaagatggtagatacttataataattccagatatattgaggatgcgaaaaagcagcttgcaattctgaatggagatgccagtgcagatacaagttcagatacaagtgcagatagtagttcagatacaagttcagatacaagttcagatagtagttcagtatcagaggactcagaaaattccgatgactccaatagctatgataattctcaggataatggagattacgataattctgacaatacagaggatgacgaataagattacgaaggaaaaggatatgcgaagaagcatatccttttttagcgtacggattcaggtaattaaacggaaaatgagaaaagcaggaggcatgaaaatatatgagatatcaggtacaggaaaattgtctgacgatctatcttccaagagaggtagaccatcataatgcagatgaaatcaggaaagaagcggatgcagtgatcagcagaaatcatatcagatatgtgatctttgactttgacaggacagattttatggatagttcaggaattggaatcattatggggaggtataagaccgtcagtctgatcggaggagaagtctgggcggtacatacgaacgaaagaatccggaagattcttacattttcaggagcagcaaagattatgcagatttatgagggggaaaagtgatggaggcgagtaatacacagaataatgagatggagatctgctttgacagcagatcagaaaatgagggatttgccagagtatcggtagcatcctttttaacacaacttaatccaacggtggaagaagtagcagatgtgaagactgcagtgtcagaagctgtaacaaatgcgattatccacggatatgaacagagagtagagaaagtaaagatacattgtagtatagaaaaccagctttttacagtagaaatatcggaccgtggaaaaggtattgcaaatgtggaaaaagcaatggaaccgatgtttacaacaaaaccggaggatgatcggtcaggaatgggattttcttttatggaagcatttatggatactgtggaagtagagtcaaaggtaggggaaggaaccagtgtaaaaatgactaagacaataggtaaagggagcagaatatggacgacacaatcgctttaatcagaaagtcacacgacggagataaaaaagcgagagaagaacttgttgaaaaaaatataggtcttatctggtgcgtagtaaagcgattttacggaagaggtgcagaaccggaagacttgtttcagattggaagcattggactgcttaaggcaattgataaatttgatttttcttatgaagtacagttttcaacctatgctgttccaatgatatccggagaaatccggcgttttttgagagatgacggaatgataaaagtcagccgttcattgagagagctgtcctataagagtcttcaggcgagagaaaagatgaccaggatactcgggagagaaccgacattgaaagagttatcagaagagcttcagatagattgtgaggagatcgtccaggcaatggagtcgtcagtggaggtggaatccatatataagccgatccatcagaaagagggaagcgagatccttctgatggataagctggaagaaaaagacaggcaggaagaaaaggtgcttgatcggattgtattaaaagaagtactggaaacacttgaagcgaaggaacggacgatcatttatctgagatattttgcaggaaagacgcaggctgagataggaaagaaaatgggaatgtctcaggtgcaggtgtcaaggacagaaaaaaaggtgctggagcggatgcggaaagaaatgaagcggtagagtttaccatcttttccaaaaaaacaatcccgctccgattcctttccctaatgcaaccattatcacaaacaccgcgagataccggacaatccttgcccgtctcataaaaatgggaaatacattcaaaatttctgcaagtgccattgcccagcaaccaacaaaaatccctccgaaaagtccataaattgcaagaaatatcatccttccaggaagattaacttcaaaaatctgaaacaagtttccaaggatcgcaccggctgctaccatatcttcataaattaaaatatgattgccggtatgggtacgatctgcaaaatctgagatcacaccaagttccacaatgaaagaaaagacaccgccagctactatcattccggcacttaaaccaagcaatgccaggaaaattatctgcaacaagttcatttttcgacctccagttctttcttttgccgtgctgcattttccaccagagttgtctggatatcattttcataaagacgcatctgtatttccatcggtgtaggatctactgtaaagcgtttcttaccaaagtgattaaaaaatatcagaattccgattgcaagccctatggaatacatgacttccagaacagaaaaaccatctgtcttctttcccatgatcagttcataaatctgaccaaacagcttcgttaccccaacatcattattgaatgccatgatcgagaaggcagatccaaagaaaatcactgctgataccagcactacctttaaaatgtgccagagaagaggtggtgttttctggttttcataagtaacgataatatctgtttcgcccagattctgaatctccagccggggatactgttcatgaatacaggcaatgattttcaacacggaaattacatagcgctgttctttttcctcccggatcttcaagatccgcaaagtttttactttcatcaggatggtcttgtctgaacactccatattcaggatatctcctaacatgacattttgctttgatacctcaacattcctgtctgctttgagataaagggttgctgattcagatgccatggacgatcacctccactttcttatccggagcagaatatttgttactgttcacacgatgtgcgaccagcaacgcatctcgccattttaaatcgcgattaaaagtagaaaaatttgaaattcgtaaaggtatgcgaatgcattgtgttgtgagacaacctatgggaaaggcgataggaaatgaaagataagtatcttagggaaacacgaatggttgatttttctaatccggcaattcaaaatcttattcaaaatatgaattggaaggaaatgggtgaatttgaaaggattaaggcaatatacaactatgtaagagatgatattttatttggatataatattgatgatggaatttcagcttcaaaagtacttgcagatggttatggacaatgtaatacaaaaggaactttatttatggcacttttacgtgcctgcaatattccatgcagagtacatggttttacgattgataaaagattgcagaaaggggctatgacagggtttgtttaccgtaatgctccaaaaagtattttccatagctgggtagaaattaattttgaaaatcagtggtacgaactggaagctttcattttggataaaacctatataaagaagttacaggaacgaaatccggaatgtaaaggtgcattttgcggttatggagtagcagtcaaggatttcagaaatctcagtattgaatttgataggaacaatacttatattcagagcgagggaatcaatcaggattttggtgtttatgattgtccagatgaactgttgaaggaacatcatcaagaaatttcagtctttaaagcatttgcttatagacatattggaagacacctcatgaatcgtaatgtcaggaagattagagaacgatagttttaagcttttagaattaaaattaaattcggagggtaatatggcagacaaaatacaaaatgcttatgaaacatcaaaaaatatatatgacgatgttcttacgcaaagaaatattttcagcaaactgtatattaagttattttggagtggcactgatgataatgatatagcacgaaaagttttatcatatgttcctgatgactttttaggaaatcttcttgatgttccggttggaactgctgtatttacggaaaacaaatggagttctctgaaaaatgcacatattacttgtattgattacagcatggatatgcttgaacaagccagaaaaagacttggtagtcatgcacatatcaaatgtattcagggtgatgtgggaaatctgcaaatggagaatgaatctgttgatactgttgtcagtatgaatggttttcatgcatttcctgacaagcaaaaagcatttcatgaaatatggcgtgttttgaaaccaggcggcaattttattgcctgcttttatatcaggggaaaatcgaaacggacagactggctggtaaaaaatattcttgcaaagaaagggtggttttctccaccatttcagacggagaaagagctgagagatatccttcaaaaactatataaagaaacggatatccatgttgacggttctatggtatatttccgttgtgtgaagtaatgcaatgatgctggatttataataaagtttcagataataagtctggaactttatttttgtctaaatggattattgctgtccgttcaggtctggataatgctcgattctcatgttaagataatagaaaaggttagataaaactaacacaaagaaataccactatgtgaaaggagaagaaatttgaatataaatgaaattgcaagacttggaagtaatgtgaagcctgtgattcagaatgagaattgctctgttcttatgttaaatgatgcgacaggagagggcgttatgacggtttaccgagtaatgccaggtgtgatgatttgtttttcagacatgcacatggaacagtgcgcatctgaatttgaattgaagaatgacagaaaaatattctgtattgaccattgccgggagggaagaattgagatggaggtaaagccaggcgtgttcagcattatgcaggaaaatgaacttcgtctggataacagagagaatcataaagggacaacttattatccgctgaagcattatcacggagtcagtattttcatggaagttgcggaagttcagaaggtacttgatgaattgtatcatggattttccgtttccattgagaaacttcgaagccggtattgtgccgaagagaaaccttatgtaattcgaggagataaggaatttgagtcaattctttcagggttttaccagaaaaacatggcacatccggaacttgcaaaagcaaaagaatattatcagataaaagtcgtggaattattgttgtacttaaacacgatgaccgtagaagacaggaaagaagtcagaccatattattacaaaactcagatggaaaaaatcaaagggattcatgcgcagatcacagggaatcctcagacacggtttaccatcgaagaactttcctctatgtatgagattccactgacaactatgaaaaaatgcttcaaagatgtttatggagattctatttattcttatcagaagaggtaccgcatgaatctggctgcaaatatgctgttacaggataaagagaaagaagtacaggagatcgccgcaagtgtaggatatgaaaatccgggaaaattttcatctgcatttcgaagtgtgatggggctgtctccggcagagtaccgattcagaaaggaaacatatgatggaaaataaaaaagtatcagaaaaaaaggacagctggctgaaagtgttgctgagctataccgaaggaagcgggcaaaggcttggaatatccgttattttatctgttatcagtattatcagtggacttatgccatattattgcatttaccgtggaatcgatttgtatataagaaacctgaatcaggctcctatgcaggaaattctaagatggtgtctgtatgccttactcttttatattataaaaatcgtaagcttttccgcatccacatggatatcacatatagcagcctatcacatattggagggtttaaggctccgcctgacagaccgatttctgaaagcaccattaggagatgtagaagggcacagtattggtgaaatcaagagcatcatggtagaaaaaattgaaaatatggaaccacccattgctcatatgattccggaaggaagcggacatatcctgcttccggtaatcagctttatcgctttgcttacgctggactggagaattgcactggcttctcttgtaaccgttccattgtctttggtatttatgacacttaccatgattatcagcggaaaaagtttcactcagtacgacgaatccaatgcacatatgaacagtactattgtggaatacatagagggcatagaggttattaaggcatttggcagggcaggaacctcttatgagaaatatgcaaaagcaattctggattataagaaattcgttgtgaaatggctgtcttccacctggatcaccatgaaaatgacattcgccctgtttccatcgacactgcttggaactttgcctgtgggactgtatctgacgatgcatggtcagttgaccatatcacagcttgtgctggcagtcatgctgtccatgtccatggtgacatcttttgcaaaaatagaggtattctctgaaaatcttcgtgaaatgcaatataacatcgaaagaatacaggattttcttacgatgaaagaattgccggagccttctgtatatgcaaatatcaacagctatgatgtgaaactggaaaatgtgcatttctcttataccggtgaggaaaaggacgaagtgctgcatggaattgacctgacaatgccagcaggaagttttaccgcattggtcggactgagcggtggtggtaaatccacggtagcaaggttgatctcaagattctgggatgtgacatcaggaagtattaccataggcggtgtaaatattagggaaattccattgtcacagctttcagaaatgattagttttgtgacacaggataatttcctgttccggtgttccattctggaaaatatacgtctcggcaatccgactgcatcggatgaagaggtgcgggaagcggcaaaaaaggcatgctgccaggagtttatagagaagctgccgcagggctatgataccccggcaggggaagcaggaaaacggttatccggtggagaaaagcagaggattgccattgccagaatgatattaaaaaatgcaccaatcatcattcttgacgaagcaactgcatttacggatccggaaaatgaaaacaagatccagaagagcattgaagaactgacaaaaggcaagacattgctggtcattgcacacagactttccacaatcacatatgcagacaaaatcgttgttttgaaaaatggctgtatagaaggggcgggaacccaggaagagttgcttcagaattgtcagctttatcagcgaatgtggcaggctcatgtgggagcaagacactgggcagtgggaagtcagaaagaaggtgaagactcatgtttggcactgtaaaaagaatcattgactggtgtggcagttttaaaaagaatctgtatattggttttgttttttcctttttttcaggctggtttgcggcaatgccggtcatatgggctgcatatataatcgggaagcttgtagaatgcgaaggacagggaaatgctgtctcaacggtttggattggaaaaagtatcgtgattctgttgttctttgtttttctgcgctttctgtttgattatctgagagcaagatttcaggagtcgatcagttatgaattaattgccagggacagacttgcagtgggagatgcactgaaacgtgtatctttaggatattttcagaacatgaatacaggcacgattctcaattctattactacaggtcttcatacgctggaaggaatgggaatccgtatgattgataactttgtgggaggttatctgaattttatctgcatccttttgtggctcacctgtatgaactggagggtagggctgattgcagtgacgggtgccgctgtttccctgatattcctgttcatcatttcaaaatacagtacaagaaatacaccaatccttgctgcggcaaacagggatctgaccggagcaaccctggaatatgccagaggactttctgtagtgaaatcctttggaaaagcaggagcttctatggagtcaatgaaaaaagcatgcagggacagtcgtgacattaatctgaaaatagaatggggatatattccttataatgcactgcatttgatggcgttaaagacagcaagtgtgtgtatcgtaatcgctgcgttttacctgggattttccggacagctggattttacttatatgatgattatcattctgttgtcatttcatgtgtttggttctttggagccgattgcagactgcgcccatgtattggctgtcattgatgatgccctggatcatttggatgaattgacaaaagagtccttcattgatgcagatggacagcagatagagattgcacactatgatatcgaatttcagaatatagatttttcttacggagaagggagggaaagaagacaggtgcttcataatgtgaatctgaaaattccggagtattcagttacagcaatcgttggtccttccggaagcggaaaatctacgatctgcaatctgattgcccggttttatgatgcagacagtggaagtgttcgtgtggggggacatgatgtgaaagaatttacctgtgacagtctgttatccaacatttccatggtatttcagaatgtatatttgtttcatgatacagtgaggaataatatttgtttcggaaaaccggatgcgacagaggtagaaatggtcgaagcggcaaagaaagcatgttgtcatgatttcattatggcattaccggaaggctacgacactgtcatcggagaaggcggagggagcctgtccggcggagaaaaacagcgcatttccatcgcaagagcgattctaaaagatgcaccaattatcatactggatgaagcaacagccagtgtagacccggaaaatgaacatctgattcaggcggccatatcggaacttaccaagggaaaaaccattgtgacaattgcacacagactggcaacgattgaacaggcagaccagattctggtggtagataatgggcagattgttcagagaggaacccacagagatcttgtggctattcctggaaaatacaaggattttgtagatatcagaagccagtcggaaggctggaaaatcggctaaggaggaacgaaaaacatggaagaatcaagaaaactatcaggaaaggatcttattacaataggaatcttctctgcaatttattttgtgctcaatctggcagctatgattactggatttgtgccagtgttatggctgctgttaccgggcgtgacaggaattgtgaccggaattccattcctgcttatggcatctaaagtgagaaaaccaggggcagtacttattatgggaacaattactgcattgctttattttgtgactggtcagtttacagtattgttactgattacatttgccattgcatgtatattgtcagaactgtacagagctgtgacaaagtatgataacagttttacacatatgatgatatcgtttgtgtttttttgttatggaatgcttggctcgccactggcaatatgggtgtataaagacagttttctggcgcagattcagcaaaatggaatgtctgcagaatatgtccggtctttatcgggattgatttctacgccaatgctgattatactttgtatctctccagtcataggaggcgtgattggagcgttgattgctaaaggtttattccgtaagcattttaagaaagcagggattgtctgatgaataagataacagtcatcaatcatcttgatccaagagctgggctgtggctgcttttaatggcaaatattggtatgttctgtcagaaaaattctgagcaggggagtatgctttcaggcatatttctcctgcttatgctggtgcatggactatataaggcggcaggtaaaggtatcgttttacttgtttctttccaccttttactaatgtatgtatttccgcagtgccccgcatggatgaatatggtgtttccagttttagttaattattcattgcgtatgctgccatgttttttggcaggtttgttgctgcttcgaacatcgtccatgcagaaaatgatcgctgccatgtatacactgcatctaccacaaggatttatcatagcaatgtctacgacacttcgatattttccagctttgaaagaggagttcgtacatataaatgctgctatgaaacttcagaatatctcatgggcatcccgcttggagtgtacggtagttccattgatcgtgtctgcagtcaatacatcggatgaaatagcagcggcggcagtggcaagaggaatcgagaatccaggaaaaaagactagtgaaataacacttcacatgggaatttcagactggttgataatgattttggtaacatttggaatacttatagtggtgattgcaggataaagaaaatgataaagtttgaaaatgtaaatgtaacaatgcaaggaaaaagaattctgtcagatataaatctggagatacaggatggggagttcgtattgatatgcggggaaagtggatgtggaaaaaccacaatgacaaaactgattaatggattgattccgcattttgtgagggatgtcagcgtagatggaacgattacggtttgcgggaaaaatgttgcagagatgcctatgtatgagattgcagagcttgtagggtctgtttttcagaatccaaaaactcagtttttttatacgaattctaatgctgagatggcatttggcctggaaaacagaggcgtggaaccggaatatatacgaaaaagaattaagaatacaataaatgaattagatatagagaagctggaagaccgggatgtattttccatgtcaggtggtgagaaacagcttcttgcgtttgcatcagtatatgccatgaatccgcagatttatgtgctggatgagccgtcagcgaatttggatatagcagcgatggaaaagctgagtgaaagaatgaaggtaattaaggagaagggacatactgtagttgtggcagagcatcgtctggcatggatccagaaattcgcagacagaattatttatatgaaagaaggacgtatagaacaagaatttacatcagatgagtttaaggctttgtctgatctgaaacgaaaacaaatggggctcagaagtatcgttcctgaacagatacagattccggagattacaggaaactcagaagacgcagtacttcagatttgtaacctttcatgtaagagaaagaaacagatgatttttcagaatattagcttatctgcaagagcgggagacatcatcggtatcacagggaaaaacggtgccggaaaatctactttttgcaattgcttgtgcggtctgcttaagcccaaaggcggcgagattctgtatcaagggaaaaagctgtcggaaaaggcccggaccaaactgttcgggatggtcatgcaggaagtcaatcatcagttgttttcagatagtgtgaaaaatgaatgtctgcttgcaaatgaagaagcctctgaacaagaaatcagggaattacttgaaaaatttgacttggaagagtatgcagaatatcatccgatgatattatctggtggacagagacagaggcttgctatttgccaggcagttatgggtgaaaaaaagctgcttattttcgatgaacctaccagtgggttggattttaggcacatgtgtcaggtggaaaaattgatgaaacaattgtcagaagaaaaatatattattatagttgtaacacatgactatgagtttttgaatcgagcttgtaagaggtatattagaataaatagttaacttttaggaaaggaaaacggattaaaggaagaaattatccattcatgaacggcttgagattaataagaggattattcaagaaaagcagggaaaagataagccggagagaggggctgatttgagtgtaaggacggtgtagtataaaatagaatggagtcggaggtcacggataacaatgtggctcccggcttttttgttttgaatgatttgtgcttcaaagttatgtgaaaagcgtgacatcagcgactgtaggttacacatccgaaacattatgatttatgtatgcggccagtgcaagacggtggtttaggaatgaagcgtgtcttagaatatatggaaattccatttgaaacatgggaatctgtaggacagatgcggatggaatttgacaaagaaggggaaatgaaaacagcgtgatataaaatagaaaaaaattatcttgagacatcggtatgcgccgatgtctttttgttttggtaaaaatgctgaattatctaccacgaaagtatacaaagcctacaaagatgtatctttgttcaaaaagactatatatgggcgaccttttacgggcaatttatatagaatagagaaaagttatgaaaaatcatggatatgaaaacagcagttatatattgtcttgaagaattgataaggcaaaaggatattaccgtgaatgaggcggcgatacgttctggtgttccgccatcaacgctgaagaatattttgtatgggcagagtaagaatgtaggcgtagttacaatcaagaaattgtgtgatggattagaaatcacaataccagaattttttggagattccatctttgcagagttggaaccggagttatagaagtaagagataatctcatggcaaaattctgcgggatggtttttttatgaaataaggttagctgtaactaacaatgagggaggattatgtataagatagcgatttgtgatgatgataaaagatatagaaaaacgatcagagagattatagagcatgaaaatagtttgcctgaaaatgaaatcagattttatgaatacgaatcaggaaatgaacttttgaaacatacggatattctccacgaattagtctttatagatatccgtatgccggggctggatggaaaccaaacagcattaaaattgagaaattataacaaagatgcagttttaatcttctattccagttattttgagccgacagtggacagtataaatttcggacagccctttcggtatattatgaaggacttacacgataccagcttacgccgggaaattgcagctattatgactgaggtaaagagacgctttctgaatgactatgcggtaacggtgacatcggcggggaagataatacgcatacacgtggaaaatatcttatatgtttccagagccaaaagaggatgtgagataaccattgtgaaagagcaagaaaaggagacagttcggtgcagagaagcgtttggagaattatgtgaacagctaaaagatgcctcaattgaactcttaaacaaaaaaattgttcctggaatttactatgcaacggatattattgagggagacattgttttaggtgatttaccgaaattgaacatagacttaaatataagtgaatatgtgatgcaggaggaatcattcgatgacgaatttgaagaagggactatttgaattacatataattggagatccgagcaagaaaaaagtattattgattcatggtatgggttttcaatggaaattctgttttaaaaaagtaatagaagaactcaagagaaactattgccttattctgccggaactgggaggccataatatgcagggcttgggcggattctcgaatgtttatgaatgtgccgatgaaatcattacatctatacggaatcatagaatagaggagctggattgtatttatggtatttcattaggggctagcattgcgatagaaatcgcattgagagattgtattaggataaataaattaattctcgatggcgggcaatttgaatccatgggtattatgaaaaaaatagatgcatactttatggcaaaggaatttcaaaaagtaattcaaaagaaaagaatgtggtcatatgttagcaaacaaatgggttacagaaatggtaatgaaatagaggtactttatcctttgtgttgcaaaagaatacaatttgatacattatatgatgcggcattggcagcttatggatacgacataaaaaaaagaatggagaaattacgaatgaaagttgttataatgtatggtgaaaatgagctttttgctgcaaaatcagtttcgcttgttaaagaaaaatgcgtttctgagtgcgaagtttatgcctatgataatatggggcattctgaggttttaagtttgcatccagagaaactatgtgaaattattcgaaaataaaaatcaatatcaaagttgaagttgcatttttattgtttcctatattatactaataaggacaagtaagttacaactaattaaaggaatggggtatcaacatgaaaaatagttggtatggagaaaatgttgcttcagtaaaaaaacgccaagaatataatttaattaattatcaatgtaatggaactggtattcttatggcatatgcgttgtttccaggcattgatttgatttttatggattttaactgctcagatacttttcatgagcctattcctaataaaaatatcattgaaatccgtcattaccaaaaaggacgcgttgagtttgagctaagaaataataaagttttccacatgaaagagggagaattttgcatcaatgcccttgctaatattcctgcggcctattcctttccctttggatatagtgtaggactaagctgtgtgattgataaagattctgtcgatgtggaaacacaacagattttttcgtactacaacattgatgttctaaatctcggacgagaattggaattagaaaaaaagtggtttttatgtcgtacaccacagcggttgttacatatctttgaagaattgtatgctgcaaaaggtgttgaagagcgagattatttccgtatcaaattattggaactattttaccatatcaaacagctgcggattgaagatcagtatgaggcaacgtattatgccaaagaacaaattgaaatcatcaaacgcatccgccaacagctcatagaaaacctcgacaaaaaaatatccatagaagaacttttgcgaaaggagccaatgagcaaggtcacatttcaagctattttcaaacagatttatagcgatacgccctatgcacatatcaaaaagtataaaatgaatcttgcggctgtttatttgcaggaaacagaccaatcaatcacgcaaatagccggtgaacttggatattcaaatattagtaaatttgcgcgagcctttcaagaagtgtttggaatgcttccaaaggattaccgtaaagcaaaaaaagtgatttaacttttgggctgttttcttgatttacttttccctttggagtagttagagactgcaaaccggtgtaaaatgacagcgtagttagatattgctaactacactgtcattttattttaaggaggtttcaaaaatggaacaaacggtaaagaaaaaaattggcgttcgagatattatgacgattgccgcaatgatggtcatcaattttgcaattgcaatggtgattggtatggttacattgcctttcccagcagtatatttatacggctctgctggtattgatgcctttattggagcaacattttatttggttgcggcaaatcgcattaacaaacacggattgttgtttgcttgggctacggtttatggactaatccaaggtgttatgggttatatgttcttggttccctatttcttgattgtagccctcattgccgagttatgcatggttggcaagaatacataccgaagtgcagttcgcaaccgaattggctggatggtcaactcaatcggaaattttgtaggctgtgccgtaccgctgtggtggtcttgggacagctatcaggaaatggcagcaagtagtggctttgatgcaaatactttgaatatgcagttttctatggtaacttctccagcactgatgcttctgggtgttgtcattactgcggttcttgcaattcttggtacattgtttggccagcgcctgctcagaaagcatttccaaaaagctggcattgtaggatgatggccggagaaaaaaagcaaaggcggattgaccggattgacgggcgcacagttctttttctgactctgtgcgcctgccttgtgactttcttgacgacaagcttttggggacatgggatttttaccttttgcatttttttaattctgtgctggtttggcttgtataaacaggcgttggggtgctttgcggtctatttggtggcgattgtatggctgatgatcgagacaaagtatcaaatcagcatcccctctccgctgttactcagtatgatttacaagctgttactgcccgctatgccagcctatcttctggcgaaaatcccgtccgggaagctgacagccagcttgaggaaaatgccgatccccacccgtatcatgcttgttttgatcgtcatgctccgctttgctccgactgtgctgcatgaatttggagaagtcagggaagccatgaaaatccgtggcttcttaaaatcggttggcaatgttttgaggcatccaatggacacattggaatacgccattgttccgatggtgttccgctccttaaagatcgcggacgagttagccgcttctgccattgtcaggggaattgaaagcccctacaagaaagaaagctactatgtcagccggatcgctgcgctggattactttttgattgttgtcagcgtgggagctgccgtgtgctgctgtcttttataggaggaatggaatgggaaaagaaattatgatccgtgacctgaccttttcctatggcgggaacggaaatcaactggaacatatatcgttagacattgccgccggggaggtcattgttatgaccggcccatcaggaagtgggaaaagctctttgacgagagtgattaacggcctgatcccctacttttacgagggggaattgagcggcgaggtttttgtggacggaaaaccgctgaaaaagattccatcctgggagcgcggcaaaatcgcgggaaatgtttttcaagaccccaggagccagttttttgccaatgaggtagctggtgagattgctttcggctgtgagaactatgggtattcccatgaggacattcagaaccatgttcaccgggcagcggcagacatcaaaattcaggacattctggatcacagtctgcacagcctgtcttatgggatgcgccagaaagttgcgattgcatcggcagaggcgattgacccggaaatctatgtcatggatgaaccttctgccaatctggatattgcatctacttatcgctttgcggacattatccgcgatttgaaacagcagggaaaaaccattatcatagcagaacaccggctttattatctgatggatctggcagaccgcttcctgtgtgtgcagaaaggaaaaattgtgcgggaatttaccgcaccgcagatgaaggctctaactaatcagaaaatccagacattggggcttcgaactcctgacctgcatcagattgagtatatggaaatcccgtctgcggcaaccagcgaggttgtcctggaagtgaaaaagctaaaccactcttttggtgaaacaattgtagctaaggatatagactttcaatgccgtaagggagaagtgattgccctgatcggccccaacgggacgggcaaaagcaccatagggcgaatcttggcagggcttttgaaagagaaatccggcgaagtcgttttattcggaaagcattgcagacccaaagaccgcttgggaaaggtctggtacattccccaagatttagacagccagcttttcggtgaaaacttgctggatgaactgaccactggagcagaagtcactcccgaacgaaaaaaagaagccgaagaaattttgggagctttggaactgacaccgtttattaaacagcatccttccacactatcaggcggacagaagcagagactggctcttggcgtagctttgatgcacaaagcaccaattattgtgctggacgaaccgacaagcggattggatggtacgaatatgcgaaatgtcagcaggatgatccgcaaactggcgaagatggggcgcaccattatcgtcattacccatgacgcggagtgtgcgcttgcctgctgcgagcgggcaatacgccttgaaaacggctgcattaccgatgattttcaaatcagaggatcagagcttcttttagaaaaaattgggtataatcagagttccataagcggtttataaaatcataaaaagtaccaacaccgggagtattaccgggttcaaatccgctgagaatggcataaagaggattcattttaagctgggtagcccattctgtcagcgaagtaactttaaagtcaatggaaagcaggtaagaacgctgcatacaggaaggagttcttggtgttggaccgaatttagaatatttatcagccataaaagtatcggtaaaagataaatcgagattccagaaacgctcgataatatcccatgtagagcgggcaagagcgtcaggatcaggataatatttacgaaaattagtaacaacaaaatgttggtagtcggcatgactgccacagttaacaggtaacataaaaaatcgcctccaatcgaaaaatatctgccgccgcaagcgacggttcttattgatcaataggcgcggagcgccgcatttttcgatgaagttgtcaattgtttttggcaaaaaaagtgggtgattttaataaaaaaggaatctgaaggccttgtatttactgacttagagattccgagagattattataaccaaaaggaggggtagaaatggcacagcaaaataagagtcagtcgaaggttaaaaccggactggcacgctgcctagaattggcttcaggccataaaggacttgtgtttctatcaggtgttttggctgcgctggccgcaatttgttcttttgtaccttatttatcaatttattacatcattcgggaaatcctgtttgtttacccggatatgtcgctcttgaatgtttctacaatctcaacttggggctggcttgccttggctggtattttggggaacatcgtattttacttttttgctctattgtgttcacacattgcagcgtttggaacactttatgaattgaaggtagcctttgccgaccacatcatgcatattccccttgggtatcatttgaccttgggaagtggcaagctgagaaaaatcatggacgaaaacattgaaagcgttgagaaatttattgctcaccagctcccggattttgtcgcctctttggttgcgccgcttgttctggtcattattcttcttgggattgactggcggtatggtatcgtttgtctggtcggtattgttctggccttcatcgttcagtttgcgggcttcaacggcgaagcaaagggaaaaatgcaccgttttcagaccgcccaggagaacatgaacagcgcctctgtggaatatgtgcgcggtatgccggagatcaaagcatttaatcagaccgcagattcttttaagcggttgagtaaatccattacggactatacctctttcgtgctggagtacgcattgggctggcaaaactgtatgcctgcatttaccacaatcatcaataatatttatctatttttaatcccggtgggtgttttgattgggatgcacactacggatttcagagagtattctttgacattcattttctacctgattattgtccatgcgatttccggtatcctgaataagattatgtatatctcggagtcctttacgcagattgacggcagtgtagagcgcatggatgaaatcttgcgcatcccggtactgccggaaaagaatacctcggctgatatacaaaactatgacattgcttttcaagatgtcagcttttcctatgaagccgattcccaggtcaaggccttggctcacatctctttccttgcgcctcagggcaaggtaacagctgttgtcggtccttccggtggcggtaaaagtaccatagccaacctgatctcccgattttatgatgtgacggacggaagtattcaaatcggcggcgttgacattcgggatattccgttggatacgctgatggataaggtcagctttgtatttcaggatacattcctctttaagcagagcatcatggataacatccgcatgggaaatccagatgctacagaggaacaggtgattgcggcggcaaaagcggcaagatgccacgaatttatcgagcagcttccaaacggttatcagactgtgattggaagcactggcgttcatctctccggtggtgaacgccagaggattgccattgcaagagctatcgtaaaagatgctcccatcattgtgctggacgaggcaactgcattcagcgacccggaaaatgagtacctgattcaaaaagcctttgaaaagctaatccagaataaaacggttgtaatgattgcccatcgtctgtccacgattcgcaacgctgaccagatacttgtcatggaaaaaggacacctgattgaatccggcacccatgacgagttgctgaagatgggtggaaaatacgcgcagatgtggagcagctatacggagtcgatcaactggaaaattagcacaggaaaggcggtgtgatctatgagtaagctgaaagaaaagctaatgctgtcggagaaaggctactccgacctgaaaaaagcgattacagcctgcacaataaccaatattgcgctactgcttccttcaatggtagcctgcttgctcttttgggagctgctgaaaccgtttacaggagaaacaatttcgtgggtcgcactgtggaagctgctgggcttgggagtgattgcggctatcctagtatttctggccgcgaaaaacgattacaggaaaacctatattgcctcctataaggaggccagcacgaccagacttcggattgcagaacatcttcgcaagctccccatgagtttctttaacacgaaagatttatccgatattaccacaaacatgatggctgattgcagcagcatggaatccatgctaagcagtactattccgccgctgattgcgaatattatctccgttaccctgacctgtatctgtctggcattttttgactggagaatggcccttgcgattttctgcacgatgccggttacattcctcatcatctggtgcggacgcaaactgcaactccgtctgtttgacaaacaggtagatgtgaaattggaggcgtccagccagattcaggaatacctggagggtatcaagatcatcaaatcctgcggtcttagtggttcccgtttctctacgctggataaagcactccaagccatgagaaaaatcgccattaaggtagaactggcctccggtgttctggttcagggagccagcctgatcctgcaagcgggacttggcatcactattttcattggaacagtgctgataaccggcggtgagattgagctgcttcctttgttggtactgctcatgttctccacgaagatttacgggccgatccttgccattctttcgcagttgacttctctgttccacttgggaacagtcaccaaccgtatgcgtactctgctgaccacaccagctatggagggcgaggataaagatgtatccaagtacgacattgaactgaaaagtgtcactttcggatataaccgtgacgatgttatcaaggatgtgtctttctctattcctgctggcagtataacagccctggtagggccttctggaagcggaaagagtacgatttccaaattgattgcccgcttttgggatataagaaagggtcagattaccattggtggtatggatgtcaaaaccattgagccagaacacctgatgcgctgtatgtcctttgtatttcaggatgtgaccctgttcaacgatactgtttttaataatatctgcgtaggtaacatgaacgctaccgaggaacaggttatggcggcggcaaaggccgcgtactgtgacgaatttatccagcgattgccggacggttatcagactgtcctcggagaaaacggcagtactctttccggcggtgagcgtcagcggatttctattgcccgcgcgttattgaaagatgctccgattattcttcttgatgaagccaccgcatcccttgatccggaaaatgagattttaatccaacgggctattgcaaagttggtggaaggaaagacggtcattatgattgctcatcggcttcgtacggtggtggatgctgatcagattatcgttttggaagatggcaaactggccgagctggggacacataaagaattgatggaaaagaaagggctgtacgaaaagttgtatcatattcaacaagaaagtctaggatgggctatttaactctatcaggaaggtacagggctatttagaaagaataagacctccgttttggcaggaggttatgctcctgctaaaacatgagagtagtaataagccaaatataattaacctgaattattcatggagcaatttctaacctaaaacttgcaccatgaattgaaaaaatgatccatgcagccataacttctctcaattcgtcagaaaaagggcataaaatccctatgacgagttttggagcaattatcaggctgtcaaggttcgttgacagttgctattccagctgtacactcagcttacctatgcataggaattatcgggtattttgacatggcaaaataagtatgaagattataaatatagagtgtatggaatcaatcaaattcatatgctctttttcttttttgattgaaataagtatgcgtggactacttttaggtgcgagtgtgatagggtagcgcaagaatagattagatggaaaggaagaggcaccgttaagtaggtacctcttctttttaaagagctagctcttttcctgatacgggaacttgcatctctggagcattaagcagtgatgtgaaattctgccgaatgatatcaagtgtcttttgctttttctgcagctcctgtttttctcggatggtagcagcctgttcagattcaagattttcaatttgcttctggattttattagaacttgggattttggtgacaccgagatcctgaagctctttttttagtgaatcgtggagctggtattctgcctgatgcttggtacggtaatcttttggatttttagcaaatttgcaatcctcaatcacttttcggcagagccggtaagaatcgcagtgtttctgaatgactttctgcgtgttcagatcactgttgatttgtgctattttttggtcggcaactttcacagaaacttcaatgtcagatacatgctgcttgaaatcctcataattcaacaggttattttcggaaagatagttaaaggtgcgggctgcctctttcagattattgagctttgcccatcgttcaaatccttctcgattgccggtcgtaacataagtggaaatattgatatacaggcgagcttctctggacagatgcttcggagttttcactttgttacgatttttagctaggcggatgcggatattttcttctgaataatagcttccgagagatttcatataagtgaaattcttctgctccggtgcacggaaggacaggtgttttccttggcggacttcatatccggctaactgcattttttgtagaaattcctcatagttgatggaagtccagattgccttatcaactgcaacacgtagtttggctttccaactcgtgccacgatgatattccatgttctctttatagcttttacctttttctccggttggcatactggtggcaagtccattttcatggcagatacgattactgatccggcagattttatggtagctccgcttattcgaaacatatttgtgatgattaacaaaacttgctgcattaaagatgatgtggttatgaatgtggtttttgtcaacatgggtactaatcacgtattcatattttcctttcagtacttcgtctgcaaattgttgtcctaagcgatgggcagtttcggcatcaacttctccaggtttaaatgactggatcagatgaaatgccaggttatcgcctttgtccattccattcttttttgccagttctcttgtcatagaaaattcaagatctgcagtttccggggaacagccaaaactggagactaacagtttttcatctgttttatctggattcgtgatgtagtccagagctttcttgtctgttactttaattgggaagatcttaagatacgccataattctttcaccatctctttcaattcttgcatttcttccggatacagatctccggtgctgtttacttttttggcaatctgattaatattcacaccaatcttatgcatttcttcatattgtttttttaatggagtggtatcggtgttgacgatgtaaccgtcaattgccattttacgaagataagctcccatgttttttgtctttgattctatcatttttctgcggataagcttacgttcttcttcggtgacatagaaatggatttctttgtttctctttctttcagccattggcgggttctcctttctgagagggcagttgtatcgttgctttcagcgtttttcaatttagggcagggtaccctaaattgggattttccggaagtgtatcctcacttcctgtccttgctgttttacccctctattagttaaagtcaggagaaccgggaaaatgcaaaagaattttgcaggtagtacgggatacgaaaatgtggtataattatgggcaggatatcagaagaatcaggagttgaatagattgtgaagaaagaagaaatttttgaatatgtgcagaaacagtatggcacgattccggaatatttatggagtaaactaccggacagtgcagtactccgacatgaaaatggaaaatggtatgcagtgatcatgacggttgaaaaatcgaaactgggattagatggaaaagagccggttgatatcatggacgtaaagtgtgatccggatatgacaaatatgattattcaaacttatggatttttacctggataccatatgaacacgcagcactggatcacgattttactggatggttcagtcagtgaagcaaaggtactggactttttagatatgagttatgatctgattgacggagcaggcagaaaagaagaaaatgtaagtggattacagtgatttttgagcaaaaggaaaaccggggattttactcctcggttttctggctgttgtgcttcagtcttcaatttgaaaaatatcttctacaggcactttcaggtaatgtgccagccggattgcaatctcaagagagggattacgttctccacgttcgatgcggcctatagtctggctgcaggaacctatggcttcagccaaatctgcttgaatgagattccgttcttcacgaatatcttttagtgtattattgattgccattcaatcacttcctttgcttattgttatcagcaggatcatgaacctgctgttgaaatctaatgaaatcccggaatttctgcacctttgcatttcccgattacttttccaaaaatcttaaaagagtcagattccaaaacctggataggacgatatttttgatttaacgagatcagataaacaccatctggctcatcgtgtaattccttgatgtaagtattgccgttgagatagaagattccaatttcaccattagcaagagaatcttttttttgaatccatgcaacatcgcctgtatgataaagtggctccatactgtcaccggaaatccgtacaccaaagtcagtctgctcaggagcaaggtgtcctacgtcataggtttcttttacagaatcctccaggtaatttccagtaccagcagaaactggttcccaggtaatttctacaggatgatggaatgggataatctttgcagacagtggagaaaactttttagaagctttcaaaatatcagcaaattcaatcaatttatttctaccttcttcattcaatccactcataatgttatatgggttttctccaaagaaggattcatatatatcttcgatatcaagtaactggcaaagtgtcaggaaaacatgtaaagctggttctcgtgcattggtctcccatttggagattgcttttgtagtgacctgaataccttcctgagaaagcaggtctaccagatctgattgagagtatcctttcttttttctattttctgctaatatttccccgaaatcacgcatttgttcgcctcatttctatttgaattttctatatgcattataccgtatgttggaaataaaatcaacaataatctccaaaatggagaaaacacaaccaagatgtcacttgactatctccgaaatgtcgatatatactaaacatacagagattgataagacattatgttgaaggaaacagctgggaggtgaaaagtttgagtgagcgtgtgatcctgcatagtgatatgaactgtttttatgccagtgtagaaatgctacatcatccggaatttgccggaatgcctctggcagtcggtggcgatccggaagccagacatggaattgtactgacagcaaattatattgccaagaaaaaaggagtaaaaaccggaatggcattatggcaggcgaaacaggtttgtccgggacttatttttgtaccaccacggatggatttgtatttgagattttcacagatggcaagagaaatctattcggagtatacggacaagatcgagccatatggaattgatgaagcctggctggatgtatcggacagcagaaatctgaaaggaagcggaatgacgattgcaagagaaatcagccatcggattaaatacgaactgggtgtaacggtaagtattggaatttcctggaataagatttatgcgaaacttggttcagattataaaaagccggatgcaatcacagagtttaatcgagaaaattataaagacaggatatggcagtttccagcgtcagatttgctttatgtcggaagacagacaaataagaaattgcaaaaacttggaatccggacaatcgggcaacttgcggaatcagacgaaaagttgttagagagtcattttggaaaaataggaaatgtattatgggctttcgcaaatggctgggatgaagatccggtttgcaaggaaggatatgaagcaccagtaaagtcgataggtaatagcactacaacaccgagagatctggaaaatgatctggatgtctggatcattcaaatagcattggcagaaagtgtagctgcacgattgcggaaacatggatttaaatgcaaaacagtagaaattacagttcgagataatggattgtatagtttttccagacagatacatttacgacagccaacgaatattacaaatgagattgtaactgcagcatttcagctatttaaagataattacaaatgggaacatcccattagaagcctgggaatccgagcttcggatcttgtgttagatgatattcccgtacagttggatttatttggaaatcaggagaaaaaggaaaagttagagaagctggatcgtactgtagatgagatcagacgacggtttggttatttcagtatacagcgagcggcaatgtatcaggataaagtcttatcccacttagacgctggtacgcacacgatccatccacacagttattttcatgggtaattggagggatagatttgaaaaaagcattaaccagaaaacagaaagaaagttatcagtgtattttgaattatacgaaggagcatggatacccgccgacagttcgggaatttggaaaactgatcggagtaagatcaacatcatctgctttttccagaatcaagcagttggagcaaaatggatatatccgcagaatcccggcatcaccaagagcaatcgagattttatagtgaggtgtcggcatgaacaaagtatatgtagatgtagtggcagagttccggaaagacggacggctggttcccatattttttacatgggaggatggaagaaaatatagtattgacagaattttgaaaattgagcgatgcgccagcagaaaggcaggcggtgtaggagtgatgtacacctgtatgatacaggggcaggaaagccacttgttttacgaagtggataaatggtttatggagagaaaaacagcataaggagagattggtatagacgatattatttggattattaaccggcagggatagtcactttccctttatattcctgcaggttttacataagaagatggatttcggtcagcaaaggcagctcccacaattccttttggatatccgcttctgcaagttgtagtaagtaattgcttcccatcaaaatcatggggaaagcgaactggtctgaaagaccgccagttagtgtgatgatgataaggagattttgaaactgatgacagacagagattatgcaattaaatcaatgaaagaaattaccttccagatggcaagtcatgcacaggattatctggaagttacaatcgaaagacattatactgatattaaagaactgatgacaagctaccagaaactgattttagaaaaccaggttgtattagaagaactggatatggagtgccaggagaaaatcaatgaagatatggcatatgcattgagttatctgagcatttataacaatcagctgaatgtgccaaagatgcaccgggaaatgaataacctgatgatcatttatggcttgtctgatatgatctatcgtggaatgacactggtgaagttctatgcaccgaatggtgtgatgctcagtgaaatccttcattcctgcttttgcagtcattataataagacagatgtggaagtacagcaggagttaggaataggcaggacttctttttataaaatgaagaagcaggcacttggatatttaggattttatttttatgagatcgtggtaccgcaggcaaaggataaaagatttaaaccgtcactgggcgttgaggaagagtaggtgagtaatatgagatatgaagattcgatgaaaggtgtagctgatcagataatcaaagaacagcagcgagtcagtaaaattataaacaatccagaagagttccattggcatgacgaatatgcaacgttgaatttctttcggtttatctgcaaaaatatcggtaacttgagaaatggagaaattgaaaaaatggtcacacgtttaaagaacatagatcagaaagcagtggaaaaccatgtgaatggtgctgtttgggcatttgattatgataagatgttctgtgtattgatggaaaatgaaatttgccgaaaggtgtgtgaaaagaataaatataacagttggatgaatctgattggacagtattgtgtttcaaggacttaaagacgaaaaaagttgttggagagaaataatttccagcaactctgtctttaatgaatagagttcatttttttattcaactattcccatgatatatacaatatgtaaatttgcaattcaaatatcagtttatgctaagtaaaataataataataattactattattgacaggagaaataattatcatgtataatacagatatacaagaaaaaaagtgttagaaaaattgctaggaacttggtaacaaaaataaatcgacattgaaaagggaaaatgactatgataaaatatgaatgtgaaccatgtggatatatttatgatccggcagtaggagatccagacgctggtatcaatccagaaactgcatttgaggatattccagatgactggacatgcccaatctgtggattaggaaaagatgttttcgttcctgtagaagactaagcagaaaatgcaggtacgaaactgccagacattaaaagatcctaagagaacatacaaaagaaatggaggtcaaattatgacttacgatttaaacattacctttgatgacaatttagtaacaggaaatgaaacaattgatacccagcataaagaattgatcgaccgtatccagaactttgtaactgcctgtcaaaatggcgacagcaaagtaaaagcaatcaaaatgctggattatctggatgaatatactggctttcatttcaaagaagaggaaaagcttcaggaaaaatccggttatccagagcgtgaaaaacattatgaaaaacatgaagagtttaaaaagacaattcaggaactgtatgaataccttcaggattatgaaggaccaacagatcggttcagtgaacttgtacagaaaaatgtaatcgactggctgtttggacacattaaaacatacgaccgctctgtggcagaatttatctttatgaaacaaaatccagaccgatgctaaaataaaccagggaacgagttcattcagaatgtagacaacgtgatgaagtaaactaggggctgtcacaatgcagccccttttctgttatagcgatattctaggtaatatattgtgctggcatgacatattattttactactactatatgggaagagcaagcagctcttctttttttgtcctttttatccaattttaagttgtaaagtctcttttcatgccaacagtatcggaggaaaatgaatgagagagaaaactatatatgagaagattgcagaaaagtataacacaataccagaagaagtacgcagagaaatgcagatagccatagatgaaggatttgataatcctgacccggctgtgcaggaagaatggaagaaaatgacacttaaaggagacaggcccacaccggaagaagtaatcaattacgcagtaaaaaaattaaaaggaaattaaaaatatgaagaaaaggataattgcagtaatttcaggaacagcaatcttgataattgctgtaggaagtatttatgggaaatttgaatccagtcataaagaaggcgaaccagatgtagttggaactttttctgtaaatcgggatgaaaatataaccgtggtcgcaaatagggaagatattgaggatagagaagcgtttgcaagaaaacttttgcagatgtacaaggatgattcttttcattcgacaaaattctccacagacagaggatatgcgacgagcattgatatgaacatctatttatggaaagaggatattgaagacggggaatcggtaatgacagccgaatatagacctgtagaatacggaaaggactatgatgttgtcaataatcctgataaatttcaactatatatagatggaaaagagattaaatagtaatctcctgaaagcaagctttttgtcaattatttcaaagataaattaaaggataacaaaacatagttttgacaatgacattttgaaaaattttataggaatgctctattatcaaattgacataggaatatggtagcgtataattagaattgaatacactgaaaaaatggaggaattacatgaaagcacataaatattggtcagtaggagctttaatcacaatgattggaactttttatacaggatataaagggttaaaagcagcacacaaatactttgcatttggctctctgatatgcatgattatggcagtctattctggtcataaaatgatttcaggcaataaaagaacaagaaaacaggtggaaaatacaaaagcggaggaatagtaaatgctagagttaggaataaaagcaccggattttgaattgccggatcagaacggagaagtgcataaattaagtgattatttaggtaaaaaaataattttatatttttatccaaaggataatacaccaggatgtacgaagcaggcatgtggcttttctgagcgttatccacagtttactgagaagggagctgttattctcggagtaagcaaggactctgtagcgtctcacaagagatttgaagaaaaatacggactggcatttacgctattagcagatccggagcgtaaagttattgaagcatatgatgtctggaaagaaaagaaaaattatggaaaagtatctatgggtgtagtaagaactacatatcttattgatgagcagggaatcattataaaggcaaatgataaagtcaaggcggcagatgattaaaagtagaaaaatttgaaattcgtaaaggtatgcgaatgcattgtgttgtaagaaaagcctaaaggagaccagctatgaaattttatgaaagtggagacaatcgtaaaccagtgatttttttatttccgggtacctgttgcctgtatagcagctttaaccatatactggatgggttacattcttatttttatacggtagcagtttcttatgatggatttgatccaaatgagaaaatagaattttgttcaatggaagatgaatgtgaaaaaattgagcaggaaatcaggaaaaagtatggtggcagaattaaagcagcatatgggtgttcccttggaggaagttttgtatcccttttgattcagcggaaaagaattcatatagatcatggcatcattgggagtagtgatatggacgaagcgggttcatttatggcaagaatccagtcatcgatagttgtgccgattatgtatagaatggttcacacaggtaaattacctaaatttatgcaaaagaaaataaatgaagcagataaatcaaagaaagaactggttgctggatttttaaatatgttcggtattgaccagggaggaagtccgtggattacgaaacagagtatttataatcagttctattctgatctggttacgaaagtccaacatggaattgatgtgccgggaacaacaatccacgtgttttacgcgacaaagatgggtaaaaaatacgaaaagagatattgtacttatttcaaaaatccggacatccgaagacataacatgcagcatgaagaactgttttgctgtcatagtgcagagtgggtggaagaagtgaaaaaagcagtggaaggcgacagacaatgaaagaaaaagtgaatgtgacaggtgtgccggaaacaatggtacagactttgtatgcaagagcaaaagaaacaagaaagaaaaatgccaaaataaatgacgaaattgcagtagaacttgtgaaaaagcttgattatgactttaccaaggcagataaagataacgccatgacttatggtgtgattgcgagaacaattgtattagaccggatggttgagcaatatttggagaagcatgcaaatacagttgttgtaaatattgcatgtggactggataccagatgttatcgaatggaaggaaaatatctgcgttggtataatgtggatctgccggaagcgatgaagataaggaaacagtttcttacagaaacaggtccggtgtatcagattacaaagtctgcaatggatgattcctacgtggatgatatcgattatcacggagaaaatgttttggtgataatcgaaggacttactatgtatttgtatgagaaggacatcaaaaaaatgttttctattattgaaaaatcatttcaggaagtaaccgtaatggtcgaaaccatgtcaccttttgttgtaaaacatgtgaaagaaaaatccatagagggaagcaatgcaaaattcacatggggagttaagaatggaaaagagctgcaaagaatcatatcggaattttctgttcagcaggaagtcagtctggtcgaagggatgaaagaacttatgccgatttatcatgtgataggtaaaattccaactgttcgaaatatctcgaacaaaataatagttatggaaaaacatggatgatattatacgagcaggagatgatacagatgaagaaaagacattttgatgtgggaacagatggattttatgctgcatactggaaatgtgaatcagattcagactgtgcaatgattgccatgatcggagatgattcagaggattatctagcgcgtacatctgtgaaatggttacataaactcggtgtgaatgtgatgacaatgtcacctggaaaaaaggattatggacatcataattatccgctggagcgtatagaaaaagcaattgattggttaaaagcacatggtaatcagaagataggaattgtcggggcatctactacaggaacacttgctttaactgcagcttcttattttgaagatattacattgacgattggtctgacaccgagtgactttatctggcagggatttatgcagggcaaaaaagatggatgtaaagaatggccgattgagggagaatctcttttttcttacaaaggagaaccgcttccgtatatgccattttgttacaaacatccggattactggcatgtgattgagaaagaaacaaagcgaacaggtgatatgattaattcgagaaaactgtttgatgattcggaaaaggctcacacaatcacagaagacgagatgatcaagattgaaaaaatcaatggaatattattgctgattggtgctgaagatgatgtgttatgggatacagcaaaatatatccgccgtatgaagcagcgtatgaaagaacatccacacacatgcagattggagtatgttatttatgagcatggaacccatttcgtttttccagagagtatgttaaagacgatgttgccagttggttctggagttttcatgaaactggcatttcaggcagcaagaaaacatccgaaagaatgccgtagtacgcgtctggatatcgatcagcgggtgagaaatgctgttgcagaatggaagagtagaaaaagagacggataaaaaataaaaaatggacagaaggtggaaatatggtttttaaaacaacaggaaacaaatcagaaccagttgttcttttctttcatgcaatgggagtgactggggaaagcagcatgccggttgctgacaaattggcgggaaaattctattgtattatgccaacctcaacagtgtattgctccggacagaggtactgcagcaaaagagatgaggtacagcaagtggtacgatttctggagaaacaagaaatcaaagagatagaacttgtagtggcatcttctatcggtgcagatcttgccattgcatttgtgacgaatgccaaaataccggttaagcatatattttttgatggcggacagtttgcacagattggaaaggtgacacgcaggattatggttccattcttatatgtggcaatgaaaagcctgtactggtcaaatggaaaaacgctgaagaaaattatgtggtgtgacgatgacaagattaagccttactttataaaggcaggaaagaacctgacttatagaaatctgagaaggcagctgacagacagtctggaagataaaccgtttcccaaattgccggaagaattacaaaaacatacgttctgggaattcggaagtaaagaagaacatttcaaatacaggagtgcagtgatgcagacttatatatatggtaactttccggtttttcagggatttaaccatatgcagtatcagatccgcgacccggaagggtttgccagaatgttggaaacgataatggagactgatcgattacccaaattgacatttgcaatatgatataaaggaaaaaactatgaaaaatgcttatgagcttgcagaaactatattgaagtccagacttgataagaatggagaattaaaatcatcagattctttttcaagcattgaattatatggtacatcagcttgcaaaaaagcaggattaaaagtagaaaaatttgaaattcgtaaaggtatgcgaaatgctacgcatttcgtcggtgtggcgtatccgccaaataaaatttcaaaaacagccttaaaaatgcaagcatttcatatctgcttttgaaattttgcttggctctgaacagttaccattttcctttcttatcatacatttttagaaaaaagctgtaaagtctttggcaaatattttccattagactttacaactttcactatcattcgttatttacttctatctcagataatatgtcatttcatgccattcttctccaccccagacagaatctgacattcccagatctacaaacccaaatcttttatacatctctactttttcatccaggcaggtaagaacaatttcttttcttcccttttcttcttctctttgcagataacatcttacaatctctcgtgccagaccttgtcctcgatactccggtaatacatctaagccaaggatcataactttctttccttttggattattcaaagatgcatctgtaaaaaattcatctcggaatttttcctcgtccgttgcaattccattcaaaaatcctgctaacttcccagttgttttatctaccgcgactaaaaacaattctggagtcacaccgattcgctccttcatgtgtttctcagaacatgcttcatttggcggaaaacaaattttctcaatcaagactgcctgatctgcctcttcctgtctaatatccctgaattcaaatctttctaaaatcctactgttcccttcaatctgtccttgcattttctaatctccttcttcatcaacttttgtaataacatatttgtaatttcatactgtcaccgtaagcactgctcctacagatgctaccaacgaagctgctactgctaatatctggaacggaaaactaccaagtcttccgcaaatcaggctagttcccgcacgttttctggaacgattgtatgcaacaataactcctactccggttagaacctgaaccacacttgccattcttgtgaaaccaacaaagctctgcacacccacaagtgcgatcacaagacaaggtaatgtagctgcaagccagctgatcttttcgccccatttcgtctgttcattcacaatatctcgaagattcagtgtattcgcccagaaagatgttgcaagagccaacagtgaaaaaacatatccgataatgctgacccatccgccaagatggccggaaagatccaccagtgctccattctctgtcacattagaacatcccagaagcgtcataaatgtgatcaaaagaatcagtcccatattcaagcccgtgcctgctgcaatcgctttacgaatacctttttcgtctccttctaaacctttcacaacctgtggcacagacataacagcagataatgaaaatgcaatcatgctataaagtgccagcatattgttattcgaatagaactttgtcgaaagctctgttgtctctgaaagcatcgttgctacaaaaaggatccctatgactccaaacatggaaatcactgcaattttctcacagataccaaccagtttcattccgatatagactacacttgccgccaatacataaaagagcagcattccggccacggacggaagatgaaaccacgcagaaaatacagctgctgcaccggtgataaatccactcacattcactacaactgaaaatccaagcagtccaaatgccagccatgtacatgccatcttcagttttcccacaaacagctcattttcaaagcatttgataaactgcgcgccattgttattcaaagacagttccgcaatcataaaatgcagtaaaagattcatgcaataagccactgctgcaatccagataatatcatgccagttattcctggatgcaaggaatgggaccgaaagaattccagatcccacgccgtgtcctatgataatactcgtcgactccaaaaaagtcagctttgattccccatgtactttcgccatacctacgcctctccagtaataccaatttgttgtttaccacttatgatggcggaaaacaatctcaaatctgatatgataactctttctattgtacctcattatagcttataattaaacccatttttaaagagctttttcccaggcattttatattctccagaaactatgcagttaatcatattttatgttatactcttaatagaaatagctattaaatctaaacgaaaaacagaggtaactatcatggaattcaaaagcattttaataaaagacacaactgtggaagaaagaaaacagattgtaaaagaatctttaggcaacatttctgcaagctgcgacggttgcatggcaagactttcagaaatgtacgatgagtatattaaaggtaaaaaagagatccgtgacattaatatggaatttaatggacactatttacgtggagacatggacaagggtgaaagaagaagctgtccgatgtaaagtagatctactccccttttaaccttcactcaagacctactgatagaatggaggtgtttgtatgaaatttaagaaaagaatcgcatttttcacagcaattatgatggcactattgactgtcggatgtggcagcaaatcaatgtcagcatccgaggacagtgcaaccatggaatcagtctacggtacagattattcagaaaacgaatactgcgaagaacctgcagaaacagccgatgcaggagtcacttccggaaatggactggaagctcaggtagaaaacggacgaaaactgatccgaacggtttctctttctttgcagacaaaagaatttgattctgtactcaatagcctgaaaacaaaaactactgaactaggtggctatgtcgagaattcttctatcagcggcaatagttattcttatacaacaacccgatatgcaagctacaccatacgaattccggcagacaagttaaatgagtttgtggatatcgttggtgaacttggaaatgtaacacaggaaaatgaatccgtggaagatgtgacacttcagtatgtagatgtcgaaagtcataaaaaagctttagaaacggaacaggcacgtttgatggagctgctttctacagcagaaaatatggaagacctcttagccattgaaagtaaattatccgatatccgatatgaaatagaaagctacgaaagtcaacttagacttctggacaatcagattgattatagcacagtgcatgtggagatatttgaagtcgaacgtatgacagacgcgggtgagaaaggcttctttgaagaaatcaaagaacgattcggagacaacctgtataaagtaggtcacggcttcaggaatctcatcattggaattcttggtgcattaccgatccttatcgtatgtgcagcagtcatagctgttatcgtagttatagttaagaaaagcatcaaaaaaataacattcaaaaaacagaaaaaagcaaaagaaaacgatcatgaagaaaacttcaaatagcgactctccttcgtttctcttgtaaagcaaagcactcaaaagcggaaaacctctgaatctaatgagattttccgctttttgttttcctcttattctctattcttttttatatttttttccattgcagcaatttcctctgccgtatattcttccaccactgtctttgtcacttgttttatatgcttttccttcagacgaagatatacaaattccctgaaaatagtgtacagaaccgaaactaatggaatgaaaataagcattcctacgatccccatgagattgccaccaatcgtaacagcagcaagcacccagattgacggaagtccaactgatccaccaaccacatgcggataaatcagattgccttcaatctgctgaagaatcaaaaatacaataataaataaaattgcttgcttaggatttaccataaaaatcaaaaagcaacccactgcacatccgataaaagctccaaagatcggaatcaatgcggtaaatgcaattaaagttccgatcaaaagtgcatatggcatttttaaaatactgagtgtaacgacaaacatacttccgagaatcacagcttctacacactgccccgtaaggaaatttgcaaatgtctgataggtcagagaacaaattttcagaaatgcctctgctttttgtttcgaaataaatgcgaaaaatacttttcttatctgtacatgcaatttttctttctgaaaaagaatgtagcatgcaaaagaaaacgcaatgaaaaatgtagcaaatccactgacaatagagcccactgccgacattgtcgtattcatcatatttcctgctccgctgccaagaatgctgatcccccatttaatggcctgatcttgattaaactgaacctgatttactaatttcataatatcttgattattatgtgaaaactctcgaatccagttttgcatctgtggaacaaaattcgcaatacttatcatcaaacttcccattgtccgagtaagctgtggaatcacaccaaacattactagtgcaatcacaccaaccgccaatataattgtgagaagaagactgatcggtcttgctaacttttttcccaccttatttccatcttttgtcttgccgaaaattttcttttctaaaaaactcattggcacattgattacaaaagcaattgcgccaccaagtacaaatggaaatataattccccatattgttttcagtacatcgatcactacttcaaatttccacaatgcaactacaagcagcactgtaaaaataatcagttctcgaattttcttcatagataacttactcaaatccattatcgttctcctaatttcttaaaatcagccaactatacttttatgcaacaagatatttttcatcatatacttaaaataatattgatgtcaagacgatttatcaattcagcttggcattgtatccgtcttatgataatgttattgatgaacgttatgcaacgaataaatatcagatattgaaaaataaaacctgaaaaaatcgaaataacgaaatttatacgaaaagagaaacaagaaaatgtcacaaaaacaaaacaaattgactcaaaccggtattgtagcacttcttgcttgtgtatgctgtatcctgtggggaagtgcaatcccggtaattaaaacagggtatcaccttctgcaggtagattcttcagacactgcaagccagattgtatttgccggaatccgctttactttagctgggattctggtattaatttttgcatcaatcagggaaaagaaagtgatgcttcctgataggacactcctcaaatatgccattcctgtgtgtcttgcccagacagtggggcaatacttctttttttacataggagttgcacacacttccggagtaaaaggtggaatcatcaccgggcttggaaattttattgcaattttgttgtcttgtctggtatttcgaaatgaacggatgacgagccaaaaaatcgcaggatgtgtattgggatttgcaggagttgtagtaatcaatctgatgggaaattccctggatatgggatttaaactgatcggagaaggatttattctgattgcacaattatcttatggaatgtctactgtgttgatcaatcttttttccaaaaaagtatcaccagtagtgttaagcggaacccagttcacgatgggcggaattgttctgactttaattggaattggaatgggcggacgcctgggaaatataactaccggaggtctgtcaattatattttaccttgcactggtttcagcagtggcatatacactctggtctatactgcttgcatggaatgatgtttccaaagttgcgattttcggattcgtaaatccactttgcagcgtaatcttatcggcactgatactcggagaggtaaaacaggcatttaatgttggcagcctggttgcattagttttggtatgcgccggtatttatatcgttaatcgcagaaaaaattaagcattgttattttgaataatcccttcataacctgctttaaggaaaagatcaaaacaagtatggaatctgcaccattcttcatcagattttcctaaatgttttctgcacatttccagacatcccattatttgaacggttagtaaatcagttaatgtggattcatctaaacctgtcttatccagcataacatcaagaaaatcctgtttaagtgcaacaactgtatgttttactgccggcaggaacaatgcttctgaaaaaaagaggggctgatatttcggattttcccgtaaaagccaacagagccccttcctaacaattatatttgaacttgatccattctcagataacaaagccatatttttaatatcatatagagcatctgaaaaaacttcttcaacaacttgtccaatgttaccaaaatgagtataaaatgtccctcggctgacacctgcatatttacaaagatctgttatagttatttgcatatagtcctttttcagaagaagctgcagaaatgcatctttaatcgaattatgtataaaattgtctttagataaaattgctttttcttcattcatgtatttccaaaaacctcgctatatacaaataattatagtatattttcacataaaaataaagttgtttttcatgaaaacgaggcattttgaacaattgtctcttctttgttcaaacgtatctggagggaattggtttctggatttgtttatgttatgttgggtatataagaagcgtgtatataaaaatagaaggaggtaggtattctatgggagaaacattatacacaataggaacggatcagcaacaggcgtggatgaaaaaaaattgtttcccacctagaggatatggttactctgaaccgggaacatattctcttgatgctacagaagttgcagcatacaatgttgcgaagtcattttatcaagtctatccggaagtctggaatatcgattatatcgagaaggaaaccggaatcaaacccgatgatatcaaggatcgattaaaacgaatgtatgatgaacatcttatcatgttcgttatgaatccaaatgttggtgtttacggttggggactttattattgggttgtcaaattaaaagacggtacagatccaaaggtaaaagctgaatttgccaagtggtatcagaataaagatgatatttgtacaggatatctcgcagagggcgatttcgatttctttaacggaaatcacatgagagttctggacaatcttcttgcagatgttatccagccatggaaagacagaccggaggttgaatatgtacatctttgtccgatcagagcagatgtcagagaatcattggtgaaccagtgggatgttccggaagacagatacagaaaatttatttttggagaagaacagaagaagaaattccttaaagttcagaacaaaatagataaaaaagattttgctattatcgaagctcttaacagtacaaaatcaatcgcagatatgtttgattttgacatactggagaagttatccggcctggatggcaagcagatgaaaaaagacattgtaatgtgtgttgatgaacgaaaatttatgctgccaatgatttatattaattacagagcacttggaatatcaatgcatatgtatctggttcgtatgttccagaatgttccgagttacaggaaagcagaaatcgtagatgaattctcacttatgccagaattcgtagatattcttcagttcggtgactctttctacgattgcatgctgactgtttataccgaagtaaatgacgtagaagcaatcagaacaatgttagaaggatatgctgaaattgaagaagtaaaagtagcaaattcaaagagacagttcagacgttgggtagcccgtcttgatgatgataacggatattgggaagaatgcgttatgacggatgactttttacagaacagactggaatccggttccgtaaaatgtcgtttctcaactgactcagaggaggtgcagtaatatgatcgtaaaacatccaagagaatatgttgttgataaacttcaatatgcattaaatccaaaaacgattgccgtagtcggagccagccgttattccacaaaggtcggctataaagttgttgatggccttttaacatggggatataaaggaaagatttatcctgtaaatccaagagcagataaagttgccggatttacagcttataagactgtaaaggatattcctgatgaaatcgatcttgcttttcttgctgtacctgcacacattgttaaatctgttttggaggattgtgttgaaaagaaagttaagattgttgttattgccacaagtgcatttaaagaaatcggacgtggaacactgcaggatgaactcactcaatattgtcgtgatcatgagctgcctctgatcggaccaaaccttgtaggaatgggaagtccataccttaatttcaactgcggatttatcccttatcttccaatcaaaggtcctgtagcaatgatttctcagtcaggtgccaacttgcttgcggcacttggaacttcacagaaagatcattttggaatgagcttcttcgtaggacttggaaataaagccgacgttgatttctgtgagtttatatcctacgctggaagagatgaaaacagtaaatgtcttgcaatttatattgaaggactggatagtcctgatgcatttattgaagcctgccgcagtgttgataaaccgatcgtaacaataaaagtcggtggttcaaagattggtgaaaaagctgcttttgcacatactgcttctgaaaacaaaggaacaaatgatgcattttatgatgatatttttgaaaaggctggagctatccgtgcaaccacatggcaggaattcctcgatatatcaatggcattaggaatgcagccggcaccaaagggtgacaatatcgttatgattaccaacggtggtggttcaggtcttctcagctgtgatcactttgaacgtcgaggaatgccaatgcatgagctggcagagatttctcctaatctagcaggaagaatccgtgcatatatgccaatgtttggttcaccgcttaatcctgttgatatttccggaacagcttcacctgttcagtataaaggtgcattcacacaggtaatgcgtgacccgaatgtacatggaatacttggatccatctgtccgacagcagtaacagatgttccggctgtaacagatctggttatcgatatttacgagacatacaaacatcttggaaaaccgttcattatggaatgccagggtggtgaagaatgtcaggaagctatcatgaagttgagagatcatggaatcccagcttatccgactgctgaacaagccgtaaatgctatggttgctctttacaaatatggccagatcaaaaataagaaataaattatgagcagacattgttactgttcactcccgtgtgaacagcaatcaaacatttagattatgatagaagttgtataaaagactacttctcttctataaaaagctcttataagaaaatgacacctcttttagggggtgtcattttcaatagctttattttctttgaattaaaatcttacccgctcccgatccggatgttctcccgaccatccgatctgcggtaaagtcatcaactgatacatatcattttcctctatttcaaatccgaaaacatccagattctgatgcattctctcactggaagaggattttggcaacggtaacacaccgcactgcagagcaaatctgatacagatctgtgcgacagatacctgatatttttctgcaagttccataagaagtggctccttgagaactctggctcgaccgattggactccatgcctctacctgaatccccatctgcttacagaaatcaactgcagccttctgcatatatcccggatggaattctaactgattcaccataggcataatgcttgtccgctctaacagattgttcaaatgatgtggcagaaaattgctgacaccgattgcccgtacctttttcgacttatagagatcctccaatgccttccatgtctccacatccaaatctctccactctgcattcagatcagaaggtcttggccaatgaatcagatagagatccaaataatctgtacctaatcttttacaagtgctttcgaactcctgcaaagttgaatcatatccaagatgatctttccatacctttgatgtcaggaaaatttcttctcgtggaatttcactctcgcgtacagcttttcctactgcttcttcattgaaataaaaggctgccgtatcaagatggcgatacccctgtctgattgcttcacttataattgcttcatcggtgttgtctgcggctttataggtgccaaaccccactgctgggatttccactccattagctaatgtaaatgtatgtctcatatgatgcttctctttcttgttatatagatgctgtggacagtaacaatatgtttcgattcagattataagcaagtttgcttataaaatcaaccatttgtttctgtatcttcaataagatttttctttaatgccgcaatcgtatcttggttctttctcaaaagctctaattgcctgtacgctttttctcttaatattttcagcctttcaattttaggcacttcctgtcttatcaaatctgcatttgtatcttccagattgataagcacaaccaattcttctgctgaagcaaaatctctgatattaggagttttcccctttattcctttttcacttctccattgtgctgctgtttttccaaacaaagccatatttaaaatatctgcttctgaagcatatgtatatgccatttcctgcggagataatgtgggagttatcaaaaattcttttactgcatctgtgtggatacgatagtttatttttgaaagttctctctttacatcccatccaatcgctaaccgttctgcttcatctttctttaatcgctgataatctttgatgatataaagcttaaattccggcgaaatccatgaagcaaactcaaaagctatatctgtatgagcataagttccaccatatcgtcccgattttgatacgatacctattgcatctgttgctttgatccactgctgtggtgtcaatgtaaacgcattatcaccagattctgctttaaacctatcgaattcgataggtttaaaattcggattgtgaatttgctcccacaagcccaaaaatgaaatcgtagaatgattacgcatccagtttgccaccacgataaaggcattatctggatttttatattttgcaatatcagtgagcgaaatgtaagcttcttcattaacaacatcgcccatcactctgatttctgttccattggcctctattttcatgtttttcatataattttcattttcctttttagcaataaacccaactctttatttgtatccgataatatcctgagatactttttcaattacttcagggttaattgaagatatctcggctatataaactttgttttttctcggattaaatattccgagtttttcaattttccgaaattctggatgtattgaatgacatcccataatatagtacattaacaactgcaatgtatatttacttcttggttcctcttttgacaccttaaaatcccacaacgtattctcagttaaataatctccatctcctgatgatactatatccgtataaccaccctcaaaagtaaaaccatcttttgtaataggaccatattctttccaaaatgccagacttcgtttaaccataatcacaatattctcaatagtatcactatcaggcttaatttcttctactggtttatacccaattacacccgctctgaaacaaacatcgtaaccaactaatttacatgcattactgacagactcattatcaagaccttttatgccttttaataacttcttagcatttcctaatgccaacccttttttgccacttgcattgtttaaaaataaatcaagacacaatgctccctgtaacgaaattttaaaagcttcttctacggatgttcccatcataaaacgggtcaaatagtcaaccgcaagaccaattaacgaagcatgaatattctctgcttcattcaatgtctttccgtcatcaatagtagtaatatcaaattgctttttatttagatatcctccatatggctgttttgccatactaatacgtttagtaacagagtacattgaaatctcctccctcttgcaaaaataattttaaattacaagcatccacctaatgtcaaaattatctgagtgtatttaaatccttcatttaatctactacattccatgacgataaaataatcatcttcattttctgctctcacaacaataccttgcgataaatctgttttccacaaagttttctttccataaaattgatcaacaaagctatttgtgggattaggcatattggcatcaaatccattatgtattaaccattgatggtaatcgtttaacgctggtagcccaacgctttgtattgctgccatgattgctgattgctcacttaattcgcgttcgatattgataacatatctttcttctgcatcaagttcgtatccatgagcctttacaatttctcccatattttcattcaatttaagttttttcactccaatttatcccctttcctatactttacgagatcattttctcaaatatttgcttactgttgcttgagaaattttaagcatatccgctatttgttgttgtttatatccttgctttcttaaagctttaatttgtgatattaacgcttccttacccaaattggtagcaaattgtgttgtcgtttgcactacgccgttcatatgtttggtcaacgttgtagtatactggaaaccatccttatttccaataacactggcaattccagtctttgaatcaaaagtcgtttttacatcatttaaacctgtattagaaacaaaattatttattgcattcaaaatatttttcgattgctttctcatcaaatcattgctcattcttctaccctctttattccgtgttatgctttttataactttataataatttatttggggtaattcttcaagcaaaaaatataaatacgatacatattcctagcagcacttaccaatagattatctctctatccaaaatctcccttgcacacgcctgtatattattcattctgcctacccactaccgggcggattcggaactttaacccgttagaaacgtgcgccgctaggcgcacgacgacaaaaagcccttagctatgagttttatacccacagctaagggctttttagataaatatggatttatttgttgcacaatcacctgtcaattattctctaaccctaaaaccactggattacaagaataatggctctcatgcaactgttatcaatttgttatcaaaagacttttaaaagagccgcaaacccgcttgatttactaagcatttttgtttattcaaactccactgttcctgtcggctttggtgtgaaatcataaagtacacggttgattcccggaacttcatgtgtgatacgttctgtaatatgaaccattaattcatgcggaatctcagcaacagtcgctgtcataacatcaatagagcatactgcgcgaacgatacaagaccactcaaaagcacgttttccatccttgattcctgtagatctgaaatccggaacaacagtaaaatactgccagatctttccttctaatccattcttttcaaattcctcacgaagaattgcgtcagattcacgtactgcttccaaacgatcacgtgtgatagctcccggacaacgaactccaagtcccggtcctgggaatggctgacggtaaaccataccatgtggaagaccaagttcgtctccaacaactcgaacctcatccttaaacagaattctaactggttctacaagttcaaaattcatatcttctggaagtccgcctgcattatgatgcgctttgattccttcttctgactcaagaatatctggccagattgtaccctgtgctaagaattcaataccatcaagctttcttgcttcttcagcaaatacttcgataaattctccaccgataatctttctcttctcttccggatcctcaactccagctaatttatcaaggaaacgatctgtagcatccacataaaccagatttgcattcatctgattacggaatacttcgatcacctgctctggctcacccttacgaagcagaccatgattaacatgaacacatactaactgctgaccaatagctttgatcaaaagtgcagcaacaacagatgaatctactccaccggaaagtgcaagaagaacttttttatcccctacctgttctttgatcaatgcaacctgctcgtcaataaaagcctttgcaagctctggtgttgtaattctttccatgtcagccggacgtctgatttcagtaacattcatttgattttcctccttagtatcctctcaatatctacaatgattgtaccgtcattatgattacacgtcaacacattctgacataatttgatttatttatctttcaaaaatattactgtactcttctccttctgcaataatttttttctatcgtaaaagtgacatggccatcctgcggtaggtgtgacgtttcccccttatcgccacgctataagctgtaatattctccggtaatgccatccccatatatccactatccccaatatgatggatatctgcaccagccatcttacacatgagagcaatctgacgaactgtagcttcatctgcaccttcctgagatgttccaatcgttgtcattgccaacgcacctttttcatgcgcttttcttataagatttcccgcatattccattgtgattcccggaactgttcccggagccggtagcaggatcacatccgcgcctgcatcgacaaacgcctccacatccttttctgtgaggatcttttctcctgcttcagaaataattcctgatgcatgcattttcccggctgtcaaaatcactctgtctccaactgcttcttttaatctggaaagggcctgtataattgcttcattatctacgccaactcccggatttcctgtcagaacaatcatatctacgcccatgtctgcagcttttcttgcattctctaccgtagcctgacggccggttgtcagattccatacagattcttcctgcccatcttttatcacagccggctccagattaatcgcaaccattcttccggtaagacgcttcacctcacgaatcgtatcttctggtgatgtctgcggcagtccctgaattatcggatcgtttacatcaaaaatattcagcatgatcagatctgctcccagagatgctacaaactctgcgttagtgatatttactaacatcggagttactgttcctattgtctctgctgcgagcgttcttccttcactgtctgaaatagcagtcagaagttctgccttattataggaagttaattctctggccgtcgtatctatcagtcgttttaacatcgttttctctcctttttgcagtgttttgttttcatcaaaaagtgtatgatttaagctttttctttgcatcataacattttgtgaaataactgtaaagaaaagtatttgctattgcaaaaactttagcgatttaacgcgaaaaatcactaaattgtattgtcgtatacaaaaacagctgttataatattaaaaatgataatcagataggaatggtgataaaatgagtcagttagaaatattaagagagagtcttggccagtgtgatgaaatcatcctggatgcattgcttatgcgtaatcgtattgtagaagatatcatggcttataagaagtccaatgatcttccaatcttacagccggaacaagaggccaaacagaaagaatggctggaaaaaagaatgggaaaaaaacgtcataaagctgaagtagaagacgtatttagaagcatcacaatgaacagtaaaagaatccagtccagaaaattgtttaactataatattgtgcttattggattcatgggagctggtaaaagtaccatctcagaatttttgaaaaactcctttgcaatggaagtaatcgaaatggatcagatcatagctgaaagagaaggtatgactatttccgatatttttgaagtatatggcgaacagtatttccgtaacctggaaaccaaccttcttatcgaaatgcagtccaaaactaatgtcgtgatttcctgcggcggtggaactccaatgagagaatgtaatgtcgttgagatgaagaaaaacggacgtgtagttcttctgactgccaaaccagaaactattctggatcgtgtcaaagacagccatgaccgcccgctgattgaaaataacaaaacagttccgtttattgccgatcttatggagaaacgaagagaaaaatatgaagcagcagcggatattattattgaaacagacggaaaagatgaattgcagatctgcgaagaactgattctcagactacgtcagatggataataaataaaaacaacttatgaagtcgcatctaagattcagacccagaacaggaggaaaaaatggaacagagaattaaaggaacaacaggtttattagcattgattggaagtccagtaggacattcaggatctcctgatatgtataacttctgcttccgttatcacaatttggactacagctacatggcttttgacatcaaggaagatcaggtaccggcagcattggatgcgatgcgtctgttcaaaatgagagggtgcaatgtgactatgccatgtaaaacagcagcagctcagaacatggatgagttatcacctgctgcaagaattatcggtgcagtgaatacaattgttaatgagaacggaaaactgatcggacacatgacagatggtatcggttttgtggaaaatctaagagatcatggtgtagatgtaaaaggaaagaaactggtgattttaggtgctggtggagctgcaacagctatccaggtacagtgtgcacttgatggagcaacatccatttccatcttcaatccagacgatccatttcttgatcgcgcaaaaggcacagctgctaaactgaaaaacgaagtaccagattgtaatgttcaggtattctgtctggatgatccgggaaaactgaaagaagaaattgaaaaagcagatattctggtaaatggaacactggtaggtatgaaacctcatgaagattgttctccaatcacagacaaatctgtatttcgttctgatctgattgtatgtgatgttgtatataatccggaagaaacaaaacttcttcgggaagcaaaagaagccggttgtgcaaaaacgatcggtggaaaaggtatgcttctttggcagggagttgcggcttataaattatataccggcctggatatgcctgtagaagaatacaagaaatatcaggcagaaaaccaaaaataaaactgctcccagttaagcaaacaataaaaatatcatagaaacatttctaaacaaaagtagcggaagtccttgattttttttaagagcttccgcactttttgaccagttcttaaaagcagatgtaatgtatttcctgcttttctggtgtcttcatcttaaattatcttttatttccctgaaccaggcagatacttcctgctccgccactgaacaacagtagtatcatccagcagaacagttcattactatccgctgttttcggactttttactgaagtttttgttccacttgcctgttcttttttcacctctgtttttacagcttccggctgttctttcgatggctgctccggtacagacggtgtaacaggcacagatggctgttccggttcgactgtctctttggttgtctgaatcatattctgcttcgctgcacttgcagtaactgcatcggaaccctgttcaaaaaattgaatcaacagctcttcgcaacaggaatattctccgatctccgctgcattggcaagctgtggatagctgtcagaaccggcaagataattattaactgctacagtatactcttttgtatcatccagctcctgcccatctttttgcacagaaagcacacgctcccccgccggctgtgccggatcgaagcggacggtaattccaccaacctgcagataacttccgctgtcatttggccacgcatcccactcaccactgtcatttgcaacaatacagtttttctgaatagtaagactagtctccaacatttcctttatctgtgtaccggtcaatttctttgtcaccacatagtttccataaggactgacattgataacatctccatacgttaccgttccagcagcgatagaagcacggattccaccagcattttcaaaggctatatcagcccctgtggcaagcaggtacgcatcagttatgacatttccaagatttgtctgtccgatacggatatgttcccagacaccgtccaattccaccggtgaagtaccgatggcacgattcagtgctgtctcgttttctgctttgatcgtatccaatacagctgtcacggaagcatccttcggatagttctgtgctgcttcataatcgacagatgttttctcataatccacatgcacacttccatcctcatccatagtacagttcagatcaatcagccccacactatttaaataatgtccactttccgatacataggtttttgaaccgtccggtgtcgtcacagattcactgagttcaatatgctcatgtccacacagccacaaatcgacaccgtccacctgtgcagccacattctttggatcaagcgtatgggacaatgcgatcaccacatcacacccttctgcctttaaagtagaagcttccctttttgcataagctactgcatcctgaaagtccaatccctccacattagatggcgttgtcttatttttcatctccggatcacttacaccaaacacaccgatcttcaatgtttttccattttttgtaatctcttttacaagttcatccgtatcaaaaaaggatgtcccatctgcatttttgatgttaccggataaaattttgacattagcaattccaccaagctcttttaaacgctcttttccataactccagtcatggtttcctgtggtcatcgcatcatatccacaagctttcatcagttttgccaccgattctccctttactattgtcgcaatcggttgtccatgaaaggtatctccggaatccagcatcagcgaaccgtccgctccttccgtaaatgcctgtgcaattccactcagtcgatccattccgatcacctgattgtaatcatcttcctctacccgtgcatgaatatcattggtatgtacgattttcacatcaaaaattgtacttccagatgcatttccatcctgcgcctgtaccggcattgccccaaataatccgaaaactatcccaaatgtcagcaaaagtaccgttaccttattccattgtttttttaatttcttcatcttactccttcctttaatgaaacggatattcgtaatccgcattcactacttctttatgaaaacagcccattatatggtttgttttcatattgtttcctttccttttattatatgtaaaaagctgtaaaattcaatacttgacatacaacgtccacgaacttcaactattgtcctaaaagtacaaattatctttctggaaaataacacagaaaggatggggctgccgcttcacgatttagaaatcgttaaagcgacagccccttgcaaatttttatatacatttttattgtcgctctatattttccgctaatgtcatcaacagcttatcaccattccgattaatcatcttcatttatttcgtggttactgagcaatgacctgcgtttcaccccaccagattttatatttctaaaaatagtcaggtgaaatagttcaattaaccttttcacctgactatttacatagcaaagagtctctgtacaattacttagtgtgacagcactcattctaccaatatcttttaaaaatctaattcttaataatcaaactgacgataatatctacgaatagaaagtggatgtcttaaaaacagctccatatatgcatctacacgattattaacaccatgcattaccaaatgagaaattgttcctctaaattctggactaattccttttaattcatgttcttttgtatcaataatagtatagtttgcatttacacgtggaagaaattttgcaatacgctcagctaatggtcgttgttcatcctctcccataaacaaagtaactggtgtatcttcaacgataatctcctgcattccgtggaaaaattcttgacagccaatagattttgtacggatccacatctgctcctcccaatagcacatagcataggaataggttgccccatactgatttcctgatccaataaagtaatgaggaagatctttatgttctttccaaaatgccaccttattttttgcatactcatatgcccactcatcggaatctttctcaacctgaactaatacatccgcaaggttagcttccatctctttattataacggtcataatcatcaaattcaccatttttatacatcaagtaatttgcaaccatataaaatttcaactgctcattcattggataaacaatcagataatcttgcttgtcaggctgtgtgagagtagtacctggattatcgatgaataaaaatacttttgcacctttttcatgtactctgtccactaattcaaccatttcttttgtatttccagatactgaagatataattactacagatttatttgtaaattttttgtttcctgtagtcaaaaactcagctgcattttcaacaaatattggaagctttgaacggccacgcatatatacttccacctgcatactggaagcataagtacctccaataccaataaaatagattccatcaaatccttcttcccagatttaatcaataattttttcaatctgcggacgaagagcaagtgctccattcacactatcaatctgtgcttgctctttaaaattacgcaaacaagcaccttctgtttctttccacgcttttgcttcatatttcatagttgatatcccctttcactactttctatttaatacaatttcgttgtctgcaaatctagatttaagaaaaattgtatagctcgttgaatcattttatcccaataaggccactcatggtcccctggtccttccatataaacatgaccataaccattactttcagcgatttttctgaatttctgattattttcatataagaagtcttctgtaccacaaacttgaattaaccttggacgattttcgtctttgatccaaatgaaaccatttcccacaaatagctggaagttcatctgcaacataatggaaataatcaattccaacttttcctgttgtataaaaactacgttgaacttcaggcataattattatgaaattatatttttttgcataatattcaattttagaaaatcgcgtccattcatcactatttcctgacagtccatgaagtaaataaagaaccttcggtgttacatcataaagaggtgttacatcattagaaacatccgggaaaataacattaatctgtgttgtcattcttaaattttttgaataaaaattccctgtagataatcccattattttaattttaccttttatctgaaaattgtacattaaagttacatttatcaccacgcacataattgcgattgaattcgattgcccttccatccgtatcacacgtaagactttgaaacaacatcacgggtgttcctgcatctattcccaacagttttgcatcattcaaactaggacgaaccaaatccaatgtctgctctgcttccgctagatgaataccatacatttcatatacttcatacacagaaaacaccgataaatcaatcccatccattttgggaattaaataatgcggtatatataattcctccaaagaaatcgaatctccgtcagcataacacatgcgcttaatataaaaaataggctcttctggtttaatgccgaacatatttccatacaaatttcctgccattcttagatacttggacacaattctaaaagatggtttcatattcctatctaacattgtctgcgtgaaaccttctaacttttccatgtttcgttcgattttatgtcctaaaacatatacttctttatcagaaatatatttcaacaatccttctttgactaaaacttctatggctgttctcacaatttgcttctgaacaccaaacatttcagccaattctgtatcagtaggtatttttgtaccaggatataaatcaccatcttctatttctattcttaaaatctcactcacttgctgagtgatcatttttttacaggcagttttcatatttcggctccttattttttagttaccatgctccaaaatactttaatgtttctgttgcatttgctgcacctttttccattgccccttctatagaaagtccatctacaattcctgttaaaaatccagcaatataactatctccagctcccatactatctacaagatgatcacaaggaacgattccaaaacgatgatatctttcaccatcataacacaaactgccttcttctcccatcatacaaatgacaagcttaggtccctgtttttgaattctttccatttgttctcttacctctttagtatctcctgtttccacagaataaaagagataatctgtatatggtatcgcttttacactttcctctgaatctgggcttgtcgcacaatcaaaggcagtaacaattcctttttctttcaactctttaaactgtccttctactttgccccaaacatcacaaattacaacatcaaaatttttgatataattaatatcttcatctgttaatttatatttttccaatacgccttcgtcgtaatctccaaatactctttcgccatctatcaattcaacctgggtaacggctgtctttcctttttctacacgcaaatgcgaagtgtcaacgcctttcgctttgatagtttctatcataatctgtccgtagacgtcatcacctactggtccaatatatgcagcctctcctcctaaacgtagtgtataaactgccatatttaccgggcctccccccggaaatgcttttacaccatctatattgttataataatcaatacagttacttccaactgccgctaatctcatacgatatcactccttttttatctggtgtctcgccttgttagaacattcgtatattgtacctgatctggtctcgccataatcctaaaaaactcaatacctactcctctatcgtcgtttacaacacctgactgatagtacaagtattgtccttcttctaccttcaacaatttagcttcttcttctgtggcaaatgtaattcctactttctccgtccctttagtcaacaatatgcctaaatcccctagaactttatataaagattcttctgcaaaattgtgagcttccaaaccttcacactgttcgtaattaatgtaactattctcaatcatcaaaggaacattgtttctaatccgcaagcgatataaatgaaatactttatctccctcttttatctgaagttttctcgcaacatatccatcacacgtctcaattctagagattaatacttctgtccaaagaaagtaccctgtttttctcattgcttccgaagtagactgaattccctttatatccctaactaatctcggaggtgccacaaaggttccagagccttttacactatatagttttctttcttcaattagttgttgaatagctgtatggagagtggaacgattcatttgccacattgtacacaactcccgttcgctcggaagctgtgtatgtggttttagctggttttcttgtatataccattgaatctgctccatcgccatatcttgcggacgaattttttttattttctccatacagttctcaccttctcaacatattaagtctaatgcttatgcactttctctattattttttctatcccaataatagaatactggaagtcctgtaactactgccacaagcgcacaaattaagctctgcattggcgcatatgtaagctcgccccaaataagtgtacttgtcataataattgcaataagaggcataattggaccacctggacacttataagatggattgtatccatgttctttgcctttttttcgaagcacaaagattgtaacgaatgtaagcacattctttaataatgctaccattgtaaagtatcctagcaatgctgacaagtctgaagcaaaaattaatacgattacaaccgcacactgtacgatactcgaaaaataaggagtttcgtattttggatgaacttttgcaaaagatttaaagaataaattatctttcgccatagcatactcgatacgtggctggaacataatacaagatgataatgaaccaattacaacaataatttccataattgcaacaattgtacctgcataatgtccaattcctggaagcttagatgccaacaatgcgattggagcatcagatgtagccatttcatcaatagaaagaattccagaagctacaaatgttaatcctgcataaagagcaagtacaacaactgctgtaagaataagccccaaaggcatattctttttcggatttttaatttcgcctgacatataacaagcagctcccataccatcatatgaccatgttgttgcagctatacctgcgattagcgcagcaattccacttgttgcatatccttccaaagatgcagaagataataaaatatccccctgaagattgaataaaccaataccaataaccaatgcaaatggtaaaattttaagagctgtaataattgtctggaattttccaccaccttctaccgaacgtatgtgtactcccatgaaaattaatacaaatactacagcaaccagccttaataccaaaccatgaatcggaataaaaaatgcaagataattcacaattgctaaagccatgattgaaattgacggtgggtcagttgcccaaaagctgatccatccacacaagaatgcgagtggtcgtgatcctgcttcacggaagtaaacatattgtccaccatcctctggataagcagatgctaattccgaatatacaaagtttgctggaatctgaagcaatccccctataatgaatgctaataccagaaacaagctactaccggcagcatttgctacctcagataaagatgaaaaaataccagagcctactgtagtaccaacgccaagtgcaataacagcgccaagtccaagtttacgaccaagttcgtttttgttctcagacataaaaactctcctttccttttaaacagagtataattgaaaaatcttgtgcacgacttttctttttttaatttcctattatcttcgatgcttttatattgtaaacagctatctatcttcgctatcacaatttcttaaatagtaaacggtaaataggttctttccattgttagttgaattcaaagtattaaattgatatgatatgtatataggtggaggtagcaaacaaatgaaagattttattactgcattagatccgaattatcaacttgacaaatatcatatcaaaaataatgttgctgtattttatattagctccaagatgagtgaagtaaaatgtccttattgtggtactctttcatcaaaggtacattcatcttatgaaagagaaattcaagatcttcctatgcaaaatagaaaggtaatacttcttgtgaaaactagaaaaatgttttgttctaattgcaaatgtgaaaagaaaacattttctgagtgtcatccatttgtagaaaataatggaaagaaaaccagaagacttgttcagaatatattatttacatcagcacagcttagttctgtgaatgcagcaaagattctaaaatcaaacagtatagaagttagaaaaagcagtatctgttctttgcttaaaaaaaatgccatcaattgtggataagtcttctgtaaaaaaagtttgtgttgatgacttcgcgttgcgcaaacggttttcgtatggaacagtgatggttgatttggaaagtcataagataatcgatttgattccaactcgaaatactaatgaagtaaaagagtggttgtcaaaatatcctaatattgaagttatttctagagatggtgcacagttgtatgcaaatgcagaagaaagatcgcatcctggtataacccaagtaagtgacagattccacataataaagggactgactgaggctataacaaagtatatgataagaacatttcctgcacgtatagaaattccagcagtaagcgctgaagctgatgaaattttaaaattacataacataaataatcgcaaagaacgtgttagttttgctcaccaaaaacgttcggaaaatatgacagtcaatgaaatcgcattattattgcactcctccgtaaaaacagttcaaaaatatttgatgctcgatcctgatgaaattgaaaataggacaattgtaaaggaaaagaaacatctattagctatgaaacagaaacaaaatgaagttaatgaggcaagagcattagcaaaaaaaggtgtgcctatagaagaaatagccaagactatgcatcatacctgtaaaacgatacaaagatatttatctccagattattctgttgaagatggacattataatgctcgtattccaggaaagcttgcaccatatgaagctgaagtaattaagttaagaagcgaaggaatgacttatcccaatattcataaaattattaccgaaaaaggttataaaggttcagttgcatccttaaggatgttcattcaaaaagaacatattcgaaatgaagcacatttaagtcaacaagagacttgctcggattatcaatcgaaagaatacattcagagaagatctttgatacaattaatctataagggattaagtgatgtcaagacaattaccaaaacacaatatgagcaagttcttaaaacgtacccagtgattactgaattatatgctgcaataaaagaattctatgaaatactatattcaaggcgcgacgaaagattagaaacatggcttgaaaaaatagaaaattttaacatacctgagctacagacctatgttaacggcataagaattgatattaatgcggtaaaaaacgggataaaattaaagtataataatggacttgccgaaggaagtgtcaacaaaattaaagtaattaagagaattatgtacggacgaaatagttttgatttattaaaagcaaaagtgcttttacacgagcactttcgctgtgaattcaactaacaatggaaagaacctattgagcgtttaccttaaataatctattactttttatttattcactttcacatttaaacgattcctgcctcggccattagctcacgcatgttatcaatggcacgtttcgcataaaaacgtggttcgttaatataatttgtaaccaattcaagtgttgcagttttatcataacctattcgtttcatttcatatagcatttctttaattggaatatttccctctcctggtatcatatgagtgtctgatccattttctccatcaataatatgcatatgatccatcttatttccgagtttatcaaaatatgccataatactttcatgctgtacaaatggtggaacaatatcacacatgccgactacatatggattatccactcttctaaatagctccaccaaatcatttgctcttgtaaagaaattagattcatacggtgttaaagcttcaactactagcttgatttctagttttgctgcataatctcccaactcttgaatatttttttctaatctgctccacaactgatcatatgtagcaagatatccgccgtttgcaggacttgtaagtacaaattccgcacccatctcttttgccatttcaagagacagtttcagataatcaacagcatctcttctctgagcctctgaaccaatcatataattgtaaggataggcattatgctccggtgtgtaaccaagcaccggcatttcatacttttcaattaatcggcgaacttcattaatatctcccgctttcagatccggtgcatatgcatgtggacgcccaccccaaagctcgatataatcataaccgtactctttagcatccataaaacaatgctccaacggattccgctgatatcccgatgtaaacattccaacttttaacattattttattcctccttgttgtgttttgttggtaaaattatataataattaagcaccatttttctattcgcaagaggtctaaaattcaattataaaaaatgtataaaattccataaccatgttgtttgttattccaattctataccaattatgttattctgcatgttttatcctctttattttctcttctttttatgcattatgcacatagtggtatgtttttgatttatatttataccagtttcatcagatacacttattttgctacttattttttagttatccatccaattgccaatgctttgtgcaccatgataacttataagtgttctaataaatagtgtgcaatatctgttagaacacttcgatgacttttattcataaggaacgagcattcagctttgatttttttgttgctggatatctgacctttctaaggttcatctgttatttgatgtcgcctcacttttactcttaatatctttattttcctatacataagttatgtctttacaaatatcattaatcattaggagttttaaataatatgtctgaatacgcagatcttattttattatcaaactgtatttttacagccacagaggaaatacctttctcttgatatattgctatcaaaaacgaccggatactttctatcggaaaaggattggctcctactgaactaataggaacaaacacaaaatatcttgattatgggaacaaaacaattacgcctggattctccgatgtacattgctttttcacaggttattctgtaggatttgttggaattgacttatccgcagctacttctcaagaagatatactgaattcaattaaagagtatgcgaaaggaattcctgcagacaaacctattttggaacatggttggaactccgatacaatccaacctgatggaacagatttgttagatgaggctttttccactcgccctgttcttctgtttgcaaaaggctgcgaaacttgttggatgaatcaagttgctataaatcgttatcagtttaccccggaaacctgttatccggagagttatgttcgctttttaccagacttacttggagataaagactttataattccggaatttaagcgctatattaaaatgatgaacagtaaaggaatcacttccatcaaagaaatgggattcgatgatttctacggatttactgacattctcgcagaactagaatccgaaaacgctttaactatccgcgtaaactttatgagccaacctgttgctgaaccttttaatctctcatatggcaaggaaatgcgtgaaaaatttaaaggagagtttgttcgtttttctggatataaccaaatgaccgacggttctataagcgaactttgcggtgatttgaaaaaaacttattcctgcgcagatacgacctgtgcacaagacattgattgagatcttttagcaaacgatacctttaaagctgataccgaaggatttcgtttctcattacatgctcaaggagatgctgctatttcaaaagtattagatatttatgactcttgccaaaaagatgaaaatggaaaacttataaatcgtcacagtattaccgatcttgaattcagtgatccaacagacttggagcgtatgggaaaattaggcgtaatttctgaaatataccctcaaattcaatctatcgcaaatcgaaaagacaaacttgccatgattgaagaaaagattggtatggatcgcggacagtattattggaacagacgtaaaatggctgacagcaatgtgttattaagttgcggaactgatcttccacttcttattgatgatatcccagaatctatttatcatgcagtcggaggatacttccctgaaggtggagagccatttaacaaacaaaatatgctgactattcctgagttgctaactgcatggagtgctggcggtgcttataatctatatcaagagaaagagctcggcacactggaaaaaggaaaaaaagctgatattgtcgtattcgacggaaatctatttgaaacagctattgaagaaattcgttctcgcaaagtagaagtaacttttctcaacggacgaatcgtatatagctatgaataaataaaaaaatatctctcttatctaaacagtttatattctctttaagaaaggaatggaaatatttatgaaagagtcttattttatggggattgatactggaacaaactctagtaaaggtgtattaatcaattctcacggagaaattatagcagaacatacaactgaacatgcaatgacaaatcctgcctcaggtcactatgaacatgatgccgacaaagattggtggggggatttatgtattataagcaatgcactgattgaaaaatccaaagtttcaccatctgacattaaagcaatcggaacaagtgcacttgatgccgactgcctacctgtcgacgatcagtgtcgacctctacgcaaagctatcctatatggtattgatgcacgtgcaaccgatgagatagaacaactcacagaaatgtatggggaagaacagatccgacagtggtacggacgtccattatgctccagtgatgtaatgcctaagattctttggataaaaaataaagagccagatatatatgcaaaaacccacaagtttctaacaggctctagttttatagcagcaaaacttactggtaattatgtagtcgatcgttttttaggacttgcaagttttaatccactttattttaatgatggaacaccaaatcctgaaacttgcctaccaatttgccgccctgatcagctagcagaagtgaatgaagcaaatgatatcgcaggttatgtaactgaaaccgcttcaaaggaaacgggtcttgcagttggtactccagtcattgtaggaacagatgactccggcgcagaagcaatcaacactggcgttgttgcccctggtaaaatgatgattcaattcggttcttccatttatatgattctcgggacaaaagaattggttgatgatgaacgcttatggcgtgaagaatttattgtaccaggactttgtgacatatctgccggcactaatgctgcaggctctcttactaaatggtatagaaatacaattttcccagatgcactcgagctagagcaaaatggtggtcctgatgcttacatcaccatgatgcaagatttggataaaattcctgttggaagcgatgaccttattacactcccttattttgctggtgaaagaactccaataaatgatcctcttgcaaggggaattctatttggattaacgcttgctcacacgcgtcagcatatgtaccgaagtgctttggaatctgttgcatactcagtaaatcagcaattaaagatcatgcttgagcacgatgttcctatagaccagatttttgccgtaggtggtggtgttaaaaatgacttatggatgcaaattgttgcagatgttactggtaaagaaatcagtacccctgccattactgtaggtgcgagttttggcgatgctctaatggctgcatcgggaatcaaatattcaggctttgaatctttcaacaaacttacagatttcattaaacctggaaaaacctatcatcctaataaagaaaaccatgaagcatataaaaaatatcagaatatttatgattctctttatcctgctactgtaaacttaatgcattgtttatcagactaatctttgtagattagactttataaagactatgtgataattctttcatcaaacaaaaagtacagctgtatgagtttttaataactcttctgctgtactttttaaatctattattttattcatgaagctgaattgtaaatgaagtcctgtcacttctgataaaagagcggctatacgcaatcgctctaccattattgtcccagtaatcacaactcaacataattaatgctactccatttggaatatctaataatttctttatcttactcgttccatctataatctccattgtttgctgcatactggaaatttctattccataaaatgcaaaaatatcttttattgtaaaaactgatgagttcactacttctaacttcggcaaaacatcttttggtacatatatatcttcaattgccaatggctcactatccaaagttatttgatgtcgtacacaaaagattaaatcatctggctcaatattaaaataatttgcatacttatttcctgctggtctatatatttttgcctgctcctttatcgaaactctttttgttcctgaagacattacattaacaaacccaccatgttcatccaggttttcttcgtatttatcaccaacaacaaaaacaccttttccctgaacacgtctcaaaattccttcattaactaatgtatctactgcgttgcgaacagtcaacctattaataccataagtttctgctaatttattttcagacggaattgctgttcctggaaggtactctccctcttctattcgatttctaataatttctctcaattgaagataaattggtgtacgataacttaattttccgtcttcacgctcttcattttcttcggtatagttcaatttattatccataaatctgccctgcttttctcattattcactctctattctgctaacaagcttgaatttatctcctctaattaattgtttataatacataattatcactccttcttcatctttcacaactccagatgtaaaaaacaaaggagaatccggtattatctccaacaacgctgcttcttgttcactggcatatgtaacactaatatgctcctcgcccgaaatctgctttctatgatatacatttttcaaaattcgacccatgctagttttatcagtataatacttttcaaaatctggatatcgttcacaatcaagatatgttgtttccaaaaaacatggaacaccatctatttttctaagaagaatatactcataaacctcttgtccgagcagaacatgaagtttcttagaaatctgtttagttgcttcaacttttcttacagaaataatcttttttgtcaaaatagatccctgctgtcgaagttctcctaccattgaatctactccaaccatgtttcgattcttctttcctacagacacataaactcccgctccattaattctatataacaccccacgaccaacaagtgtatctaccgcctgtctcagtgtcgttctgcttactccccacatttcacacaaatctctctctgatggaattcttgtattcggagccaatcgatttactacaataaaatcttccaatttttccacagcctcagttcccggtggtatacgatattccatattcttattctccttaccattgtttacagaccactttcaaatgtaagctaattctatcatctttttcttcgttttccaaccaaaacatataccaaactcaaacgattatgtgtttttaatattcatccgataatagcaagcttctttttcttctccggtacaagccccaaagcaatatacagcgactaatattatccataatcatgaaaaaccacaccatttttaaatcacgtccaaacataccaatataaatccatgtcaggcctatccttatcccccacattgttaatattgcaaatataaatggcatttttgtatctccaataccatgaaatataccctcatatataattaacgctgcatacataggctcactaatcgctacaattctcagtaatgacactccaagcacaataacctgctcatccttcgtaaagaaacgtataatcacttctgctccgcaaaaaagacctatggccattgctgtcataatagaaacagccacaataagtcctgaacgtacaaccgattctaattctaattcgtctttttttcccacagcatttccagcaagtgtactgactgcagtttgaataccatatcctggcacataaaaagcctgttcaattgtaagtgcaatcgaatgagctgctacacttagtgttccaagtcccgctactaatgctgaaaatacaacataaccacatcccataacaattctctctccaattaaaggcaaggaaacattaaaacaattttttaacaattttccttccggtttcaccttcattccttttagtgtcaccaatggattttgcattgcaacccaaaaaatagtaactccacctatcccttgactaattgcagtcgctatagcggcacctcttactcccaatccagctcccggaatactgagcaacattccaaatcctgaaatcgtagtatgagagctaattaaaagctgatttaatataatattcaaaaaattcacaccaatatttatataaagaggtgttttcgaatccttgtttgcccttaatacatttccaaatataatcaggcttcctctcaatatcaacggacagcttactataaaaaaatactcacttgcatctctccatatttcctgactagcgcccatccacattggcaacaccggactaattgctaaagcaatcactgtttcaatcacgccaagaacaaaaataatccaaattgcctgtgctgaagtatgatgagcagcttccaaatctccctgtccagtatattgggcaataaacaaaagcattcccatactaacagcaaacaaaattccatttaacaaccaatttacagtggttgtcagaccgacagcagcacttgcaatcgcaccaatctgaccaaccattgcagtgtctacataagctacaatggtttgtagagcctgttccagtattgtcggtgctcctaaatcccacaattcatgcatcgtcgttccaaaacaatattaaacaaaaaagatatttgttcaacacaacaaaacccaatgttatcactctaacataaagagaagtatacattatcgttacgtacatcctttgtttttagttttatattctctaaacaaatttttattttaatatgtactaaataatgaaatatgaccattgacatttatataagttgtgatattctatcgttatagtgtatcttattttaactacttatatatcaaaaaaaaattatggaggtgttattatgtcaaatatcacaatggatcaagtagctgttatgagtgtacaatattttcattatacactcgattattatcttaattccatgcatcgttgtggagttaaaaatctcgacttatggggagcatcgccacattattgcagattagattatctcacttcatctgccgccgaacgaaaacttcgtgagatcagaaaaagagctgaagatttaggacttaaatttgtaatgtatacgccagaaactttagcatatccctacagcttgagtgctcctgaacaacctattcgcgatcgaacaattgattactttgatatggctattgatgatgcacttactttaggaacaactaggttatttatgaattctggttgtggtcctctcgatattcctcgagaagatagttggaagcgtgcagttgaaacaattagtaaaatatgtgaaatggcgcataaacgtggagttacaatcttacttgaacaacttcaaccatatgagagtaatttgttggtcaacttgccacaaatgaaagctatgttggaagaagtcaatagtccagcattaaagacttgtgttgatttggtcgctatggaagtagcgcatgagaatcttgaagattattacaaggttcttggtgaagatactatacagtttatccattttgcagatggcgatccttccggacattatattctaggggatggtaattatccactaaaagaatacatcaaaattcttgaaaagcataactatacaggtattatcgatttagaaataaacgattcaatatattgggatgatcctcatagctcagtagaaagatctgttgattatctaaagaaaaatatatttaaataactatttacttaatttaaatataagcaaaatgggctgtaaaaaaagaataagtcccgaaaaaagaaagaccaagagttcataatgtggaactcttggtctttctttctgccgccataccaacgcacctttcccggtttgcctgcaatgtgtcctgcaggtcctttccatcacatttctttgcttaagaagattcagaaatcacttatgtatccaggtaaaagagaactcgcttgaaggatttattatatcctatatcggcggtattaattgtaattatcttattattcttttagcttttgttaaacctatctccagaaatctgttttttgactaagcccgatgtctgcgcttttaaaaacagggttaattcttttctttaactatgcttcataatcttggaccgctttaaatgcaatctctgataaaatcagaataaccggaatgttaatgagcgccataaccccatcagtacatcgaaaagatcccacaaaagagacatctccattcctgcgcccagaaagattacaagtgccgataccagtctgaagcctttcataaaagctttttccggctgtttttttccacaaattcaattccatgagtgttatgaattctttccagcaaatccggtatttcatccatatccacatctgaaacttcaccgcattttacacacctgacatggtaatgatttttcaatgtaaaatcgaacctattcggtccatccggaacttcaaccttccttaacgaaccctcatctaccaatatatcaagatttctatatacagttccttttccgattgtaggatatgcttcttttataaattcatacacttcatttgctgtaacatgtcttctcatttcgtatacggcatttcttacaagatctttttgaatggtatttctcctacttgtcatcagtcctcctcattaggatttattcttaataaggattatatatcattattattctattgtcaataaaaatagtaataattatcgttattataaaaactgccaaattgagcatcttttatctgaataactattttatttcgcgttcaaatacatcgtaacacctcctccagaacgaataatcattctgaatttagtatacttgtggatatcttaaatatacagaatcgcaaaaccaagttctaattctatagaactatattcaaagtttttctttgcatttacgtaaaaaaagcgttatgattgaatcagttaaatcacaggaggtatcaaatatgaaatcacataaatactggtccttaggcgcacttttctgtatgttgggatgcatttattctggaatcaaaaaatctatgactgcacataaatactttgcctattcttcattgctttgtatgggcatgtccatttattctggtcacaaacttgtttctccaaagaagaaaaaaatcactgaatcaaataatagtgagaatagttaaataaaaaattgacctttattcatcaaagacaaaggggctgttgcaaaatagatgagtaatcaatctatggagcaatagctccatttagtaccatataagtgtaagagataaagtataccattagtgctttatcttctgttcagaagttgaatagaagcctaatcttgtgttaaatacggatggataaaccaaaaccctggtgcgtgagcaacagggttttttattgcgatattttgtgatgatatcacagaaaataatctaccttttgcttataatgtagttagaaactaagtaaggaggtagtctaaatgagattaaaagataaagttgcaatcattacgggtggaagccgtggtataggatttgctacagctgataaattcttgaaggaaggtgcttcagttgtgttggcagcaagttcacaggaatcggcagatgttgctgtagataaattaaaagaaaaatatcccaatgcaatagttgctggaattagtccaaatctggcaagcatggagtctgtcagaaaggcttttaaagaggcaactgaaaaatatggatgtgtcgacatactggtaaataatgcaggaatttcagaaaacacctcatttatggattatacagaggagactttcgataaagtcatggatctaaatgtaaaaggagtatttaatactactcgtgtagctgcagaatgtatggtggcaagaggcaagggggtcattctctcaacttcttccatggtgagtatttcgggacagccaagtgggtttgcttatccggcatcgaagtttgcagtaaacggattgactgtatcattagcaagagaactaggacctaaaggtattcgtgttaatgctgttgcacctggaattacagaaactgatatgatgaaggccgtgccaaaggaagttatcgaacctatgattgaaagaattccattgcgtcgtcttggacatccagaagatattgccaatgcgtttgtgtttcttgcttcagatgaggcgagttacattacaggtgttatattaagtgtagatggtatggcaagaagttaagttaatgaggtatggtgatgtaatcacggaaaataaatgaaattaagactataataaatctacaaaaagaaaaagataaggaggactgtaaaatgtctgctattaatatcaataaaaataattttcagaacgaagtactgaattccgataaacccgttcttttagatttttgggcatcttggtgtgcgccttgccgtatggtagtacctattgtagaggagattgcaagtgagcgtagagatattaaagttggaaagattaatgtagatgaagagcctgaactggcaaataagttcagtattatgagcattccaactttagtggttatgaagaatgggaagattgtacagcaggtttcaggtgcgagacctaagaatgcgattttagaaatgctttaggggggtgtgctaatgggatttttcgatctctttaaacagtcgaatattaatcaaggcatagaagaatataaaaggactgatgatgcagttctgctggatgtacgtacaccgcaggaatatcaggaaggacatataccagaaagtaaaaatgtgccgttgcagcaacttgacaatattgcttctgtagcgaagaataaggatattccactgtttgtatactgttattccggttcacgaagccgccaggcaactgggatactgcaacgaatgggatattctaaagtaaataatatcggtggcattgtagcttactcaggaaaggtggaaaaataagatgaaggtaataattgtaggaggtgtagccggaggagctacagctgcagcaagaatacgcagactgaatgaacatgctgaaattactgtgtttgaaagatccggatacatatcctatgcaaattgtggacttccatattatattggagacgtgatcacagacccggaagaacttacactacagacaccagagagtttttttaaacgcttccgtattaacatgaaaattcatcatgaagttatctccatacatccggaacgtaaaacggtttcagtgaaaaatttagagaatggtgagatatttgaagaaaactatgataagctgatcctctctccaggtgcaaagccaacacagccgagacttcccggagtaggtattgataaactttttacacttcgtactgtagaagacacttttcggataaaggaatatataaataagaatcatccaaaatcggctgtattggcagggggcggttttattggtctggaactggctgaaaatttgagggggcttggcatggatgttacgattgtccagaggcctaagcagctgatgaacccttttgacccggatatggcatccatgatccataatgaaatgagaaagcatgggataaaactggtactgggctatacagtagaaggatttaaagaaaaagacaacggagtggaggtcctgttgaaagataatccatcccttcaggctgatatggtagttctggcaatcggagtcacaccagacacagtattagcaaaagaagccggcctggaacttggcatcaaggaaagtattgtagtgaatgacagaatggaaacctctgtaccggatatttatgctgcaggtgatgcagttcaggtaaaacattatgttacgggtaatgatgcgctgatttctttggcaggaccagccaataaacagggcagaatcatcgctgataatatttgtggcggtgatagtcgttacctgggcagtcagggaagctccgttatcaaagtatttgatatgacagcagctactacaggtatcaatgaaaccaatgccaaaaagtcaggattagaggtagatacagtaattctttctcctatgagtcatgccggttactatcctggtggaaaagtgatgaccataaaggtggtttttgaaaaagagacctatcgtttgcttggcgctcagattattggatatgaaggagttgataaacgtattgatgtgctggcaacagcaattcatgcagggctgaaggcaacccagctgaaggatttggatctcgcatatgcaccgccttattcctctgccaaagatcctgtaaatatggcaggattcatgatagacaatatagcaaaaggtaccttaaaacaatggcatctggaagatatggataagatttctagagataaaagtgttgtgttgctggatgtgagaactgtaggtgaatttaacagggggcatatggatggattcaaaaacattcctgtagatgaactaagggaacgtatcaatgaaattgagaagggaaagcctgtttacctgatatgccagagtgggctacgcagttatattgcaagccgtattttggaaggaaatggatatgaaacatacaacttttcaggtggattccgcttttatgatgcagtggctaatgaccatgcactgattgaaagatcatatgcatgtggtatggattattagaaataaataaaatatttttatagtttgattgtagtataaaaagatcccccatttattagaatgactttcataattctgataaatggaggattctttagagaaaaaaacgttttatgatctttgtagtgtttccagtcttttcgaatcaaggattgttattttgccgcgagagagtctgacgagtccttcgccttgaaagtatcgaagcattcgagtgataacttccctgtgggaaccaagatggtttgcgatagtttcgtgagtgattttcagttcatttgttccttcaatggatgtttcttctaaaagaaatgaagcaacacgcttatccaaactcttccacataatctgttcaatcagccacatgacatcagaaaaacgggtagccattaactcattggtatagtttgcgacaggagcagattctttcatgatgcccttatagatttcagcagggatgatccaaagatccgtatctttttctgcttcaatggttacttcaaattgaatagaccgcatgatacatgaggcggataaaagacacatatccatatcgaacagacggtaaagtgtaatctcccgtccttcatctgaaagtatgtaagttcgaagctgcccggatttaaccagtaataatccagtacagtccaggtttccattgtgaatgatcgttcctttttttacatcccgcgtgattaaattgtctgaaattagttttttctgtgctgtatttaagtcattccatagtggaaaataattttcgaagctcatagcagtcatctcctttacgaacatagtatacttgcttttttaagatgcgtcaattaaataattgacatatgccataaataaaaatatactgactatagtacatgacggttgtaaatatgagggagggataaataatgcatggagatgtcagttttacatttttggaccgaattgaagaagtagaactgaatattgtagatggacgatggcagtctgcactggcattggcattgactttgccagatatttgtggaggtattgctttcccggaaattgttaaacattatcgagatggtcgggttatgctggatcggcaaaaaaatccgactcgggatgtgggagcccagtatatccgttggtttgatgaatatgcaggggatcactttaaactatctcaatccgatgaaaagccatatatttgcggagaacgctgttggcagcttcggtgtgaatatcttcatcaaaacaaaggatttttaaatgatgaaaataatatacactttcatcttggattgaactgtggaatgtcagtttgtcagttggacagtatgaacatacaggagaacagaatcgatattcgtatagacatagaacatttttgtctgagaatgtgcaaggcagcaaagagctactatgataaagttaatttggaaaaagactttagtctctataacacaccagttttggattttattcaggtaacacaaaaaaagaaagatgcttctattattgcactgatttgtggcaatgaacactatgcaaaaggattaaaagaagcattgcagtttatttcagagcagatcatgctgttttacacaccggaaagcgctaaaacaaaattaggaaaacataagccggatctttggattgttaccgaagatatgacgagccaaccgaatcagccatggcgtgctgacaggacaacacctgtaattataatcacaggaaatcctgatgctgttgaaattaaaaagaattcaggaaaactaactgttctttctatgccattatcaatagttgatttgcggaaaaacgtcgaaatatatgtgtcgtgaggagaagtttatgctgtacataatactattatttgcaatcatagttatatatttgatgatgcttatgcggagacagaaagataagatgagcgaaattaaaatacaaatggatcaactgcaggcacaacatgatgaattgcagaaagaaagggatcagttactagaacagatgaatcatctggaagagcaacgagaacacttgcaaatacaaacagaccaggcatttcggagggctgatgaaattgaaaaaatttgcgatgagatatggcatcatgctaataccatccacctttattcttcgttagctgaagaagaaagcaaatctataacaatgaaagaaaaacaaaaagtaattattagaacaaccgaggagattctaaacatcatatataaatataaaggtaatgtataataaaaatatgtcattctagttattagcgttctaggtaaattcttatgtaataatgtcacagaaggatttacctttttcaggtacaatagagatacaaaatttgaaaggggaacaaagcattggcaaaaagagtggcaagtgtcgataaaaaaagatgtgttgcctgcggagtatgtgaaaatacttgtccgctggcagcggccaaagtttaccatggatgttatgctgtggtagaagaaacagtgtgtgtaggatgtggaaaatgtgcaaagtcctgtccggcaggttgtattgaaatgaaagagaggacagcgatgtgaagaaaaagaaacattggtatgattatttatggatatgggcgatcctttattttgctctcggtttttttaatgttttgttcgcttggtttgggatgattgatttcctgttgccgttaggaatagcaatattcggtgaaaataaatttttctgtaatcatttgtgtggacgtggccagctttttagtaagcttggtggagatttaaaatgctcaagaaataaaccaaccccgcgatggatgagttcaaaatggttccgatacggctttttgatatttttccttacaatgtttgggaatatggtatttcagacatatttagttggtgccggagcatcctccttgcgtgaagccatcaaattattctggaccttccgtgttccgtggggatggacatatactgccggaacagtagctgattgggtggcacagtttagttttggattttatagtttgatgcttacatctttgttattagggttgattgtaatggtgttatataagccacgaacctggtgtacattttgtccaatgggaacaatgacgcagggtatctgtaaattaaaaaataatgaaaagaagtaatactataaggtgattcataaaaggcatatgtcaaaaacattattgacatatgccttttataggactattatataagaaaagcgagaaaggagcagtttatgccgagaccagtaaaatgcagaaaagtctgccatttccccaatgttttagaatttcttccggcagatgatacggagaaaaaaacacccattgttctgacggtagatgagtacgagacaatccgtcttttggacaagaaaggttatagtcaggagcaatgtgcagcatctatgcagatcgcaagaacaacggttcaacgaatttacgggattgccaggaagaaaatagcagatgcactcattgatggatatccactcagaatcgagggtggggatttcagaatctgtgacggtcagagcggcaactgcagctttggaggatgttacaaacaggaaatttacaaaaaatatgcagcagaaaaaggagaaggtattatgagaatagcagtaacatatgaaaatggacagattttccagcactttggacacacagagacatttaagatttacgatgtagaggaaggaaaagtagtacattcagaagtagtagatacgaatggaagcggacatggcgcattggcaggagttcttaatgcattgaatgcagatgttttgatttgtggcggaatcggaggtggcgcacagacagcgttagcggcagcaggcatcaagcttttcggaggagtttccggagatgcagatgaagcagtagaagcttttatcaatgaaacacttgagtataatccggatgtgaaatgttctcaccatgagcacaaccacggggaaggacatacatgtggtgagcatggatgtggaagccacagctgccattaagaagaatagcaaaaaataatagtacgaaaggatgtgccaaggtaatgtagaagttaccgcagcacatccttttgtgttatgtgattctcatattgattatttcttacttgccgaaaataatgaattgaacgtataatactcccatctttttgtaactgtcaaagatgagagtatacttaatttattgagaagagtcaattatataactgacatatgctgtaaatagaagtaaaaaagtgtaataaagtaaacttttctgtgatatcatcacggaagcaagcacttatttggggtatattaagttcaaataggagaaggagttgaaaaatatgacatctataaatataaataaagaaaagtttggacaattaattcataaggaaaaaccggttttggttgatttctgggcaccttggtgtggttattgccgtagaattggagcagcttatgaaaaaataagtgatgaatacagcgatattcttgttgctggaaaagtaaatattgatgaagaaccgcagattgcagaagctgaaaagattgaggtgattcctacgctggttttatatcgaaatggaaaggcaatagattctattgttgcacctgaatcaaaaataatgatagagaattttattaatgaagcattggaaaaataaaaggaggactgctgtatgaatgaaaatcatgtttacgatatgattatcgtagggggaggacctggagggtatacttcagcattatacgcagccagagcaggacttgataccattgttatagaaaaattatctgcaggtggtcagatgtcattgacctggcagattgataactatcctggttttgaaaatggaattgacggattttcattggcagagaaaatgcaaaaacaggcggaaaaatttggcgctaaaagtgaatatgctgaagtttataatatggatttaacaggaaagcttaagagagtataaactagttcgggaatttatattgggaaaacagtagtgattgctactggagcaaatccaagagaacttggtctcgctaaagaaaaagaattgataggtcatggggttgcttattgtgcctcctgtgatggtatgttttataaagataagatcgtggtggttgttggtggtggaaattctgctgtatcagatgctgctcttttaagtcgaattgctaagaaagtcatcattgttcatcgtagagatacattacgtgcaacgaaaatctaccatgaccagctgatgaaaactgaaaatatagagtttcgatggaataatacagtaaatgaactgatttatggagaacgattgactggtgtgcggttgaaagatacagttacaggagaagaaaacattatagaatgtgacggcctgtttgtgagtataggaagaaaaccgacaacagattttttagataatcagatagaactggataataaaggatatattgtggcaggtgaaaacactgaaacgagtattccgggtgtttatgctgtaggagatgtcagaacaaagttacttcgtcagatagtaacagcagtggcagatggtgctatggcagtacatatggcagaagagtatgtggacctgactgtagcaatgtcaaacccctatctaccgtgttagattcagatgtttctgtaattctgttaatgcatctaggtcaatagatgttttatcatctgaataataccatgtaatcaccagacggtcattatacacatatatcttatctacaaaatattcaagcacctgatttcgtgtatcttcatcgtcaaaatctgctttcgcatacattacaaaatatttctttatactgtttttatcttcaacaagtgcctgtttcaacttttcagtttcaatggcttcttcaatgcccgtctttttgttctctacacaaacaaaagagttcaacgaaatcttgaggtgcttacaccactggaattccatgaacaaaaactaaaaaacgttgcataaataacccggtacataaactgtaccggggaagaaaaaattttcgttatttaatttgtctacttgacgggtagcacaccaaaacactagctttttctggctgcagttttccaaaaaagtgcaaccaaaaatgcaaccttctcaaaaaatgcaaccaaaagtgcaacccatatttggcaactgcccaatgggcagtgccaagaatgttaattatgggattttaaattaagatatacatgaaaaaagagaacagctttcgccattcttttttctacaaacttgaatttggctatttcgttgcaacaatacttatccaatgattttttgcatttgaatacgttttgatctctgtaaaacccgcttctttcaaagcggcaacaagttgtttagatgtgtaaatcttcataccattgatcatctttgtccatttttcatctgcggcattcgttccgtcactctcgttacaaatcaggaatatgccttcgcttttcagcacacggttgacctcggaaaagcattttactaatcctggccaaaagtaaactgtttcgaaggcagaaacataatcaaaagtcgcgtcagaaaagggtatagcagatacatctccttgaactacattacatttcccttgtttaatggcgagggcgttcaatttctgagattctgccacactaacctcagaataatccattcctgtcacgtggccatttctacatctatcaagccagaccgcaatatttgctccgccgccacagccgacgtccagaacttcagcatcagacttcgcggagatatttgagaatccccattgcgataatttggcgtgaccgctgttcatcatcttcgtcatcaattttccgccgaagccttgtggcttacgggtattttcaaaaaatctcattacagaattcctcctccacaaataccggttttcttaattcgacaaaccggtattgctcaatcgtttttctccgttaggagaatatacaatccataaataaaaagaacaaggaataaaaccgtaggaatcaataatccattttctaaaatacttacaatcattcttccaggtggcgttacccatgcagttgctggattttgcattgccgctattatcattcctacaataccaacaacaccacttaatgttaaaaaaccaccttttatatttctactcataatcattacctcctcgttaaataccgatttttcggatattgtatcataaatacttagtagcagcgacattatcacagtaacacttttattaattttacaggtacctgtatgatcagtttgtcacaaaaatgccttatatagaaaattgtcatacatataagccggaagttgtcacaacacaacttctttttatttgctgcaactccttactttgctaaattcataatacgttctgccatgttttctggatataatgtcgccatactggcgtgtcccatatttttcatttctataaactttacatgtagaaaatgttcttttacatatgctaaatcttttgctctttctttacgttctttatcaccgtaccaatattctaatttacccagatattctatagtaccttccggcatcctatagttgttgcatgattcaaaagttctccaaatggtcttataactgataaagcggaaaactttcgccatatattctaaatcttccttgctatattcatctgttgcaaacaccttttccagaaggctaaacccgcctgtttttcccatagaaatcagcagaaaatccttaacagcaatgaatcgagtaagtaaccatggcatctgatatggtgtgattccgccatcgcatattgtgttatttacggtaattttcttatctgcaagcattcttaaaacaatactacctcccatagaacagccatatagaacatcaatggtggtaatctttttttttactaaccactctgccaattccccggcgatattttccacgctggtaaaattttgctgtgaatcattttcatcatatcccggcaatgccggaataattacatgacaatccttttccaataaaggaattagatattcaaaaaaatcccacatcactacagatggatgtaccagaaccactgtctttgcattactttttccatattcatgaattgtcattccttatctcctgtatacttcccaatcaatttgataactcccgattttctcaatttccaaattggaagtttccattttcctgtacttatatttttcatcaaagcggctgcatcatttcaagaataatgccatccgggtctctaaaataaaaagctcgactttccccaaatccatctgccctgaaatcaaaatactgaggttcagacagacattctacatgattttcgacaagtgttttgtagacagaatcaatgtcatccgtgtaaaagcacacttctgagatagatgtcgtaaacaaatccgattttactttatggatttcgctgtctacaaactgaatcaattcgactggcggtgcttcaatagccttagaaccattcaaataagcaacccttgctttacaattttccttacggaacattttatctgtttctttgcccttcataaagacttcgccttgaaactcaagtccaagaatatctctatagaacgcaatagagcgatccaaatcagaaaccgttagtcctacatgataaattcttccaatcacctttatatcctcctaaaaaaatccgattttctattctctcacaaacaaacttgaattttcaaattagtctttgcaaataacctttgaaccttcaccatcaattacaattcagaagttgaatagaagcctaatcttgtgttaaatacggatggataaaccaaaggggctgtcggaagcatatttaccgacagcccctttctatatccggaagcgccatttcctatgtcggcaaaaagaacagaaatcgatcttggaatgtgttggtatttttgccgatgatgtgatatactatgtaatagattaacgtagttttttggatagattttatggcggaggatcatagatgcgatatctttcagttactgaaatagcgaaaaagtgggatgtgtccgagcgcagtgttagaaattactgtgctcatggacgcgtaaacggtgcatttcttaccggcaagacctggaacattcctgagaatgcagagaagccggagcgttccaataaaaagaaagagcagccaattatattgctggatattctacaggagcagaaggcaagtatgtattccggtggtatttaccataagacacagattgacttaacatataactccaatcatattgaaggcagccgcctgacccacgatcagaccagatatatctttgaaaccaacaccatcggtgtagaaaaagatgtgctgaatgtggacgatgtgattgaaacagcaaatcacttccggtgtattgatatgattattgataatgcaaaggcagctctgacagagaagtttatcaaagaacttcatctgatcttgaagagcagtaccagtaattccagaaaagattggtttgctgtaggcgattataaaaagatgccgaatgaagtcggtggcatggatactgcacttccggaagaagttgcagataaaatgaaagcgctgcttacagagtacaacggaaaagaagaaaagacttttgaagatatcctcgacttccatgtgaagtttgagagaatccatccgttccaggatggaaacggccgtgtaggcagattgattatgtttaaggaatgtctgaaatataatatcgtgccgttcattatcgaggacaatctgaagatgttctactaccgtggactgaaagagtggaacaatgagaaaggttatttgacagatacctgtctgaccgcacaggataagtataaggcgtatttggattattttagaattgcatattaaacgtgattcaaagtgaaaaatttgcgctttgagaaatgataaagttgaacaggtatatgaaaaactggaaaaacagataaatcatcagccgctttctgagttgtttggtctttttgctgttactaatgcggaaaaagtaattcttgagcgtattcaggaaaaacagggacagataaaagaatatttaaagaatattatggctgaaatagctctgataataaggaggagcgaatgatagatatagaaaaaatgggagtgagatatatggagcaattactgattgttgaagatgatatcggtttgaatcaagggttatgcaaagcgctgaaggcagatgctcggcagatcatttcctgtcaagacctaaaaacggcgaaggagcagctactttgcggcggtgtatccctgatcctgttggatatcaatctgccggatggcagtgggcttgagttgctccgggagatcaaggaaaacatgcccgggattcctgttattctgctgactgccaatgatactgatttggacatcgtagacggattggagagaggcgctgatgattacattaccaagcctttttctctttcggttttgcgggcaagggtgaatacccaactgcgaaagcaagcgtcaagccataaaaatgcgccgatttgtattgatctttttcaatttgactttgaggcgatgaccttttatgcgggagatttaaaagtggaattgagtaaaacagaacaaaaattactgcgcctgcttgttgaaaaccgaggtcgaaccatggcacgtggagaccttgtagaccggatctggacagatggcgcagaatatgtggatgaaaatgctttgtctgttacgatcaagcgtctgagggataagcttggtgcacagaaatacattaaaaccgtctatggaatcggttatagctgggtgacaaaagatgaatagaaccggcattgtgatcatactgctgtgttttctggcggcggtagctgttgtattatgggagcggagaaaggccagaaaaacaatggaagaaatcgaaaggatgctggatgctgccatgaccggctccttttctgaaaccaattttgatgaaagccggctgtctgctttggaaacaaagtttgcacactatctttctgccgcagaagcatcttctcgaaatgtagcgcaggaaaaagacaaaatcaaatccttgattgcggacatttcccaccagacgaaaacgccgatagcaaatctgctgttatacagcgagcttttaatggaggaagcgctgcctgtatcggcgaaggcaaatgtcgaggcgctgtacaaacaatcggaaaagctgcgatttttgatcgattctctcgtaaagctttccagactggaaaacgggatcatttcacttgcccctcagcaagcagcgctacagccactgcttgaaagcgtagtagaacaatataccgccaaggcttctgaaaaaggattgtctttgcaactgcaggataccgatgcttttgctgtattcgacttcaaatggacagcggaagcgctggctaatatcgtagacaatgccattaaatatacggagcatggcacaatcaggatttctgctgtaagttacgaaatgtttgcaaggatcgatatatcggataccggttcaggcatcccggaaactgagcaggcaaagatctttgcccgcttttatcgttcaaagtctgttcgggagcaggaaggggtcggcatcggcttatacctttcccgacagatcatatccggcgagggcggttatatcaaggttgcttccgttccaggaaaaggaagtgcgttttccatatttctgccgaaataacaacaattctttcaaaactgttagatttttttgcgccctcgcaagaatgtggaaagaatcctatgcgataatctgtatgtgtaaaaggatcatttcctttcatacatacagattttttcatggaggtactcatttatggaagttttacaggcaaaagacctgaaaaagatttatggctccggcaataacgcagttcatgcgttggatggagttgatttaagtgtgaagaagggcgaatttgttgcaattgtcggcacgtccggctccggaaaatccacgttgctgcacatgctgggcgggctggatcgccctacaagcggtacggtcatggtggacggacaggatattttctccctgaaggaggaagcgctgactatcttccgccgcagaaaaatcggctttgtatttcagagctacaatcttgttccggtgctgaatgtatatgaaaatatcattttacccattgaactggatggtggaaaggtaaacaagaattttgtgcagcagatcgtgcagacgcttggactgagcgaccgcttggatgcgctgccaaatcagctctcaggcggtcagcagcagcgtgtggcaatcgcccgtgctttggcggcagcacccgctatcattttggcagatgaaccgacaggtaatctggattccaaaaccagccaggatgtattgagtcttttgaaagtcacaagtcaaaaattcgcccagacaatcgtaatgatcactcacaacgaagaaattgcgcagatggcagaccgcattatccgtatcgaagatggtcggatcgtctccgagaactaacgggaggtggctacgatgaatgtcaaaaacagaaaatgtattcgaaagctcagcttaaaatctctttatgcgaaccgtcgccgcaatctgatcgctatttttgccattgcgctgacaacgctgctatttacttccatgttcaccattgtcttgtcactgaacgccagctatgaaacctaccagtttcggcaggtaggcggctatgcacacggcacctttaaggatgtttcccccgagcaggcggaacgcatcgctgctcacccaaaggtgaaggctacgggggtacggaaggtaatcggtatcactgcggagggggtctttgccaaaataccggcagagatcagctacatggatgccaactgtaccaaatggagctatgccaccccaactaccgggcggatgcccgaaagcggcaaagaggtggctatggatacgacagcgttgcagctgcttggtgtgacaccggaactgggcgccgaggtcacggtttcatattccatcacggacaaagatcaaaccgcctttactgtaacagatacctttacgctggtaggctattgggactatgatgaactaatgcctgttcactacatcaacatcagccgtgattacgcagatgacatcgaagcgcaggcagtgaaaacagggttacagcctttccgcaccgatttgaatgtcatgctggcctccggcacaaatattcaagggcagatggagcaggtggataccgatcttggctacacctgggacagctatactgatcccaacagcgtccggatcggcgtcaattggggatatacctcatcccagctggagtcgcagctcgatccagagctgataattgccatagcagcttttttgctgctggtgattttcacggggtatcttatcatctataacatttttcagatctctgttgcaggggatatccggttttacggacttctgaaaaccattggcacaacgccccggcagctcaaacgcatcattcgccagcaggcacttctgctttgtctgatcggcattccggcggggctgctactgggctacggcatcggtgctgttctgatgcctgttgtcttgcgctccaccaagttggatgcaggcatcaccaccatcagcacttcgcctgtgatcttccttggttccatgctgttttccctgttgacggtgctcttgtcctgttccaagcctggaaaaatggcagccaaggtctctccggtggaggctatcaaatatacggatgcaatgcagactaagaaaaaacagcgcagcacccggggggccaagctccatcagatggcctttgccaatctgggacgaaataagaaaaagacggtgctggtggtgttgtctctggcactgtcggtgacactgttcaatgcgctgtgtgcctttgtgggaggcttcagcatggagaagtatgtatcctccatgacctgcgccgattttatcgtcagcactcccgactatttccgtttcaacccggcagatgaattcatcacgccagaacagatcgaggagatcgcagcaaacacaaaggccagtctttccggcacgggatatgctgtgcgaaaaaccgcatacctgtggatgacggaggatgctctgcggcagaactatgcaaggtacgaaagcgccgagcagttagacagccatatgagccgcatggagcaccgggggaatatggtgatgggagatagcagaatcgaggctctggataacagcctgtttgacaagctgcaagtgtttgatggagatatttctcctatgttgaagccggacaataacgccattgccattgcggtttctttggatgattacggcaatctgcccaatcctgaatactaccccgaggttggagacacgatcacggctacctatgcggatgatgtgaaatatatcgacagccgcaccggagaactctgcaccgaagatacaccagaggagtaccttcaggcaaaattgtatggagccagagatgtagagtacacggtatgcgctttggtagaacttccgtattccatgggttatcgttatggtggtgatggctatgatgcagttttgtctgtggacaccgcacagagggacagcggtggtgcgaccattccgatgctctacctgttcgacacagcggacgaagctgacgaggccgaagcagaacaatatctatcgatgctcactgccggtgagttttcgcccttgatgtatgaaagcaaggccacggctcgctctgaatttgctcagttccggcagatgttccttctgatcggtggtatcctctgtactatcattgggctggtgggactcttaaatttcttcaacgccatgatgaccggtattctttcccgccgccgtgaatttgctgtgcttcaggctgtaggaatgacgaaccggcagctcaaaaccatgctgatctacgagggattgttttacgcaatgtcctccgtagcggtggcctttattctgtcgctggcggtgggacctcttgcaggaaaaatgctgggcagtatgttctggttctttgagtatcagttcaccgttctgcctgtcctgctgacaattccggtatttcttctgctggggttgctgatcccctgcatgatgtatgacaatgcagcaaaatgcagcgttgtagagcaattaagggatgctcaataactgttaagccaagggttggaaggcatagacggttagaaaataacccacgggattttatgcagatattacatgtaaatatagatgattttttggatgtaacatgatagaatggttacaacaaaaaaaggagaacacccatgaaaccaagaacagaaatcagcatgcagctctacaatctgatgatggaacgaggttacccggagaatttatgtgatcttgtcaccagaaatctgaataccgattatacagcaacaaggatgatcggatatttatcccattattctgatttgccagatgtagaagttgtggatgaaatgcttgctattttaagtgaccgtaacgagctgatcaagaaaaaagaatctgaacaggcacaggccagaatcagtgagatttacagatttggattagatattaaataaaagtggaatagataagaggggcaaatctgccccctcgattatttttgctctaaaatataagctaataaagcgtcgcaaccttcatttacgtctctgtatgttgcatcaaaattcccagtataccagggatctgcgatatcagcgcctttacgtgatgtgtaatctaaaagtttagaaaccttaccatccggatcacctttaagcatgcggttaagatattttatattgatcgaatccatacctatgatataatcgaaattatcataatcggaaaatgtaatctgttttgcacgatgtggtactaaaggaattccaacttcttttagtttgtttactgtacctctatgcggtggatttccgatttcttctgtgcttgtcgcaaaactgtctattacaaactgatcactcaaccctttttcttttaccttataggtaaacacgctttcgcttaaagttgatctgcaaatattcccccaacatacaaatgctactcttattttcatgatgtacctcattcttctaataaatatactggaaatatttctccctgtctcttatgcctccaatgcataggaaagaagctttttcaaattgtgatgaaactgacgtttatatgcatgtagttttttcttctcagaaacggaatagtgtttctccacgtagatatcatatcgtttgaacaaacttcggaaatctgtatcctgcctttgtccccaacgaaccagcacccagttcatggcatctatattccagtattcgcttggaattcctgctattttcaatgtggtaatctgacgcattgcctgcatggataggcggctgagctggcgttcacggtgcatctcatccggatcatttttcccaagctttttcattaatttttgagagagtgtctttgttctggaagcacgttccattacacgaacactttgatcaatgatatcctggagctgcacggctgcattccagtaagtcacgaaagaaacggattctttctcatcttccggcgtaagtttaaatgtcttaaaaacacggtctgtaactccaaaaatttccagattataagcttttcttttcgccggattggaaagaacccggtaggcttccagaatctcctgcataaaagcagttgtatctatatctttatgcatattggcatccggatggtagaccttagccaatgcatttttcgctgaagtaatttcttccagagtcgcatctctggatacacctaagatatcgtaataagtgcgtgagctcattttgacctcctaatattagattccatctttctgaaatcatagaaaatggacagtacttctaatatacgcctgtaaaattgaaaagtcaattctctccagacatatttccccttcatcgctactatactggtaaaagaatagtccatgggggaattgcagatgaagaaaggttttacagtgattctgctgagtgtttttctgctgtataggattacatttccgacaactgtagtccacgcggaagaagtagaaataagtgcgccgtctggcattcttatggaaatgtctacgggaacggttttatttgaaaaagatgcagatactgcgcggccaccggcaagtgttacaaagatcatgacaatgttgttaatctttgatgcattagaaaacggaaccatatcacttgatgatgaagtgtcaacttccgagtatgcagcttctatgggaggatctcaagtattcctggaacctggagagatgcagacggtaggtacgctgctaaaatgcatttctatcgcaagcgcaaacgatgcatgtgtaactatgagtgaatgtatctgcggtaatgaacaagaatttgtaaaacaaatgaatgagcgggcaaaaggacttggaatgaaacatacaaacttcgtaaactgtaacggattagatacagatggccatgagatgagtgccagagacattgcactcatgtcgcgggaactgatgaccaaatatccgcagataaaggactactgtacggtctggatggaaaatatcacgcatacaactgcccgtggatcttcagaatttggcctgacgaatacaaataaactgatccggcagtacgaatatgccactggtctgaaaaccggatccaccggaaaggcaaagttctgtgtatcagcaacggcaagtaagaatggtgtggatctgatcgcagtaattatgggcgctgaagattcaaaaagccgttttaaggatgcggtaaccttattgaattatggatttgggaaatgtcagatttataaagcaaaagaacgaaaactgccagtggttctggtgaaaggtggcaaagaagatcatctaaagattcaatatgaggaaggatttacttatgtagatacggaaggatccgatttatcgaaagtcgaagaagtaacagaaattccagatgaagtaaaagcacctgtgaaaaaaggggaaacagttggtcggatttgttatcggataaatgggaaagaaattggatccacaaatctgatcgcttcaacacctgtggaaaaggcagattttggagattatctaaaaaagatttggaagaaattattataacacttgtcgggaacatggaaaatgttttataataaagggtacgaatgcgggtagctcagaataattttcagtctgttttatgaaattttactacccgcaatggatataaaaatacaggaggcagattaaattaatgattacagaacgtattgatcatacattattaagagcagatgcaacagaggaagatatccgtggattatgtgaggaagcagttacgtacggatttcattctgtttgtgtgaattcaagttgtgttgcgctttgtgcctctcttctgaaaaatacaggaattaaagtatgtaccgtgattggttttccgttaggagcaatgtcaacaactgcgaagattgcagaagcaacagcagcagtgaaagacggcgcagaagagctggatatggttatccatattggagcattgaagagtggaaactgggattatgtaagaagagatatcggtgcggttgtagctgctgccggggatgacgtgattgtaaaggtgattcttgagacatgtctgcttacagacgaagagattcaggaggcttgtcttgtaagccgtgatgcaggtgcagactatgtaaaaacttctactggtttctcaaccggcggagcaactgtagaagcagtttctcttatgaagcgtacggttggctcagacatgaaggtaaaggcatccggtggtattcatacactggaagatgcacggaagatgttttatgcaggtgcagaccgtattggatcaagttccggtgtggcgattgcagaagctgagatgtccgagatacatacgatatgagcatcttaggttttttcactgttctttttccgattgtgtgcgcggttatattagcagaaatgtatcgggagcagcattctttttgtgtaacacattacgaagtacattcaccaaagataacctgcacagccgaaaaagactcagtgaacagaattatttttttaagtgatatgcacaaccatgtttatggtaagcagaacaataaattgttcgaagctataagagcagaacagccggatctgattttaattggcggagatatgctggtagcaaaaaatgacgttcgataccaagaggcactggattttgtcagtcgtctgccgcagctctgcccggtttattatgccagtggaaatcatgaacagagaatcaaagagaatccggaaaactattctttgtgttatgaagagtatcgtaaaaagttacaggcagaaggggttcgttttctggaaaatgaaagttgcgatattctgttgggaaatcaacagattcatatcagcggattggaactcccactgattgtgaataaaaaattccgcaaggcggatgtcaccgctgaagatgtacgcagatgcctgggagaaaatcatactacaggaaatcaggaaaaacagcaggagacaacagagaatttcgcagacaacagttatcatattctgcttgcccacaatccatcctatatggaagcttataaggaatggggttccgatctgattttgtctggacatttacatggaggatgtgtacgcttgccgggaattggcggcgtgatcactccgcaggcatttctttttccaaaatattcaggagagatgaccgtggagggagaacagacgatcatcgtcagcaaagggcttggaacgcatacatttaatgtgagactgttcaatccggcagaagtgattgcaatcaccctttgcagataaaaggagattattatgggaataccggtaaaactggaagtatttgaaggaccgttggatctgctccttcatctgattgagaagaataaagtagatatttacgatatccccattgtggagattacgaatcagtacatggaatatatccgtcagatgcaacgggaagatctgaatgtgatgagtgaatttcttgttatggcagcgacgttgttggatattaaatgcaagatgcttcttccaaaagaagtcaaagaagacggagaggaagaagatccaaggcaggaactggttgaacagctgctacagtataaaatgtataaatacatgtcttatgagctcagagaccgccaggtagatgcggatctgattttatataagaatccgacaattccggaagaagttctggaatatgtggagccagttgatcttgaccttttacttggggatctgacaatggtacagttaaagaaagtttttcaggaagttatgcgtcggcagacagataaagtggatccggtaagaagtaaatttggcaagattgagaaagaggaagtttcactcacagataagttcctttatgtgcgtgattatttacaggaacaccgccggttcagtttccgtcagcttcttcagaagcagaagagtaaaatgcatgttgttgttacgtttcttgcgattcttgaaatgatgaagctgggtgaaatttatgttgaacaagaatctacttgtggtgagatcatgattgagagaaaaggagacgtagtgtaaatggcaggagtaaaaacacttcaggctgcaattgaagctattttatttacaatgggagagtctgttgaactaagtaaaattgcgaaagcaatcgaacaggatgagcagacaaccgaagaattacttcaggatctgatgaagaaatacgaatcaaagaacagaggaatccgcatcattgaactggacaagtcttatcagatgtgtacaaagaaggaaatgtatgactatctgatccgtgtggcaaagcagccaaagaaatatactctgacggacgttcttcttgaaacaatgtcaatcattgcatacaaacagccgatcaccaagatcgaggtggagaagatccgcggagtaaaatctgatcacgcagtaaataaacttgtggaatatggtctggtagaagaagtcggaagacttgatgcaccgggaagaccaattcttttcggcacgacggaagaattcttaagaagattcagtgtaccgtcgattgatgatcttccgtcattgaatcccgagcagctggaacatttcaaagaagaagcagaagatgaggcaaagatccgtatggacatttaatttttgaattctacaacttgcattggaatcataaaattaaaagaagactggagcttctaatataaacaggaaatcaattgatgatagaatttaaaaagtggtatttcagaatctatttattctttgttcgcatactgattgtcagcatgatcattggaatttcttttccggttcatgtttttggaactacatctgatcatgcaggacaaaactggaagataaatgtcagttctaacgaacgtcaggtagttccagatgagctaaaacaattatacgccctgtctgccgtcttaatggatgcagacagtgggcgtattttattttccaaaaatggacaggaagaacgggcaatggcaagtacaacaaagattatgacttgcatccttgcattagagagcggcataattgattcagaaaatcagattgttacagtaagcgatcaggctgcggcacagccaaaggtacatcttggaatggttgcaggagaacggttttatttaaaagatcttctttattccttaatgctggagtcacataatgactctggggttgcaattgcagaagctgttgccggaagtgtagagaaattcgcagatctgatgaaccaaaaagcgcggacgatcggctgttattctacttattttatcacgccgaatggattggatgcagcagattcaaatggaatccatcacactacagcagaagatcttgcaaggatcatgcgttattgtattatgaattctaagaaacaggaagaatttcttacgatcacgcgtaccgaaacctatcagtttcaagatgttgaaggaaaacggtcgttcagctgttataatcataatgcattcttaaatatgatggacggtgctctttccggaaaaacaggatttacttcagatgccggatattgttatgtcggtgcgctgcgtagagatgagcggacatttattgttgcactccttgcctgcggatggccaaataataagagttataaatggtctgatatgagaactcttatgacttatgctttagatcattatcaatataagacatttgaaattgaattacctgtccggcagatatttataaataatgggataaaagcacattcagatacgatagcttatcccggtaaaaacggaaccaagatttctcttactgcaaatctgacacctgtttctttcctattgaaagaagatgaaacgatttctgttgactatgagattcctgatcagttggatgctcctgtaaggaaaggaatgcaagtcggcaggattcgctgcacgttaaatgacaaattgatccgtgaatatcccgtctatacaacacagaatgcagaaaagagaaccttcaaaaaatgtgtggaatatattttccacctgttttctatacaaaattcgtaccaaaaagcaggaaatattaaaaaagatcaagtgaggtgattaaaatagtcactacaatctaagactttcctgtgctaatataaacgagtgttaaaaaacaacaactaaattgattaaatataagagaggtacacattatggaaaactggaggaaatacgaaaagacttactttatgccacctgagccatgttatgactgggtaaagaaagattcaattgacaaagcaccaatctggtgcagtgttgacttgagagatggtaaccaggcactgatcgagccgatgagtctagatgaaaagttggaattcttccagctgcttgtggatgtaggattcaagatgatcgaagttggatttccggctgcgtctgagacggaatatcagtttttaagaacattgatcgagcagaacatgattccggatgacgttacgatccaggttctgacacaggcaagagagcatattatcagaaaaacatttgacgctgtcaaaggtgctccacatgctattatccatgtatataattcaacatctgttgcacaaagagaacaggtatttaagaaagataaagagcaggtaaaacagattgcaattgacggtgcaaagcttttgaaagagttagcagaagaaacagatggaaactttacattccagtacagtccggaaagttttcagggaacagaagttgagtatgccttggaagtctgcaacgcagttcttgaaatctggcagccaacagctgacaacaaagcaatcatcaacttgcctacaacagtggaaaatgctatgcctcatgtattcgcaagtcaggtagagtattttaacaagcatctgcgcgacagagagaatgtaattctttctctgcatccgcacaatgacagaggatcaggagtttcagatgctgagcttggaatccttgccggtgctgataaaattgaaggaacattgttcggaaacggagagagaacaggtaacgtagatattattacacttgcaatgaatatgttttctcagggtgtgaatccgggacttgatttctctaatatgagtgacatttgtgaagtctatgaacgcgtgacaagaatgaaagtttctccgcgtcagccatatgcaggagatcttgtatttacagcattctccggttcacatcaggatgcgatcgcaaaaggtatgacctggagagaggagcatgactgtcagacatggactgttccatatctcccgatcgatccacaggatgttggcagaagatacgattccgatgtaattcgtattaacagccagtcaggaaagggtggcgtaaactatatcctgaagcagagctttggaatcagcttaccggaaaagatgagagaagaagttggatatcttgtaaaagatgtttccgacaaggctcacgaagaactcacaccagacaatgtatatcatatctttgaagaccattacatcaatgcgaaaccaattttcagtgttgatgaatgccactttaaacaagaagatggaattgtcgcagaagcaacgattcaccacaatggaagtaaccgcaagatcacaggtgttggaaacggacgtctggatgctgtcagcaatgcgatcaagcattattttgatatcgaatttgaacttgcattttacgaggagcattctttgacaaaaggatcttcttccagagctgttgcttatgtcggcgttatttccaacaagaagcgttactggggtgtcggagttgatgccgatattatcaaagcatctattgaagcactcgttgttgcagtgaataaattggatagcgtacagagatcccagacatgcaaggatgaaagattattagatattacaaattatatttacgcaaattataaagaagttacattggatgatcttgctgagaagttcttcctttcaaaaccatatttgtcaaaatatattaaagaaaaatcaggaatgacattcggagatattctgaaagaaatccgtatgaaaaaggcaagagcaatgcttaagagcagcagtgcaactgtagaaagtattgcagaatctgtgggatatcagaatgtagagcattttaacagaacatttaaaaaactgtataatatcacaccggtacagtatagaaacaaaccttgatcccgattcgagtttgactaaatttagaaatgtaatcttaaaacaaatcgcctgacagttaccataagtagtagctgtcaggcgattactgttatgcagattcattattctgctaattcttcccacaattcatacaattcttctaatcttgcttcatttgcagcgcgttctgttgaaagtttctggcactcaatagagttcgaataaacttcctctttcgtcagttcctcgtcaatctctgtgttgcgatcttcaagttttgcaatttcttcctctgttttcttcaactcatttttacgtttacgttcacgtgcctgctgttccttctgttcctgccagcttaattttgaatccgaagcaggagtggatgcagcagaattgcctgaattggatacattttctgcattcgtttcatttccagaagcataagcaagtgtcagtgcttcttttttctccagataataatcgtagtttccgatgtaattgacaaatgtctgattcaccagttcaaggatacgggaggcggtctgattgataaaataacggtcatgggatacataaagtatcgttccgctgtagttatttaatgcttcttccagaatttctttggaagtaatatccagatggttggtcggctcatcaaggattagaaaatttgcttccgaaagcataagtttggcaagtgatacgcggcctttttctccaccgcttaacgtatgaatctctttgaacacttcatctccggtaaactggaatgcagcgagtgtatttctgatctgtgtattggtaagatcaggatagtcatcagaaatctcatcaaaaatggtcttatcatcatgaagtacgtgatgttcctggtcgtaataaccaatcgtcactttggatccaagtgtgaattcgccctgatccgctgcaataacctgattaatgatctttaaaagtgttgtctttccggttccgttgtcaccaatcacagcgacatgttcgccacgtttgatttcaaaactgatatcactgaagagaacctgactgtcaaattgctttgagagatgttccactgtaagaacatcatttccgctgatctgcgatggttccagcgtaaaatgcatttctttcgtactgtcaaccggtttgtccaatggcgtaatcctgtcaagcattttctcacgactctccgcacgtttgattgatttttcacgattgaaagactttaatttatcaataacagcctgctgatgtttgatctcacgctgctgattcatgtattctttcagctgtgcatctcggatctgctgttttttcattgcataatctttataatttccaaggtacatgcgaacctgtgcattgtcaatctcaacaacttttgtgacaacacgattcaggaaataacggtcatgggagacgataaataccgctccggaataattgatcagatatgtttccagccaggcaatggaattcagatccaagtggttggtcggctcatcaagcaggaggatatccggacttgtaagcagtaattttccgagagaaacacgggtcttctgacctcctgaaagtgtatctgtctgtttattaaaatcgtcttccgtaaacccaagtccctttaatacacctgtaatctcactttcgcaggcataaccgtttcttgcatcaaattcagactgtagacgattgtaggtctccaggcggctctgcaattcctcaccttccagatgcttcagttcatgttcaatggaacgaatctgagcttccattgcaaaaatatccgcttttgcactttttacttcctcataaatggtatttccggattttaaatcctgacgctgcgcaagataacctagcgtctttcctttcgcgagaataacctctccaccatcaagaggttcttctccgatgatcatcttaaggattgttgatttcccggcgccattcacaccgacaagagcagctttctcacgatcttcaatatgaaaggagccgtctcgtacaatttcgcgttccccaaacgctttttctatattgtgacatgcgagtatcatatattttcacctcgttttttgacttctaacattatcattatatagaaaaatgtcgaaaatacaaggaaaatatatggattttaaaggtttttgcaaaacaaaagtttgacagaactttaactcttttatataataaagagtagtttaagagtggagggctaaaaattggaacagagaaagatatcacgcgcagtcatttccagacttccgaggtactacagatatctgggagatctgctggaggctggcgtagagagaatttcatccagtgacctgagtaagaagatgcatgtaacggcttcacagatacgtcaggatttgaataatttcggtggattcggccagcaggggtacggatacaatgtgaaatatctttatacagagattggaaagatcttaggattggatagatgtcataattttattatcattggtgccggtaatttaggacaggcactggcaaactatgcttccttcgaaagaagcggatttattctgaaaagtcttttcgatgtgaatcctcgactggaaggcgtaacgatcagggggattcctgtacgtatggttgatgaactggaagattttcttaagaataatgacattgaaattgctgcactgacacttccaaaatcaaaagcaattgaagtggctgatattctggtagataacggtgtgaagggaatttggaattttgcacatacagacctttcccttccaaaggatgtggtcgttgagaacgtacatttatctgacacactgatgaagttatcttacaacctttgtcagcaggataaagaatagaatctagcaaagctgcaaggatgctgtgggaccaactgacaaaaggaggtttcgcagcatctgttcatgttaaaaggaattaataatgatagaaaggtcaggcgataagcatgagatatcttccaaatgggaagcagatgagtgaagctgatgcacacacaattcatgaaattgggattccatcccttgtacttatggaacgtgcagcacttcagattgtcgagacaatgcataagaaaaatatttccacagaaaaaagtctgattgtttgtggaagcggcaacaatggtggagacggatttgcagtagcaaggctcttaaccgaacagggaaagcatgcagatgtactatttgcagggaaagaagcttctttaagtgaagaatgtcgatgtcagaaacagattgtagaaaatatggggatttctgtattcacagaattcccggatgaagaatatactgtaataattgatgctgtatttggtgttggactctgccgtgaaatcacaggacattataaagatgtgatcgactggatgaatcttcaggatgcagaaaaagttgctgttgatattccatccgggatctgtgctgcaacaggaaagattcttggtacagcatttcgagccgaccttacagtatgtatggcatgtgtaaaattaggctgtgagcttttccctggcaagtcgtatgcaggagagagcattccggttgcgattggaattgatccaaaatatttttcgaatcgcccggatgtttgttatacctttgacaaaaatgatcttggaaaacttcttccttcgagaatgatgaattcgcacaagggaagttatggaaaagttcttatgatcaccggaagtcccgggatggctggtgctgcatttctttctgcctgtgctgcctatacagttggtgccggtctagtacagatttatacagcaagtgaaaaccgtctggcactgcaggaacttcttccggaggcaatcatatcctgctatgattcttatgatgacagtcaactgtctcatcttcttgactgggctgatgtggtttgtattggctgtggacttggaatgggacagatttccgaaaagatattgaaaaatgtattgaaaaatgtatcttgtccatgtgtcatagatgccgatggacttaatttactgagcagggatatagagttattaaatcaatgttgtgcacctgtgattttaactccacatatgaaagaaatgtcaaggctgaccggatggagtattgatacgatcatcgaagatcgcttccaggcacttgatcagatcataaaacaatccggaccggatacaaaatcatccataatctgtgtgttaaaagacagtcgtactgttgtcgcacagacaaatcggcagagatttgtaaatctcgctggtaataactctatggcaaaaggtggttccggagacgttctcgccggaacgattgcaggacttcttgcacagcatatggcaccatttgaagccactactgtgggagttttcctacatgcctgtggtggagatgaagcgaaaaagagcaaaggaagttacagcgtattagccagagacctgattcagggtatggccgatgcaatgaagaatgcaaaggagtgcagataaattatgaaacagtataacagagtatgtgcccggatcaatctggacgcaattgcatataatatggaacagatgaaaaatcgcattggtcaggagggacgtttaatagctgttatcaagacggatgcatacggacacggagcagttcctcttgcggaaatgtttgaggaaacgccttatatctggggttacgctgtagcatgcatgggagaagcaagaactttaagagcacatggaatcaagaaaccaatcttgattcttggctgtgtttttcctgatgagtatgaagaaatggttgaaaaagaaatccgtgcagcagtttatacagaagagatggccaagggaatggctgatgctgccgtaaggtcaggaaagaccgcatttcttcacataaaaatcgatacaggaatgggacgaattggattcaaagtaagcaaagagagtgttgagacaatttctagaatcagcaaacttcctaatattaaaatggaaggaatgttcacacactttgcaaaggcagatgaatttgacaagtcttatacatttgcccaacatgaaaaattcctctggatgaaagaacagttagaaaaaaatggagtccagatctcctattatgattgtgataacagtgccggaattattgattttccagatatgaagcatgaccttgccagagccggaatctctatttatggaatgtatccgtcagatgaagtgaaaaaagatgctgttgatctgaaaccggcactggaattaatcagccatatcagctttgtaaaggatgtggaaaaaggaacttccatcagttacggtggaactttcgtcgcgccaaagaagatgcggatcgctacgattcccgtcggatacggtgacggatatccgcgttccctttcaaataaaggctatgttcttatccatggaaaacgtgcagatattgtaggaagagtctgcatggatcagtttatggtagatgtaacagagattccggaagcaaaattcatggatccggttactctggtcggaaaagacaaggacgcaattatccgtgtagaagatctttctgatctgagtggaagattcaattacgaatttgtctgtgatctgagcaagcgtgttccgagagagtattataaaaacggtacgatcgtaaaacagattgattatttcgaataaccggaataattgaaagaatccggttgatatgcatacatccgataaaaccggagatactttagtatgttcttagaagaaaaacaaaaggttctgagaagaatcagagaacaaatacgaaaagtaactggaatatcggagtgtgaatgaattgataattaagcggggcgacatttattacgcagatcttagtcctgtcgttggttccgaacaaggtggaatccggccggtacttataatacagaataacataggcaacagacatagtccaaccatcatctgtgccgcaattacgtcgaagatgaataaggcaaaattgccgacacatattgaaatctgtacaaatgattataatattatgaaaaattcagtcattctgctggaacagatccgaacaattgacaagaaaagactgagagaatatgtctgtcatatcgatcaggaacgaatgaaaaaaattgaccaagcaataagaatcagtctggatcttactacataaatccaaccaaattctttacagaacaaaaaaagcgtggtaaaatcataaggatagtgctttacagaacttagtgtgtatctgtgaatgcaaatgaatttatataaaatacattgatacaatagaaaaggagaatcagaatatgtcaggacattctaaatttgcgaatatcaagcataagaaagaaaagaatgatgcagcgaaaggaaagatttttacaaagatcggacgtgaacttgcaattgctgttaaggaaggtggaagtgctgatccgacaaacaacagcagacttcgtgatgttattgcaaaagcaaaagcaaacaacatgccgaatgatacaatcgagagaaatatcaaaaaagctgccggagaaggaactgctgataactatgagcgtattacatatgaaggatatggaccgaacggaaccgctattatcgttaaaactcttacagataacaagaaccgtacagcttccaatgtaagaaatgcatttacaaagggatgcggaaacgtaggaacacctggatgtgtatctttcatgttcgatgaaaaaggacagatcattattgataaagaagagtgcgatatggactctgatgatcttatgatgactgtacttgatgcaggtgctgaagactttaacgaagaagaagacagctacgaagtattaacagcaccggaagacttcagtgatgttcgtctgaagatggaagaagccggaatccctatggtttctgctgaagttacaatgattccacagacatatgttgatcttacaaaagaagaagatattaaaaacatccagaaaacacttgatcttcttgatgaagatgatgatgttcaggacgtataccataactggaacgaataatcagttataagaaatgggggacaatgatgagtaattacaagatggaaactaaatgtgtacagtccggttacaatccgggaaacggtgaaccacgtgtgctcccgatcatacaaagcacaacattccgttacaccagcagtgatcagatgggaagactttttgatcttgaagagtccggatatttttatacaagacttcagaatccgacgaatgatgcagtagcagcaaagatctgtgatatggagggtggagtagcagcaatgctgacttcttccggacaggcagcaaacttttatgcgattatgaatattgctgaagaaggtgatcatatcgtatgcgcatctgccttgtatggcggtacatacaatctgtttgctcacacaatccgtaaaatgggtgtgaaagcaactttcgtagacccagactgcacagaggaagaactgaatgcggcatttcaggagaatacgaaagctgtttttggagagacgattgccaatccggcattgactgtttttgattttgagaaatttgcaaaagctgcacatgcacatcatgttccgttaatcgtagataatacatttgcaacaccgattaactgtcgtccttttgaatggggtgcagatattgttactcattcaactacaaaatacatggatggacatgcagcctgtgttggcggtgcaatcgttgatagcggtaactttgactgggctgcttacggagacaagtttgccggacttacaacaccggatgagacttatcacggaattgtatacacagaaaagtttggtaaagctgcttatataacaaaagcaacatcacagctgatgagagatcttggatcgatccagtctccacagaatgcatttcttctgaaccttggactcgagagtcttcatttgagaatgccaagacattgtgagaacgctgtaaagatggctcagtatctccagggacatgagaaagtagcatgggttaactgtccgtcacttccgggaagtaaagattatgacctcgttcagaaatatatgccggatggaacatgcggtgttattacttttggattaaagggcggaagagaaacagcagttaagatgatggacaaactgaaactggttgcgattgtaactcatgtagcagacgcaagaagctgcgtacttcatcctgcaagtcatacacacagacagatgaatgagcaggaactgttggaagcaggtgtacagccagatctgattcgtttcagtcttggaattgagaatattgaagatctgattgccgatgtagaacaggcactggaagattaatataaataacatatgattcaggaggtatggattcccatgattttgtatccatatctcctgttttttgtatccgaattgtaggttttaaacagtaattagctcttttgcttaaattgtggagattgatatgcggaattggatacaatacatatttccccgtattctgtgcattctagtaatagtatttatttactttcaacaggaggcatatttatatgagcgaggaaaaaaagcaaaaatcagatgaaatcaaagaatttggtgcgttaatgttaaatgaaaataaaaagaattacaaaattcgtcttctgacaattataggtgaaattgaaggacatgaaacagtatcaaataataccaaagcaacaaagtacgaacatttacttccacaactggctgaagctgaagaaagcgatgaagtagagggggttcttattttattaaatacactgggtggagatgtggaagctggacttgcaattgcggaaatgatagcttctttgggaaaaccaaccgtttctcttgtccttggtggaagtcattctattggcggtcctcttgctgtttcggcagattattcctttattgtaccaacaggaaccatggttgttcatccggttcgttcaaacggtacttttatcggtgtgacacagagtctgagaaatatggaacgtacacaggacagaattgccagatttattgctgcacactctaaaatcacagaaaaacgtcttgttgatctgatgttgaaccctacgcagcttgtaaaagatgtaggaacactgttagaaggagaagaagctgtaagagaagggatcatcgacgaagtcggaggcattcaccaggcatttaaaaaactctatgaattgattgatgaaaaacgggaaaaaccttcggaaatgtaaatatagaacaaaaaaatggcatctgatcaaagaaattttgtaatgacatgaattttaattgatgttatacttgaaatagtatgtattcaatctatcgtttgattgaatcagtacaatggtataataattaagggggaatcagatggctgcaaaatctacaaacacgaaaaaaagttctacgaacaacacagcgaaagcagcaaaaaatgcaacaactaagaaaacatcgacagcaaaaaaagcttctgcctccacaaagaaaagttctggcagtaagacaaaaagaacttcaaatcatataaatacagcacaaagtcaggaaatccgttcagagattcttctattgggttcccttgccatctgcatccttcttatcctgagtaattttggtatgggtggcatagcgggaggagcaatttcttctgtaggatttggacttgtaggagcaatggcatatttatttccatttgtttttttcggagcagttgctttttatatttccaataaaggaaatcctcatgcttacataaaagtaggtgccgcaattgttctggtcattctcctttgtggaattttagaattgatgtttcatccatatactgccgggacatctgttttatcttactacaaagattccagtgctgataaaaatgcgggtggattacttggcggaattctgatcagtattttatgtccactgattggagaagcaggtacttatgttattttgatcattttctcaatcatttgtatcattctggtaacagaacgttctttattagctccacttggaagacatggaaagaaagcttaccaggaagtgaaacggaaacatcaggaaactgctgagatccgtacactggagcgggatgcccgcaaagaggcacttgcgttgaagcaaagagaaaaagtcgaaacttcacaggcagatgcatcttctccaagtgagaaaaagaaacgcacaaagcggacagaccttaaagcatcaggtattacgttcgccacaacgcttctttcagaggaagaatcacctgttggtggctttgggcggactccaaaatcacctgaaatgacagaacttgtcccggagaaagagccggattcaaaagatctgacggattcctttgaagatcattttgtcattaacagagcagaaccggcaatggatgtacaggaagagattccgtttgacgatgcactgcaccttgaaccggtacagacatccgcttcccgacaagaaaacgagatgagttctgaacatgatccggctgcggaccctatgattgaaaatagcccggagataaaacaggagcattccagaaaaagcagcaaaaaagacgcgcaggcggttgccgcagagacagccagtgtagaacagaccatacgggaacaggagcaaaaaccacggccggtttatcatacacctccgctgaatctgttaaagaaggggaagaaaggcggcggtgattcggatgaacaccttcgtgccacggctttaaaactggaacagacactacagaattttggagttggagtacatgtaacaaacgcaagctgtggtccatctgttacaagatatgaacttcaaccggaacagggcgtaaaagtaagccggattgttggacttgcagatgatatcaagctaaatcttgcagttgcagatctgagaattgaagctccaatccctggtaaagccgcggtcggtatcgaagttccgaacagtgaaaatacagcggttatgctgggagatctgctggagtcaaaagagttcaaaaacagtaaatcgccaatttcatttgcagttggtaaagatattgccggaaaggttgttgtgactgacattgccaagatgccgcatcttcttgttgcaggtgcaacgggatccggtaaatctgtctgcatcaacactctgatcatgagtgttatttataaggcagatcctgatgatgttaaactgatccttgtcgatccaaaagttgtggaactaagtgtatataacggaattccacatctgatgattccggttgtcacagatatgaagaaggcggcaggtgctttgaactgggcagttgctgagatggaaaagcgttacaaactttttgcacagtacaatgtacgtgatttaaagggctttaatgaaaaggtcaaacatggggaaaccggaccggagattcagaaaaagcttcctcagattgtaattatcattgacgagcttgctgatcttatgatggttgctccgggagaagtagaaggtgctatctgtcgtctggcacagttggccagagcagcgggacttcatttgattcttgcaacacagagaccatctgtaaatgttattaccggattgatcaaagcaaacatgccttcccgaattgctttttctgtatcatcaggtgtcgattcaaggacaattatcgacatgaatggtgccgaaaagctcctgggaaagggagacatgctcttttatccatccggatatccaaaacctgtcagggtgcagggatctttcgtctcggacgaagaagttcaaaaagttgttgattatttgattgacaagaacggaaatacctcgtacagtaatgagctagaagaacagatttcgagcagcgcagatcttccggggcaggggatgcttccgggacaacaggacagcgagaacagcagggatgtctattttgcagatgcagggaatctgatcatcgacaaggaaaaagcatcgattggtatgcttcagaggatgttcaagattggtttcaaccgtgctgccagaattatggatcagctatgtgaagccggtgttgtaggtccggaggaaggaacaaaaccaagaaaagtgcttatgacaaaagaagaatttgcagaatatatgcagaatcagacttcgtaaaatctaaaaacaccaaaagtgatacaaaggagagggaaagatgaaaacagatattcagattgcacaggaagcagaaatgaaacacatcaaagaggtagcggtacaggccggtatttcagaagatgaacttgaattttatggaaaatataaggcaaaactttccgatgaactctggaacagaatcaaagataacgaggatggaaagcttgtacttgtaacagcaatcaatcctactccggccggagaaggtaagactacaacatctgtaggtctcggacaggcatttgcaaaacttggaaaaaaggcaatgatcgcacttcgtgagccatctctcggaccatgtttcggaatcaaaggtggagcagccggtggcggatatgcccaggtcgttcctatggaagatctgaacctgcattttacaggagattttcatgcgatcacttcagcaaacaaccttcttgcagcaatgcttgataatcatatccagcagggaaatacacttggtattgatccaagacaggttgtatggaaacgttgtgtcgatatgaatgatcgtgttctcagaaatattgttgttggacttggacgcaaaacagatggtatggtccgtgaagatcattttgtcattacagtggcatctgagatcatggcgatcctctgtcttgcagatgatcttgctgatcttaaacgcagacttggaagaatcattgttgcttacaatttcaagggagaacctgttacagcagatgatcttcaggcaacaggtgctatggctgcacttctgaaagatgcgatcaagccaaacctgatccagacacttgagcatacaccggcattggtacatggcggtccatttgcaaacattgcacatggctgcaatagtgtacgtgcaacaaagatggctctgaaattaagtgacatcactgtcacagaagccggatttggtgcagatcttggcgctgagaaattctttgatatcaaatgccgtatggcaggtctgaaaccagacgcagtagttttagttgcaacagtacgtgcattaaagtataacggtggcgttgcgaaggctgaccttgcagaagagaacctggatgcccttgcaaaaggtattgtaaatcttgagaaacatattgaaaatattcagaaatacggtgtaccggtaatcgttacactgaattcatttgtaacagatacggatgctgaaaatgcatttattgaaaaattctgtcgtgaacgcggatgcgaatttgccctctcagaagtgtgggagaaaggcggagaaggcggtgtagatcttgcgcagaaggttcttgagacacttgagacaaaagaaagtgatttccatacgctttataatgatgagctttctctgaaagacaagatccgtacaatcgcacaggagatttacggcgcacatgatgttgtatatgaacctgcagctgagaaacagctcgccaagattgaatctatgggatttggttctttcccgatctgtatggcaaagaatcagtattctctttcagatgacgctacaaagcttggaagacctgaaaactttgatattcatatccgcgaggtatatgtaagtgcaggagccggttttgttgtcgcactgacgggcgctgttatgacaatgcctggacttccaaaagttcctgctgcaaacggaatcgacgttacagatgacggaaagatcaccggacttttctaaagttttttatgattggctaccggtcatagtattttttgaccggcaatgccaattgttttcgtggagttagataattaattaaggagatacacatggcacagttgatagatggtaaattaatctctcagcagattaaagatgagttgaaagaagaagtagcacagtttaaggcagaaggcattgatatttgccttgctgttattcaggtgggaagtgatccggcttcttctgtatatgtcagaaacaagaaaaaggcatgcgcctatatcggggtagaatccagatcatatgaacttccggaagaaacttcggaagaagaactgatcaagttagtagaagagttaaatgcagatgaaagcgtaaacggaattcttgtacagcttccggtaccggatcatattgatgaagataagatcatccgtacgatttcaccggataaggatgtagatggattccatcctgtaagtgttggaagactctggatcggagaaaaaggatttttatcctgtactccggccggaatcattcagcttttgaaaagatcgaatatttcgatcgagggaaaagaatgtgtgatcattggacgaagcaatatcgtcggtaaaccaatggcagcccttttgcttcgtgaaaatggaactgtaaccgttgcacattcccggacaaaagatcttaaagaagtagcaaaacgagcagatatcctgattgttgcaattggaaaagaacgttttatcacatctgaatatatcaaagagggagctgttgtcatcgatgtaggaatgcatcgtgatgaagcgaaccatctttgcggagatgttgattttgcggatgttgaacctcattcttctgcaatcacgccggtaccgggtggtgttggtccaatgacaattgcgatgctgatgaataattgtgttgaaacagttcgtaagtaggaggaacttgtaaatgaggtgtacacattgcggagcaaatataccagacgatcagttgatttgtcccgtatgcggtgctgaagtacagattgtaccagattataaccctctggaagacgtactcgcccgcgaagtgaaaggctcagtagccggagctacacgtcagatccaggcagatgtagtccgaagacagaatgtgagccaaaaccaacagaacagaaatcggcaaaatcaacgatcgaatcctaattccacacgcgtcttaagccaggcggaactggataaagtaagagaagagcgaagagagcagctacggcgccagagagcgcaaagacaacgtcagaaaacagatgcaaagcgttatcaggatgcccgtcagtcaacagagaatctgcgccggacatctactgaaagcagacgcctgcagcagatcaaaaaacaagaagctgccagaaaaaaacgccaaaaattacttacggtttttttcctgctcattcttctggttggtgtcggaatttatatcggatatcagaattcctatacaggcatgatcaaaaaagggaatgccgcactgcagaatagtaactatacttctgcagagaattattttaacagagcaattataaaggataaatcaaaggcagaggcttataccggacttgctaatatctatgttgcccaggatgatctggacagtgcagagagcgtctatctcaacgcactggagacacaaccgtcgaatgtaaatctctataaagctgcagtaaaattctatgagaaaacagaacagccgaataagatttctgatctcctgcaggattgtgaagataagaatgtattatctgctatgaatgattatgtttcatctgctcctgaattcagtttgaaagaaggaacctatgatgaagtacagcaggtaacattaacatctgctacaggcggaacgatttattatacaacagatggttctgatccgacggagtcaagtacagaatacaaagaagctgttttgcttcagtccgaaggtgacacagagatccgtgcaattgctgttaataaaaagggaataccaagtgctgtttccagtgcgaaatattccattgaatttccacttgtagacgctccggcagtttctccatcaaccggacaatatagtacagccactcagatcacgattacggtaccggatggatatacggcatactacacgatggacggttcaactccaaccgcatcctctgagaaatatactgacccgattgatatgccagaaaattcacaaacaactttttcagcaattctcgtgaacgataaaaatggaaaagcaacggaagtaacaacacgaaactatattactacatattaagtaaactgtgtaaagtaactagaaagtaaccttgattttggaaaatgttatgtaaattttccaaaatagggttgctttttttcgtatacagagttataataatacctgttaaaaaaataacaatactacataaaaaaggagagatttgttatgagtagattttgcttaccaagagacatttatcatggaaaaggatgtcttgaagaactgaagaacctgaaaggaaagaaagccattcttgtagttggtggcggttctatgaaacgtcagggattcttggataaagcagttaattatctgaaagaaggcggaatggaagttcagctgtttgaaggtgttgagccagatccgtcagttgagactgttatgaaaggtgcagaagcaatgcgtgctttcgagccggattggatcgttgctatgggtggtggatcaccaatcgatgcagcgaaagctatgtgggcattctatgagtacccggagatctcctttgaagacctgatcacaccattcagcttcccggaactgagacagaaagctaaatttgcagcaattcctacaacttcaggaacagctacagaggttacagcattctcagttatcacaaactatcagactggtgtgaaatatccactggctgacttcaacatcacaccagatgttgcaatcgttgatcctgaccttgttgcaggactcccggttaaacaggttgcatatacaggtatggatgctcttacacatgcaattgaagcatatgtatccacactgaacggacctttcacagatccacttgcactgcaggcaattgagatggttcttgattatctgccaggatcttacaaatgtgatatggttgcaagagagcagatgcattatgcacagtgccttgcaggaatggcattctctaatgcattacttggtatcgttcattcaatggctcataagacaggtgctgcattctctacaggacatattccgcacggatgtgctaacgcaatttaccttccatacgttatcaaatacaacgccaaagacgctgtagctgcaaaacgttatgctgaaatcgcacgcagaatgggacttgccggaacatctgagcaggctctgatcaacagccttgttgagaagattgatgagttcaatgtaagactgaacattcctaagactctgaaagacttcggaatcaatgaagaagaattcaaagaaaaagttgacaagattgcagaactggctgtaggagatgcctgtacaggatccaacccacgtgcaatcgatccggctgctatggctaaacttctcacatgtacatactacggaacagaagttgatttctaaaatcaaaaattaataaaggtttcagtgttcttataaaataagataacgctgtaaacttgtcttaaacaatacgggtagatgcatgaaattgtgtgtctgcccgtatgttttacttgaattcatagctgaagtgtcgtattattaacaaagagcgagttgttattgtttacacaatgtttgaagacaataacgtcgatttatttacaaggaggagaaacatgtataagatattaaaagctgaaaaactggctgataagatttatctgatgaatgttcatgcaccacgtgtagcaagtcactgtcagcctggtcagtttgtcatcgttaaaatggacgagaaaggcgaacgtattccgctgacaatctgtgattatgacagagaagcaggaacaatcacaatcgttttccaggaagttggagcttctacagtgaaaatgggagaactcaaagccggagacagtttccgtgactttacaggtccgcttggatgcgcttctgagtttgttcatgaagaccttgagtcccttaagaataagaagatgctgtttgtagccggtggagttggggctgctccggtttacccacaggtaaaatggttgaaagcacacggaatcgatgctgatgttatcgttggtgctaagacaaaagatatgctgatccttgaagatcagatggaagctgttgcaggtaattactacccatgtacagatgacggttcctacggacacgccggaatggttacaactatggtagaagaacttgtaaacaatggaaataaatacgatgtctgcgttgcgatcggaccgatgatcatgatgaaattcgtctgtctcttaacaaagaaacttgagattccgacaatcgtcagcatgaacccgattatggtagacggaacaggtatgtgtggtgcctgccgtcttcaggttggagatgagattaaatttgcatgcgttgacggaccagagttcgacggacaccttgttgactttgatcaggcaatgaaaagaagccagatgtacaaatctgaagaaggacgcgcaatgctgaagcttcaggaaggcgatacacatcacggcggatgcggacattgtggaggtgacgaataatggctgatatgatgaaaaaagtacctgtaagagagcaggatccaaaagtacgcgcaacaaactttgaagaagtttgtctcggttataacaaagaagaagcaatggaagaggctacaagatgccttaactgtaagaatgcaaaatgtatccagggttgtcctgtatccatcaacattccggcatttatccatcaggtaaaagaaggaaacattgaagaagcttacaagatcattggtaaatccagtgcacttccggctatctgtggacgtgtttgcccgcaggaatcccagtgtgagggaaaatgtatccgtggaatcaaaggtgagcctgtttccatcggaaaactggagcgtttcgttgctgattatgcacttgagaatgatattaagccagaaggtgctgagactatgaacggccataaagtagccgttatcggttctggtccgtccggacttacatgtgccggcgaccttgcaaaactcggatatgatgtaacagtattcgaagcattacatgagctcggtggagtacttgtatatggtattcctgagttccgtcttccaaaacagaaagtcgttgcaaaagagattgagaaagtaaaagagctcggtgttaaattcgagacaaacgttgttatcggtaaatccacaacaatcgatcagctgatggaagaagaaggattcgaggcagtattcattggatccggtgccggacttccaatgttcatgggaattccgggagagaatgcaaacgaagtattctccgcaaatgaatacctgacaagaagtaacctgatgaaagctttccgtgatgattacgatacaccgatcgctgccggtaagaaagtagctgttgttggtggtggtaacgtagctatggatgctgcaagaacagctcttcgtcttggcgcagaagttcatgtagtatacagaagaagtgaagcagaacttccagcaagagctgaagaagttcatcatgcaaaagaagaaggaatcatcttcgatcttcttactaatccgaagaagatcaacgttgacgagaacggtaatatcacaagcatgacagtgatcaagatggaacttggcgaaccagatgcatccggaagaagacgtccggttgagattgagggctctgagtacgacattgaagttgatacagttatcatgtctcttggtacatcaccaaacccgctgatttcttctacaacaaaaggtctggagacaaaccgcagaaaatgtatcgttgcagaggaagagaatggacagacatctaaagaaggtgtattcgccggaggagatgctgttacaggagctgctacagttatccttgctatgggagctggtaaagcaggtgccaaaggtatcgatgaatatctgagaaataaataatagaaggaagattgtacataggggcgtaagcttctttgagataatcggaatttgaaaacagaatatcctgacaggatacagaaaactctgtgcttgtcaggatatttttaatatactaaaaatgaatttgtcgtgttataatttgagggagacaacggaaaagtttttgtgacatacagcaattttgctcaaattagatgacaacctgttcgaagatatggtaaaataataaaccaaatatttgcaaatttcaataaacctaagaagcaaaaatctattttggaggaaacataaaacatatgacgaattataacagcaatgacaatcgatttgatggaagatgcttccttgaagatgttgagataaagttacaaaaacgactggaagaaatagggcagtctctctctgatggacagaaagagattgataacatgcaggaatattactgggaaaattatacggagatggatgagtatggttacgaagattacgataatcagcaggcactccttcatcaggtcaacgctaataatgagaagctgcaattaaaacatagatttgagaaaatgttagatgcaccttttttcggacgtgtcgattttatgtatgatggagatgacgaaccagaaccgttttatattggaatcggaaattttgctgaaaagaacggtatgcagccgctgatctacgactggagagctccggtcagcagtttgttttatgattatgataaaggctctgcaagctatgaggctcctgccggaagactggatggagagattctttcaaaatggcagtttaagatccagaatggagaacttgtctatgcctttgaaagtgatacaaagatcgatgatgatattctgaaaaaagaacttggaacaaacagtgatgtaaaattaaaaaatatcgtccgcacgatccagaaagaacagaatgcaattatccgaaatacgaaagatcgaatccttgtaatccagggagctgccggaagtggaaaaacttcgattgctttacaccgaattgcatatcttttatatcatgaacgcgacactctgaaatcatccaacatactgattctttcaccgaacagcgtatttgcagattatatctcacatattcttccagaattaggagaagagaatatccgtgagatgagttttgatctctacgcctacaaagagcttcgaaaaggtgtcgcagcagactgtgaggatcgttatgatcagttggaacgtcggatgaagtttccggatgaatcagttcagaatcgttttgactggaaacaatccaaagattttattggtgaaatagaaggtttccttgcgattctggaagatcgtctgatggaattcaaagaaattgagttccgtggaatgacattgaccgaagaagacttgatccaattgttctattataaattcacagagactccgttattgaaacgtatggatgctgtaaaagactattttatcgattcctgggaaactctgaaaggcagaaatatttcagaggatgatcaggagatgcttcagatgaagttcgacaagatgtacacaacgaaagatatttacaccatttataattggatgctcgatgactgtggttgtgatctgttgccggaagttccgtacgaaaaacgaaagctcccttatgaagatgtatttcctatgctctatctgaaatatcgtctttccggtgggaactcaactcataagaacattaagcatcttgtcattgatgaaatgcaggactacacttatctgcaatacaccatcctggaatccttgtttcattgtagaatgactattcttggagaccgtgcgcagacattggatacaaagcaacaggatgtattgagatttcttcccaaattacttggacgtgagatccgaacgattgagatcaaaaagagttaccggaacacattggaaattgcccggtatgctgaaaaagtcagtggagtatctgatcttgagttactggaccgccatggaaaagaagtcgtagaaaagacatttaacacagatacggaattgcttgatgaacttgtctgtcatttaaaatgtccgggagactttgaaactgctgccctgatcacaacaacagaagaagaagcttttgacttaagccgtctcctgaaactgcgtggtatcaacgtatcttatgtagatcgtaacagttccgcatttaagaaaggactcacagtaaccacattttatcttgcaaaagggctggaatttgaccaggttttcgcacttcgcggtgcaaaagaaaatccgctcaaaaatcaggcggaatatatttgtgcaacaagagctcttcacgaactctatgtttacgaaattgctgacagcttatcaaaataacagttaacaggcatgcatgattaaaatttattcagaaagaacagaaaaatgaagattacattaataaccgtaggaaagataaaagaaaaatatctgcgagatgcaattgcagaatacagcaagcgattgagccgatactgcaaactggagattatagaagtagctgatgaaaagacacctgaccatgcaagtgatgtcgtggaaaatacaattcgcgataaagaagctgaacgcattatgaaatatgtaaaagaggatacctatgtgatcactcttgagattaacggaaagcttcttagttctgaagaactttctgcaaaaatcaatcaacttggaattcaggggacaagccatatcacatttatcattggcggatccattggtttgggcaaagaagtgctcgcaagatcggactatgcattaagcttttccaagatgacctttccacaccagttgatgcgggtcattctgttagagcagatatacagaagttatcggatcatcaacggtgaaccttatcataaatagagatctgtcacagaaaacaactggtataggacatcgtgatatattcatatactgatgacaaaggatttttatataaaaaacttcaatgaaccgagagcagatcaaagaaaagatggtatccgcaatggatctcccaaaagatgtgattcagaatgcttctgttataaccattttaggacgaaatgaattatgcattgaaaattatcggggcattattgaatacacagatacactgatccgtgtgcagacgcgagcaggacagatccggatccagggaaaacgactccggattcaatactacacaaatgatgagatgaaagtaactggagcattatcatctttagaatttaccgaggggaggaatccggggtgattcattgcctgatccgctacttgtccggttatgtgaagattcagatcaaaggatactccccagaacgatttctgaatctctgctgttatcaccgcatccgattctggggattgacccgtatcggaacaaattatgaattatacttgagtttatctgattttcgaaagattcgtccttatgtcagaaaaacacatacaaaagtcatactaaaaaaacggtatggctttcctttttttctttatcgctaccgaaaaagaaaactattctttatcagcatcttcctatgcatttttctaatcgattgttactcgcaatttctatgggatattcattttcagggaaataaaagatggaccgacacgaccttgacaacgtttctgaaagaagaggggatttatcctggaatgcaaaagaaaaatgtagattgtcaggggattgtcaaagcccttcgaaaggaatataatgatatcgtttgggtatctgcttctcttgatggtagccggttaaaaatacagataaaagaaaatgaagatgcgcttcctatcatctcatctactcagacagattctttacctgctgatcttattgcttctactgatggaatcattacaaatttaattacacgcaccggcattccccaggtacatatcggggattctgtaacgaaaggaactttacttgtatctggacggattgacatcctggatgacagtggtgaaattaccggatatcaatatacgcatgccgatgcagatattttcgctgatacacagatttcttatctggatataatttcctgttatcataataaaaaagtatatacaaaagaaacaaaaaagtccggatttattcaaatcggatctgtccggttagaaacatggaagccaaaaatgtccgctacttctgaaaaattgtgtatagcacatcagttaaaactaggagaaaatttttcacttccgattttttatgggcatgaaacaataaaaaaatacggcttcaagaaaataaaatatacaaaaaaagagatgcagacaattttaagcagtcgatttcgctatttttgtaaagatttagaggaaaagggtattcaaattaatgaaaaaaatgttaagatatatatatctgccgaaaaggcaacggcttcaggtacgctctatctgaatcagcagattgaagaggaaacagagaccgaaagaataactttagaaaggaacgaaccggatgagtctgtcggaactgatcattgatattccggctgaatacgagatgaatgtatttggccagtttgatacttatataaagaaaatagaaagaacttttcatgtcacattgatttcacgtgacggtgcaaccaagattgtaggagatacaattgctgcacagaaagcccagcgtgtacttacacagcttgtggaacttgctaaacgaggaaatacgattacggaacagaatgtagactatgcaatctcgctcgtatttgaagatcaggaagaagcccttgtttctattgataaagatctgatctgtcatacactacagggaaaaccaatcaaacctaaaacattaggtcagaaaaaatatgttgatgcaattcgtaatggaatgatcactttcggtctcggacctgccggaacaggaaagacctatcttgcgatggcaatggcaatcacagcattcaagcgcgaagaagtaagcagaatcatcctgacgcgcccggcaattgaagccggagagaagcttggatttcttccgggtgacctgcaaagcaagattgatccgtatttaagacctttatatgacgcgctttatcagattatgggagctgacagttttcttaagaattctgaaaaaggattgattgaggttgctcctctggcatatatgcgcgggcgtactttagataatgcattcattatccttgatgaagcacagaatacaacgccggcccagatgaagatgttcttaacaagaattggttttggatccaaagttgttattacaggtgattctacgcagaaagatcttccatccggaacaatatccggacttgatgtcgctgtaaaggttgtaaaggatctggaagggatcaacatctgtacgctgacaagcaaagatgttgtaagacatccattagttcagaaaattgtaaaagcatatgaggactatgagaagaaatcgtccagaccgagagaaaacaggaggaaaaaaggatgagtctttttatcgaagaagaggggaatataaagttagactttgatacagaagagattgccgcattagttattgacgctgcattagaacttgcagactgtccttatgaagcagagatcaatcttcttttgactgagaatgcccaaattcacgaaatgaatctggaacaacgtggaattgaccgcccgacagatgtgctttctttccctatgatcgaatacgaagagccgggagatttttccgtgattgatgaagaaagtgcagaagcttttaatccggaatccggagaattgatgcttggtgatatcgttatctcaaaggaaaaagtgttatcccaggctgaagaatatggacatttacccaaaagagagtatgctttcctgattgcacacagtatgcttcacttatttggatacgatcacatggttgatgaagaacgtgttgtcatggaagcgaaacagaaagaaatcatggaaaaagtcggtattttccgctgataggatacatatattaaatagattttaaggaatgggacactaggaggaagttatgtctgaaactgaggcacaaacaacgaaaaaacgaacgaaaaaggatgattatattgtccagggttcgatacttgcagcagcagctgtacttacaaaaatcataggcgtagtctaccggattccgctgacgaatattttaggagatgaaggaaacggattttatggatatgcctatcaggtctatgcaatcgctctgatgatttcatcattcagccttccaactgccgtatccaagctggtatcgatccgacttgcaaagcgtcagagacgaaatgcattccgtgtatttatctgttcacttgcttttgcaatcggtgttggattattcatctcgctgacaatctttttgggagcaggactgatttcaacacatttaatgaaatctccacttagcgtttacgcactgagggttcttgccccgggacttctgatcgttgcagtcatggctgttatccgtggatatttccagggaatgggaacaatgcttccaacagctatctcacagatcattgagcaggtatttaatgccgtgatcagtattgtcggcgcaagtgtcctctttggtatcggaacaaaagcaggagaaaaatccggagaggagcttctcggacctgcttacggtgctgccggaagtacacttggaactgttgtcggctctttatctggattgttatttcttttgtttgtcatttttttatataaaaatgtgatacgcaaacagcttaaaagagaccgcaccaagaatgttgaaagttattctttccttctgaaagcattacttttaacagcaatcccagttgtattcagtaccgctgtatataatattaaccagattatcgaccttacaatctttaatcacgttatggggtcacaaggctatgtagagaaagaatatatggctcttcagggtatttacactggtaaatacgacaccctgatcaatgtcccgatggcaattgcgaacgcacttggaacatctcttgtgccaagtcttacagctgttgttacagcaggtacaaagaaacaggttcacaataagattaaccagactttacgtcttacaatggtaattgctattccgagttgtatcggttattttgtacttgcttccccaattatggttctgctgtacaatgactccagtgcaacaccggcgcgtctgttgatggcaggagctatcgttgttgtactgtatggactttcctctgtaacgaattccattcttcatggattaaactacatgacaagtcccgcaaagaatgctgcagcagctcttggaattcatctggtagcatttgtactgatgatgactgtattcaagatgaacgtctatgcactggtgggtggaaatattgtatttgcacttgcaatgagtattttgaacctgctcaagattcgaaaagtcagcggtttcaaaatcgattttgtaagcactttcggaaaaccattcgctgcagcagcagtgatgggcattgtaactttcggcgtattcagactgtttgatacactgatcggcggtcgtgtaattccagtatgcatttcactgattgtagcaatacttgtttatgcggttgttatgttgaagatcggaacactttctgaagatgatatccttgatcttccaatgggtggacgtatcctgagaatttctaagaaattccatctgcttccagccgtaaaagtagaagaataaaaaaaataaaaaagccaatactgtatgaaaaaaggagcgatttgcgatgaaaaaatacatgattggctttttttctgttttatttctgattaccggatgtttgattgcaggttatcaggttagttacaacaatctactgaaaaaggaaaaagctatagaactgactaaaaatgaaaaaaatgattccattcaaatcagacgcagttcagccaaaggagagtctgtttcagatgatgcatattatctgaaagagctgcatggatatgttgctgtctatctgcaagatgggacaaccctttacgaaacaaccagcctatccgtaaataatctgccggatgaagtacaacaggatctgaaaaatggaatctatcttaagtcagctgaagaactgtatggttttcttgagaattattccagttaaaaaagtggacgaagtgcacagaatcgtgtataatacagaatcagcggagtgattgacacgggagtgaacagtaaagaatatcgcaacattaaacggaacaagaaaaaggagagagatagacaatggaacaaaagaagattgatcgtatcaatgaattatataaaaaatcaaaagcggaaggactcactccggaagaagcgaaagaacagaagattcttcgtaaagaatatatggaacttatccgggtgaacttaagaagccagctgaacaatattgacatggaacaaaaagatggaagtattgttaatcttggtgagaagtatggcgaaaaatatatgaacaagaaaggaaactaggatcatgttacagaatttaccacaggatcctgttatccttctgagcgtcataaatacaaagctcagagatttttatccatcactggatcagttatgtaaagagatggaagtgaataaaaaagaacttatagataaattagatctgattgactatgcttatgatgcatcctgcaatcagtttgtataaaggaaatgagaatgaaagaaataattgaaaatgtaaaactggtggaaaatgcaccgttggaagaacctgcccgtcagtattattttatggaaaaagcaaaagaatacgttgctgaaatgtctgagaaactggggcgtccattaactgcgtgtgtgacgacatttggttgtcagatgaattcgagggactctgaaaaactgcttggtattttagagaaggttgggtatgcagaagaaacggatgaagagaaagcggattttgtaatctacaatacctgtactgttcgtgaaaacgcaaaccttcgtgtttatggacgtcttggacaacttggttccattaagaaaaagaatccacataagatgatcgcactttgcggatgcatgatgcaggaaccggaagttgttgagaaattaaaaaagagctaccgctttgttgaccttattttcggcacacacaacatttacaaatttgcagaacttttaacatctgcaatacagtctgacagaacagtcattgatatctggaaagatacagacaagattgtagaagatcttccggttgaaagaaaatatcctttcaagtctggtgtaaatatcatgttcggatgtaacaacttctgtagttactgtattgtaccttatgtacgtggacgtgaaagaagccgtgaaccgaaggcaatcatccgtgagatcgaacgtcttgttgcagatggtgttgtagaagtcatgctgcttggacagaatgtcaattcttatggaaagaaccttgaagaaccgatgacatttgcacagcttcttcaggagattgaaaaaattgaaggacttgaaagaatccgtttcatgacttcacatccgaaggatctgtcagatgaattgattgaagtgatgagtaaatcaaaaaaaatctgtaaacatctgcatcttccggttcagtccggaagcagtcggatcctgaaacttatgaaccgtcattataacaaagaacagtatcttgcacttgctgaaaagatccgcaaagcagttccggatatatcacttactacagatattattgtcggtttccctggtgaaacagaagaggacttccaggagacccttgatgttgtaagaaaagtccgttacgacagcgcgtttacttttatttattcaaaacgtaccggaacacctgctgcagtaatggaagatcaggttccggaagacgttgtaaaggatcgtttcaatcgtcttttacatgaggttcagaccatttcagcagaacagtgtgcaattcatgaaggaaccgtgcagacagttctcgtagagtgtgtcaacgaacatgataagcatctgatgacaggtcgcatgagcaataatctgctcgttcatttcccgggggatgaaagcctgatcggtcagctggttgacgttcaccttgacgaatgtaaaggattttactatatgggaacgatagccggtaactagaaatcaagattgtcgtaagtgaactttctttttgattttatgaatcagatacctgttttttctgcatcttgaatcaaacccgttcaagaaattcagtgttaaactaagacatatttttaaaatatttcatgagatttattttcgaagatgaattctagatccatgagtattctgaaaacaggaaggagataaaaatatgactagaacactgacaggaaaaccgagtattgatcgcccatggatgcagtattatccaccacagttgatggaaggactttctattccagaagatacggtttatgaatatttactgaaacgttgcccgggagatgatgtcgtagcaattcattactatggcagagagataacctggaaagaagtaaaagagcaggtggataaagtagcacgttcccttcgagcaatcggttttggtgaaggtgacgaaatcccaatgtttttacgcgctgtacctgaattcatctacgtacttcttgcagcagaaaaaatcggagcttcccttctttgcagagataatacgattcaggaaaatgttgatgcagtaaaaaaatccggtgcaaaaatgattatcgcacaggatttcttatctcatgaagacctgaacaaatatcgtaatgaagcaggtgtacgcggagctgttctcttaagtcctatacaaagtgccaatcgatcagaagtcccgaattattgctggaattatcttgaatcactttatacagattatcctgcgtatggtccgtgtacaatatcctgggatgaatttctcaaattaggagaagcttatcaaggtactgtagaggcagaaaaaaatattgaccgtccacttttccgtgcttatacaagtggatctaccggtccatcaaaacaggtaatccattctgcccacacaatgatcggaaatatgcatcagatgaacttttatggtgcatccagtgattttcgtccaacctggctcgtgacacagctcacaccgtctcttgtggcagtcgttgttgctatgttgcttctgcctttagcttcagataaattgctgattttgagcccgtttgtagcaccggaagatgtcgatcttgaaatgatgcgctatcgtccgaactgctggccactgattcctatgtttattgaaacagttatgaaaaatggcagagttccggatgattatgatatgtctcacctgttttccgccggagccggatgtgaagcatataacaacaatcagctgcagcgtgcacaaaaattcttgaacgaccataattgtaaagcaacatttacaaccggatatggatgtagtgaagccggttcaaatatgtcactcccgttaacacctcatccaattagaaatggaaatgtcggaattccaatgccgttaactacaatttcgattttcaagccaggcacagaagaagagcttacatataacacaatgggagaaatctgtcaatgtggacctggaaccatgcttggatacgatgacccagaagcaaccgcaaaagctatcatgatacattctgacggaacaagatggctgcataccggagatattggatatatgcaggaagacggaacaatttatgcattaaccagaggagacgcacctcgctatggcggtggttctcttgcaacacttccgatggaaaaccttcttgcagacgcagaaatcccgggaattgatgatgaattttttgtaatcattcctgatccggaacatcatcgttgctttgtgccatatctttttgttgttcttgataagggatacacggtggatgatattcgtgaaaaagtatacgattgtctggaagaatatatgcatccgattgatattattgcacttccggaacgtcctttcttccattttaaaacaaacagaatcggattatctaaagatattatgatggggaaatttgaaaattaaattttaatgatttttatgtaagcattaaggtgttgtccgctgatacggcaacaccttcttctttttttaatcattttgtgatatagtaagtcttaacttaaaaaagattgcaaaaatatgacaagcaaaaggagtactacacatgcgcttattattagctgaagatgaaaaggcattatcaaaggcgctgacagccattctggagagaaataattattccgtagatgctgtttacgacggacaaagtgctttggaatatttggaaacagataattatgacggagtgatcttagatattatgatgccaaagatcgatggacttacggtattaagaaaagttcgtgaaaaaggaaacctgattccgattttattgttgacagcaaaatcagaagttgatgataaagtggaaggactggatgccggagcgaacgactatttgacaaaaccttttcattccaaagaactgttagcaagaattcgcgctatcacaagaactcagtcggcacagacaacatctaagctgacttttggaaatgttacgttagatcgggcaacctttgagctttctacagcaaagggcagtttccgactcgcgaataaagaatttcagatgttagagcttttaatgtccaatcctcatcaattgattccttccgaacgttttttagaaaaaatctggggatatgacagtgatacagaaatcaacgtagtatgggtgtatatttcgtatttaaggaaaaaattaacagccctccacgcagacattcagattaaagcaacaagaaatgccggatattcattggaggagcttacatgattaaaaaacttcgtattaaattgatcgctacttctatggtctctcttttccttgtcctttttgtaatcggagggattgtaggcattataaatcataagaagattgtggcggatgctgaccggattcttgatatcttagaggaaaatgatggaacttttccaagaatggaaccaagagagaaaaccgatgatcctcatggtatgtcggcagaaattccatacgaatccagatatttttctgttttatatgacgcgaatggaacgattattttaacagatacttcaaagattgcatcggttgatactgaaacagctgtgaactatgcttccaaagtatggaacaaaaaatcagaagaaggattccaggataattacagatatcgtatgtattcgtctaacggcaatgtacgcattattttcctggattgcagacgacaattaaataattttcacaactttttgcttacaacctttagtgtatccggtgtcggacttttatctgtatttattttaatgcttggtttgtcagcacgtatcgtaaaaccgttttccgataattacgaaaagcagaaacgattcattacagatgcaggtcatgaattgaagaccccgttgaccattattgatgcagatgcagagattttagaaatggacttcggtgaaaacgaatggctacaggatatacaagcacagacaagccggcttgccgatctgaccaatgctcttgttatgctttcccgaatggaagaaggtgtaagcagagacacaaaaatagaatttccactgtcagatatcgtagaagaggtatgccatacttttcaggctccggcaaaagtgcatcaaattaatctggacagcaagattgaaccactgatttctatgaacggagatgagaaagcaatccgcggacttataacaattcttcttgacaatgcagtaaaatacacgaacgaaaatggaactctttcactcgctttagaaaaaaagaaaaatcgtatttatctgtctgtttttaatacaacagaatctatttccaaagaacagatttctcatttgtttgaccggttttatcgcacagatgcctctagaaattctcagaccggaggatatggtttgggactttccattgctgccgcaactgtggagtcccatcatggaaagataagcgcagagacaaaagatgaaaaatcattaaagattaccgtggtttttccaacataactgatttacatagctcgtacaaacataacgtttgatacgggcttttttcatattcttttctagccttaatttttttaagtttaattaaggttacgggagtatcttatgtatgtaaaataaaaaacaggaggaaaacgatggcttatcaaatgacttttaagcgttatgaattgaaatatctgctgaacagacaggaaaaagagcagattcttttggctatgaagcctcatatgaagctagacaattacggaagaaccgtcataagaaatatttattttgatactgatacatttcggctgattcggcgttctctggaaaaaccggtgtacaaagaaaagcttcggattcggagttataaacccgtaaagaaaacagatccggtatttgtagaaatcaagaaaaaatataaatctgtcgtatacaaacgcaggttacagcttccggaagagaaggttatggacagttttcagactggagaaccgttaccggttcattcgcagattggaaatgaaattcaatatttccgcgattactatgaaaatcttcatccatccgtatttttatcctatgaaagggaagcttattattctctggacggcagtgattttcgtgtaacttttgatgagaatatcctgtatcggagaaataatttttcccttggcagcgaaatctatggattttctttactggaaaatgatcagacactgatggaaattaaaacttccggaggaattccactctggatgagcgaagtgcttacgaaacagcatttatacaaaacatcattttcaaaatatggttctgcttatcagcgtatattaacagaatctttacaaggaggatatagcaatgtctaatactttatttcagggaatttttgataccaatatgaccagtgtgatttctatttctgacttcttattatgcgtgggatgtgccttagtgatcggtctgatcttagccggtacttatatgtatggaacaaaatatacgaaaagctttgtagcaacacttgcgctgcttccggcagtggtttgtgtagtgatcatgatggtcaatggaaatgtaggaaccggtgtggctgttgccggagcattcagccttgtccgtttccgttcagttcctgggtctgcgaaagaaatcggagcgatttttcttgccatgtgttccggtttagtagttggaatgggatatctggcgtatgctttgctatctgctgcaattcttggaagtatcatgcttctgtataatcgtctggattttggaacaagaaaacacggagcacgttacaaaactttacatatcacgataccggaagatttggactacagcggagtatttgacaagatcttaaagaaatatacaatagattatgaaattctacagatcaaaactacaaatatggggagcttatttaagctgacttataatttaaccttaaaagatcctgcaacagaaaaagaactgatcgacgctcttcgttgcagaaacggcaacctggaaattacgatgtgcagacaagaaactatagtcggagaattataagaattcaggaggcgatgactgatgcgaaaaaaaacaattatattatttctcacaatgggagctttgatgctatccggctgtaacacaaaaattggaaatacgacacagcaaactacagaatcatctactacgacaagttcttctgtcaccgaaacagatgcttccgatatgttttcagatcgtgataaagaagtaggctatgacgaatccgaaagtgtcactatttctctggctgacaatagttccagctgtgagtctgatgccgtgtccattacggaaaataccataacaatcaaagacgaaggaacctatattctttcaggctctctgtctgacggaatggttattgtagaagcagaagatactgacaaagttcagattgttcttaacggagtaagtatctctaacgatcaatccgctgcattctatgtccgctcggcagataaggtattcgttaccacatcttcaggaacagaaaataccttagtgcatagcggaagttcctatactgccatagatgaaaataatattgatgcagctatattttctaaatcagacctgaccctgaacggagagggaacccttacagttacagcacaggaaggacacggaattgtatccaaagatgatctcgttctcacaagcggaacttacgtaatcaccagtgccagtcacggactttccggaaaagacagcgtgcgtattgccaatggcacttatacgattgtatcaggtaaagatggtatccatgcgcaaaataaagatgatagcagttccgggttcgtttatctggctggaggtacttatacgatatcagcaggagatgatgggattcatgcagcttctaatgtgactatttctgatggaaagatagacattgcgcaaagctatgagggtatcgaaggattgagtattgatattgcgggcggtgaaatcagtgtattggcatctgatgatggaatcaatgcggccggcgggaacgatagtagtagttctgaaggattccagggcggagacgaccagtttgcatccacagaaggcgcctatattcaaatttctagcggtgtgcttcatgtaaatgcttccggagacggaattgattccaacggagacatcacagtttccggtggagaaacttatgtttcaggtcctacaaatgatggaaatggaagcttagattacaatagaagtgcccaaatcaccggcggcatatttgcagcatccggttcctcgggtatggcacaaaattttgattcttcttcaacgcagggcactattatggtaaatattgatgaacaggaaggtaataccgagatttcactccttgacagtagtagcactgaacttcttagttggacagcagaaaaacaatattcttccattatcataagcaccccgggaatccaacagggagaaacttatactataacagccggaacagcagatcagagcgttaccatggatagtctggtttatggaagtaacgctcagggagaaatgcctggcaatggtggagaaagaagtgacatgaaaggcggaccagggaacagacagcctgacgcagacatggagaaacctcaggggagcactcctccagatgccccatctggtagtaagtaagaaaaaatgcatgagtatgaaacgaaaaatcatacacatgcattttttcgtttatttatcatataacaagtgaaaagcaaacttgttcatgttataattgattcaaagaaaaatggtaaaaatactttgccaaacttgataaaatagcgaacaatgagacagtacactagcaggagggcagaaaaatgtttaacacagaatgtaaaaaaacagtttcaaaaatgatcctatcattcatactgattacggtaactctattgtccggctgtcaaaagaataccacccattctgctattgagtttggaactatagatgtgtctgaaattgataaaatcgaactttctggcacaacaggtggaaaagatggaaattattcctatacattgtctgatcaggaaaagaaggagttcgtccatttgctaaatcaagttgagcttggtgatgaagttgataaaaatcaagcattatcaagtggagcagttacttactataagctttatttccaaggaaaagacatcgttacactctgtccgggacattatttcggtgttgatgaaaagtattatgagtttgttaatttcgataaattgtgggatgaatttgtcactttcaatagtaaacaagatacctctcagcaagacaaatgggattgttctgttacttgcgcagaaacctctgagacaaataactatgtagttacatattctgataaaaaagtattctcccaaactggaatactcacctttcaaaacagcaataatttcaatattattgttcatctacaaataccggatgaagaagaaagaacagcagaaattccagcgggcggtgttagttccttgtatcagatatcccaaaacaaggcatgtactgtaggtgtatacgctgatgttcctgaaaatgaaacgataaaattaatggtctatgatggagctgtagcagatttaaattcaagtcaggaaaaagaacaagtatattttgatgcaactgttcttgaagtaaagaaaaaatcaattaaggtaaaatgttcagaatcctttgatagtggtattcctgttgatgaagaattctctgtaacaacgaatagagtagaaagtggtgagctccctgatttgaatgccggtgaccatattcgtattgtatttgatggcatcatcaaggaaagttatcctctgcaacttggaaatgtctttgctatatatcttctagatgaaaacggaaacttgtaaagtccgtagtctgaaaggctcctacaggagcctttcgtttttttatgtcccaaaccaatatattttatggccataatatgaatgcgtattcgaagtatgctatactgatactgattatgtgaggcgaggtgaattcagtatatgataaaaattgcaatcgttgatgatgaagaacagacaagagaacaaattctccggactctaaaggaaaatatacagaaacaatacgaagtagagattaaactatatgcatcgggcgaaagtttctttgaggaaattcagaagggcgaaacagcggatattttatttacagacattcagatgcaacagctggatggagtggaactggggaaattggtccgaaggctttgccctgacatgtacattgtcttcatcacatcttatgaagaatatgcggcagaaagttatcggatcgaagcatatcagtatattttgaaacaggatctagaatttcgtcttcccggagttgctgaacagcttattgaaaagctgcaaaaacaaaagaaagaattctgtattataaaagacggtacagaacaggtgaaattgctttataaggatattctttatctgtataaatccaaaggtgctaagtatgtaaattatgttactacccaaggcgttgtgagagagcgaacttctttggaaaatgcactgaaaatgttaaatagtagacaatttcttctggtggaacgtggatacgctgttaatataaagcagatttgcaaagtaagcggtgacactatctatctcgaaaaaggatatgaagtaccagtaagtaaggcaagacttgcagaagtaaagcgagaaatcaatctctattggaggaattcgtaacgatggatacacttggaatatggattggactgaattttcttgaaaccttccttttctattatctgttattcggaacagttatagacagaaagactctgaaaacgaaagataaatggattctctattttgttttgatcagcacttcaacaattatttctgtatggatcaaaagatctgtgtttagtgcttatggatacctgttgacgatttttattttgattttaggaagttttcttgcctatcgaaagaaattgattcttcttacagggatcgcatctatgtatgaagcagcaatgatgttatttttatatatcatttactatcttctcgcatttatttatgggaatcaggcagaaaaccctcagattctatttttccgttaccatgaaaatgaagaagcttgtgtgataaaaagcctgttattaattatttccttttttatcattttcaaaataagaagctggaagaagaaaaaagacatagaagcatttcaatgggtatttgttttatgtggtgtactgttatcagcactcgttttggagtatcagaaacttttaaagtatggactactgtactccacagccggaattccggtgattcaggatgtcttaaaaggaagtctcatcagttttcttactatgatcgtactcatcagcgtcatgacatttcttatatggaaaaacagaaacataacgggacaaaatacatttcttctgatgaaagaagagatggagaaacagaaatatgaggaaataaaagcttccatcaagcagaacaaagaactcgttcatgatacaaagaatcattatcttgtgatcagtgaatatgtaaaaaatcaggaatatgaaaagctggaaaattatgtagatgaaatcagaagaaattttgtaaaaatcaatccacagatttatacaggaaatcatgtagtggatctgattcttgggcaaaagcgaatcctggcagtacaaaaagggattgatttccaattggatgtaacaccactatccagtctgacgatggaagaaagagagatctgttcactatttgggaatctgttagacaatgccctggaagcctgtgagaaagtgactgataaagaacgtaagaaaatcagtataaagattgagcagcatatgcaaatgttgtttcttgaaattaagaatggaaccgataagcttcctgccaaatcaggacatacttttctgacttcgaagcaggataaatctcttcatggatatggcttgaaaagtgtggaacggattgttacacgatatgatggagatctggcctatgaaatggaagatggaatgtttgttgtttcaataacattttttgatttataaatactcatgtccagtaatccagtacttgaaggccatccgcttgcagtactttcaccacaagattaaactgaatgtaagaaaaaaacctgttccaaattttcaggatacgaaattcgtatcacacagacaggaatggaaatggaggaatgatgccatgacaattaagaaaatgagaactaaaatcattttaccatcgattctgacagtcagtcttacttgtggtctgttacttacgggatgtcagaaaacaccagatcagagtgcagttgtcagtaaggccggaggattaagcgaggatgtaattgcagaaccattgaaagatggagagacgcagacactgaatctgccggaacactgggacacaacagtaacatggagtaatgaccgcggagtttttcacgcagatcaggaattagaatctgttacgacaggaaatcttccggtaattgaagtcaatcagaaaaaactggagcttgaacaattaaacggacttatttcctattttgcaggcggagagattttgtatcagacgcaggaacttaccagagaatactatcagaacctcttagataagattaagaacagggaaggattctatgctgacaacagtgtggagtatgatttaacagggcttgaaaagttagtggaagaagttcttcctcttgcgccggagcagacaccattgcaggaaattggacagattgaatacacatcaaaaaagacagatccggcgtatgaagcattcagaaaatcactggaatcttacggatatgattttcttccggataccacaaagcaggatggaatggagattcattttcaggcaacggttggtgcagatgcaaagggtacgatcaatgcagaaacttacgatccggaagcaggaaattatagtatcttctcctggtcagaaggaaatgggatcgaactggcaactattgaaaacactctcgcaagagagaatctcacagcccaatatggagttcctgcaggaagcgtaaaagaatcttttatggaaaaactacaagcactgaaggaccagatggaagaaacctctctcttagaagagacagcagaagatgaagctgaaaaagttctgaaagatctgaacctcgaaaatatgcagttgttgtcatcagacaaaatcctctggtatgcacagtctgattatccggaagccactatattagaactacaggaagcattatggaatgctgatccaaatcttggaaaaacaggttatcgtcttacttacgttccttctgtttccggattaaaaataaatcaggataaatccggaggatattcagatgatagtggatttgcatatgcaccttccatgccggtagagcagatttatattgtagtgacagaagatggaatccgttccttcaaatggaagggtatgagtcaggaagaaaagatagttacagaaaatgtaaaactccttgcatttgatgaaatagaaaaccgcctgatcgatcaggtgaaatatctttacccttccagtcagcctgctgagaacaagacgatatttggttatgatgttgcaactgtcgaactaggatatacttatataccggcatataagaatccacaaaatgcctggctggttccggcatggtttttcactataagcgagagtgaagatacaactgccgaacttggaacagccggaaaaaaaatagaaggatatcagaccgactacattgtattgaatgcaacagacggtggaagaataggttcttattggagatgatagaatatgaaacgaagacatcttttcagaacagaattgaaatatgactttggaaaccgaagattttatatctctgtactggcgttgtgtgcggttcttttgattgttgcacttccttatcgaaatcatctgatcgctttcggtggatcaacagaaggggaagcatggttatgcaccttcacctatgcaatcacttcagaaaaagccttgcttttctttccactgttggttcctctggcaacagccgcagatatacaggaagaattacacagccgctatgcatggtttcttattaacagaataggaaaaagaaattatatttggatgaaaagttttggagttgcattcacaggtggtgccatttccgtttcagcggcaggaattgcattggttgtttttatagttatctgtagaaatatcccgactctgaatactttgcaaaatatatcagaggtaataagtatcacaggaattggatttatcagactttttctaaatggagcattgtggtctttatgcggttcactgacggcagttttaactaaaaataagtatctgagctgtgctgttccatttattttatattatgtactaacagtgtttcaagaacgatattaccgtaattattttttcttaagtccaaaacagtgggcaagtccggcatattatggaaacggattctgtcttttggctctgcttctgatcagcagtcttctggcactggctttgcgtaaatgcgtggtaaggagagtggtggcatgaaaaaaacgcaatttaaaacggacattcatcaaatctttcttctaacaaaaagaaatttctctgactggggcaaaaatccaagaatttggatgacatttgcattaggctttgtactttgtctaatgttgacaaatcagattttagagcaggcacagacattccagacaccggtgcagatgttcgagccactgatctggaccttcggtgacgcacagtccgtgatgctttcatcccttttactgctgttattatttgcagatatgccttttgtaaatcagatgacaccctattggctgatccggacaaagcgaagcgtatggatggcaagtcagatcctatatgtgatcctggctacttgcctttataccgtcttcctctgcctgacagaacttctaattgcaagtccctgggcttacgttggaaatgtatggagtcagaccgctgcaagcattggatatggaagtaataatcatcttacggttcctgtatcaataaagacaatggaaatgacaacaccatataaatgtgcaatctgtgttgtatttcttatgcttttttattcgttatttattacttcagtcatgcttgtattaaatctacagaagggaagagccggaggcgttgttggcgcactcttgataaatctttatggaattcttctgactccggatatttttcaaaaagtttttcatctgggtggagggctttcctatcgggcaaatattctttgcggatggttatcacccttaaatcacgcaacatttccaatgcataatttcggatatgattatttgccacaaataaaaataagcatcctgttattccttgcagtgatatgtattttgcttttcatctcgagaaaatgtatcaaacgatataattttacattttctcaggttgatgaatcctgacggaataagaaaggggaaaattatgaaagctgctgtgaaagttaaaaatctaacaaaatcttttgggaaagaaaaagtattaaaaggaatcaatcatacctttgaggcaggaaaaatccacggaatcatgggatttaatggctccggtaaaactgtaatgttcaaatgcatctgcggttttcttcaacctgacagagggagcgtatatgtctatggaaaaagaattggaaaagatattgattttccggaaaataccggaatgattatcgagagtccgggatttcttccatatatcagtggatatgaaaacttaaaacgccttgcacaacttaatcgaaaaataggagatactgagatccgggatgcaatcgcaagagttggtcttgatccgttttctaaaaagaaagtaggtcaatattcactcgggatgagagaacgccttggaattgcacaggcgatcatggagcggccaaaattattaattttagacgaaccattcaatggattggataaaagaggcgcacaggatgtctgcgaactctttgttgaattgaaagaaaaagggacaactattctgttagctgcacacaatgtgatggaaatggaatggttgtgtgatacagtgtgcgaaatggatgccggacagttagaagttgtttatgaaaaatgaaataataattttttcaaattaaaagaagagagcgaacccaagaatattaaacgaatattcttcagttcgctctcttcgcacattgcgatataggtactccgacaaaatgatacatttctacgttctcaacatcttcaacatcagcttgaaattcatgttaaaatttgttagaatgatttgcgaacttacattctaaagagtttttagaaaacccttgaaaactaaggagaaattgatggaaaatattgacatagataagctaacgcccatgatgaaaatttattgcgagacgaaagagcagtacaaggattgcatcttattctaccgcctcggcgatttctacgaaatgttctttgacgatgccttgactgcatcccgagagcttgagatcacactgaccgggaaaagctgtggtctggatgaacgtgccccgatgtgcggaatcccataccatgccgtggaaggatatttgaaccgtcttgttgcaaaaggatacaaagttgcaatctgtgaacaggttgaagacccaaagactgcaaaggggattgtaaagcgtgaggttgtaagaattgttacacccggaacgaatctggatacacaggcattagatgaaacgaagaataattacatcatgtgtatcgtctatattgcagaccgctatggagttgcaatcgcagatatttctaccggagattattttgtcacagaacttccggacagcagccgtctgatggatgagatttataaattcagtccgtctgagatcatctgcaacgaagcgttctatatgagcggtatggatctggatgcgatgagagacaagcttgggatcacgatttattctctcgattcctggtattttgatgatgctgtctgcaaagataagctgcttgagcatttcaaagtaaagaattttgcagggcttggacttgctgattatgactgtggaatcatcagtgccggagcacttctgatctatttatttgagacacagaaaaattcactttccaacctgacacatattacaccatatatcacaggaaaatatatgctgattgacagttctacacgtcgaaatctggagctgtgcgaaactttacgtgagaagcagaagcgtggttcccttctctgggttcttgacaaaacacgtactgcgatgggcgcacgtacgcttcgcaaaaatgtagaacagcctttgatcgataaatccgagatcaaccgcagactggatgcagtagaagaactgaaaaatcaggccattgcccgggaagagatccgggaatatttatctccggtctacgatctggagcgtctgatcacgaagatcacttacggttctgcgaatccgcgagacctcaccgcattcaaaggttctctggagatgctgccaccgatccgctatattttacaggatctgcaggcaccgcttttaaaagagatttatgaagatctggatgcattagaagatctctgcgagctcgtcacgaaagccattcgtgaggatccgccacttgctatgaaagagggaaatattatccgcgacggttataacgaagaagttgataagcttcgccgggcgaaatcggacggaaaagactggcttgcaaaacttgagaatgatgaacgagagaaaacagggattaaaaacctgaaaataaaatacaacaaagtcttcggctattatctggaagtgacgaattcttacaaggatcttgtaccggattattatacaagaaaacagacacttgcgaatgctgagcgttatatcacaccggagcttaaagagcttgaggacatgatccttggtgcggaagataaactgtatgcactggaatatgagctttatagtgaagtccgtgaaacgattgccggacaggtggagagaatccagcagactgccaaagcagttgccgcactggatgcgttcagttctcttgcacttgttgcagagcgcaacaactatgtccgtccgaaaatcaatgaaaaaggaatccttgatatcaaagaaggccgtcacccggtcgttgaacgaatgattccaaatgatatgtttattgccaatgatacttatctggatgataagaaacatagaatttcaatcatcacaggtccgaatatggcaggtaaatcaacttacatgcgtcagactgcattgatcgcactgatggctcagatcggatcttttgtcccggcagaaagcgcgaacatctgtctttccgaccgtattttcaccagagtcggagcatccgatgaccttgcttccggacagagtacattcatggttgagatgaccgaagttgccaatattttaagaaatgcaacctcaaaaagtcttctcattcttgatgaaatcggacgcggaacaagtacatttgacggtctgtcaattgcctgggctgttgtagaatacatcagcgacagcaaactgttgggagcaaaaactttatttgctacacattatcatgaactgacagaactcgaaggaaagattgataatgtcaacaactattgtattgctgtaaaagaaaagggtgacgacatcgtattcttaagaaagatcgtaaaaggcggtgctgacaagagttatggtatccaggttgcaaagcttgccggagtaccggatcttgtcatttcccgtgcgaaagaaatcgtagaagaactcagcgatgaggatatcacaaaccgcgtcagtgagatcgcggcaaaggaacatactgcaaagaaaaaaagtaaagcaaagaagtatgacgaagtcgatatggcacagatgtctctgtttgacactgtaaaagatgatgacgtacttgatgaattgaaaaatatcgatgtcggaaatctgacaccgatcgatgctttaaatacaatctaccggttacagaataagctgaagaaccgttggtaaaaggaaaggcggaaatatgccacacattcatgtattagaccagatcacaattgataaaattgccgcaggtgaagtaattgagcgtccagcttcaatcgtaaaggaactcgttgaaaatgcgatcgatgcaggatcaacttctgtaaaaatagagatcaaagatgggggcatttccttcatccgtattacagataatggctgtggcattccgcaggatgaagtgcagcgcgcttttctgcgccattctacaagcaagattgagacagtagaagacctgtctcacatcgcgtctttgggatttcgtggagaggctctttcaagtattgcagctgttacccggacggaactgatcacaaagacagccgatgcagagtttggtacccgttatgtcattgaaggtggaaaagaagtatccttggaagataccggtgcgccaaatgggacaactttcctcgtccatcagttattttacaatgttcctgccagaagaaaatttttgaaaacacctatgacagaagccggacatgtgcaggatctcttgatgcatcttgccctgtctcatccggaagttgcttttcagtttttgaataacggacaggaaaaacttcgtacttccggaaatggaaaactgaaagatgtgatctacaatgtctatggccgtgatgtggcagctaacctgattgagatcgattatgagaaaaatggtatccatatcacaggttttctcggcaagccgatcatcacacgtggaaatcgcaactttgaaaatttcttcgtaaacggccgttatgtcaaaagtgcaatgatctccaaatccgtggaagacgcttatcgtgattttgtgatgcagcacaagtttccatttgcagttctgcattttcatctgagtggagaaaatgtagatatcaatgtgcatccgacaaagatggagcttcgcttctcgcggcagcaggaggtttataataccgtctttgaagccgtacacaggactttgctggaaccggaactgatccagaaagcagaagttcctgatccggtagagcaaccggagagacaagccgaaagaccggagcgagtgaaaaagacattcacatccgcttcgaccaaagataaagaggataccggcagtccgtttcttcttcgtccgcgtaaggagaatgaaaaagtaacagctgcggaattgatcaaagaatccaaggaaacggttaaggatgatgttcaagatgaggattattttatccgtaagatgaaggagcgcgtactttcttaccataatcgttcttcttccgccgaagttgcagaccggaaagagattttccgtgcagatgaacagaaagacaaaattgctgaacatgtcaaatacgccgttgaagcagcagataagacagttgcaccggaaactgcggcagcagttcaaaaatccaaaccagctgttgaaatgcaaactgctaccaccagcaccgatgcagcatctgattgtgaaataaccgacgcaaaatcagaaccagaaaacggtacgcagatggatctctttgaagaaaatttcttaaaaagagatatccgtgcagaatataaattgatcggccaggtctttgacacctactggctcgtagaatttaaagataatctctacatcattgatcagcatgcggctcatgaacgcgtcttgtatgagcgtaccttgcgtgaaatgaaaagcagagaatttacttctcagtacttaagtcctccgatcattttaagcttatccatgcaggaagcacagcttctgaatgaaaatatggaccgcttttcacgcattggtttcgagattgaaccttttggtggagaagagtatgcagtccgtgcagtacctgacaatctgttcagtattgccaagaaagaacttctgatggagatgatcgatgacctgaccgaaggtctttctacttctatgacaccggagctgatcgatgagaaggttgcatccttgtcctgtaaggctgctgtaaagggaaataaccgtctttctgcacaggaagtagacaaactgatcggcgaactcctgacactggacaatccatatcactgtccgcatggacgaccgacaatcattgccatgacaaaacgtgatctggaaaagaaatttaaacgaattgtataaatggaatcgaggaaatatagatggaacagacaaacaaacgcccacttgtcattctgaccggaccaactgctgttgggaagactgctgcctccatcggacttgctaaagcgatcggcggagagatcatttctgctgactctatgcaggtctacagggagatggacatcggctctgccaagatccgtccggaagagatggacggtgtgccgcatcatctggtagatgttcttgatccgtctgaggattttaacgttgttctctttcagcagatggcaaaagaagcaatggaaggaatctatcagcggggacacattccaatcgttgtcggcggaacaggattctatattcaggcattactttacgacattgatttcacagaaaataatgccgatactgcttatcgggaagaattagaagcacttgccaaaacccagggtgcagaatatcttcatgaaatgcttgaaaaagtagacccggaatctgcggaacagattcattttcataatataaaacgtgtgatccgcgcgctggaatattatcagcagaccggacagaagatttccgagcacaatgaggcggaacgtgagaaagaatctgcttataactccgcatattttgtgctgacagatgatcgtaagattctctatgaccggattgataaacgtgtcgatctgatggtgcaggaaggacttcttgaagaagtcaatgcgttaagattgcgcggacttaaaagagaaagtgttgcgatgcagggacttggatacaaagaactgtttggttattttgaaggagagtatcctttggaagaagccgtacgcattattaagagagacacaagacattttgccaagcggcagttgacctggtttagaagagaacgagatgtcatctggcttgataaaagtgagattggaagagaagatgaacaactgatccaacagatgctcactgttttaaaggaaaaagatattattcattaggatatcaggctgcatttagataaaatgcagctttgccatgtaaatcaaacgataaaaaacttaaaaagaaagaagaagaaaaatgaatacaccaactacagaaacaatttacgaacaactaggaatcagtaaagaagtctgggcgttcggacagaagacagaagagaaactaaaagaacgttttgaagaatttgacagaaacgctgaatacaatcagttaaaagtaattcatgccatgcaggaaaaccgcgtaagtgaaggatgctttaactatgtaagcggatatggatacaatgatcagggaagagatactttagaagatgtctatgcctctgtttttcatacagaagctgccctcgtacgtccgcagatcacttgcggaacacatgcgcttgcgcttgcgctcgcagcgaatcttcgccctggagacacactgttatctccggttggaaaaccatatgatacacttgaagaagtaatcggaatccgtccatctaacggctctcttgcagaatatggaatctcctataaacaggtagaacttctggaagatggatattttgattatcctgcgattgaaaaagctctggaagataaaacaatcaaactggcaacgatccagcgttccaaaggataccagacacgcccaagctactctgtagaaaaaatcggcgaactgattgcatttatcaaagggcgtcgcccggatgtcatctgtatggtagataactgttacggtgaattcgttgagcgtatcgagccaagtgatgtcggtgcagacatgatcgtcggttctctgatcaaaaatccgggtggcggacttgccccaatcggcggatatattgccggaagagctgatctgatcgaaaactgtgcttatcgtctgacttctccgggactcggtaaagaagtcggtgctacacttggtgttacacagtccttctatcagggattcttccttgcaccaactgttgtatgcggtgctttaaagggtgctacttttgcagcaaatatctacgaagctttaggatatccggtaattccgaacggttctgaatcccgtcatgatatcatccaggcggttacacttggatcagcagaaggtgttattgcattctgtaagggaattcaggcagctgctccggtagacagttatgtaagcccggaaccatgggcaatgcctggatatgacagtgatgtgatcatggcagctggtgctttcgttcagggttcttccattgaattaagtgcagatggaccggtaaaacctccgtacgctgtctatttccagggtggactcacatggtatcatgcaaagcttggtattctcaaatcgctgcagagcgttattgatgcaggcgttctttctatcgagcgtgtgagagaacttctgtaaaacaatttttcgagagaattctatcgaaaattcagttgagttgaatgaattgttatgttaaaattcagacagatgtaatctgctaagaaagtaagaggatatgaattttaatgaacacaattgcaattataggtggcggtgcatcaggaatgatggccgccattttcgctgccagaaaaggagcgaaagttctccttctggagcaaaatgatagattgggaaagaaaatattagtgacaggaaatggccggtgtaattatacaaacacttaccaggacgcttcctgttatcgttcggagcagcctgactttatcacgcgggtactggatcagtttccggcagaaaaagtcattacttttttccgaggactcggaatctatccaaaagatagaaatggatatctgtatccgtactctgatcaggcaagtgccatccgtgatgttttggaacaagaagtttaccgtcttggaattgatgtgcgtacagaaacttcctgcaccggaatacagaaaacaaaagagcgatttttcctgcagacctcacagggttctttgaccgtagatcaagtgattctctgcaatggttcaaaagctgcaccttccaccggttctgacggttccggatacgctttagccagacagcttggacatcagataattcctgtacttcctgctctttgtgctttacattgtaccggaaagcatttccgcacaattgccggggtgcgtgcacagggaaaagtttcgttgtttgttgaaggtgaattaactgctgtcgataccggtgaacttcaattgactgcctatggaatctcaggaattccggtattccagatcagccgttatgcatcgaaagcattatatgagcagaaggaagttgttgccatgctggattttcttccagaatattcggttgatgaagtgaaaattcttctgaaagaacgtgccaaccgccagccagaaaaaacagcagagcagttctttaccggcctatttcatgaaaaactggccgctgtatggctgaaatttgccaagatcaaaaaagagaagctatgcggcgacttcacagatgcagatattcagaggctggcatggatgatcaaggaattcaaatcacctgtaattaagacaaattcttatgaacaggcacagatctgctgcggcggtgttgatacgacacagattaatccggaaacgatggaatccagacttgttccagggctttattttgccggagaactgatcgatgtagatgcaatctgtggtgggtataatctcacctgggcgtgggcaagcggttatgttgccggacagtctgccgcatctgcataatcgcctgctgctaacttgtaaccaatatctggatgatatactttaatattagatttcctgaaagaaaggatagataaatgatacgaattaatcagctgaaactacagattccacacacggaagaagctcttgaaaagaaaatacaaaagacacttcatctaaagaaaggggactcttttacttatcggattcaccgtcagtcattagacgcacgcagaaaacccgaattattctatgtgtatacggttgatgtcactgtttccaatgagaatgctattctgaagcattgtaaaggaaacatccagaaagtagaagagaagcattaccagattccatctcacggaacagagactctgaatgcccgtccggttgtcatcggcagcggtcctgccggactattctgcgcttatctgctcgcactggaaggataccgtcctttggttattgaacgtggtgcctgtgtagaagaacgtaagaaggatgtggatcgtttctgggagaccggtgtgcttgacccttcttccaatgtccagttcggtgaaggcggcgccggtacattttcagatggaaagttaaatacacttgtaaaagataagacaggacgtaaccgtttcgttcttgagactttcgtaaaattcggagcggacgaagatattttatatgcacataagccacatatcggtacggatgtcctgattgatgttgtgagccagatgcgtcaggagatcatttcgcttggcggtgaattctgttttcatacacaggtcacagatgttgatctgacatcaaaaacactgaaacttgttcatctctcagagaattccgcagaagaagtatctgccggagcagccgtttttgcgatcggtcacagcgcccgtgatacattcgaaatgctttataagcatcagattccgatgcgcgcaaaatcatttgccatcggagtccgtatcgaacaccctcaaacattgatcgatcattctcaatatggaagagatcggggaaatgatcttccggcagcagcatataaactgaccgagaacttggacaatggaagaggagtctatactttctgtatgtgcccgggcggatatgttgtaaatgcttcttctgaagagcatcgtcttgcagtcaacggaatgagctatcatgaccgtgccggagaaaatgcaaacagtgctgtgattgtcacagttactccggatgacttcggttctgaccatccgcttgccggaatttctttccagcgcagcttagaagaaaaagcttatcaggcaggacagggaaaagttcctgtccaacgttttggtgactttaaagaaaatcagattacaacttcttatggtatggttcattcttgcatgaaaggagcttctgtctttggggatgtacgtggtatctttccagaagaaatcgcacagtcgcttgaggatggaatcacagcaatggatcataagattcatggatttgcagataatgatgcattattatccggtgtggagagccgaacttcttcccctgtaagaattgaaagggatgagaactttgtctgtgcttcctgtgactggatctatccatgtggtgaaggggccggatatgccggtggaatcacttccgcagcgatggacggaatgaaggtcgccgaggcaatcattcaaaaatataaatcttaatcatttatgaaatttgtggttttttggtatcttctctatacacttttttgaaactgtgctaaaataaatcgttgtattatgtcatcgcagtgatatgattcacatggaaaatagaaatacagaaacaatcaaaatgatgtatcttgaagaccgtccttatgaaaaatgtgagcagtacggtgcagaacatctgacagatgtggaacttttagctgttttacttcgtaccggaacgaaaggggagaattcgcttcggcttgcccagaagattctgcatccaccatttggctctgaaggacttctcagcatcccacagtggtctatggaacaactgctgaagatcaaaggaatcggaaaggtaaaatccatccagattctttgtctggcagaacttgcaagacgtatggcgaaagcagaagcctcactgggattggatttttcctccccggacagtattgcacgttattatatggaggatcttcggcataagaaacgggaagtaatgaagcttttgcttctgaataccagatccaggctgatcagtgagatggatgtttcaacaggaaccataaattccacacttgtttctccacgggaactgtttgtggaagctttgcagaagaatgctgtatccattattcttttgcataatcatccgagtggagatccgacaccaagcaaagaagatcttctgacaacccggcgcgtccgtgaagcaggggctttgatcggtatagaacttctcgatcacatcattattggagataattgttatttcagtttaagggagaaaggattcttttctcaagaatctgcaaatagataagggaatggagtgtatttatggccaggaatgtatatgggttagatcttggaacttatgatatcaagatttttgataagaaaaaagaccgcatatggcatgccaagaatgtaattgccatgaaagataaaaaatatattttttctgtcggagacgatgcttatgagatgtatgaaaaggctccgggaaatatacagatcatatttccgatgaagaatggtgtcattgcccgttttgatgacatgcaatatcttctcggagatcttttgaaggaagagcgtccgtttatccgtggggcagaatatgtgatcgctgttcctacagatgtcacagaagtagaaaagaaggctttctatgatcttgtgcttcattctgaagcgaaagcaaaatcagtaagaattgtagagcgcggtcttgcagacggacttggacttgggattgatgttctggaagaaccaggagcttttatcgccaatttaggtggaggaacaacagaactttccgttctttcctacggtggtattgttatgaaccgtctgcttaagatcggtggcgaacagctggatagtgcgatcgccaatcttgtccgtcattctaaagattttataattggccgtccgactgccgaacggctgcgaaaagaatttggagtttttgaccagtccaccggaagctttcttactgtatacggcagagatatgatgcgcggcggtccgtcgcacattgacattccaatcagtcttgtacgggcagcgatcaaagaacctttgagagaatgtgtgcgggccattcattccatgctcgaccgtacacctcccgatgtccggagaaatattaataaaaacgggatttatattactggaggacttgctaatctgcgagggatttctacttatctggaagaaagtatcggtctaccggttcacatgaaaacagaccctgaactctgtgccgtcaaaggtctgcagaggatcatactgaataagaccttgtatagaaaattaagttactccatgttagacgaagattataggtggttaagataatatgaaaaaaaagaagaatcagacttctgttatgaacagatatttacttataggactttctgttttctgcatttttatgatgctgttatcttccttttcagacaaagtaggaggtccatttaaagttgttgcaaatgtaaccgttatccctcttcagcagggaatcaatcagattggtggctggatgggagatatgaaagacaatttccaaactctgaaacaggtacgcgcagaaaatacaaagcttcagaaacaggttgactctctgattacagaaaataacaatctacaacaagaacgttatgagcttcagagactgcaggaattatatcagttggacaagaactatgcggattacaaaaaaactgctgcgcatgtaatcgggaaagattccggaaactggttcagtacatttaccattgacaaaggaagtaaagacggtattgccacagatatgaacgtaatggccggaagcggtcttgtcggcattgtcacagaagttggtccaacctgggcaaaagtccgttctattattgatgattcaagtaatgtaagtgcaatggtactttctacttctgaccgttgtatcgtaagtggagatctgtcacttatgagtgataaccagattcgttttggtcagatggaaaacaatgataatacggtttccgtcggagaccagatcgtcacttcttatattagtgataaatacctgcagggaatcctgatcggatatgtcagtgaagtaacggtcgactctaacaatctgactcgttccggatatattacaccggctgtagattttaaaaatcttcaggaagttcttgttatcacaacaacgaaagcggatttggtcggatccaatcagagcgaataggagtgaatactcatgaaattaatgaaatttaaaagagttgctgtaactgtactgatcgtacttgcagcatatctgctccagtgtaccttattcaatcatctggaacttgctggaattaaacctaacctgattctgattgtcacagcatcctttggttttatgcgtgggcagaaagaaggaatgctggtcggtttctttgccggccttatcacagatattcagtttggtacaattttgggattttatgcattactttacctggtaatcggttttgtaaacggattatttgaacagctttattttgatgaagatatcaagctgccgttatttttgatttctgtcagcgaatttctctacggtatcatcatttatttgctcatgttcatgttgcgaagtgattttaactttttatattatctcaaccgcatcatcgttcctgaactgatttacacaatcgtgatcacactgggattatacccactgattttatttattaaccacaaacttgaagcagaagaaaaaaggagtgcaagtaaatttgtttagaaatattttagaccgtctgaaagaagccggagcttacctgatgcagtcaagactcgttactttgatcattatattttgtgtcagttcttccatcctgatcggaagattattctatcttcagatcgtaaaagggtctgattatcttgaaaactacgaatattctatccgccggacgacatccgttgcagcaacacgcggaaatatttatgaccgtaatggaaatctgctggcttacaaccagctggcttattccgtgacaattaatctgtcaaccgttgaaaactccatcacaacagataaacgttctgaaaaaaatgcggcattaaataaaatcctggatcaggttctttctatcgtagaatcaaatggagattctgttgtttcaagttttggtatcatcctggattcctccggaacctatcagtttacacagtcaagcgatacccagaagctccgttttattgcagatgtctatggaaaaagaacaatagatgaacttacagaaaagcaacagaaccaaagtgcagcagatatcattcattatctttgtaccgatgaaaaatatggatatggccttgatgacagcacattagagcctgcttatattttaaagatcatcaacatgcgttacgcaatggcattaaatgtatatcggcagtacattgatacagttcttgcatccgatgtaagtgacgaaacagcagcagcaattatggagaataaggacgtccttaccggtgttgacatttcagaagattctatccgaaaatataccgatggaatgtattttgcatctattatcggatataccggacagatttcccaggatgaatacgatgcgctggacaaggatgaaaagaaaaagtactctctgtctgatattgtaggaaaggccggcattgaacaaagcatggacactgtccttcagggcacaaaaggtgaaacaaccgtgtatgtagatagactcggacatgtaactgatactgtcagtcggaaagatcctgaagccggaaatgatgtatacctgacgattgataaaaatcttcaggaaagtacttataaacttctggaagagaagattgccggaattgttttatccaaactacagaatgttctggaatacgatacatccagtgtagatgactctaagaatctgatcatcccggtcagtgatgcatattataatctgatcggaaatgccgtcatcgattcaggacacttttcaagcagtgatgcaaaaactgccgagcagcaggtttattccattttccagggaaagaagactgagacgatttccatgcttgaatcagaacttcagaactcacaggccagcgcatatacagatctttccgatgaaatgaaagcatatatggattacatctgtgataccctgctgacaaaggatacaggcatccttatgtcagatcagattgataagaatgatgctacttatattgcatgggcaaaagatgagacaatcaatttatatacttacctgaattatgcgatttctaaaaactggatcgatacttccaaacttggaagcagttcttattccagttcagaagagatttatcaggagattttaaaatatttaaaagaatatttggcagatgacagtaatttcgacaaacttctctacaaatatcttataaaatcaggtagtgttactggtgaacaagtttgtgctatcgtatatgaacagggtgttcttcctatggatgactcggcatataacggattactcaacggaggaacagatgctttttcctggatcaagagcaagctggaaagccttgagcttacacctggtgaactggcacttgagccatgttctgccggtgcagttgtaacaaatccaaataccggagaagttttagcatgtgtttcttatcctggatatgacaataatcgtctctcaaacgtaatggatcgttcttattatgtgaagttgagcatgggtatgtcacggaccttctacaacagagcgacccaggagaagacagcaccaggttctacttataaaatgctttcttctgtagccggtctgacagaaggggtaattaatggaaactcctatatcagttgttcaggtgtatttgataagatcacaccaagtccaaaatgctggatttatccaagtgctcatggaagtctgaatgtagtaggtgcactgcagcattcctgtaatgacttcttctatgaagttggttatcgtcttggacaagactcgaatggtaactatgacagtgataccggtcttgaaaaactggcaaaatatgcaaaaatgtttggatttgaccagacatcaggaatcgaaattcctgaatcacagcctcagatttctgattctgactctgttcgatctgccattggacagggtaccaacaactatactgtcagccagatcaaccggtatgtgacagctgttgcgaacagaggaactgtttacagtctttctctcattgataaaacaaccgattcgaatggaaaactgatcaaagattatactccggaagttgtaaatcagatggatgagatcagctcaagtacatgggatctggtacacaatggaatggaaagcatggtaaaaagcagctccacctttgccggaatggatatttccatgggtggaaaaaccggaactgcccagtatagtaagatacatgcagataatgttctgtttgtcggttatgcgccggcagattcacctgaaatttcaattgctgtccgcattgcgaatggatatgcatctacctatgcagctgaaattggaagagatatcacaaaagtgtacttcaatccagaatccgccgatgaactgcttcaaggatatgcttcttctttaggaactgcaggagccggtgattaattaagataacgaaaggggatgggatcatgagtgaactggtaacaataaaaagcagtcattccggtatagagctgcggcttaatgccgaactcccattcccggatcttttgaaagctgtagaagagaaattccgacaatctgctgattttttcaagaatgcaaagatggcagtttcatttagcggaaggacactttccatcagcgaagaggagcagttaatacaggttattacgcagacgacaaaccttgagattatctgtatcattgatcatgatgaacgcaaggaactaatctacaaaagagcggtagcgcagtgtttatctgaacgtgaaaaatcagatggacaattctatcgcggaacattaaaacgaagacagcttcttgaatccgaatccagcattgtgattttaggagatgttgaattcggagctaaagtagttgcaaaaggaaatattatcattctcggtactctctatggatctgttcatgcgggagctgccggtgacaggaatgcttttatcattgctctctccatgcagccgcagcgacttgtaatcggagatattgaagcaaaacgtcaattgatctatcaggacagcctttccatcaacggaccgcaaattgcagttgttgacggaaaaagaatttaccttgatccactgatagaataaatctttggaaagacataagcatgggaaataggaggaatattcaacatgggtgaagtaatcgtcattacatcgggaaagggcggtgttggaaaaacaacaacaacagcgaatattggaattggtctgtcttcagcaggaaaaaaagttcttgtaattgatacagatctcggacttcgaaatctggatgttgttcttggacttgaaaatcgcattgtctacaatcttgttgacgtcattgaaagcaaatgtcgtctgaaacaggcagtaatcaaagatacgcgatttgaaaatctgtacctgctcccatctgcccagacaaaagataagacaagcgtatcaccggaacagatgaaaaaactgattgacgaactaaaagatgattatgactttattcttttagattgtccggcaggaattgaacagggctttaaaaatgcaattgcaggagcacagcgttccattgttgttacaacacctgaagtttcctcaattcgtgatgctgacagaattattggattgcttgaagcttccggaatccggaaaaatgaacttctgatcaatcgtctgcgcgttgacatggttcgcagaggtgatatgatgtctgtagaagatgtcacagagattcttgcgattgatctgcttggagtcatcccggatgatgagtctgtcgttgttgcaaccaatcagggagaaccggtagtcggcgaagattccttagccggaaaatgttaccagaatatctgtagacgtctgttaggagaagaagtcccgatttccgattttaatcacaaacccggacttcgcagtaaactctccagtctttttcataagaactaggaggtcacattatgagtgtaccttctgttacaattgcaaaagacaggttgcgaaatttgctaattactgacagaattcaatgtacacccgatatgatagaatttctgacatcggatttatatcagacaatttctaaatacatagaaatctccccagaacaatttgatgtcaaaataacacgcacggatatacatataaaatatacaggagaaaaacattgaaatcattttttactaatttgaaacagcattataatattagagattataaaatcagtctggtttttctggtcactctgatttcactggtcggaatccttatggtccgaagtgcaagacctgatttaatgaatcgtcagattatgggcgtttgtcttggtctgattgttatgtttattatctctttcattgattataaatggattttaaacctatattggccactttatgctctgaatattgttatgctcctggctgtttttctttttggaacagaggtaaatggcgcgaaaagatggctgaaccttggatttacacaattccagccttccgaccttacaaaaatccttatgattctgttctttgcaaaattcttaatggaacgagagcagaagattaaagaaccaaaaacgattattcaggcaattgctttaatccttccatcacttgcattgatttataaacagccaaacttgtctacaacaatttgtattgccgcattatttgctgtccttctttaccttggaggattaagctacaaactcattggaaccgttcttgtaatcacaataccgacgatcatcatactgcttgttgttgcaatacaaccaaaccagccattcttaaaagactatcagcaggaacgtatccttgcatggctggaacctgaaaaatatgccgatgacgaatcttaccagcagttaaactctgttatggcaattgggtccggacagctgaccggaaaagggtatgataatgacgcaacaacatccgttaagaacggaaatttcgtattagagccgcaaacagactttatttttgcaataattggtgaagaattaggatttgtgggttgttgtggagtcataattttgttattattaattgtgatagagtgtatcttaattggtttgaaggccaaagatacaggagggcggatcatttgcggaggcgttgcttcactgattggaatccagagctttattaacgtcagtgtagctacaatgatttttccaaatacaggattgtccctcccatttgtcagttatggactgacttccgtagtatgttttttcatgggaatcggttttgtattaaatgtaggcttacagcctaataaatatcagtaaagagaggataccactatgaatatcggattagtagcgcatgatgcgaagaaaaaattgatgcagaatttctgcattgcataccgtgggatactcagtaagcataatttatatgcaacagaaaccaccggtatactggtcgagaatgtaacaaacttaagcattcacaaatatcttgctggacatctcggaggaaaacagcagctcggctcacagattgaacacaatcagatggatcttttgattttcttccgtgatccactgacacctcactcacatgaaccggatgttaatgacattgttaagctttgtgatatttataacattccgatcgcaacaaatatcgcaactgctgaagcattgatccttgctcttgacagaggcgaccttgactggcgggagatgtatcgataatatgagtaaaccatacaaaaagaagagaagacgaagaaagcaacggcattctgtcagccgcatacttattcctgtcatatgtcttattgttgtattgtccggagctgtcggtggagtctggtattacaaagaatatggtggtgatcctgtccggacatatgagacagccacttataactctaatttataccagggaagtttgtttgctgataatttatgcgtcgctgctgatgatgtggctctcactggatttgatgatgaggattctcttcatgctgcaggattattcaatttaaatgataagacagttgaatatggatataagctttatgataaattatatcctgcaagtacaacaaagcttatgacggcataccttgcttttaagtacggtaatatggatgacatcgtaactgtttctgacagtgtttcaggctttgcatctgatgaagtagtctgtaacctgcagcctggtgataaagtgacactttatgatttattgtgcggtcttttacttcgttcaggtaatgactgtggtgttgctatcgctgaacatatttccggaagtgtagaagcttttgctgagcttatgaactcagaagcgaaggctcttggtgccactggcagtcattttgtaaatcctcacggacttcataatgataaccattacacaacagcctatgacctgtatctgatctttaatgcctgcattcaggatcagagatttatggacattatttccatggattcttatacaatgaatcttaccggagcagatggtacaacaagaacatttgatgtagtcccaaccaactattattcctcagggaagatcaatgcccctgaagggattcgtgtatttggcggtaagaccggtaccacagatgaagcagggtgctgtgtgatcctttatagcgaagatctggaaaagaatccttatatttccattattatgggggctgaagataagagttttctttaccaggagatgagccggcttcttgaggctggagaaacaactaaaacagaataaagaataaccgatacgaaaaagccatgtggcacagagcaacaaattagaagctttcatttttaatctgtccgcatggtttttttctatcttatttcatgtaatattctcctttaccgtttcctgttttcagtaacgctctttaatttattaatatgtattcttcccatgaaaggctggaaatatacacaaaaaaatgatatactaacaaagttaaagcagaaatgacaggaggtaatatttttatcttggcaaagaaaaaaaacaagtctgtaaatataaaaagatataaggcaaaaaaagaatttaatattggaatgtttctgtttgcagttgtatttatttatcttattgttactattaccgcatatcttttagaagataagccttctatttatgaagtgcgggagggcagtattgtgaaggataatacctataccggattgatcatccgccaggaaacaactgtaaatgcagaatcgggcggctacattaattattatcagaatgggaacagcaaagtcaaatatggcgcacctgtttatgcaatttcaaagaatgctttgaattttgatgattcatctacggaatcatcttcaactgcagatcttagtcctgatgttcaatcaggacttgtgacacaacttcagacattcaatgaaaactatgacaattccaacttttcaagtatctataccttaaagaatgagctgcaaaatacattgcaaaatgcatactgcacaactaaaactgcgcagcttgcatctgtaattgagagcagcggacaaactgtcacaacctcttctgccggacaggacggaattgtttcccatacgattgatggtttagagtccttaactgttgacaattttacagcagataattttaataaaacaaattataaagtaactgagcttaccgatcagatgaagatatcaagcggttcaccggcttaccgcttgattaccagtgaaaactggtccgtagtgatacctttaaaagaagacaccgcaaaagaatttcagaaatctaatttacagaatgtgcaggtccgcatagataaagacagtgaaaagatgtggtccgctttctctgttcttgaacgagatgggaatttctatggtgttctgacctttgacaactctatgattcgttatgcatcagagcgttttctgaacatagaacttatcttagaagatgagtgtggcctgaagattccaaaatcttccgtagtagaagagcagttctttgtaattcctcatgattacattacaaacggaggtaacagctctttagaaggtgttatggttttggattcaaaaggaactgcctcatttcaggctgttgatatctatgacacctccgacgatggagaagtttatttaagtcgagatcagctgaaatccggaacagtgattgtaaaaccggattcttctgatacttatacgattgatacccaaaagccattaaagggcgtctacaatatcaataaaggatacgctattttcaaaaaagtatccattttatgtgaaagcgacgaatattacattgttcaggaaggagattcttacggactttctaattacgatcatatcgtacaaaacggagccggtgtttcctctgatgatgttgtatttcagtgatttgattttgtagtcctttggaaattggatacaaaattcaaaagaggataatcaaatttaaaaaaggagagataacttatgctagaaacacagttaaaagaagtagaagcaaagattcaggcagcctgtgaccgtgccggacgcaagcgggaagaagttacattgatcgccgtaagtaagacaaaaccgatagaaatgcttcaggaagcttacgatctcggtgtccgtgtgtttggtgagaataaagtacaggaaatcacagccaaatacgatgcacttcctgatgatatccactggcacatgatcggacatctgcagaccaataaggtaaaatatattattaataaagtagatctgatccactctgtcgattctttcaagcttgcagagacaattgaaaaggaagctgcaaaacataatcttacagctaatattttaattgaagtaaatgttgctcaggaagaaagtaagtttggacttaaaacagaagaagttctcccgtttattgaaaagattgcaaatttcgaacatatcaaggtctgcggactgatgacaattgcaccttttgtcgataacccggaagaaaatcgtcaaattttcgcaaatttacataaattatctgttgacattaatgagaaaaacattgataatgtttatgtgaacatactttcaatgggaatgaccaatgattacgaggttgccatagaagagggagcaactatggttcgagttggaactggtatctttggtgcaaggaactataatatctgacttaatttattaacctgatgaatgagttactgtttacaatatttttgaacagtaattgaatagtatcattttttcgttggatcgtatgaataaaaaagagcgccacctgaaaaaggggacaagataggagtgtaaaaatgggtgtatttgataaatttcttgacatcatgaagttaaatgatgacgattatgatgacgatgaattttatgatgatgatgattttgcagatgacggtgattttgaggaaaaaccgcgtcgttctttcttcggtaagaagaataataaagaggaatctttcaatgactttgatgctgatgaagataagacgtttcagccttctgcttccagcaaggttacaccaatgcgttctgctgcaaaacacggcggaaacatggaagtatgcgttgtaaaaccaacttctgtagatgattcccgtgagatcacagagacattacttgcaggccgtactgtaatccttaacttagaaggtatggatcttgagattgcacagagaattattgattttatttccggagcagcatttgcgatcagcggaaaccttcagaagatttccagctatatcttccttgttacacctacaaatgttgatatttccggtgatcttcaggatcttctcagtggatctatggaaacaccaagtgttcgtggaagatactagaatttaacttcaactataggaactggattttagaattattatgataaaagaaaatcagaaaaaagaaacaaagcttttggaacacagatttattgaactttccagaattgcttttgaacgtgaaattgttacatattcggattttcttaacctgaatgatcagaatatcctgcataccctgccaaagaacaagctttattcaagatatgtcctctttggcgggtatgatatggcggagcgtcagatggctgcatttatccctgaggctctttctttgcgttatggggtatctgatattactccgaaagagattgattatccgttttgtgctgtgaaaatagaaccaaaaaataaaagattttctgaagacctgactcacagggattttcttggttccatattaaatcttgggattgaccgttcaaaaaccggagatattcttgtgacagaagattcagcacttctttttatcaataaggaccttgtatctgttgtaacagaagacttaacccgggttcgccacactgttatagatagttctgtcatcaacttagatatgataaactacacacctgatttccagcagataaaaggaactgtttcatctgttcgcttagacagtctacttccacttgcattttcttcttccagaagtaaactgtccggactcattgaaggcgcaaaggtctttgtaaacggcaaattgattacaagcaatggatatcaggtaaaagaaggagatcttatctctgtacgcggattaggtaagttccgttttgaggaagcggggaaaatcactaaaaagaatcggatcagtgtaactattcagaaatatgtataatctaaaaagcttagaaaagaggagcttatcgactcatgaataatacaaaaacaaagacaaagagttatcttttcgctgccattgggtttctgctcacattagcacttgaccaatggaccaaatatcttgcatctactattttacgccgtctcgagtctttctctttgatttccggagtttttgaacttcgctatcttgagaaccgcggagctgcatttggtattatgcagaatcgacagattgtgtttgtagtcggaggtattattatacttgctgttattttgtatctgtaccagaagatgccatttacaccacattacagaccactgcgtatctgtgctgtactgcttgcatccggagctgtgggaaatatgatcgatcgtgtgaaacttgattatgttgttgactttttctatttccgactgattgattttccaatctttaatgttgcagactgctatgttgtaattgcatgtattttatttattgttctcattttattttattataaggacgacaacgattttgagtttttaaattttaagaacagataaaaacgcacaacaggaaggattctgaaagcttatggaagaacttcattttaatgcggatattacaggggaaaggatcgataaattccttgacgggagaatagagagcctttcccgttcttatatccagaaattaattaaagaaaaaaaaattcttgtaaatcaattaccggttaaagcgaattacaagttaacaacaggggatactatcattcttcagattcctgacccggaaccacttgatattcagcctgaaaatattcctctggatattctctatgaagatgatgacattctcgtcgttaacaaaccaaaaggaatggttgtacatcctgcaccgggacattacagccatacgctggtcaatgcggttctatatcactgtggagaaaacctgtcgggaatcaatggtgtaatccgtccgggaatcgtccatcggattgacatgaatacaaccggttcccttctgatctgcaaaaatgataaagctcatcagattcttgcagaacaattaaaagaacattctatcacaagaaagtatcacgctatcgtacatggtaatctgaaggatgatacaggcactgtgaacgctccgatcggtcggcaccctacagatcgtaagaagatgagtacaaaagcaccaaatgggcgacatgcagtcactcattaccgtgtattggaaagatttggtaattttacctacattgagtgccagcttgaaaccggtcggacacatcagatccgtgttcatatgtccagtatcggacatccaattctgggcgatgagatttatggtcctgcaaaatgtccttataaactccagggacagactttgcatgcaaaaatccttggtatcactcatccatctacaggagaatatatagaatttgacgcacctttgccagactatttcaaagatttattaaataaattaagaaaacaaaactaagtataggaaatggtataggaaatagtgaattgacattgtcttttttcatctttttggttataatatacataagatttcgcatagacttgaaaaggagtgtggcttattatgaagacaaatactattataacaatcggacgtcagtacggaagtggtggaaaagagatcggacatttcgttgccgaggcatttggaattaaattatacgacaaggaaatgctcgcgcgtgcagcaaaagaaagtggtatctgtgaggaattatttgagactcatgacgaaaagccaacgaacagttttctatattctcttgtgatggatacatattctatgggatatgccggcaacacatacacggagatgcctatcaatcacaaagtttttcttgcacagtttgatgcaattaaaaagattgcagatgagggaccatgtgtcctggtaggccgttgtgcagattatgcacttgaatcctatccaaatgttgtcagcatcttcattcgtgcagatatggaagaccgtattcgtcgtgtagcaacaagacttgatcttacggatgcgaaagcaaaagatctgatcaataagacggataaaaagagagcaagctattacaattattatacaaacaagaaatggggcgaggcagccagctatgagctttgcttaaacagttctgaactcggagtacaaggtacagcgaaagcaattgaacagtatattcttttaaaagaaagtattgaaaaagaagccagaaatattgtttaatcttatttattaaaatgtatagtgcaaaggatacagaagagcagtagtgcattctttctgtatcctttttatctattcttattctttttactttctatacttcacgaagctttacagcacctgccgcctgacggcgtcggtcttcatcgattgctgcataatgtttctttgttgtattgacatctttatgccccagaacatctgcgacaagataaatgtctccggtttctttataaagtgctgttccgtaagtgctgcgcagtttatgtggagttatcttcttattcggagtgacctccctggcgtacttctttaccatattttcaactgcctgaacgcccatacgttttcgctgggtagacaagaacagtgcgttttcatgaccggagagtggtacagtttgctttctggtcgtgtaaagatacgtctttaatgcattctcaacctcttcaccgaaatacacaaccatctgattcccaccttttcgtgttacagtaattccgttattcttaaaatcaatatcctgaagatccagtccaacacattctgatacacggattcctgttccaagcagaagcgtcagaattgccagatctcgattttttgtcttttcaaaataggctttacgctgacctgtaagattatcacccccgtgatcgacataatccaggagcattgcgatctcatccgtatcgagccgtataatcgctttctcatgcagcttaggcatctctacaagcaacgtagggttcttactgataatttgccgtttaaaataatatccataaaagctacgaagcgcagacatctttcttgcaagtcccttttctgtgttcgtgatacatttttcttcgtcattcttatagaccttcagatattcctggtattcctcaatatctacaggctccaggcgttccagatcatgtacctcaaattgttcgattgtataatttttataaaccggattattctccataaggaaatgaaagaaaacacggatatcataggcataagaaatcctggtccgcgcagatgtcgttggttccaccgcacgaaaataatcctttgcaaatggaggcaatgtcttcaggatctctctgagacgtaatgtgttatctatatatgtctgttcatgatatgtttttctgttagaagtttctgccatattaaaagctcctttatagattcaaatttactgaaaaccccatatttcttatatattttaacataagtactgtttttcgtctatatcttttggaaaaatcggtatttgtcgtatagattgatttctgttaataaaatccgaagagactatctgctgctatttaaagcgctatttctagaaagcagatagcaatcttcttcggattcagggagtgtatatatcaatacatagggtgtatattgataccatttataatttttcgtaagcgatcatcaggtattgacctgcatgaatcgtatccgaatcaagatgattcattaccttaagtgcttctacatattcgcttacggagccatatccgtctgtaattgtttcttctgcaatgctccaaaggctgtcacctggttcaattaatctacttgtgtaacagatctcaatagcatctgaagttctctgttgatctatttcctttgccgaaactcggaacattccaaagtacatacagctgcagagaataaaaagaatactgcatattaccaaaccagaatgacgaataacaccatgtttcttctttgaatttactgaatgatttcctgaatactttttcataatcctcttcctctcttttcgcttactgtatacctatcttctgttattgctatgtatcgaacatctgttcttttatgttttcattatatcgttcgaacaaatgtttgtcaagtattttacttcataaaaccgaacatattttcgcaacaaatgtttgctttctaaaaaatgctgtgttattatgttcttatgattatagtagattcggagggaacaatatgtcagaagggaatattactcctaagcagaaagagattttagaatatataaaagaccagattttaacaagaggctttccgccggcagttcgtgagatctgtgaggctgtgaatttaaagtctacctcttccgttcattcgcatctggagacgctggaaaagaatggttacataagaagagaccctaccaagcctcgtgcaattgagattctggatgataatttcaacctgacaagaagagagatggtgaatattccgatcataggccgtgtcgctgccggcgaaccgcttcttgcagaacagaatattgaagattattttcctattcctgtagaatatatgccaaacaagcagacatttatgctccaggtacaaggtgaaagtatgatcaatgcaggaattctgagtggggattatgttattgttgagcagactccatctgctgaaaatggggaacaggtagttgcactgattgaagatggcgctacagtcaagactttctatcgtgaagaaggtattatccgcctgcagccggaaaatgatgcatatgatccgatcattcttacagatgtcactatcctgggtaaggtaatcggtgttatccgtatgtattaaatctcattactggatagaggatttttaattagaactcaaagtataaaaaactggcagaatgtagtactccactactcttctgccagttttttataattctcactatttatgcttcaagatcttcaacagacacatgatgtccatctttccagattctctccaaattgtagaactgtctgttctcacgatcaaagacgtgtacaataatatcaccaaaatcaagtaacacccatcttccggatgcatttccttctctctgtaccagagaatatcctgctttatgcaattcttcctccacattgtccacaagggcattcacctgactgtcactgtttccatttacgatcaggaaataatctgcaagtacagacacgcctgagatatcgatgatctggatatcttctccttttttatcactgagggctgtatatgccagctttgccatttcttttgactgattcatcttttattctcctttgtcgctataatattgataagtttcaatgctcatcggatctaccggcttaccattcttacgcagataattaaccgtattccctgcacaaagacagattgcatggtcaatatcgacaaacacagtttcacggatctcctgaagaccaggaattatctttctgttcggttcaatataatcagcaatataaataatcttctcaagcattgtcatctccggtcgtcctgttgtatgccatgtaattgcacttaaaacgcctttattggtcacaccatactctttctccgcgaaatatgctcccagtttcgcatggaccaatgccggcatctcaagttctgattgtgtaagcagaataccgtgtttttgacatctctcaacctgttcctgcgcagaaccatactttccacaatcatgcagaagtcctgccatcatagcatcatcgatatcttcatgataacgcattgcaagagatgctgctatatacataactccgattgtatgttcaaaacgatcttttttcagctttttttccagttgttttctaatgttaatgaaagcttctttcataatcgtgttctgtctcctctctggttactgttcactccacaccaccattttgacaagtgcagataaaatatgctttaaatatatagattcttttctttgatataatccgcgacaacatcaggcaccatataacgcacgctgagtccctttgctgccctttctcttattgtagtggaggaaatctctaccaacggtgcgcgaagcagttctatatgcgctccgtatgcttccgtaagatatcgtatctgtcccttcattgctgaagcatctttgtcgtcacgcattgctgcaagaatcgtacaggtcgtaaaaatttttctgaaatctttccactcttcaaaagcaaacagagaatccgctccgagaataaaataaaattcatcgtttgggtagatctcgttaaaatgcctcattgtctgatacgtataagagtgcttcttcgtatccgcttctgaaagattcaatgagaaattcggattactttttattgcaagacgaaccatctcgatcctgtgatgcattgcttcttctgtatcgagtgtctctttgtgtggaggatttccattcggtaaaaaccagatctcatcaagtccaaaatcttcataagcaaactcaccaagaagaagatgaccgatatgaatcggctcaaatgtaccacccataataccaatcttcattgtctgtacccgttccttttctactatggaaaacacgctctgcgagtttcctatattcaaattcagcttccgaatcatataataactcagaagctgaaaaaataattattttggaagctgaattttctttttatcgtcttttccttctttgtaaagaacgattttctttccgattacctgaacaacctgagactgtgttctctctgcaagtgtctctgcgatttctctcggatcatccatgcagttctttaaaacactgatcttgatcagctcacgtgcttccagtgcctcggcaattgcctccgtaagccccggattcatgcttgcttttccaacctggaaaatcggatccattgtcatcgcaagtccttttaaataggctctctgttttgtagtcataatattctccttatttataataatcaaactgaagtccgtacattctaactgtgtcaccttcctggatgccagctctctcaagatctgcaagaatacctgaatctttcaggaacttctggaagaatgcaaatcccttctctgaatcaagattcgtatatccaagcattttctcaatcttcggaccttcaactacatacattccatctgcctgttctaccgtataaggaagatcttcatagatcagttcatcatccgggaagtattcctgctcgaatactaccggtttctgatccagcttctgaagctcgttacttacatagtagagaagatcggagattccttttcctgtagctccggagataggaaatactttgattccctttggctcaaactcatctttcaagcgctgaaccggatcatcttccggatcatagatcagatccgtcttgttcgctgcgattacctgcggacgttccgcaatttccggattgtaagcggcaagctctgcattgatcttatgaatatcatcaactggatcacgtccttctgttccggctgcatcaacaacatggatcattaactttgttctctcgatatggcgaaggaactcatgtccaagaccaacaccttcggatgcaccctcaattagtcccgggatatcagccataacgaatccctttgccccatccagatcaacaacaccgagattcggattcaatgttgtgaaatgatagtttgcaattttcggttccgcatttgtaacacgggaaagcaatgtagatttaccaacgttcgggaaaccgatcagaccaacatctgcaatcaccttcaattccagattcacttccagctctcttgccggctgtcccggctgtgcatacttcggaacctgcatggtagaagtagcaaaatgctgatttccaagtccgcctcttccgccttttaagacaacctgacgtctgttctctccggacatatcagcgataacttttcctgtaacagattctttaattactgtaccttccggcacacgaagaacaaggtcttttccgtccttaccgtgacagcggcgctttccgccctgttccccatcttcggcagcaaattttctcttatgtctgtagtcaacaagagtattcagcccttcatctacttcgaagatcaggtctccgccgtgtccaccgtctccaccgtccggtccgccgtttggtacatacagttctctgcggaagctgcagtgaccgtctccgcctttaccggaacggatcaatatcttagctctgtctgcaaacatattattctcctcttaatttgtatcaacaactgtttctgtatctttattcacatcatatatgcgtaaatttcttcatcatctgacaataaaagatttctttgaaagaaaaagcctcagaccttaaaaaacgtctgaggcttccttttgccatgtatgcgagtgaaaagattccgtcggaactttccagccaaaactgattactcagctactggatagatagaaacctgtttcttatctcttccttttctttcaaatcttactacaccatctacaagtgcaaacagagtgtcatctccaccgcgtcctacgttaagtcctggatggatctttgttccacgctgtctgtaaagaatgttaccagcttttacaaactgtccgtctgctcttttagcgcccagtctctttgcctcggagtcacgaccgttctttgtagaaccaactccttttttatgagcgaaaaactgaagattcattttcatcatggtaattacacctccttgaaaattatgtcgatatatttctcgtagtcattgctgtcttctatctcttccagaccaagaatcatggaatccagcaataatgtggcatcatgtgatggtgttccgtcaaaacggaactcgatacttccggtatcttcatccgaaacgcagcttgtctcatcatctgtaaaacgctcaattgaattcagcgcattgatcacgagagcggatactccggcacagacaatgtcttcaccggcttctgcatatcccgcatgaccttccatatcaaacccagcatattcctgccgttcggtcttataaatggttaccttaatcatcagaaacagattaagcgttgatcttttcgatctttacttctgtgtactgctgtctgtgaccgtttttcttatggtatccagattttctcttatacttgtaaacgataactttctttgctttaccgtcaccgattacagaagctgtaactgttgcaccttcaactgttgggttaccaacaaccatcttgtcgttgttaactgcaagtacctggtcaaatgtataagtctcaccagcttctaccccaagtttctctactctaatgatatcgccttcagctactttgtactgtttaccacctgttgctataatcgcgtacatatggcacctcctattatcattactcgccaactatggtgtctgaaatcagaacttaaatacctcgttgtgcggcatactcatatatattaacttgcaaatttagatttgtcaatagggttcatctaatttttttattttttcataacagtattcaataatactttttcttgttatgattccaatgaatttcttctggtcatccacaaccggaacaaaattctgattcatcgctttctgaagaagatcctccatgtcagcatctgccgatacaacctcataatctgcttttcgtgggaagtcctggataaaaattgtctctgcctctttcaggttcagattcgtatacttcttgattccccagaggatatctccttctgtcattgttccgacatattcccctgccttattcagcattggaatggatgcatatttatgaaattccattgtttccaaaacctgacgtaatgtgctgtaatcataaataaaagcaacctcactcttcggtttcagaaaaaataagatattcatctcttttcagcctttcttggttttaaatctgtgtcagtacgaaaatctcatacaatgctttgatcgcatttttaaaatcatcatgacgtacaccaacgatgatattaagctcactggatccctggtcgatcatcttgacattaatgtgtgcatgagcaagtgcagagaagattcttcctgctgttcctcttgtagacttcattccacgacctacgatcgcgatcagtgcaagatcagactcaagctcaatgtgatccggatctaccgctttgtgaattcctgcaagaatctgctgttctttctcttcaaacttatctttgtggacaaagattgtcattgtatcaattccagatggcatgtgctcgatagaaacaccattgtcttcaaatacctgaagtactttacgacagaaaccaacttctgagttcatcatcgctttttcaattgtgatcgcagcgaatccatctgttccggcgattcctgtaattgtgtacttcggctgacagcatgttgcttctacgataagtgttcctttgtctgccggtgcatttgtattacggatattgatcgggattcctgctcttcttaccgggaagatcgcatcttcatgaaggacacttgcgcccatgtaagaaagctcacgaagctctttatatgtaattgtctcaattgattttgatccttttacgattcttggatctgcaatcagaaatcctgatacatccgtccagttctcataaagatctgcattgactgcacgagctacaagagaacctgtgatatcagaaccacctcttgaaaatgtaactacacgcccttcctctgttgctccgtagaatcccgggataacagcattcttagccttttcaagtcgtgcagacataatttcatttgtgatctcggactggaaatctccattctcatcaaaacgaacaacctctgctgcatcaataaattcaaatccaagatatgcagccataatcttaccattcaggaattctcctctggatgctgcataattgcttcctgctttttcagaaaagttcttgcggatcacttcaaaatcctcatccagggagaactttaaaccaagtccatcaataatttcctgatatctatctttaattgctgcaagcttctctgtgaaatcttcaccattctcagcagccgcatagcagccatagagcatatctgttacctttgtatcagctgaaaaacgctttcccggagcagatggtacaacatatcttctggattcttctgcacggataatatttccaacttttttaaactgttctgcgctcgcaagagaacttccgccgaactttactactttcttcattcttgctattcctccaatgtaattctgcgttgctgtttcgagtttcccgtgaacagtaacaatactgctttctgcattatcggttcattattatacagtgttacgcagtccttgtaaacttttaaataagaaaacttataggaatttcttataaacattaataataatcaattagaacgtaatctctccatattccgcccgtgcagcctttttcagatcatccggtttcaatttgatctgcattccaatcttcccgccacttacataaatgtattcctgatgctgtgcactggaatcgatcacagtcggaaattgcttcttcattccgattgccgtacagccaccacgcacataaccggtcaccgcagtaatatccttcacatggagcatttctactgatttttccccgactgacttcgcagcctttttcagatcaagctccgccgcaatcggaataacaaacacataatgcccgcctgtttttccaaccgtcacaagcgtcttatatacctgttcgtgcggaagaccgattttatctgctgttgtgattccatcgacaaattcatcacattcataggtttcatattcatatgggatcttgttcctgtccaagattctcattgcatttgttttcagttctttcttactcattatattagcatctcctctgttgtctctgcctgcaaatgcatctactattctatctctcttactgcttcatgcagcggcttacgcactttctttctcgtcacctcagcaagtccaagtgctgtaatatcaactaatgttgtctggattggatctttcgcaagaaaatatcggaattcttttaataaagtttcctcattcttttcctcatcctgatttataaaatcaatcagaatgattccagacagattacgaagacgtatctgtctggctgtttccttcgctgcctccagattcatcttcaatgtagactcatcatcaccctttttacggacatttttcccggaatttacgtctatcacggtaagcgcctctgttacctggatcaccagatatcctccatgtttcagccagactctttctgctaaggcatgttcaaccgctgtttctgtactataaatctttccaagtggataaccactgtcattatggaaatgaaccagttccagattctccggcatttctttcttgaaatagctgcaaatcttttcatatatttctgcatcattcacaagaatttcttccatgccatccatatagacatttttcagatctgtaatataggacggtggagcagatttcaggcatgagaaacacactctggaagcagcatattttaaaagatgttcatattccgctttcagctgttcaatctctgtaaggacatcttcgaatgcagcatcttttgcatttgttctgataataagaccatactggtcattctgatattcctgaaggcgctccttataggcttccctgtctttttttgaaattttagaagatacacctattcttgtattaccatgcgtcaaaacggcatatctgcctgtcagactgatattaccggtcactgtcggaacctttgtctttacagcttccctgctgatctgaactaccagttcatcaccgatgcaaagtggcttcttcccaatcttatgcgtaaaaaatgcattctgtgcatctcttaaatcaaaataacaattaacgccaggttcgatctcaagaaaagctgcccctatattctgtacgatattctgcactttggcgacatatatatcgccaatctgatgcaccttttcctgttcgtcggactttgtacagtgaatctcagcaatctgatcctcttccagaaaaaaggtccacacatgattttcttttttctctatcaaaactttccgtttcatctgtttcttctcattcctcatcacctgtcatatcaacacccattgcctctaatggaatcaatgatccatcttcactgcgatctgtatacatttccagtctgtgatgctggaatttcacgctgtccggttcgattccaaggaactgacaaaatgcttccattacaagatccggtttcagattctctacacttcctgctgccactttcaggtaaacagaatcgcctcgcagttcccatgcatagatcaatggtttaatgtcaacttccttctcgcttcgtttcgtctgctttacaatccggatctccggctgttccataaattctgaaaatcgttctttccagccctccggaaatgctccctttctcacagatgtcagataatctgctcctgcaaggattgtcattccggtcatcttcttctcctcagcaattctacggatgcttacgatctcgatcccctcgatctgacaggcttcgttcatccttctgactgcatctgtactgttgactgcttctgttaattcaatatcaaaatattctccgtcacttgtcagtccgattccaagcgggttagcaaatgacataatcatatgcggactatatccgcctgaaaatgcaatcggaatatccgcgcgacgcatcactttctggaagaaacgcatcacatcaagatgtccgatgaatcggagagaaccatattttctaaatttaattcttgccttcataacagacacctcctccaaatttcgctgcgccacatccggaacactgcatacggcagttcggagttactttttcttccatcgcacgatcccattctctgcgcaggaactttcttgtcacaccgatatcgatgaaatcccacgggaacaattcatcttctccacgctcacgcagattgtaaaaatcaatatcaacacccgtgttctcaaatgcctgcatccaaagttcattgtggaaactctctgtccaggaatcgaacaaacatcccaaacgatatgcctcctcgatcgccttgctgatcttacggtcacctctggccataataccttccaaaaccgtaacttccgcatcatgccagttatatttcagactcttacggtttaactgttctttaaattcatcattcactagatgtgcacgtctcatatattcttccgccttgcacatcggagcccactggaacggtgtgaacggcttcggtacaaagaaagaagaacttgccgtgatctgacattttccatgtctctgatcttttggaatctcataatatctgcgggcaaccttttctgccagatgcgcgatttccttcatatcttcctcagtctcagtcggaagtccaagcataaagtaaagttttaccttcgtccagccaccttcgaaagcctcgcctgctccgtttaagatcacttcttctgtcagacctttattgatcacgtcacgcattctctgtgatccggcctccggtgcaaatgtcagactgctcttgcggatatcctgaaccttactcattacatcaagagagaaggcatcgattcgaagagacggaagagaaatattaattcccttattcttaaactcatcgatcagatatgttaccaattctttcaattcagaataatcactggaacttaatgaactaagagaaatctcttcatgaccggtattctgcagcatatcatgcgcatactgtttcaatcgctcaacatttctttctctgaccggacggtaaagcattcctgcctggcagaaacgacaaccacggatacatcctctctggatctcaagaacaactctgtcctgtgttactttgataaaaggaacaaccggtttcatcggatacggtgcatctgttacatccataacgatctgcttcttaactacagctggtgcatattcattattcggtgtaaatgatttcaaagtgccgtcttcattatattctgcatcataaaaaatcggaatatacagaccctcgatctgcgctgcacgttctaagaactcccggcggctctttcctgaacctttccattccttataaacgtcaagcagctcatcataagctgtttctccttctccgatataaaagatatcaaagaactctgcaatcggctccggattgtatgtgcacggaccaccaccaatcacaaatggatcgtctaaagttctgtcctttgcatgcagtggtatctgactcagatcaaggatctgcagaatgttcgtataacacatctcaaactgaattgtgattccgaggaaatcaaaatccttgatcggatcctgggactccagtgcaaaaagcggaatctgctgttctctcatcactttatccagatcatgccatggagagtaaactctctcacaccacacatcctctctgcggttgaacatatcgtaaagaatctgaatccccaaatgagacataccgatctcatagacatccgggaaacacatcgcaaagcgcacatcgatgtcttccacgttcttcattaccgcattcacctctccgccgatataacgggcaggtttttcaatttctaataaaatatcatcatctaatgctagttttctcatggatttctccttgtattttgtacttatgcatttatattacaaaattgtaaatgctacttttaacatcatatcttttgacgataaaaaaagcaacctattttctctttttatgtaattgttaacttgctaagcttgttacagtcatatctttcagacatgtactccggtagtcactcggtgatattttatatctttctttaaatactcggttaaatgttctctgactttcaaatccactatccagacaaatttttgtaatagaatcactcgtattttccaaacgctggcatgcatagttcagccttacatcgttaagatattgattaaagtttctatggaatgttttggaaaagagtctggataaaacatatttgctcacccccagatcttttgccatctcttccagcgaaaatttcttcttaaaatttgctgatatataggaaactgtctggtaaataagatcgttgctccccacattactcttttctaccaaatttaattttcctatgcagcgtgccaacacaatttgaagatatgcctgtgcaacagtaatatccgactgttctgtctctaaaattgcatttataacccgatatacctccgattcaaccttttccgctttgatgattgggtattcaggagccatggattgcatgttatctgcaaatttggctatcgtaaatggcgatgcaatcagataagtcgctttatttacaccgggtgtcagtacctgatagtgatgaataacatctggaaatacaaagcctatatctcctttttccatatggtatagttcctgtccgacaccaagttctaatgctccacttgtcacacaaacgatctccagtgcattatgaagatgtggttcaatatgttttgacttcctatttattgctatgatctcctcttttgtgtcaacatattttaattgcatgaaatactcccctttgcaacgtttgtctatatatagaaaaaagcactgtctcatcgagcaatgactagacaacgctttctcctgtcaattctaatttatgtctgatgcatctgttacttcatctgtaacaattcctttttctgctttcagttttttatttgcatcttctacattcatttttgaaagtacaaacataatcaatacatcaaagattaacggaagccaaagatacataaactgcatcatatcgagtgcagactgcggctgagttgcatttgttccgatatatccactgaactcaagcagccatccaacaacagcggttccaatacctccaccgatttttacgccaagagaagtacaagagtacatcgttccgtcaattctctttccctgtgtaagataagtgtactcagagcaggatgcgataactgcattcatatctccctgccatggtccctgacctaaggctgcaagagctgtaaatgccatcatcagcggaacactgcccatatatcctgcaacaacaacaagtgctctaccgatgactgctaagacataacctcttaagttcagtttgtacatacctttccacttaccaactaatgtcggtgtgaaaatcagggcaatgatcagtggaatatttactgcccatgcaaattgtccaaacaaattcttatttttcagtacccatgtcatgtaataaatgccagctccaatcatggcaccatataactgctgtaaaatatatgttccacaaatcatcatgtaatatttgtttttaacaagaagcttgaatgcctgtaccattccgtacttttcattatcattctttacttctccttcgttaagttcttcctcaggaagttccttaacagaaagtgctgaaatcgtatttacgacaagaccaatgattgcatagataatagcaaccattctccatgctgcagcatctccaccacatttatctacaaatccaactgtaattgcctgaatcagaagacttgttgaaaacgcaaaaataaaacggtaagatcccatctgcacacgctctttgctgttctttgtaatcagtgacgtaagtgctgaataagcaatattgtttgctgtataaaacacaccatttaacagtgtgtaagagataaagaaccatgcatatttagccgttgttcccaagctgactggtactgcaaaacagcagaccagcgtaatggcacaaccaatatatccatatagcatccagggtttcgcttttcccattttactgtgtgttttgtcaatcattgatccaaaaaatatatccgtaaaaccatcaaatagttttgatacggcaatcagggtacctacgacacctgcagcaagtcctaccgagtccgtcagatagaccatcataaaagatgtcaggaacgcatagactacattacctgcaatatcacctgatccgtatccaattttgttataccatttcaaatactttttttcttccatcgaatttctttgctcctcatcttcatcgcacttagaatctcaatatggctaaccgtatgatatctaattctgtttttttgtctgattgctctgtatgtccggactttacattacaatcagactctctttccttgtttacgggttacatgaaactttattatccctttacatacggtatcagtgtaaactgaaaccggaataatacatcatcaaatcggtactgctccaatacaactggaccacaactgttagagccaatgccatttagtgcatagtcaacacaaaatactacactatctgattctgtcagttcataattatgcgttttctcctcaagttcttcttgcgtataataagaagcattgaatgagaaggcattttccgcagagaccacaattccatatcggctgttgttaagctctacatattcacaatcataatggcttccattttcctgtgggcgaatataatcctcatgcaaatcatctacatttgcctgatacaaaccgtggctcgcagcctgatgtttgtcacaatagctttcctgtggtcccattccaaagtatcgtgcagctgaaagttttttatccaggaacatcctcacaccaaatctcggaagatccgggaattcatcgtcttttgttactgcaatatctacatcaatctttccagcagcttctattttccatgtaatcgtcacatcaagtatcttctgtactgtctctgccacaacggaagcatggcttgtaatcttcacaccatgttttccctgcacaacctctgtcgtataggctcttgtgtaagccttatcatagtgggctttcttccattcagacttgatgtacatatcgttatctgttggagctctccaaatatttaattccatcggatggttcaagtattcccgccctgcgaatttcatctctgtaaagagtgcagtacgtttgtctatggtataagcaaattcacgccccttgatatgaatctgtgtatcattttcatttacctgtaattcagagtccactactgtttttggtatccatttctctgcaagtttacattttgtatcctctttacttacctcaatttcatcaaatccaagaatatggtcttcatccaacagtggcaattcttttttcagatggtaaataagttttaaataacatttcccattctctggaacattgatcttcaggtttgtttttccttccccgtgtggagccacagaaaactccggaagtatgcctttgctgatcacaagaccatcctgtgtcagctcataactaatcttcacataatctttcaagtcatcaaaatccatgtagttatgaagcaccagttctccgctttctttgttataggaaataactcttgccgggcgataaacattcttgtattccaaaagtcctgtatgtaccgttctgtccggatatactaatccatccatacagaagttgccatcatgaatttcttcgccatggtcgcccccataagcatatatagtctttccattctcagcagttccatgagcaatcgcatggtcacaccattcccagacaaagccgccgcacattttatcattatcctgaatcatctggaagtaatcttcaaaatctccaggtccgtttcccatgctgtgacagtactctaccaaaaggaagggtttgcttccatctttatccagatattcctgaatttcggaaagcgctgggtacatccggctatacacatccagattactgtaatcatatgtttcatcataattacgatatcttgcactctcatattgtgtgatacggtctggatcaaaattctttgtccattccagtgctttttcaaagttgcagccataagcactctcatttcccattgaccacataacaatacagaaacggtttttgtcacgttccaccatgagttttactcgatcaacgattgcctcttcccataccggatcatctgcaatcttctcattccatcgtttgaaccgattgtaatcagtgtcttcttttctgtagatcataaatggaccatgagcttcaatatctgcttcatctattaccatgaatccatacttgtcacacatttcatagaaaaatggtgcgttcggatagtggctggaacggatcgcattaaaattatgctgcttcattaacgtaagatcggttgtaatctgttccagattgattgtaaatccagtaaccggatcagaatcatgtcgattgacaccacggaatttaatcttctgtccatttaaataaataacctggtctttaatctctatctttcttaatgcaatgtgatctacaattacttcattctctgtttcaagaatcagtttatatagatatggattttctgtattccaaagttccggacttgcgatttctaatacagctgttccttcttcagcaatacttcctagtgctacaactgctccgtttctatcttcaatcgaaatttttacatttaacggagagtagaatttcatttcaatttctactttcgcaagcatatcctcaattcttgttttaatatgataatcactgattgcctgttttgggcgtttcaaaatgtacacatcccggaaaataccactcatacggaatttgtcctgatcttccaaataggaaccatcacaccacttcatgaccagaaccgctatgctgttctctccgtccagaaggaggtcggtgatatcaaactcactggtcatatgagaaacctggctataccctacataagagccattgatccatacataaaagcaactgtctaccccttcaaaattcaagaaagcttttggtgcattttcatctttgtgataaacaaaggtatgtgcatatgttccacatggaatatcctgtggtacatacggtggatcaaatgggaacggatacctgatatttgtatactgatgtgtgtcatatcctgccatctgccatacactcggaacctgaatctcatcaaaattttctgtatcataatctttctcaaagaagggttcctgaacatcatagatactgttaaaatactggaacttccaagttccgttcaataactgcattcggtctgactcttccctgtgctccaccaggttatccattcttttggatgccggaataaaataggctctggctggcattgtattttcatgcagtacgcttaaatcctcataataacgtggtacaatcataaataactctcctttaatacatatacatttttttgcactttgtttttccacagcaaaccttgtcttttacttttatgtttacgcttctctgttttgctatatatatcttatcctaatctgcaaaacatgtctatgaattggattagacaaaatatgcactaaatgatacaataacaaaaaaggaaaagaggtgctaccatatgtatatgaataccggttatttaaaccactcccatatggatttcaaagacaaaagtcgcccactggttgtaggaagttgcggtacttaccgcctttccagccatccaaagttaccaacctaccgtccaaggggacgcctggattatcagattatctatatcactgctggttgtgggcattttcattttgacaatgtggataacgaaacgattgtccccgccggtaatattgtactgtacagaccgaaggaacttcagaaatatgaatattatggaaaagataagacagaagtatactggattcattttacaggcaacaatgtaaaaaatatcctacggcaatatggattcccggataaagagcgtgtatttcaggtcggaacctctgtggaatacgaacagattttcaagcgtattatcatcgagcttcagcgttgccaagataattatgaggaaatgcttgtccttctgctccgtcatcttcttatcatctttcatcgggaactgaccagggaacatatctcgaaaaatgaatacctggatcacgagatggataacgcagttacctttttcagtgaaaattataaccagaatattagcatagatgattatgctgcctcacgtggaatgagtgtcagctggtttatccgaaacttcaaaaaatacacaggttctacaccaatgcagtttattgtgggaatccgaattaacaatgcccagatgttacttgaaacaacaacctattccatcaatgaaatttctaaaatcgtcgggtatgataatcagctttatttcagccggcttttccacaagctgaaaggatattctccaagagagtaccgaaagataagaaacaagttctaaaatccacaatatcataaatccctaactggctgttaatagttacgattgatctatattatgatcaggcaatgcctgttgtaatgattaaatcgggctttccccgatgtggtgtgcttcaaccacctcctttcaaggcgcaaaaaagcaccttaaccttattggctaaagtgcttgtatttgtttgctattaaattgttgtgagtcagacaaactggaattgagatttcatgtattccaagagatttaataattgttatattttattatcaaatatctctcaagcctttgaaaacactaagtttggcgcaggtgagctttcccttattgtttcccttgtgttatatcgtcccaccagtgttcccttaaccgaaaggacgtcagttctttcggttgttgcagatgcgtaaactgcgttccccaactctaacaaatagatccgatagccaaaacagctgttttgcaaacgtctgaataataatcaaaaaaacaaaagagaccatgctcaacacagtctctctcttttactattttattttcttttcaacttctctcggaagacgttcgtacaaccatgtcatacgtttcaatctcttcaccgtctcttcatcaaactgtcccttctccattctccaggtccagtttccgccaagtgtagacggtacattgattcttgccttgccatccaggttcaataaatcctgcatcggagttacgcaaaggttcgccttactgctcattgcaagtcggatgaaatcccacgccagatcatcttcatccaggcgttgtgcattcatatactcttttgcaaaatctcgcgttgctttatctgtactgtgataccatcctcttgttgtatcattgtcatgcgtacccgtatatacaacactgttttccggataattatgcgggagatatgcagagcctccatttggatcaaatgcaaactgtattactttcattcccgggaatccactgtcggatagcatctgaagtacactttctgtcaggaatccaaggtcttctgcaataatattcaatttgccaagtttttcttcaattgtacggaacagatccattcccgggccaggcatccatgctccatccactgctgtcttatttccataaggaatggaataatattcgtcaaatccacggaaatgatcaattcttactacatcatataatttgagacaatgacggattctcttaatccaccagtcgtattctgtctttttgtgatattcccaattatacagcggattgccccacaactgtcctgttgcagaaaaatcatccggaggacatcctgctactgccaccggattattctcttcatcaaactggaataactccggagatgcccatgtgtctgcaccgtcaaatgcaacataaatcggaatatctccaacgatctgaattccctgttcatttgcataagtgtgaagctgtgaccactgtttatcaaattcatactgctggaatttgtaaaaatcaatctcttctgcaagttcttctctcgcattctcaagtgctgcttcctcacggtttttcagggcttcttcccattcattccagctgattccacctttgctgtccttgattgccatgtaaagactataatcatccagccaatacgcattttctttgataaagttatcatatgcttcatctttttcgaaacgctcaaatgcctttttcagcactttaaatcttgaattgtagattttttcgtaatcaatactgtctgcctgctctccaaaatcatacactttacattctttttttgtcagaagtccttctttgatcagtgtcttcagatcaataaaatatggatttccagcatatgtggagaaagactggtacggggaatccccgtatccagtcggtccaagcggcagaatctgccagtaactctgtccagcctcttttaactgatcaataaatttatacgcttcttttgagaaacagccaattccgtattttgatggcaatgaaaataccggtaataatactccgctcgctcttttcacgttcttctcctcctcttacagatgccagatatctctgttgtactcttcgattgttctgtcagatgagaaataccctgctttcgcaatatttacaagtgctttcttagcccatgttttctgatctgcataagctctcaatgcttcttctttcttttctttatagctgtcgaagtcaagaagagtcatgaaccagtctttactgataatctcatgctgcagtctctcaagattctctttctctccaactttcagaacttcctcgcttgtaataaagtcaattgctgccttgatcgcaggattcttctcatagaaatctcttgcgacataatcagcttttgcataatgctcgattacttcatcactggatgcaccgaatacaaaaatgttatcgtttccaacgagttcatgaatctcaacatttgctccatcctctgttccgagtgttacagctccgttcagcatgaatttcatattacctgttccactggcttctttagatgcaagtgaaatctgctcggaaatatcacaagccggaattaatttttcagcctttgttacgttataattctcaaccataacaaccttcaggtatggatttacctctggatcattgttgatgatctcctgcagacaaagaatcaaatgaatgatatcttttgcgatcacataagccggtgctgcctttgctccaaagatagctgtcaccggtgcagccggaatctttcctgctttgatctcaagatatttatcaatgatatataatgcattcagctgctgacgtttgtactcatgcagacgtttgatctgaatatcaaagattgtatcagggcttacttttactccctgtgtctcttccagatatttgcagagtgcttctttatttgcatgtttaatctctactaatctgtcaagaaccttctcatcatccttaaatgcaagaagtttctcaagttcagctgcatctttcttgtatccctctccaatcagttcatcaagaagctctgtgagagccggattacaatgcagtaaccagcgacggaatgtaataccatttgtcttattgttaaacttctccggataaatcttgtagaaattattcagttctgtctctttcagaatctctgtatgaagagaagcaacaccgtttacactgaatccgtaatggatatcaatgtgtgccatatgaactgtatcatttctgtcaataatagaaacgctttcatcttcatattttcttcttactttatcatccaacacttcgatgatcggcatcagctgcggaactaccttcttcaggtaatatacaggccatttttccagtgcctctgcaaggattgtatgatttgtgtatgcacatgtcttagaaacaacttcgatcgcctcatccatgtctaatcctctctctacaagaagacggatcagttccggaattaccattgtcgggtgtgtatcattgatctggatcactgcataatcagcaagatcatgaaggttgcatccctttgctgtacattcatcaagaatcagctgtgctcctgcacttaccatgaaatactgctgatagattcgaagcagtcttccgttctcatcactgtcatccggatataagaaaagtgtcagattcttctcgatgtcttctttattaaaagcaattccatcctctacgattgtctcatctacagagtcaatatcaaagagatgtaatttatttgtcttattgttatatcctgttacttcaatatcatacattctcgcatttacattaagtcctttgaaagctaccggataaacaacatctgtctttttcagccaggatttttcttcaatccatggattcggagtttctctctgaaggttatttttaaactcctgtttgaaaagtccaagatgatagttcagtccgacaccgtctcctgcaagtccaagtgttgcgattgaatcaaggaaacatgctgccagtcgtccaagtccaccattaccaagtgacggctctggctctacttcttcgatctctgcaatattcttaccgttctgtgcaagtacatcttttacttcattaaaaataccaaggttgatcatgttgttagaaagcagttttccgatcaagaactctgcggaaatatagtaaagttttttcttactatctgtacgttccttttctcctgccatttcctgcaccatactaagaagtgctccgtagatttcttcattggaagcctgtgcaatctctttaccaagtttctgctgtaatgtttcctgaatgttcatttgaataatctcccttcaaatctgattctgtttttatgttacatactttgtttctttgttttcaacttatgattgtattttaatacgattatcttcaaatatcttgcaatatacttgcactttattgtacaatactatcattcttataattcaatctagtttgaccagcaggtgtgtcagatatcattttattgaaaggatctcatttttatatgaacattaacgaatatcagaattaccatgaaacaaaagcgcatacatccgcagaatttccttataatacttatctctgctcgatccctctcgatttccctggagtaccactgcactggcacgatgagttggaacttgttgtcattaaaagagggcagggttttgtttctgtagactttgataagcgtctggttcacagtggggatattattattattccccctagatgtctccatgccatcgaacaggatgatacttttaaaatggaatatgaaaatattattttcaaaccagatttactttcttccggagcaaacgatctgtgcatgattcaatacatcgttccgcttcttgacggttctcttcctattgaatattttctcactccggctctcggatcttttgaagccttaagcaattgtatccgacagattgaccttgtctgtgctgatcagacacctggatggcagcttgctgtgaaaagttctctgtttaactttttctttcttctgatctctgaacgtcagaaaaaaacagtctccacttcctccaattccaaatctttggaaaaaatgaaaactgttttaaaatacgtagaaaatcattatacagaaaaactaacgattgatgacatggctgaacttacttattatagtaaatcccatttcatgaagttcttcaaagcccacatgggaatcggattcactgaatacttaaatgattaccggcttacaatggctgccagacttctcaaatcatccgatgactctattctgatgattgctgatgccagtggttttgacaatctgtcctactttaaccgcattttcaagagaaaatatggtatttcacctggggcttacaggaaagcatagtaactatccaaaaacaattatgagtgataatacagttcgattggatcaatcggatcaaatggatgttcttcttccattttcttattccgcccacgacgtttcatcagctcgccgctcttgttgtatacccagaaggaatatacaaggagcttatttaccttcccgatcttctcttttgtcgtcttattataatagacaccacctgtcttgaatgcagtcttcttatggatcaaagagatcagctctgtctccgttttgaccggttcaggtaagattgtatatgcccgtccgacacagtctgtcttgtgggaatcacttccaccggtcatcaccttaccgtatttttctgccagttttaaggcaccggcattagaatccttcggttcacaacaattgaatgtctcaataaaatcgaatcgtttaacaatctcaggtgagagatagtatcttctcgcatgagtgaagctcatgtacttttctccgcatggatgtgccggtcccaaaactccaccattgcggtgaaccaaatcgatcagaagtgcaagcggcattccacgcatctcaagtagacgcatctttacaccctccggcataattacaagaatatgccctgcatctctcgtatcatattcaattcctttgagtaccacaaaatcggtatgtttctttccttttaaattcttcttccagtatcggtagccattatatgtgtcatgatccgtgatcaccattccctgaaatccgtgttccttgagtatcgtgatatattcctcaatccctaccctgctgtctatggacccctctttcacgtgacagtgcatgtctatcttcatatttgagtcctccttttccgcagtcctgattttatcaaaaagtactatgtgaaataactttattttcgttctttaaaaagactgcttattgataaattcattataccgcgtttatataggagtgacaacagaagacacacaaaaatgctaattcttgtttagagcttataataccttcgacaaaaagtttttcgtcctttcatgttttggattctcaaacaattctctaggtgactcatcttcaacaattacaccttgatccataaaaataaccctgtcactaacattcttagcaaatcccatctcatgagttacgacaaccattgtcatcccttcttttacaagagatttcataacatcaagtacctctccaaccatctctggatctagtgcagaggtcggctcatcaaaaagcattacttccggattcattgccaatgctcttgcaattgcaactctttgcttttgacctcctgagagcttgtttggataggtgtctgccttgcgttccaatccaactcttcttaacaactctattgctttcgtgtctgcctcttcttttgtccatttttttaaacgcactggagctaatgtaatattctgctttactgtcatattaggaaagagattaaaatgttgaaaaaccattccaagattttcacgatatttatcaacattaagttttggatccatgatatcctgtccattgatatatatttccccttcttccggcttttccaaaagattaagacatcttaaaaaagtagattttcctgaacctgaaggaccgatcacacagacacattctccttttcgaatatcaacatctattccatttaatacatgattatcaccaaacgatttctgtaaatttcgaactttaatcactttcttttaatctcctttcaaattttctcaagaaaacagacaacagttttacaatcagataataaacaatgcctgccgccagcagtggaataaacatcttatatgtccttgatgatacataacttgccgctttcgtcaaatccactattccaacataacccaaaatagaagtttctttaatcaactgtataaactcatttcccattgccggaagaatattcttaacagcttgtggaataacaatatatctcattgtatctttatagcaaagaccaagggatcgccctgcctctgtctgtccccggtcaactgcctgaattcctccacgtatcacctctgacacataagctccactgttaattccaaaacttacaacagccgccacatatccaagtctgctgtggaaaactgcaaagtaaacaatcattaactgcagtacagatggtgttccacggatcacatcaacatagaatgcagcaatcaaagaagcgattgtcttctttccttttctatcagcattaatccttataattgcgacaatcaaaccaagtagaagtcctacaaagactgaaagcaaagaaactaataaagttgtaccaagtccattcacatagtattgccaacgattttcatctacaaagataaacttcaatgttccaaaaattccaacatttttatcctgtgtctctgttatttgaacattgtcattctcttctccagaaaaatactttgcatacaattcatcatatgttccgttttcctttaccttttttaatccattgtttaaaagttgtgcacaattactgtttcctttttgaacacaaaatacagtatcttcttctgttccttctaccggaattgatttgattccatccgtctgtcggcaataaatttctgccataattgtatcaatgattacaacatcagcgcctttatttttcagttccattattgcactggaagcattcttaaatcgttttactgttgcaccactaacaataccataatcttcgttttcgccagaagcaatcaaatcactctgagacccttcaagaacagcaattgtctttcctgtcagctcagaaaaatctgtgtattcatctcctgttcgatatacaatactttgagatcctgtataataaacgtctgaaaaatcaacactctgagctcgttcttttgtcggagcaatagatgctgcaattgcttcaatatcccctgcttcaattgaccccagcaaagagtcaaatggaagatctacccatttgatattgacgttctcttcttttgctattgcgttcattaagtcaatatcaaaacctgtaagattcccattgctatccagatattcaaacggcgcatactctgcatttgttccaacaacaatcgtatctttttgttctgtcgcacagacctgttgaggcagttgcagtattatcattatggctgcaagtaccacaaaaaatactgcctttgttttaaattttttttcagttcccatgggcttctcctttgttgaaatacgtattatatcgttatatgataatataacacagtaatatttcagattcaatatatgcttgtttttccatttcttttttctgttttttacaaatttcttcttttctttttgtacaaatatacaacactttatcttctcctcaaaacaaaagactgtctacaggctttacacaaatgttttaccctcaaacagtctttttcgtccatcttattattgccctattttgcttcccatataatgatgaaactgtggatcctttggaatattcagatctatccctctctctcttgatgctttcacaaaaagcatttgaaatggaattgtatattctaacgtagaaaaatctgagtcttgaaggaactccgcatatagtccgtcatcattttctttctgagtattgactgcgtattgcttatttttccctttataatattcatataaatgttgcatttctttggaatcgcttccgctttgtgaaaacaaatataaaaactccgtctgttctgttactgcattatacattccatgaatgaattcacatgcctcatagccacgtaccggaaaacgtgatgtttccgatattttcaacacttcttctaagagcagacttttttggttactctctgtcagaataatcaggtctgtacaggttctcaatttctttgcttccttttcagcccatttttcacaaattggaagaagtttcggaagatttaagattactttctgaattcgttcttcatatacagtcatctcttcctcttttaatttcaaatctccttctgaattttttgcaacttcaagaaggaaaagatataatgtcaggactgtcgctgtgtaaccttttgttgtagaaccagcatcttcataaccgcattctacataaatattcgcatcagcatgtgacacgatttctgtatcatattctcctgtcatagagatcgttggaattcccgtttctcttactttatctaatgcctgaatcacagctgtgcttgttccttgttgtgaaatgccaatcacaagggaatttttaggaaatacggtaatttcttcacttaactcaactgggaatacgggcgttacccgtattcccagtttcttttttgcaaatgtagctgctgccagtgttgcattatatgaggaacctgatcccgagagaaatatctcttcgatcttatgttttttcaccaattctatactatcctttaaaatttcttctttttttcgaaaaatttcaagtagaatatctggtgtctggagaatatattgataagcatctccatgataaatcattgtagccctccagttaatccgactatttattcgtaatgtcttccgtaaccaaatgcaccttccaatccacagatttcagatgcaaattttgctgcgtctgccagtgcatttttgattgcttctgatttttcctcaccctttttgatacgatctgtgtaaccaacaaggaaagacgtaatcagagaatcacctgctcccattgtatcaactactttttcaatcggaactgccggctgtctgtaaaatgtttctccatcataaagaacacaaccttctgctcctctagaagcagttgcgagttctgctccgccatcaatcatcatctgaagatgtgcttttaattcctcttcatttccgtcaaaagaacagaatgcataatttacatccggaagtacttttttgtaatactcttctgttgaatcatctgaaaagtcaaatgcaacttttacacctgtcgccttaatcttaccaagctctgattctgtaaaacaataattacctgaatgtactacatcaaactgcttaatataatcaagatcaaagcgatccaggatatatggtgtctttccacggattcctccatcgttccagtcaacaaatactctgtctccatctttcaatgtaactttagaccatccattctcgccatcgagctgtttacatttatacatttcgattccgatttcttcaagtaccttgatcacatattctgcattgtcatcatttccaaaatatcccatgtatgcagatttctcgacaccgaaacgctttgcataagcacacagattaacacaatttccgcctggatacattgtcttcagatgctcatacatatcaactacattatcaccaaaacctaaaatttttacattatgctctgccatcgctttattccctcctgcttttgaagggaaaagccttctccggcttttcctctcattgctttttcttagtactctacaacacccatgtatcttctcatatcaagtggatgtcttctcttgtcctgaagtcctgtacggtaagcaacgctcattgcatagaacagcattggacagaagtactcattaacactttcatcaattgcatcaattccaagttcttttgcatcgatcacttcatatttctttgcatatttctcaaggaatgtaagagctctttcatccattactcttgcagctcctgttcccatcaggaggatatacagatgatcttcgtctgtacactcaaatggtccatggaaatattctcctgaatgcaggtagcagcaatccatccactgcatctcctgaagagagcagatggagaatccatatgcctgtgaataagatgctcctgatcccatgatgtaaaggaatggctcttcaaaatatttctcagcaaatacccatgtacggttctgtactttctttacagcagcacgcacgattccgtctgctttttcaagtccatcgagaatagcttcatattttgtataagatggctcctgcattttcatcagctcgttcagaatgcgcattacaattccctgtggtctgtctttctcatttgtagaatcttcccaagaatatacgattgggttcatttcttcctgtgcacaaatagactccggattgtgtgtcattgtaataacagctgcgccacactcttttgcatgctttgctgctgctacagtctctccagtatttccgccgtgggaacacagaattacaagtgctccctttttcaggaatttagatggagaaactacaagttcttttgctgtaagccaatgtgagtgcattgtctcagactctgcattaataaaatagtatcccggatacagatcaactaaagatcctccgcatgctgttaaaaatacgtctttgatttctccctgttctgctacgattgctttaattaattcttctggtgttctcattgtttaatctccttttcttttcattctttttttaatttatttttcacccattattgggacgaatacctattagctacattcctgcagaaattgcacagaatactaatgcgataattgttaatacaacaaatactttccagattgtcttccaccactggctgaaagaaattctacacactgcaagtcctgcaactgttgttcctgcaaccggactcatcatgtttgtcagctgatttgcatactgaagtactgttacagctgcttctggatttgctccgtgaagatcacatagcgaagacatgattggcattgtcaatgctgcaagtcctgatgatgatggaacaagtaatgttaatactgactgtacgatatacataacaactacaaacaatacgtttcctgttcctgcgagcagattacttaaagaattaagaattgtatcaataatttttccatcattagctacaaccatgattccactacagaatccaattaaaattgctgcaaaagcaatatctttcacacctgctacaaattcttctgcaatctctgtctctccaagacctccaataattcccatcagaagacccattccaagaaataccatagacaattcgttcatgtaccaaccgaattttacaaggcctgtaataattaacgccataccggcaacaaaaactacaagtactaatttctggcgaactgtcaactttgtattccctgcctcttgcgtgatcatttcttgtcttttgatgatatcatctttatatgtgatagaactctgtggattcttctttactttcattgcacgaattgtagtaaaagcaatgataatcgccatcatgatcacccactggatcatacgaaatacaagctgcggatttccttgaattcctgcaattccctgtgcaacaagtacgcagaatggattgatcgttgaagcagcatatccaacagtagctgacatacatacaatcataaatgtcgtcattgaatcatatcccattgcaaacacaacaggcataaccaatagatagaatggaacaagttcatctgacataccatatgttgtaccacctaagccgaaaagtatcatcaaaataggaatcatcaaaaattctttatcacccaatttatcaattatactgcgaattcccatatttaatgcatttgtttttgccataatctggaatacaccaccaatgataaatacaaatgcaagtacttcaattgcattctggattccaagcgccggtgctgtaagcactgcctgtattccctgtcttaggtttgttccatcttctgcgatttttgaaactccatgataagttcctgcaacaactacttctctttcgcctgtcgatgtttcaaccattgttctctggaattctccacttggaataatccatgtcaagactgctacaagtacaatcagtaaaaatatcaatgtatatgcatgaggcatatgaaatcttttcttcttttgttctcccataactgtttcctctctcaccttattcgttataacttataaataatttttccatctaaaatagtaagtataacttttgcatcttttactgttttcggattttctgttgttaaatctctatcaaaaattgcaatatctgcaatctttccttcttcaagcgttcctagcttatcttccatttcaagactcttctgtccaccaagcgtccatgctttcaatatttcagccgcgcttaatgtattttctgtctgaaatggttcttcttctccatccatgtatcctccgcaagaataataaatagattccgggacacttgtaatcaaaagaggaaggtctgttgctccgcaaagattgattccactatcctccatcttacgacgattccaataatacttgcctctttcatttccaattgttcgctcaatattttcttttaggacattccctgggtcaagtgacataatctgaaaatataattctgcatttgcaccaattttccctaacttctcaagatcttctggtgatgtaaactccatgtctgtgagtgcctgcttatttactaactttccatcgacttttttacacttgtcatagatttttgcaatctttgctactgctccatctccctgcgcatgtaaggaccaccggaacccttctttatctgcttcaagaacatcctgttcaatctcattccacgggatatcaatactgcacacaaaatctttcttctcgtacggttttttcagttcacctttgtaatcagcaattgttccatctgtcattcgattaaatccactgaatcgaattttatcacctttaaacttctctcgcatcctcttcgcatactcaagattcattggtgctccaaccggctgagacataaagaaaaatctcagatgaagatcgtccgaattttcaatctctttcagataatctgtaaatccataaaagtcatcaaatcccatttcttttactgaagttacgcctctactattgagcattgccacataatctttcagttctttctcaataaactcacggtcattgagatattccttcatgattctgtagtaactttctggataacagctgtctgaggtaaactgatacacttcttttgccttttcgttcataatacagcttcctcggtcttctgcaaaaagaatgaccggcttatccggaaaagcttcctccaacatctgctctccatctttctgtttccactgcgttggcttccatccatgtccaaacaatacattctttggatgtttctcctcttcatacgcttttaaggctttttcaccttcttcatttgtctttatctcagagacatctactccaagatgaaagactgcatacccagtaaagaaagtatgagtatcagtaacgccaggcattacaagttctttgtcaaactcaagaatttcttctgcttcttcctggattttctgactggcttttccttttcccatcttaacgatctgcttatctttcagacaaagaaaaccttcataagttgacttttgttttccatcaaatacgtgctttgcctgaattaagaatgaatactttttactcactttttcttcctcctttctttacttgtattataacgttatatatcattatatttcaatatgacctttcacttcaatcgtgatttcgtataatttatccagtttatatatccttttttgtatattctgcccaatttgtagccaacttatcaacaaataagttgattagaagcgcatttttttccaaacttctattttttttcagatttaatataacctttcaaacagatatctgatatctcgttccaacaatgacttcactacttagatacaaaggtctgccatctccatcatacatatagtttttcaaaagcataaccggctcattttcatctacctgaagataatgggcaatatattctggtacaattccaacctcaataatacttcgccccttgttctgtcggcaaatctgatatctctcttccagcaaccttgtcagagacccattctctagatgatcgattgggaaatccggaaaacgatctgcctccatgtaaatatcttcaaaaattaccggcagtccatccgctgacagaatcctctgaatatgataaacgaaactttcttctcctatctgaagaaactgtgttttctcccctttatttttttcaattcgaaaagatataacatgtgaactcgatgtacatccattcaacttacatgcttctgtaaaactgatattattatcctgttctaattttctatagattttgggagcttctacaaatgttcccttcccctgaatctttttcagatatccttgctgacacagctcttcaattgcccttcttattgttattctactaatgttatacatcttggacagttctccctctgttggaatctgctctccctccaaatatgttccgttatgtatctgctctttgattacatgcatcaactgcatatacaaagaaaccgttgattccttatctaacttcatttttcgtctcctgcctatgatatatttttaggagtcgcaaatgcgactcctatttcacaaaataacactatcgaataaatggctcaaaagcagccatattcttccggtcaatttctcccggattttcataataatcaaactctgtcaattcctgtccaaggcatccctgatagttgtggcgatttaatgcttccagatattcctgaagacttctatttccgaatccccacgcaagatgtccatatggattactatcaataaaatgcgtatggataacttcatctccaaacacatcaaaccagtcatctattgtctctccttgcacactcattgctgttgtatctatcaaaattttcaaatttggggaattcacttcatcatacatcctcttggcatctttcaatgttacaaccaactgtgactcttgaggtcttaaactctccattgcaagacagatccctagtttgccagcttcatctgccagttttgagatcatttctctagaacgtttccatgcttcttccctgtcttcattccaatatccccaaccggaatttgtctgcataattttacagccaagttcacttgctacctgaagaccattcttaaagtattggaaacttttttcaaaaagttccggtgtctgagctgccatttgatactgatacataacattttccggtgtaaagactttcacctgaagtcctctagattcaatctttttccgaacttccttcgcatcctgatatcccatagaatctaaataaaaatgtggtgccccaccccagagctcaatcgttttaaatccaagctctgcctgtttatccagaaaataatccaatgaataaaataaataatggatattcatacctgcaatctgttctctgtttattagtttcataattgccctccttgtttaatacgtcttataacgttatgtgtttatttaaatatatcaccactctactcaactgtcaatattgacacattatacaatttctcttcgtattttttatatacttttcacaataaaatgtgcttttataaaattttattttttcacaagcaaaatatgcattacgctttattgtggtttttttatctttcctgtataatgaattcataaatttaatttaaatacaacaaaggggaatattataaaactcgattcaggcaatgaaatgcctctttaccaacaattaaaagaagaaatcaaaggcaaaattaccgataatacatttccatatggttcaaaaatcccaactgaaacagaactaagtgaaatgtttcaggtaagccgtattaccgtacgccgtgcaattcaagaattgtgtcaggaaaattatcttgtcaagaaacaaggaaaaggaacttttgtaaaacatgccaaagttgcacgcaagatcaaatatctattaggattttcaaaatcctgtgaagcaaatggcatggttccttctagaaaagtgatcaaacgagaaattgtagaattatcagatgaagatgcaaaaactatgggactagaagctggcagccatgcagtttccattgagagaatcaatttggctgatggtgttccgattatgtacgaaacaaacctttttccatatcagaaatatgcttttctattagaagaacccttagatggatccttgtttgaacttctagaaaaaaaatgtcatacagttgtttcttattctaacaactcttatcttgaccttgcccgtgcctccggacgtattgcaaaagaattaagagttcctaatcgcgaaccactctttttcctttattcggaaggttatgacagtaataatgagctcgtctatattggaaaagattatgtattggctgaccagtatcgtttttatctggatgatccaaaataatattacagaaactatagtctaataaatctataaaaaggatgcttaaagttacacatataatttcaaacatcctttttacttctaattattttgtcacattttttatcagcaataagatttcttctgcaagccttctatgaccttcttccgtgaaatgaattccatctgagccaatgcactttgcatccagtatctccgccgcacttaaaaaatgtgccttgtgaatagctgcaatctgacgatattcttcagtcagttgtgttgcttttctacaagattcctcagaaaattctacccactctggctttggatataacttcgctggtgcaataactattttcactggattctgaccttttcgtctacacacatcttctatttgtaatagaacttcgtcaatgccatatccaatctctactgcattcacaccatatcttatttttgtatcgtttgttcctagcataacgatgatataatctaagggaaattgtgaaatcaagcaagggtataaataatccaatgcacatgtacctggttcaattcgatcagtaaatgctgttgttcttccattcattccctcttcaataacttcatattcctgttgaagtgcctgcgcaatccttcctgtccatctaacttctttttcatatctttttccactacctggcatatatccccaagtatttgaatctcctatacaaagaattctatttttcaattttattccctccttatttcatttagatgtttactttttatataatacgttatattatgttatatatagacagtagcacattgaacatttttattcaatacttttttatttttttggtgattattatgaataactctacttttttctttgacatcgatgggacacttgcgacttatcagaagcctgtttctcatcaactacgcgaaaaattgctttatttaaaaataaaaggacataaaatatttctttgcaccggaagaggttattctgatcttccacctaatcttctatccattggatttaatggaataatctgttccacaggtgcctatcttcgcatacaagataaagtaatttgggattgcccttttccacgcccattattattagaactatataactatttgagagaacttaaaatctcatcttattttgaagggagttcttttatttatcgtgcagaacaaggagaatcattagaaaaacaatttccagcaatagatcaactacttcagcaacccccttccacaatggacgcaatctactctgtcacttttcatctaaaacaggcagaagaacttcctgctattactcaatgggcgcaggcacaccacctaaatctattcatgcagacaaaactgcatggtgatatccttatgaaagaatgtaataaagctatagggattaaaaaaatgctggaataccttcatctgacagattggccgtctttcggtttcggtgacagcccaaatgatattgatatgtttcgaaccgtaaatacaagtatagcaatgggccacgctcctactgaagtaaaagaggctgcttcttacataacaggaacctttgaagaagatggagtatttgaatttttagaaaagtttgagtaactaacaataactaacaaaaagaagaaagctaacaattacactaatccaacacattctatgttgttattgtaattgttagctttccctttaattgaaagaatcctggttcaacaaatcttactgcaccttcgcaatatcaatcagtgacagtttcttaatatctgtattctcaagacttgtgatcaatgcatatgctgtgtcaattgcagtcagtacattcacacctgtctcgattgcatttctacggattacaaatccatctcttgaatgctctgcaccctgtgccgggatatcgataacaagatcaatcttatgtccgaggatcaggtcaagaaggttcggtgattcctgctcgatcttacgaaccggagtagcctttactcccgcctcattcagcgcgcgtgctgttccgcttgtagcaaagatatggtatccaatcttctcaaatcttcttccgatctctactgcatctgcatggtcttcatcgcggactgtcatgatcatgtttttatgcttcggaagcttgattccagctccaataaatgctttgtaaagtgcttcatcaaatgtctttgcaattccaagacactctcctgtagacttcatctcaggtccaaggctgatatcagctccgcggatcttctcaaaggagaataccggcatcttaaccgctacataatcagcttccggctgaagtcccggtgtgtatccaagatctttgatcttctttcctgtgataacctgtgttgccaaaggaacaatcgggatacctgtcaccttactgatatatggtactgtacggctggaacgtggatttacttcgattacatatacatcatcttcgccgcacacgataaactggatattgatcataccgataacatggagtgattttgcaagtcttcttgtgtactcagcaatctttgctttcgctccttctgtcaggctctgtgccggatatacggaaatactgtctccagagtggattcctgcacgctcgatatgttccatgatacccgggatcaggatatctgttccgtcgcatactgcatcgacctcaatctcttttccctgaaggtatttatctacaaggattgggtgatcctgtgcgattctgttaatgattccgatgaattcatcaatatcattgtcgttgattgcaatctgcattccctgtccacccagaacgtaagaaggacgaaccaatacaggatatccaagtctgttggcaacttctttcgcttcttctgctgtgaatactgttccacctgtcggacgtggaatctcgcactcttcaagaatctcatcaaagagctcacggtcttcggctttgtctacattctctgcagatgtaccaaggatcggtactcccatcttcataagtgcttctgtcagcttgattgctgtctgtccaccaaactgtacaactgctccatccggtttctcaatatctacgatactctctacatcttccggtgtcagtggctcgaagtacagcttatcagcaatgtcaaagtcagtacttactgtctccgggttattatttacaatgattgtctcatatccgtcttttgcaaatgcccaagtacaatgtacagaacagaagtcgaactcgataccctgaccgatacggatcggaccggatccaagaacaagtactttcttcttatcttttgtctgttcaacttcattctcgcttccatatacagagtagtaatatggtgtctctgcagcgaactctgctgcacaagtatctacgatcttatatgctgcaacgataccgtttgcatgacgcatatcgtgaatttcctgctctgtcttacctgtcagctgtgcgattacattatccgggaactcgatacgttttgcttctgcaagaagctccggtgtaagttcctgtgtcttcagagctgtctccatctctgtgatgatcgcaaatttatcgataaaccactcatcaacttttgtaatctcgtggatcagatcgtaagagattcctcttctgcatgcttctgcaattctccacatacgcatgtcatctactttcttcagctgatcgatcagttcatcatctgtcagatctgtgaagtcataagacatcagactgtctacatgctgctccagagaacggattgctttcataagagctccctcgaagttattacagatgctcataacttctccggttgctttcatctgtgttgtcagcgttctctttgcactgatgaatttatcgaatggaagtctcgggatcttaactactacatagtcaagcattggctcaaaacttgcataggtcttctgtgtgattgcattcttgatctcatccagattgtatccaagtgcgatcttcgctgcaaccttcgcaatcggatatcctgttgctttggaagcaagtgcagaagaacggcttacacgagggtttacctcgattacacaatattcaaatgtctctgggtgtaatgcatactgtacgttacatccacctgtgatattcaactcactgataatgttcaatgcggaagtacgtaacatctgatattctttatcgcccagtgtctgagatggtgcaactacaatactgtctcctgtatgaactccaaccgggtcaatattttccatattacatactgtaatacagtttcctgctccgtcacgcattacctcgtactcgatctctttccatcctgcgatacaacgttcaacaagaacctgaccaacacgggaaagacgaagaccattctcaaggatctctactaactgctgagaatcatgcgcgataccaccaccgcttcctcccagtgtataagcaggacgaagaacaaccggatagccgatcttatttgcaaatgcaagtccatcttctacattttctacaacgagagaagctgcaaccggctcaccgatcttctccattgttgccttgaattccagacggtcctctgccttcttaatggtctcagatgttgttccgatcaggcgtacattattctcttttaagaatccagcctcttcgagttccattgcaaggttcagtccagcctgtcctccaagtgttggaagtacactgtctggtttttcctttttgatcagctgctcaacaacctcaattgtcagtggctcgatataaacacgatctgcgatatctttatctgtcatgattgttgcagggtttgagttgagaagtacaacctcaatcccttcttctttcagtgaacggcaggcctgagttccagcataatcgaactccgcagcctgtccgatgacgatcggaccagaaccgataactaatacttttttgatactattatctcttggcattatttctctcctcccatcatctcaagaaaacgatcgaacaggtatcctgaatcctgtggtcccgggcatgcttccggatggaactgaactgtaaaaatgttctttccaacatatgcaagtccttcgtttgttccgtcatttacattcttaaatgcaggaactgcaacgtttgggtcaatcttgtcttcatcaacaacatagccgtgattctgtgaagaaatgtagactctgcctgtctgaagatctttcaccggatgatttcctccacgatgtccatattttaatttgtaagttgtaccacctgttgcaagtgccatcaactgatgtccaaggcaaatggcaaatattgggatatctgtttcataaagctttttgatttctttgataattgatgtacattctgccggatctccaggtccattggaaagcataatgccatctggattagatgcgatgatctcctccgctgttgtatcggccggataaacggtcacttcgcagccgcgatcatttaaagattttgcgatgtttttcttagctccgagatcaagaagtgcaaccttcttacctgttccttctaaaacgtatttctcctcacatgtaactttggagacaacaccttctaccttataattcttcaacttggagattacttcatcaagatcgtaattctcgtttgttgtgatcataccattcatggtacctttttctcttaaaatctttgtaagagcacgagtatcaactcccgcaatacccggaatatcatatttcttgaggaaatcctgaattgtaccttcacatctgaagttacttggcattctggataactccctcacaatatatccatctggccatgcctttaatgactccatatccggtgtaattccataattaccaatcagcggatatgtcataaccactgcctgtcccgcataagaagggtccgtcagtacctcaagatatcctgtcattgaagtattaaacacgatctcactgatcatatctctcgtcgaaccaatgcttgttcctgtaaacacagtaccgtcttccaaaataagaaacgctttcatctgttcaccctttcccttcgtaaaaatattttttctcaaaaggaaggcgctcatggagtctttattccagagcgccctctttctcaaattgtaaagattatactacagcatgagagacatttcaacatcatttttgatgaataacttagtacttttattaatatatattggtattttttacttataaatggtattttatgcatttttatgaataccagaagatcattatgatccgctttctgtcatccacggcatacgtatatttcacttcttccaattgtctgaagtcaacaagaaactgtgccgcctgtggaatcaaattatctataattttctcttttgcaacttcataaacagcattttccgaaaagcggatagcaaacatttcctgtccctgttctatccctgctttcattttttcatagatttcattctcatcaaatgtttcatagtacagaccgttgattcgataatattccagatcattggaatcgcacaccggatacggcacaaaatcatcctgctgatgatctgtaaaaatttcttcatctgtacaacatagatactcataattcacaagatcatgaggtagcgtttctcccgtctcattctcctgaaagatcggatctccgaaagtcacatccatctgataatacttatcatcacatttcactatattccatgcatgtgccccctgctcttttactgttcccacaacgtaaatacattctattcccatctgtttcaacagatattgcgctgccctggaatatcctgcgcagacggatttttttccaaccaaagaactataaatattctgattatccaatgcgttttgatcataatccaccgtatctacaagatatttgaaaatgtacttgatcttctcatactctgtcccacatccctgtgcacctgcaagtgcctcttgtgccgcattttcaatctgctcccgtctggattctctctgatccggtgtgcagatataagacggatgaaactcggtataatctttatataccgtcatttttgagctcccgtcacaccagaacaattccgaccggtcatacatcaggtattcgtatatctttccagcctcatcgttctcgcctgcgtgaagaagaatggtctcttccatggaacgaacaccctgcaggatctcacgataaatctgtttttcccgttccgtcagctgctgataataaaaaccatctgcaacatcttcttctgatacatttaactccggaaattctattttctgaccagaatcagacaaaaggacatttccagactcacggaataatccgggtactgcttttgtcatctttagtacacctgccgctccgatgatcacaagaagaagcacaagaaacacgaatccttttcttgttgtttttctatttcttcgtcgttttttccttcgtcttctgtctctttccattaatttcactgtctcctgtccgaactgatcctgtactttatgaaagctctgctattcttgacacgccaacataaatttccgatatcttataccatgttttataatctatctctcctgttaccggaagaccgaatatagattgaaatttccggacagccgcttctgtttcaggtccatagattccatcttccgtcaatttgggaatctccggatatgcccccgcaatcacattcagttcttcctgtatctgacgcactttggggccttgtgaaccttgttccagtgtatatcccggccaggaggacggaatacctgagattgcttctgccgtattgatatacatatcgtcaccataataataccttagaatttcaatcggagaaaatccctgttctcccagactttttgacccccactgtgtcaaccaatttggacagctcaccctgcggccatcacaatactgtgtcaggattggctggcgcacattcggccgtgacagatagtctgcaaacagttcatccacaatcactgaaataggctcaaatatattgcgctccgggatccatttatggtcaaatgccgttgatgatgtaattgtaaaatcaaaccctttatttcgataccattccgtataaaccctgtttaaagtgaatgacataattgccagcacatttgcccttatggtgtctgccggccaggttgcatagatttcacttgatgcgacattttttatataatctttgtacttcacataataattctgtgctgtagaatcccgcggagatccatcatgtacgataatatattccggtacaaccacacggctcaagacaatttctcctgtttcatttaccggcttaatctcttcctctgcaatcttcggaggataatttccatataaagtatgagcagggatgacgaatacctgctcttcttccctgctctgatccttttgtttcatgcgtatattctggattgcctttgtgtttgccaggatctctgttcccgaaacactgatcgactcaaatccttctgcttcaatattcaatgtatattctgaatatggttgacgttcttcgttctcatccagactccattcttccggtggtgcattcagttcaaccagttctgtctgaccggaagaatccgtcaccacctgttctaatatactttccggaattcctgtataagagatggaaatccgtgcttcttttactggaaatgcattcacagaagatgtaacatttacctgcagctgaccacgatcgatcagattctcctgcgtttctttgctttcaattgaaccttgtatcggttgaaaaagtttcatagtttgtctcccacatctgattcgtttcctttttccagtatatgcggaaaactcctattctttcctgttttctacacaagtttcagaatgtcattaaacataataacaaccatcaatgccatcagaagcacaaatcctgcaaaatgtaccatgccttctttctcaggcggtactctttttccacgaacggcctcaatgataaggaatacaagacgtccaccgtccaacgccggaagcggtaacagattcatcacacccaggttggcggtcagaagtactcctatattgagaagatttaaaatcactactaccatgcctgccggagctgcttcctgataaacgttatctaccgcactgacaattccaaccggaccggaaagatcttttactcctacctttccacaaactaacattttcagactgtcaactgtatatgtgatccaatacttcaccgtatatgctccgtatcgaaccgttccaaacagacccggacgaaccatctcaccacctgtaattccaagcagaggaaaagcatctccctcattctgttttggttccagcacaactgtataatccttaccgtcacgctcatactcaacttctacactttttgttcccgcatgcatcatattatacagactgatatcgttccagatataaactgattttcctccgatcttcttgatcacatctcccggttcgataccttcttcctgcgctgaatatccatctgtcacattactgacaatcggtgctcgatatcccgtccagccaataataatcatgcaaaggatccatgcaagaataagattaaacactggacctgcaacaattactgacattcttgcccagaccgatttgctgttaaagctcccttcagacatatcatccacatcatcttcccccatcatgcaggctccgccaaacggaagaagctttaagctgaattttgtttctccaaactgttttccaaaaatagtcggtccaagacccagagagaattcatccacacggatcttattcttctttgcaagcagaaagtgtcctaattcgtgaaagattacaatcgcactgaatagcagaattgccaagattatgcccatacattaccacctgtttttaataaattcatatgtttcctgttctgtctttagtatctcctcaacggttggagccgcaatatttttatgcgcttccatacacgcctgaataatttcaggaatctggagatacttaatctttctgtcaaggaacagcgcaactgctttctcatttgccgcatttaacacggtcggaagggaacctcctgttcttcccgcttcaaaagcaagcttcaatccataaaatgtttccagatccggctgttcaaatgtgatctgctgaagtgtcgaaaagtccagtctgtcacccggaagataacgacgttccggataatagagtgcatactggattggaagtttcatatccggtgttccaagctgtgcgatcactgcaccatcttcatattccaccattgaatgaatgatactctgtggctgcacaacaacctgaatctgatctacatccactccaaagagccatttcgcctcaatcacttcaagacctttgttcaccattgtagatgagtcaattgtaatcttgcgtcccattgcccagtttggatgtttcaatgcatcctctacctggatgttctccagatcttccagtttctttcctctaaatggtccaccggatgccgtcaggagaatcttatgcagagccttctgctgtcctccctgaagagactggaagattgcgctgtgctcgctatccaccggaagaatagaaacccctttttcctttgccagcggcataatgatatgtcctgctgtgaccagtgtctctttatttgccaaagcaatatcttttcctgcattaattgcttcaattgtaggaagaattccaatcattccgacaattgctgtcacaagaatctctgactccggctgtctcgctacttcaagcagtccatccataccgcttactactttaacatccagatcatttattttgtcttttaattcatttgctctttcttctttccaaactgctgccagtttcggcttaaattctctgatctgtttctccaggagatcaatattattccctgctgcaagtgctgtaacctccagatcgccatttgtcctgacaatctccaatgtctgtgttcctatggatcctgtggatcccaaaattgcaattttcttcatcgtaactttttacctctattctgcttttatgttacaatccacaaaactgtggatcagcaacgcatctatcacacatatatctccttttacagaaacagggaaagatagaaaataataggtgctgtaaagataacactgtcaaaacggtcaagaattcctccatgtcccggaatcagttttccataatctttaatgttgtggtatctcttgatcgcagaagctgccaggtccccaatctgtgaaattgctccaccgaccgcaccgataatcgcatattccaatatatctgctgccgcatttccccagtagttaattgcaagtccatacaatactccgatcaatgccgcaccaaggattcctccgattccaccttctattgatttcttcggacttaaaatcggtgccagtttgtgctttccgatcaacataccgacacagtatgcacaagtatcacatccccaggagcatacaaatacaagccataccgagaagattcctcccggaagatttcttgtctgataaatgtaagagagcatcactgccacatagaacattccaaaaaaaccggcaaaaatctgctgtgtattatatttcggataggcaaatacaagaaccgccatctggcagatcaaaaaagccataaacagcataacaaaccagtttaaggattctcccggaagaagcggtttaaaatataataacccataatacaggattgcaaaaatatatccgacaattcctggtgccttcttctctatgtgaaatactttatacaactctgtcattccgatcaggctgattaataacaaaactgcaaagagcaggtttccgcccgtgatcactgtgacaagcgcgatgatcactaatagtattccacttagtaaccttgttttaaacatctttattccgcctcctctactccgccgaatcttctatgcctgcggttatattcttccaccgcttttataagctcttctttcgtaaatgccggccacggaatatctgtaaaataaaactctgaataggccagctgccaaagcagataattcgataatctttgttctccgcttgtacggatcatcaaatccggatccggaatgtcatttgtatccagataagaattaaataatgattcatcgatcgtgtccggatttaccttgccggccgcacaatccttcgcaagctttctggctgctcttgtgatctcatcacggcttccataattcagggcaattgtaaaattaagccctccattgttggctgttgcctcttccagttctctgattcggctcttgatatcctcatccagcggttcaatatcgccgatcacacggatcttcatatcattctttgccgctgtcttcagacatgttttcatgtaatttcttaaaagtttcatcagtgcatccacttcattctgtggtctgctccagttttctgtagaaaatgcatagactgtcaggtacttgattcccatacgccatgcttcttcacagatcttctcaacgttcttggctccctgtgcgtgtccgtaatttctcggcattccttttgattttgcccagcgtccgtttccatctaaaataatcgcaatatgctgtggtacgttcattttcttatcctctctgtcgcaactttctttaaagaagaaatggaggccttaaataagcctccatgttcttaaaaacttatctgcgtacaaataatctgtaaacagtttttccacattacaatctgacaattcagctctgctgtttttcgatttagactgtcatgatttccttggacttcgcctctaccatcttgtcaatcttagcaacatacttgtctgtgatcttctgaagttcatcttcaagatctttgatctcatcttcagaaatttccgttcctttcagtttcttgaaagcaacatttccatcacgacggacattacgtacagcaactttcgcttcctcaccttttttcttaacatctttcgcaagttcttttctgcggtcctctgtcagttctgggaataccagacggatagatgttccatcatttgtcgggttgattccgatatcagatgtaagaattgctttctcaattgccttgagcatgctcttctcccatggctggatctggatcatacgtgcttccggtacagatacattcgctacctgctggatcggtgttggtgttccgtagtaatcaactgccagcttatccaatacatgtgggtttgcacgccctgcacggattgtagcaagttctccatccagattgttaattgtctttgtcatcttatcatcatagattttgtttttttcattcatgctgtaattcctccgctatttaaaatagtttatacagtaacttttgttcctgtgaattttccctgcattgtatttacaatactattctcttcattaagtccgaatacaagcatcggcatcttattctcaagacagagaatggatgctgtcagatcaactgctgcgagtttctgatcgatcacttcttgaatagaaatttcatcatacttcactgctgccggattcaccttcggatcactgtcatagataccgtcaattgcctttgcaagaagcattgcatctgcctcaatctcgattgcacggagaactgcacctgtatctgttgagaaatatggatgtcctgttccacctgcgaaaaagattaccttgccttcttccagtgctgcaactgccgcatcctttgagaacagagatgtaaatgctccgcatacaaaaggtgtgaatacttctgtcttcattcctacatgacggaaaatatctgacacatagatacagttcataactgttgcaagcataccgatctgatctgcttttgtacggtcaattgtctcacttgttcttcctctccagaagtttcctcctcctgttacgattgctacctgcacaccttcatctacaagctgttttacctgcttcgcaactccaatacaggttgcctcatcaaatccagtcttcttctcgcctgcaagagcttctccgctcagctttaacaatactcttttcataccgtatagctcctttaaattctatctttcagtgcctgttctgtctttttcacacaaaccataattcaaagtataatggcactaacctaacttagagtataacataagtttccacatttgtcatgaccgaagcgtgaaatccttatttttttcaaaaaaagaaccgatttctttcaggcaatgtttctatacgaaaaatcctgattaaatcgattcttttcatgattattaaattcgcctacataataagcattgaaaacagcactgtaataattccacagattccgattgcaagaccgctcattgcaccctcgatctcaccaatttcaattgcctttgatgttccgactgcatgactacatgcaccgattgcaagtcctgctgccacagaatccttcacatggaatattttgatcagcgtcggagccagaatacttccaaggattcccgtgaaaataacagcaaccaccgtaatcggcactacaccacctgccggctcagaaatactcactgcgataggtgttgtcactgacttagggatcagtgaaactgtcatgctctgatccagtccaaataatttgcacattccaaacacacttgccatagatgccgctgaccctgcagtacatccaactacaattggaagccagtatttcttcaaaatatcaatctttgtataaattgcaaccgcaagacatgctgttgccggagcaaggaacatattgattaaagccccgcccacatcatagctatcatatggaatatcaaaaatcaaaaggactcctacaatcaatacaatcgcaacgatcagtggattacagatcggtgtctttaatttattatgcagcttttctcctatccagaatgctactacactcaaccctactccaaaataaggagatgtcattaattctttcatgctttccttcctccctttttcttctccatcaatttcactgtcagcgtaactacatacgctgtcacagcaaatgttacaatcgtggatacaacacagattacaagaagctgaagcactgtactttttaaaatgtcaaaataattaatgatacttactcctgccggtacaaaaaagaatgccatatttcctaataaaaaatctgctttttcctgcacatgctcaatctttaagaacccggtcagcagacagatcaacaataaaatcataccgatcacactcgccggaaaagaaaacggcagataatgttcgattacaagactgacccagcaaacaccgaatatcacaccaaactgttttaaaatcttcatttgttttacctctttttaatatgtaagcctacatgtcaagttccagaaacaattctttcgtcagtttctgtcaatctcatgcctggagaactctctcttcacatgacacgctttttagattagcactgcgcactctatccgtcaatgtgattattcatgaaataatcacactattttgcatgtttttttgatatatttcttcaaataatccaaaagacattgacatctaattgtatatgttttatgatacatatgttttcgcactttaaacaactaaaattttacagtacgaatattaaggaggatgataaaaaatgattattgttttgaaacctcatacttctgaggaaaatatacatcgtgtcgaaaatcttgtaaaaaagcacggacttgacactcatctggttcagggaaccggaatgacgatcatcggatgtatcggagatacaacactgatcgatccaagacaatttgaaattgacacatgtgttgacaaagttatgcatgtacaggagccttataagcttgcaaatcgcgcatttcatccggaagactctattattgatgtttccggtgttaagatcggcggtgaacatttaggactgattgcaggaccttgttctgtagaatcctatgaacaggttcttgagattgctcaaaaagcaaaaacatccggagcaaatcttctccgcggcggcgcattcaagccaagaacaagtccttacgctttccagggactcggacttgagggacttgatattctctgtgcagtcagagaagaagtcggacttcctattgttacagaactcatgtcttccaagtatctggatgtattcaacgagaaggttgacctgatccagattggtgcccgcaacatgcagaactttgatcttctcaaagaattaggacaggttgatcgcccaatcctgttaaagagaggactgaatgccacatacgaagaatggatcatgtccgctgagtatatcatggcatccggtaatgaaaatgtcattctctgtgaacgtggtatccgtacttttgagacttttacaagaaacactctggatcttcagtgtatccctgttcttcgcagcaagacacatcttccaattattattgacccaagtcatgccggcggaaaatggtggcttgttgagcctatggcaaaggctgcagttgctgcaggtgctgacggacttatgattgaagttcacaacaatccggaagctgccctttgtgacggagcccaatctttgaaacctgagaaatatgatgttctgcttcagcaagttcgtcaaattgccgaagtagtcggtaaaaaattctaaggagatcgtcatgaaattaacagttgatcttggaccgaattcttatccgatccatattgaaaatggaatccttgcaaaaaccggagaacttgtaagcgaagtgttctccggaaaaaaaatcatgatcgtttcagatgataatgtttttcctctctatggagaaattatcacaaaagcattgtctgactcagggtttgaatgccactcttttgttctgcctcacggcgaacctactaagagtttccagtctctgcctaagatctatgaagcattaataaatgcaaaactaacacgaagtgacctgctcatcgcacttggtggcggtgtgatcggtgatcttgccggatttgctgccagcagttatctgcgtggaatcaaatttgtacagattccaacttcactcctcgcacaggttgattcctctgttggcggaaaagttgcggtagatcttccgcagggaaaaaatcttgttggtgcattttatcacccaaaggcagtcatcattgacccagatgtgctgaatacattgccagatcatttcatcagtgatggaatgggcgaagtgatcaaatatggatgcatcaaagacaaagagctttttgagcttttatgtagacatacttccttcgatgatttaaagccgaagctgacacagattattgcacgctgcgttgatatcaaaagaatcgttgtcgaagccgatcagtttgaccttggagaacgtatccttctgaactttggacacacacttgcgcacacgattgaacagcacttcaattatgagcgcgaaagccatggagaggctgttggaattggtatgtatcagattacaaagattgcagaagagaaaggattaactacatccggatgtgcagaacagatcaaaaaggcattggagatttataaacttccggacaactctaatttaccgattgatgtactgactgatgcaatttctttggataaaaagaacctgaataatcacttgaatgttgtacttcttcatgacattggagacagctatgtatatccaacagatgtcagcttctttgacggtgccggtattgtataacagaaatactttatgaacaaagaatgtgccttggctcattcttgcgcctgcggcggtcgcttgcgacacctaccttgtacgccgcagtgcgcccttaaccgaaaggacgtcagttctttcggttgttgcagatgcgtaaactgcgtccccacagccaatggcaggtataagcagcacaccttgtgaaacccattatttttctgtataatcaatctcatctatttatttcacttataaaggcacaggagacacaatatgtttcattattatatgttcaacaaaccttttggctgcgtcaccgcccgccgtgatagcctttacccaaccgttatggactatttttcagagttaaacaatgataatttaaatccggtcgggcgattagacagagaaacaacaggactcctcctcattacagatgacggagttttcaaccagaaacttacgcacccttcttatcataaaaagaagacctatcattttacagttctcggtgatttaaccgaggatcggtgccaacaattagaaaaaggaatccttttaaaaggatccccagtactcacttctcctgcgaaactaaaagtatttcgtcaggatattctttctaatataatagatactttgcatccggaagtacaaaatgccgtatgtaataacctcccaactcatccagtcacttacggagagattacaatcagtgaagggcgtaagcgtcagattcgccgcatgatgaaagcggttcactgctgcgtaattgaattaaaacgcatttctatagaagatattattctcgatgagacactttctcccggagaatggaaagagatttttccactataacaggaaaaatctcttttttatcttcgtatatcatttaaatccaattataatctccaccggtaattgccaaactcagaagtgaatccatcttctcaacttcctcttctcctgtaatcttctccaccaacacagctgtatcctccgctgcttccaaagtttcatccggtccaatttcatagtcaatatccatcccacaatccggacaaggaattgtattcattgtctgcagtgataaaaatcgacttccacattttttacattcataatatccgcactcttttgtgccatctggtacataatacataattttctacctcactctcttcatcttacaagtactttttatcttatcactcacaaaagaagaccgcaagcaacttatttcgttgcgcaaccttatctcttcctaagatttgtaatcaaaaaccgattggtttttcttgacaaactcaacttttttatgctatatctactataactctttgcactgcatataaatctacagtacaaactgagcagaccgtgatatcatatcatggagtcgggtcgcagatgcgacagtggaatctttcatccgcgggacagtagttgctaatactgattcgtgggtgtttttattttaaaacaattcttttattttcccacatatatttagtgccatagagctatcttttaattgttttattaaattggaggtaacacatatggaaaacagcacaatgaaaaccggaaatcctgtcgcaaatgaagaagatttccaaaaagtagccaacaaagtctctactattacgattatcggaaacatcgcactatctctgctcaaactttttgccggaattgttgcgcattccaatgcgatgatcagcgatgctattcattccgcatcagatgtattcagtacatttatagttattatcggaatcagactcgcatcaaaaaagccggacaaagaacatccctatggacatgaacgcctagagtgtgtagctgcaattgtccttgcaatcgttcttcttatcacaggccttggaatcggaatcgaagcattcaaaacgatattgcagggaaattctgacaacatacaaacaccaggtgtcttagcactgattgccgccataatttcaattgcaagtaaagaggcaatgtactggtacaccagatatcatgccaagagaatcgattccagtgcactaatggcagatgcctggcaccatcgttccgatgcattttcttccatcggcgcattggtcggaatcgccggttcaagacttggatttccaatcatggactccattgccagcttagtgatttttgtatttatcgtaaaggctgcttccgatattttcaaagatgcaatcgacaaaatggttgaccactcctgtgacgaagaaatggagactcaacttcgcaactgcgtaatgcgcaatccaaatgttcataagattgacgtacttcgaactcgaatttttggaaataaaatctatgttgatgttgaaattgctctggatggctccatcacacttcaggatgcacatgatgtggccgaaaaagtgcataacgatatcgaaaagacttttcctaaagtaaaacatatcatggttcatgtaaatcctgcaaaattataagtaacaagctttagagaacgagctttgcctttccatgaaggaatccccgtcaatgacgaggattccttctagggctgacagttcctgctcaaaattcatttaatcatgttctttaatatattgaaatacctttttgtcactccttgattttttataccatccaatacataccattatacatcaaattgatcgcttatacttacaaggatttgcaattcaggataacttttcccattttcccaatttgaaacagtttgtcgagtaacatgaaacaatttgccaaactcctcttatgttaattgattttctttacgaatgctcaatatttgatttcctatattcataatattacatcctcctttaatattattatccaaaaataatgttaaaagtaaagcaaccatcacattacattgcatatatagttccgcaaagattctttgacaggtgcttttttctctctttttgaaactttttatgccgtaaattcatctaataagtatcaatcggttgagatgaagcttgaaaacaattgaaagaaggtggcgtataaaatgaaatctcttgtaaagcgggcgcaaaggggagatgatcaggcgttcgtggaattgatagaagaaaataagcaggccatgtataaagtagcggtcggtattttaaaaaacgattttgatgcagcagatgcaattcagcaaagcatccttacttgctatgaaaagctgaaagaattaaaaaaagcacagtattttaagacatggctgctcagaatattaatcaataattgtaatcagatgcttagagaacagaagaaagtagtcggaattgaggactattatggggcagaagatgcaaaaggaaagaaagcagaagaaaagattgcagcaccaccgggagcagcaacaatcaatgaagactttctggagctgttagaccagatggaacagcaatatcgggttgtattgattttatattatgtagaagagatgagcatacgggaaatcagtcaaatactacagatgaatgaaaacacagtgaagacaagactttccaggggccgaggagtatataaaaagctatacctgaaagaacacccggaattccaatttgaatagaggatgcttttagaatgcagctgatagaaaatgcaagcaaaaaggaggttttgatgatgtcatttgaggaaaagatgaaaaaagaattgaaaaaaaacctggaaatcccagatgttgtagaacagaaaattcaggatgcatataaagaaatcggacaggggaatgttacgatgaaaaaactaaacaatggcaatcagaagaagaaaagagcatggacagcggccgcagcagcggtagcagtgattgcagtgtcaggaagcgtattttatgcaaacccagtactggcgaagaatattccagtgatcggagatgtcttttcaaaactgcagaaaaataaggagaatacgccatatggagaaaaggacaagacagcatatggaaagattgcagacaattcagaaagtgtgcagaatccaggatcagaagcagaaaacaatggcgtgacagtgacagtatcagatgcatattgtgatggatatgaaatgtattttactataacagcaataacagataatgatcaggtaaatcagaaagactatttattgcctgaaaaaagccagcaggtttatgtaaacggggaagagaccggagctgaattgtccttgaaaaaagcagaggatggaagctttgtcggattggggcatatcagtgccggatggttggctgacaaaacatttaaagatctgtccactgtagatattaaattcactgagttgtatgcaaaggtagagaatcaacctgaaccggcaacttatgtagaaggtgaaaatctgatcacaggtcagtggaatcttgaatttacggtagacaccgacacaagcctgttaaatacttatgaggtaaatacagaaaacaatggatttacagtaagtaagattgtgaaagcaccggcatccacttatttgtatcttgaagtgccggaagaatatgaaaatgtacagatgattcttacagatgctgatggaaacaagctggaaaaattcggtggaacatcaacagatccagaaaatgggatgtacgagatccagcttcagtttgagcagacagatacaaaccagattcatgttcaggttatagatatggatcagagtacgaacgacaatctggtcatggttgcagaaatgacagcagatctgaattaaagaatagttattttccgtagtaacatggtgtcttttcggggaatgacaggatggtcacaacagagttagttcggttgtgacctcttaatgtgggcatcctaagcggagcgttttttatatattaggaaaggactttcctaatatataaaaaaatcaccgtccccacagctcctatgtctgtaaaaacagtgattgttagtgcgcgatcaggggttcgaaccctggacaccctgattaagagtcaggtgctctaccaactgagctaatcgcgcatttttttgtttttgtgtctcgtgctcctcaacacaaatagtattatatatcagttgttgccagaatgcaaccccttttttcaaattttttcatttttttcaaaattattaatttcatatacaatttagacgatatcagcaacgtttcttctttcccgtgtctttgttgcaatatcccctatttaaaattcgatacacctcctcgaaggatctgcaaatgcagacaatccttcgattcagtctctgatgacaataacacaactcacggaccccagctttccaacatttcccccgtctcatcctgttctcctgtgaattctactctttctatataatatatgatgcttattttctctgtgcgatcagcttattgattggatttcccttctctgagaatttctgctcatattctgtcataatattccccttattcatctcttcctgatgatgcaggtcgtaagtataagcaagcagtgcccatccagcttctttcacctgttccagagaaaagttgaaaagttcagtattatctgtcttaaattctactcttccattttccacaagaactttctcatatcttgcaaggaattctgttgatgttaatctacgtttcgcatgtctagcctttggccatggatctgagaagttcaagaagatcttatccacctctgccggtgcaaacactgcttcaatctctcttgcatccatgcaaataaaacggatattctcaagattttcaaattcctctgtatcatatttttcaagtgcacgaagcaggacgctggaatagcgttcaattccaataaaattgatctccgggtgagccttagccatattcaaaataaactggccctttcccattccgatttcaatctgaatgggtttctcatttccaaagacctgagcccactgtcctctctgctcctctggtttcttgatcacagcacgatgtgcatcgatcacgccatctgctcttggtatatttcttaatctcatctgctatttttctcctgttcttcaccacagcattactgcgtactttctatatataaggtaaaaccttctttgatatctgcggattatttcaggtcttatcataacatgatttttctcatctcacaactaattactgtccacacaagaaagccattttgaagaatactaatgatattctcagactcacagtctctatctccaatacctctggatatttaacataaattatcttttcagattgcttgtaattttctccaaaaggtgtattataaaagatattatgaatttctaacaaaaaggaggctggttatggactctattataaacaaattgacagagattgaatccgccgcatctgcaatcgtgcaacatgcagaagccgaaaagtccgcattagatgaaaaatttgacaaaaagcggatagatttcgacaaagagcttgaagccgatacgcagcggcagattcaagaaattcgtgacaaactggaagcggagacctcacggatcttatccgggcaaagtcaggaaagtcaggatgaactcgacgccttgcagaaggaatataatgaaaagcattctgattatgctcatgagattctccgacggatcactgaggtgtagcctatgggaaatctactggaatacagtggtatcgtaacgaaaacccgggcaatggaagccaaactccttaccccggcacagtttgaggaaattgcttctctacataatgttcccgaggtagttgaatatctgaagaaggagacagcttacgcagatattttagaagagctggtccccgaacagcttcacagaggaagcattgagaagattctgactcgttcactttaccgcgactacgcaaagctttatcgcttttgcggacagaagcaacgtaagcttatgaagctacgtctgaaatcttatgaaatcgagctgatcaattattgtttaaggattgtgatcaaccattatcagaaaccttttgatcttgattacaaacgtcctttctttgatcgatattcgcagatatcgattgagaaactgatcacctcacgcaccacagatgaactgatcgagacattaaaggagacagaatattatgaacctttaaagaaattaaaggattctccttcggtcactctttatgactacgatctggcattgaatctttattattttacaactctttggaaagcacggaaaaaagtcctgaaaaaggaagacaaggaattataccagcgggattgcggcactcagatcgatctgctcaacatgcagtggatctacagagcgaagaaatattttaatatgaaacctgctgatatttaccagctgattcttccaatccactaccgtctgtcaaccgaccagatcaaaggaatggtcgaggcaacaacattagaggaattgcagacactatgcaatcagacgccttatgcccgccgctatgaatccactgagcagcttaccatggagcagatgtattcagaatgtctccatcatctgtacacaattgacaggaggcggaatccatactccatcgccgctgtcaacacttacctcttcttaaaagaagaagaaatcaaaaagctgactaccgctctggaatgcatccgttacggactgacaccaggcgagacgttagcgtacgttggaggtagaacccaatgattgttaaaatgaaatttatcaacatttccggtcctagggatgatatcgaccgtgtcacagacttgtatctctcacgttatgagatacagctggagtccgcactttctgaactcaagacagtcgataatcttcgcccgttcattgaacttaatccgtaccgggatgtacttgcccaggcaacccagttcgtcggctatcttccgaatgtagatgatgttacaccggatgattctttaggtcttgacgacatgtttgaagttgttcgcaaagcctgcgaggattatgaaggtctgcaggcaaagaaagagaaaaagaaagctaagattgaagagctccgtgccaaacagcaactgctctctccattccgtccgctcgactgtgatcttcacaaggtactcggatatcgatatattgcatatcgtttcggacggatcgcgctggaatcttatcacaagatgaataaatatctgatggatgatttgagtgcaatcttcgttgaaggtgaacgcgatgaaagcttcgtatacggcgcttacttcgtttctccgggagaagcacaaaaggtagatgctgttttccgttctcttcattttgaacgcatcgagctgaaagatgaatttgaaggaactccgtctttcgcttaccagtcactggaacgggacattgctcggatcaatctggagatccaggatctggataaagaagccggtgagatgctttctgaccgggcaccacagcttattgcagcgaaaaaccgtctggaggaactctccaagaactttgacatccgtaagatggctgcccggatgaaagacagccaggatgattcttatatcctctgcggatggatggcagaagatgatgtagagaagttcttagaagagatcaaagatgatgacaaagtctttgttgtcgtcgaagatgatcatgatgcatacttcggagaaccgccgacaaagctggaaaacccaaaactattcaaaccatttgagatgtacattcagatgtatggtcttccggctcacaatgagatggatccgactattttcgtagcaatcacatactcctttattttcggagttatgttcggagatgtcggacaggggcttttgcttttaatcggtggagccttgatctatcactttaagaaagctccacttgccggaattatcgcaactgccggtgtattttccacaatcttcggatttatgttcggaagtattttcggatttgaagacatcattgaaccattgtggatacgaccgatcgaccatatgactacactgccgttcctcggcaaactgaacacagtgtttatcgttgctgttgcatttggtatgttcctgatcatcgtagcgatgatcctacatattattaatgccgcaagaagcaaagatatcgaaagtacctggtttgatccaaacggtgtggcaggacttattttctacattgccgttgtagtaaccatcgttctctttatgacaggtaatccgcttccgggtggtattgtcatgggtatcatgtttggtgtcccgctgcttctcattttcctgaaagagcctctgacccgcatgattgagaaacgtgccgacaagatggaaacaggccctggaatgtacatcgtacaaggctttttcgagatgtttgagacattgctcagttatttctcaaacactatttcctttatccgtatcggtgcatttgctgtcagccatgccgctatcatggaagtagtacttcagctggccggcgctgaaagcggaaatccgaactggttcggagtaatcttcggcaacctgttcgtatgcggattcgaaggactgatcgtaggtattcaggtacttcgtctggaatattatgagatgttcagccgtttctacaaaggaagcggacgtgcattcgatccatatactaaaaagaaaacaaagtaactgttggatcataaatttatgacagctataaaatgtatagaaatcaggaggattccactatgagtttagcaacaaaaatcatctttatcgcagcacttgttttaagcatcatcatcccattcggatattatctgatcggtgaaaagaacaaaaaacgctacaaacgtacaatcggtgtcaacgcatttttcttcttcggcgcatttgccattgcatctatcatgatgcttgcaggtccggcaaatgtacaggctgctgaagctgccgcatcttccggtgctacaatcgcaacaggaatgggatatcttgcagccgcacttgttacaggtctttcctgtatcggcggtggtatcgctgttgcaagtgcagccagcgcagcacttggagcaatcagcgaagattccagcgttcttggtaaatccttgatcttcgtaggacttgccgaaggtgtttgtctgtacggactgatcatctctttcatgatcttaggaaatctctaatttctgattttcaacagaaaggagccgcctatgaaaatgtatctgatcagtgacaatgtcgacacttacaccggaatgcgtcttgccggtgtagacggagttgtcgtccacgaacgggatgagctgaaacaagctttggaaaaagtgctttccgatccgactgtcggcattgttcttctgactgagaagttcggtcaggaatttcctgacattatcgacactttccgattggagcgaaagatgccgttattgatcgaaattcctgaccgccacggaaccggtcgtcagaaagactttatcacctcatatatcactgaggcgatcggactgaaattataaacgcaattatattacgaactaaaggagggattcctcttgactctggaagaaaaaatcgcacacctgcaaaccacatccatggagcaggcccgcctagagggaaatgtcatcattgacacccatcaggctgccctggagaaggttttcgaagatcataaggcagaagccacaagacagtcagaaactcgcatcaaggcggaagctgccaatgcgaagctctcactgaaccaggcactcgccaagtcccagctggagatcaaacgtcgtcaaagcaaggttcagcaggaattgaaagacaagatcttcgaggaagcagacgcattaatcgatgaatttatgaagacggaagcttataataattttcttatcaaatgcatccgcaaagcggtggcttttgccggaaatgatgagcttacgatctatattaacccaactgatgaaaaaaaacgttctgatctggaaggtgctacaagagttcatctgacgatcagcgccgaagatttccggggcggtgtccgtgctgtcatccgttcccgcaacattttgatcgataattccttcagcacacagctgaaagaacagtatgacaaatttgtatttttaggaggtgacggcattgcttaagacagcgaaaatttacggcatcaatggtcccgtcatttatctgaaaggcaacacaggattccgtatgtccgagatggtctatgtcggcgaacagaagttagtcggagaagtcattgcactggataaagatatgacaaccgttcaggtttatgaggaaacaacggggcttcgcccgggcgaagaagttattgccagtggaagtccggtatccgtaacacttgcacccggtatcctgaacaacatttttgatggtatcgaacgtccactggaagatatcgcagaatcctccggcggcgcatttatcacacgcggtgtcagtgtcgattctctggaccgtacaaagaaatggaaaacacatatcactgtaaagcagggagattatctccatgcaggtgatattatcgcagaagttcctgaaacacatgcgatcactcataaatgtatggttcctcctgaagtagagggaactgttcttgtgactgttgcagacggtgaatacacaattgacgaacctctggttcgtctggaacttcctaacggacaggagaaagagctgactatgactcagcactggccgatccgtactccgcgaccgactcatcaccgtttcccggcatctgttccgcttgttaccggacaacgtatcattgataccatgttcccgattgcaaaaggcggtaccgctgccatccctggaggatttggaaccggaaagaccatgacacagcatcagatcgccaaatgggccgatgcagatatcatcatctatatcggatgcggtgagcgtggaaatgagatgacacaggttttggaagagtttagtgaactgaccgatcctcgtaccggcaaacctctaatggaccgtactacactgattgccaatacttccaacatgcctgttgctgcccgtgaagccagcatttacaccggacttactctggcagaatattaccgtgatatgggctacgatgtagcgatcatggccgactccacttcccgttgggccgaggctcttcgagaactttccggacgtctggaagagatgcctgcagaggaaggtttcccggcttatcttgcgtcccgtctgtctgcgttctacgaacgcgccggaatgatgcataacttaaacggaacagacggttctgttacgatcatcggtgctgtttccccacagggtggtgacttctccgaaccggtcacacagaacaccaagcgtttcgtccgctgcttctggggactggataagagccttgcctatgcaagacatttcccggcgatccactggctgaccagttacagtgagtatctgaatgacttaagtcactggtatcaggacaatgtgtctccaaaatttgttgactaccgtaaccgtctgatggcactgttgaatcaggaaagcagtcttcttgagatcgtaaaactgatcggaagtgatgtactcccggatgatcagaaacttgtccttgagattgcccgtgtgattcgtcttggtttcctacagcaaaatgcattccacccggatgacacctgcgtttctatggaaaaacagttcttgatgatggatacgatcctgtacctttacaagcaggcacgtacccttgtcacaatgggacatccgatgtccgtattaaaatctgagaatattttcgatcgtgtcattgcgatcaaatatgatgttccaaataaccgcccggaaatgtttgcacagtatcacagagatattgacgctttctatcagcacgtacttgagaaaaatgcataaggagggaccactatcatgtcaattgaatatcttggcttaagcagtatcaacggccctctgatcgtgttagagggcgtacaggacgccttttacgatgagatcgtagaatttgtcgtagacggcacagaacgcaaaataggacgtattgtagagatttacgaagacaaggcagtaatccaggtcttcgaaggttctgaaaatatgtccctgaaaaatacacatacgaaactgaccggacacccgatggagattgcactctccccggatatccttggccgtaccttcaacggtatcggacagccgatcgatgacctcgggccgcttgtctccactttaaaaagagatgtgaacggacttccgctcaacccggtccgcagagaatacccaagaaactatatccacaccggaatttccgcgatcgacggactgacaactctgattcgtggacagaagcttccgattttctccggaaatggacttccgcacgatcagcttgctgcacagattgtaaaacaggcttctcttggaagcgattctgatgaaaaatttgcaatcgtattcgctgctatgggtgtcaaacatgacgttgctgatttcttccgtaacacatttgaagaaagcggtgttgccgatcatgtagcaatgtttttgaatctggcaaatgacccggttgtagaacgtctgatcacgccaaaggttgcactgacagctgcggagtatctggcatttgaacaaaatatgcatatcctcgttatccttaccgatatgacttctttcgcagaagccatgcgtgaggtctcttcctcaaaaggagaaattcctagccgtaaaggattcccgggatatctgtatagtgaactggcaaccatctacgaacgtgccggtattgtacaaggcgtaaacggatctgtaacacagcttccgatcttgactatgccaaacgacgatatcacgcatccgattcctgacctaacgggatatatcaccgagggacagattgtacttgaccgcccgctccatgggcagtcaatctatcctccgatcaatatcctgccatccctttcccgtctgatgaaggacggtatcggagaaggttttacacgtgaagatcatcaggatcttgccaatcagttattctccgcttatgcaaaagttggagatgcaagaaatctggcttctgttatcggtgaagatgaactttcaccactggataagaaatatttggaattcggaatcgactttgaacagcactacatcggacagggtgttaatgagaaccgtacgatggaagagactttggatctgggatggaaacttttaggaaaactccctagagaagaactcgaccgtgttgatacgaagattcttgataaatactataaacctgctgtagaagactagggaaaggagggagcttcatggatccacgtacatttccaacaaaaggtaatctgatgctggccaagaactctcttgcacttgcccggcagggttatgatctgatggataagaagcgtaacatcctgattcgtgaactgatggatctgattgaagaagcacgcaccatacaggaagagattgattcaacatttacttatgcgtatcaatgtctgcagcgtgctaatatcgaaaacggtatcagcatggtagaacagctcgcctacactgtaccgattgaaaattccataacgatccagacgcgaagtatcatgggaaccgagattcctcatgtgaaatatatcccggacgcaggtcagccgacctatgccttcagtaccacaaaggaatcgattgatattgcccgtgaggccttccgcaaggtaaaagaccttacgatcaagctctccatggttgaaaacgccgcttaccgtctcgcaagtaatatcaagaagacgcagaaacgagcaaatgctctccagaacattacaattccaatgtattcaaatctggtctattcgatcaccaatgcactggaagaaaaagagcgtgaagagttcacgcgtctgaaagtgatcaagagaatgaaagagaaaaaagcctccggttaacgggggcttttcctttccacaggatactattctcagtatgcctgaattctcatattgcaacaacgatctgatattctttttcaaaagtctctccgctctctaccttattaattccaggcttctcagagatttctttatcaaatccaatattatcgcatcttcccatccatggttccaggcagacaaacggtgcgtcttttacagaccagattccatagcttgggaatccttctgacttaactcccacatacggagttccgtctttatgacagatccatgcttcttcaatctgcgtattatcaaagatcaacgcatcattttcaaaaagttcttctgtcaacggatatgtctcttcatttagtttcatctcatgcagtttctccggatcaggagccatttctttcatattgatcagacaatacttcaattcatcttttccagggaacttcagaatataatctgtctttccttcctcgttctttgcaaagcggaaggccggatgcgctccgattgtgaaataaattgtctcatcagacgggttctttacttcccattttacatggagtacatttttttccagtgtataagtaatgaaaagttcaaaatcaaatggataaacttccttcatctcttctgttgatgtcagaagaaagattgatgtttctttgcctgcatgaatacatttgaactcactgtctcttgcaaatccatgctgtgatgtcggatagtgtgtgccgttgatcttcactgtgttcttataggtttttcccacatttggaaatagcaccggtgaatgacgtttccaaaatttgggttctgcatcccagagaagatctgtacctgttttcttgttatacagttttgtcagctccgcaccatgctcagcaatctctacgctaagcacatcattctccattttaatcatgctttttgttcctcctttattccccttaattattatcagactgctctacctgtacgcaattgtctaccagataatccagtactttatcacgaaggattgcatctttcagaacatcttctcccacctgctctttgtaggtatccagatctgctccggctttgtccgcatactcctgcattccttctttatattccttatcagacggttccagtttctctttcttggcgatcagttttacagcttcttcaagctgaacagcctgctttgctgagtcttcaatttttttgttaaattgatcttctgtcatcttcagataagttgtaataaaatcactcagctctactccgtacatctgtgcgatctgtgtatagtaatcatttgcctgtttcacctgctcatctactgcaccgtcaggatatttatttacctctatctgatccagtaaagcagtctgtacttcttgtttcaactgtgaattacctgaatcgtcctgctgctcctgaagagaattttttacctcttccttgtattcatcaaccgtcttgctgctttcactattatttgcaacccactcgtctgtaagctccggtgttactttttgataaatcttattcaatacaatgtggaaatttgccggttttcctgcaagatcagaactctgataattctcaggaaactgtacagtgatatcaaactcttcgccggtattatgtcccacaatctggtcttcaaatccctgataatcgcctgaagctccgataaacgatcctgatccaagttccagatcatatcctgtagctgtgccaccgtcaaatgcaactccatccagagttcctgtatagtcaatatttacccagtctccgctctgtgccgcgcggtctgttacatcctgttctggcgcagcagcttccagtctggactgtatctcctgctctacagaatcatcggacacctcgtttttggcaacctctgttacttcaagtcctttatatttgttcactgtcacataatcattagacaacttaccacttccgcatcctgctaaagatgctgtcatcagaaccgctgtaagaaccgcaatcactctttttttcattttcctgtttctcctcttttataatttcttttttatttttttgtcttatccactataaaagtggtgacagtaatctggaaaactgttccttgaaccggatcagtaaattcctctcctcatatatctttcgtgtcacttgcgtactctttgtcatatcattctcaaaagctctttccaacctctgcactgtacgctcactatagattgttgcattcacttcaaaattcaggccaaaacttcggatgtccatattcgctgtacctacgcaggcaaccatgccatctactgataatgtctttgcgtgaaggaatccattattatagacataacattttgcgcctgctgcaaccatctccccaatataagaatacgttgcccagtaaacgaatggatgatctggtttgcatgggatcataattctgacatctaccccggatctgcttgcaatcttcaacgcatccagaatggacgcatccggtatgaaatacggtgtctgtatataaacatgatttcttgcactgtggatcagatgaagataattgtcatggattgtcttcgtctgtgaatccggtccacttgagataatctgtaccggatcaaatccatgcctgtcatactgcggaatctcaaacaaatgatcttccaaaaacaagttctcatgagctgcataattccaatccaggacaaacctcactgcaagagatgtgaccgctgcaccttcaatacacaaatgtgtatctctccaataaccaaacttttcatcttttccaatatattccctgcctacattgaaaccaccaacaaagccaacctttccatcaatcacgacaatctttctgtgatttcgataattcacacgcatctgaagctgtcccagaatcgccgggaagaattctgcgacccgaattccttcgcatttcagcctgtcccaatctcttttgtgcatggtacgacatcccatactgtcaaacaaaactctgacttctacaccttcatgtgctttctcgatcaataccttctctatatcctgccacacttcatcgttcctgataatataatactgtacatggatatatttcttcgcgcgtttcatttcctcgatcagtgcatgaaacttctctttaccatctgtataaatacggatatcattattatctgtcagaactgcctgtccggcctccagattataaagcacaagatcccggaaccggttaagtgccggactcgtcatcttcagctgcctgtgataaatggtttcctcctgccttcgcacagcgtatttcagctcaccttcaatctccttcgccttaaacatcttattcttgtgataatcctgccctatgatcagatatagaataaatccgacaatcggaataaaataaagcaaaagcagccatgtccatactgcctgcggtgatcttctttcaaagaatacaataatcagagataaaagaatattaatgataacgatattcttcataataaaatgaaaaaccatcaccactgtgttccatattgtctctgccattcaactcttcctttctcttaatcaacgtgaaaatattattgctcactataccccatcatattcttcggacagcgcgttactgttcacacgatgtgcgaccagcaacgcatctcgccattttaaatcgcctgtttttagtaatctttcgtttttcttagtctttcctgtatacagaacccggagcatgaagcaatccctcaatgtctgtctattagaataaactttatcagcgctatctgatttcgtccgcactcgaaaaagaatccctccgttaaatctttactccccctgtttcactttctgccaacatgtgctataatcgtaaaagcatgaatgttgcttatcattatctataagcagcaggcaaataagaaaaagaactagaacagaataaatcatttaaggagtataaaattatgaaaatcattgtattagcaggaggcttaagcacagaacgtgacgtatcactttcttctgctgccggaatctgtcgtacattagttgaaaaaggacatgatgcattccttctggatgtattcatgggattagagaatgcgccggagaatctggaggatgtctttactcttccggatcacgggcttgagattgtgaagaatatcagcacggaggaaccggatcttgaagctgttaaggcttcccgtccggatcagtcagactgcttcttcggcccgaatgtaattgaactttgccgtctggctgacattactttcctcggtcttcacggtggagaaggagagaacggaaagcttcaggcatctttcgatctgcttggtattaaatatacaggacctgactctcttggatgtgcggttgcaatgcacaaaggtgttgcaaagcagattttccttgagtctggcgtagacactccgggaggtggaacgatttataagaactctgaagatcagtcttaccagtcacttggtctgacacttcctgttgttgttaaaccttgctccggtggttccagtatcggagtatatattgtaaatacagatgaagaatatgcagaggctctgaagaaatctttccattacgaagatgaacttgttgttgagccatacatcaaaggacgtgagtttgcatgcggtatcattgacggaacagcacttccgccaatcgagatcatcccgaagacaggattctttgattatgcgaataaatatcaggatggagccacttctgaggtatgcccggctgatattccggaagaagttgcagaacgcatgaaggaactcactgtaaaagcatttaatgctctgaagctcaatgtttacagccgtgcagacttcctgcttgacgcagagggtaatctgttctgcctggagatgaatacccttcctggaatgacttccgcaagccttcttccgaaggaagccaaggtttatggaatcgaatacggcgatctttgcgaactgatcattaagaagtccatggaggcaagatattaatgaaacatatgacattatctgaaatcgcagatgcctgctgcggaatttattgcggtgatcctgcattcttagactgtgaggtctcaagtgttgcgatcgacagccgtaaagtagtaaaagatactcttttcgttgcgatcaaaggtgcccgtgttgacggacacagttttatcccgcaggtcatggaagcaggtgcactctgttccctctctgagcaggatcttggtgacgttgattatccttatatccgcgtttcatcctgcacagaagcattaaaggacttagctgaacattaccgccgttcccttgatatcaaagttgtaggtatcactggaagtgttggaaagacaagcacaaaagaaatgatcgcatctgtactttccgagaaatataatgtactgaaaacagaaggaaacttcaacaatgagattggacttcctctgaccgtattcaatatccgtgaggaacatgaggttgcagttcttgagatgggaatcagccactttggagatatgaaaccactggctaagattgcccgcccggatgtgtgcgtgatcactaatatcggatatgcacatcttgagaatcttggaacaagagacggaatcctaaaggaaaagagttccatgacagactacatgaatccgaaaggttctgttatcttcaacggggatgatgataagctaaaaagctacacttcccgtgatggaagaactccggtttatttcggtcttacagcttcctgtccgttccatgtggaaaatattgagcgtaaaggattaaaaggaacatacgcagaatttgttacaccgacatcacgtttccatgcacatatttcaattccgggagatcatatgatctataacgctttagccggagttgctgtcggatatgcgcttggcatggataatgatgagattgctcgcggaattgaaaagctcgttccgattgcaggacgtaacaacctgattgaagcaaaacattacacgatcattgatgactgctacaatgccaatccggcatctatgaagtcctctcttgacgtacttgcatatgcagacacaagaaaggtcgctatccttggcgatatgggcgaacttggtgccgatgagcttgcgatgcaccgcgaagtcggagcatatgcagcatttaaaaacactgatgttttggtctgcatcggagtactttctaaagatatggcagaagctgcaaaggaaactgttcttgcaacagagaagaacatgaaagttttccattttgacacaaaagaagacttttaccagaacatgggacagattctcaatgaaaatgatacgattctggtcaaagcttcccactttatggaattccctgagattgtgaagaaactgtcagaagaagcataagctgaaaccacactgaaaatataagtcagtcttaaaaaagagttgaaacttctgcctggatcattctagctgattcaggcaaatggtttcaactctttttcagattctattatcttattctacttttcactctatcccgagtgcttttcctaccatctggaactctccttcataaatgcagttcggcagggtaccatccacaatacccttcctgcattcttcgaaatccatccagattacttcttccacttcagattcctgtaatttcaagtttttaatgtccactggttctctataaagatatacggtactgcgttcattgtcacggaatggttttccatgaaattcagcttcaaactgtcctctgtgtgttccgataaactgaagctgatcttctcttgcatgaattccaagttcttctttcatctcacgcagtgcactttccatcagttcatccccggcactgacatgccctgcggaagaaatgtcatacgctcccgggttcgaatctttacattcacttcgtttctgaaggagtacatcataaccactctcctgattcggacgtacaatccagatgtgtaccgttgaatgcaatgttccatctctatgtgcaacaccgcgttctttcacctgtccggttttatttccatcttcatcaatcacatcaaaaagttccatcggctttccgttgagtgccacatactcaagcacatcagatttattatacacaagctttaaagagaaaaattcctcttcttcgtccatcagacggaagaaaatcttgtctccctcccataaattcagatcctttatcttttctttctccacccattcaagaatcccctcgtcacattcgatcggatcacctgtaaatccgtctgctgtatacagtgacatatattccactacatcttttccatatacaaatgtcacgattcctctgtatttccaggaagtcaatgtataaccggtctcctccttcacttcacgcaaaaggcattcctccggactctctgcatattcaaaatgtccgccgacgccgatccatttatctttattcacatcatttttcttcactactctgtgaagcatcagatattttccgtctttttcaatataacataatgtactttgtctgttcatcgtacccctcttttcttttcactatctctatgtctgatgcaggtacacaatcgcttaacctacagcttttatccgcttgaacccaacaactatgagaaacacgctctgcgagtttctcaagttatcgcggcagtcgccaaggtctcgtgcaagcacggacttctgcggcgtacaaggtaggtgtcgcaagcgaccgccgcaggcgcaagaatgtgcctttgcacattctttgttctatattaggaaagtccttgtaaacatttcgccggtgcagaaggcagtgtgccttaaggtgacaggaatctggcaagtgtggtttgagaaaggagtatgcaagatgtacgagaaagagattgagcagctgcaggcaatgattgatgagagtaaccggatcgtgtttttcggaggagccggtgtatcaacagaaagtaatattccggattttcgaagtgcaacaggaatttatcatcagaaatataagtattcaccggaacaggtggtcagtcatagcttttttatgaaatatccggaagcattctatgagttttataaagagaagatgatgattttggatgcgaagccaaatgctgcccatctgaaactggcagaattggagcaggccggaaaattgcaggctgttgtgacacagaatattgatggactgcatcaggcggcaggaagcagaaaagtctatgaacttcatggaagcatccacagaaattactgtatgaaatgtgggaagttctatgatgcggaatatgtgaagaattcagaaggaattccgagatgcagctgcggcgggatgattaagccggacgtagtactttatgaagagggacttgaccagaagacgatccaaggggcagtcgaagcaatttcatcagccgacatgctgatcatcggaggtacttcccttgttgtttatccggcagccggttttattgattattttcacggaaaacaccttgttgtgattaataaatcagaaacagccagaactgtccgggcagagcttgtaatatcggctccgatcggagaggttcttggtgcgattcatgtaagtggcgaataaaatttcttttcctgtaaatacttctgaaaaggaggatgctgtatgcagcaataagaagtatgggaagaaaaaaggaaaagacaatcaatcttacagaacttgaaccgaaagaaaagctgaagtatgagatagcagaggaattaggccttttagatcgcgtgatgcaggatgggtggaagtcattaacatcaaaagagacaggacggattggcggaatggtcaccggaagaagacgagagataaaaaaacagacaaaaattgcggataaaaatgatgaaagataaacaaaagtaaaattttgaatgacacagcttttgacaaataaggataaatttggtagaatagacagaatggggagaaattattttgcgttagaattcgcagagttttttggaaagtgataactttggtggcataaatgacagaaaaaatttcaatatttgatgtggagatttcctgtattaaggcaaaagaagcgatgatgcaggcaatcgaattcatgaaaggtgattccgtcaataccattgagcttgtatcgatggaatcgctgatgaaagaacatgagaatccggagtggaaaaaaaaggtttccatgcaggatcttgtccttccgggaagtgtagagattcttgaggcagcaaaagctgatgatgcaagattgctgcgtgagacggataataaattattcttaagaatgtttttgaaatatttacagaagaaccatcataagatttatcttctggcagccagtcaggaggaactggtaaaagcagaggaagctcttgcaaggtataatcagggaatccgtgtggtaggagatgccgtgatccatctggaagacggagagttgacagatgcagacaggatccatggaatagtgaatgcagtcaatggctcagaggcagattgtattttatcagtccttccatcgccggcgcaggaagattttattgaacagaaccgggcattgatcgacacaagagtctggattggctgtggatcagttctgatgcgcagctttgacgacagaaagatgacaagccggataaagagaatgttagtaaagaaagtatttcgctataaagtagagaagcagaattagcctttgtgaagaatgctaaaagataaaaatgtgaatatttcatagattcgactaagaaatgcataaaaaagatggatttcctctttctttttttgctgttttgccttaatataatataagggtatgtgtacggataaataatgcatacaaaaaaattgtggaatatgcacatgcgtgttactacttacagtttgctgtaatcagcaatacatcgtacagagtggaggaaaaaaggatgatttcgaatcagatacttcaaaacactattgaaggattaaagggaatatcaagggttgatttctgtgtactcgacacagaaggcaaggaacttgcagcaacatttgatatggcaaaagattgtggggaagcggttctttcttttgttgaatccccggcagacagccaggtgatccagggatgccagttctttaagatctttgacgaacagcgtttggaatatgttttgcttgcagatggcgagacagaagatgtgtatatgctcggtaagattgcggcatttcagatccagagtctgcttgtagcttataaggagcgttttgacaaagataactttatcaaaaatcttcttttagacaaccttcttttggttgatatttacaatcgtgcaaagaaattacatattgacacagaagtaaaacgtgttatctttattattgaaacatcgcacgagaaagacagtgctgcacttgataatgtgagaaatcttctgggaggaaagtcaagagactttatcacagctgttgatgagaagaatattattgttgtgaaagaactctcagataaggacggcaataaggaacttgagaagatggcgaaagagatgctggatacgctccaggcagagggaggcgacgagcagatccatattgcatatggaaccatcgtaagtgatatcaaggaagtatccaagtcatacaaagaggcgaaacttgcacttgatgtaggtaagattttctttgacgagaaggatatcgttgcttatacaacacttggaatcggtcgtctgatctatcagctgccactgccactttgtaagatgtttatcaaagagattttcgaagcaaaatctccggatgactttgatgaagagacattgacaacgatcaataagttctttgagaacagtcttaatgtatcagagacatccagacagctctatatccacagaaatacactggtatacagactggataagcttcagaagagtaccggtctggatctgcgtgtgtttgaggatgccattactttcaagattgccttaatggtagtaaagtatatgaagtatatggagacattagagtactagaaccgtaggagtatagataagttttaggaggaacatatgattgaattaaggaatgtgacgaaggagtattccaaaggtcacgcagccttgaatggtgtttccgtgaagattgaacgcggagagttcgtattcatcgttggtgacagtggatcaggtaagtctacattgatcaaattgatcatgaaagagttgaatccgaccgagggtacaattatcgtcaacggccagaatttgaaccgtatgaaacacagaaacattgctaaatacagaagaggacttggagttgtattccaggatttccgtcttctgaaggatcgtaatatttatgagaatattgcattcgctttgcgtgtgactgagacaccgacccgtgtgatcaagaagaaggtaccagcagctctgtcactggtaggacttgcacagaagtataagtcattcccaaaggaactctcaggtggagagcagcagcgagtagcgattgcaagagcaattgtaaatgaacctgccattctgctggcggacgagccgacaggaaaccttgacccgacaaactcatgggagatcatgagtctgttaaaagaggcgaatgagcgtggaacaacagtacttgttgttacacataaccaggagatcgtaaacgagatgaacgaacgcgtcattactatgaagcagggcgtaatcgtcagtgatgagaaaaaaggtgggtatatagatgaggattagtacatttggatacgttggaaagcagggcgttaagaatatctggagaaacaagatgttttcactcgcatccatagcgacgatgtcagcatgtattttcctgtttggattgtttttctcgatacttgttaacttccagtatattattaaaagtgcagaagaaggtgttgcaatcaccgtactctttaatgatgacgcaacagaggaacagaagaaagagatcggtgagcagcttgaatcccgtgatgatgtttcggaagtgaagtatgtgtcagcagatgatgcatgggcagaattccagaaagattattttggagacaacccggaacttgcagaaggttttaaggatgataacccgctggcacattctgataactatgaagtctacatgaagacggtaaaaggtaataataaggatctgattgcgaagagtaagtctctttcagctacgcagcaggatctggttaaatttgcacagagtctggacggagttagacaggtcaataagtcagatgttgtagcgaacacactttccagtgtgaatatgcttgttgcatatgtttcaattgcgattatcgcaattcttctcggagtatcgatcttcctgatcagtaatacggtaacaacaggtattacagtcagaaaagaagagattgcaatcatgaaatatatcggagcgaaggactttgtagtaagatcaccattcgtgatcgaaggtctgatcatcggattattcggtgcagttattccgcttgctctgttatatttcctttatgacaaggctgtagtatatattatggagaagtttagcattctgaagaatatcattacattccttccggttggaaatgtatatatctatttgttgccaatcgggcttgcaatgggaattggaattggattcctcggaagttacttcactgttcgtaagcacttaagagtgtaataggagatacctatgaaaagacggatgagaaaggtgacagcactggttctgtcagtcggaatgatgctgtcaatgacaattacttccggtgctgtgacaattgatgaagcgcagaaaaaagcagatgagttgcaatcacagaagagtgcagctcaggctgaaaaagatacacttgctgcgaaacttaattccataattgaccagatgaacaagacacaggaagaattaagtgccaaggaaactgaaatttcaacagctgaggaagagcttgtacaggcgaaggttgatgaggatgatcagtataacagcatgaagaagagaatcaaattcatgtatgagggtggtaataccaagttccttgagatactgatgtccagcagcaatattggtgatctgctcaataaagcggagtatgtatcaaagctttcttcctatgacagagatatgcttgttgcttttcaggaaacggtgaaagctgtagaagaaaaggaagcaaagcttaaagatgagtatgagaaactgaatacattacagacaagcttggtaagtcagcagacggaagcacagaatctgatcagcagtaaggaagcacagattgcggagattcagaatcagattacagataatgcgaacattcttgcagacctcaaggcgaaagcagaagcagcaaaacgtcttcaggaagagcaggcagcggcggctgctgctgcggcaaagaagaacaatagcggaagcagtagtaacggaagcagtagttccagaccggcttccagcggaaacgtggtgagcggaagtggatattttacacatccatgtccgggaatgacgtaccagtccagttattttggagaggttcgatctttcgattcaagaccacataaaggaaatgattatgccgcaccgacaggaacacctacatatgcagcagcagccggaacagtcattacggcaggctggagcaacagtgcaggaaactgggttgttataagccatggaaatggattggtgacaaagtatatgcatcacagctcaatttgtgtgagtgccggtcagagagtagcaaaaggacaacagattggatatgttggttctacaggatattcaaccggagcacatctacatttccaggtggagcttaacggaacaccagtgaatccaaataattatatgtaagacaaagggattcaaaatcttcctttcatgtttacatgaaagtgattcaaagaataaagggggacaaagtggaagattctgctttgtccttttctttaaataacagcgaaagggacagacaatggaacagaaaaagaaaaagggatatggagccgggattgttaccggaattcttgcaacagttcttgtcagcctgcttctccttgggggattcagggtcattacgaacacagccggcagttatgcatctggtaaagtgacagaaaaagaggtatcaaaaaaactgaataagctgaatgctttgattgataaatattatctgtatgaagatgaaattgatacagataagctggcagaaggaatttattccggatatacgagtgcactgggagataagtacactgtttattatgatgaagatgagacgaaagctctgatggaatcaacaagcggaacattttcaggtgtgggtgcaacgctgacaaaagatgcggatacgggctatgccacaattgtaaatgtctatgaagactctccggcagagaaagcaggactgaaagcaggagatattctggagaaaatcgatgaccacgaggttggtgatgagcagcttgacacggtggtgtcctggattaaaggagaaaagggaacagaggtaaagattacagttctcagagacggagaagagctggaactgactgctacacgagatacgatcgaagtgaagacagtttcgtatgagatgaaggagaaccagattggctatatcagagtgtctgagtttgatacagtaacttatgaccagtttaaagaagcgttggacgatcttgaaaagcagggaatgcagggtcttattgttgacctgagaaacaacccgggcggaagtcttgatacagttacaaatatgctgcgtctgcttcttccggaaggtacaattgtatcaacaaaggacaagaatggaaagacagacgaaatcacttgtgacggaactcatgaatttaagaaaccaatggcagttcttgtaaaccagtacagtgccagcgcatctgaaatcttcagcggtgcagtacaggattatggaacagcgaagattgtcggagttacaacgtatggaaaaggtgttgtgcagcaattgatggatctgggagatggaacctgtctgaaagtgacgattgcagagtattatactccaaatggaagaagcatcaatgggaaaggtgttgagccggatgtcgaggtggagtatcagtatgacgaagagaatcccaaagcggataaccagctggatcaggcattaagcacagtacaggaagaaattgttgaaagtacacaaaaccgataggttgaaaaagcctcattctgataaaatgttaaaatgtgtgacaattcagataaaaactcttgaaaatcaaaaaatgatgtgctaatattggaaacaagttttagcagactaaagtgctgaaccagaaaaaggctaagaacaagactctgattcacagaaactgacaggaagttggcgtcaccgactgagagcgccggacagcggagcggattaagggaacacttgggagctggctgtctgaacagatgaagtagggcagcacgtggagcatacgttacatgcaaagagtggaatctggcttacacagggataagatttgaaatgtgaagactgagattcaatgcgggtggtaccgcggatattatgattgtaatttccgtcccgggatactgatgtatcccggggcttttttatttagaaagcttcttcccgggatgctggaatctgaaaggagaagaattatggaatttgtaacaggtgtaaaaaagaaggaaacattggaactgagtgaacttctcgaagagggaagaattggaaccgaagtgaaagtaaatggtgcgatccatacgatccgtgatatgggaacaattgcattcattattctcagaaaaagagaaggacttgttcagtgtgtatatgaagaagatatttccaaatttgacttgaaagatgtgaaggaagcagatacagtagaggtaacaggtgtgcttgtagagtctgcgaaagctccgaatgggattgagattcgccttggtgaattgaagatcttaagtgagccggcagagccaatgccgcttccgattgcaaagtggaagctgaacacatctctggaagcaaaattaaactacagaccgatttctctgagaaatatcagagagcgtgcgaagttcagaattcaggaaggaatcgtaagagggttccgtgatttcctttataaagaaggatttacagagatccatactccgaaaatcggtgccaagagtgcagagggcggtgcgaaccttttccgtctggagtatttccacagaccggcgatccttcagcagagcccacagttctataagcagatgatggtcggagtattcgacagagtctttgagacagcgccagtattccgtgcagagaaacacaacacaaagcgtcatctgaatgagtacacaagccttgatttcgagatgggatatattgatggatttgaagatatcatggcaatggaaacgggatttcttcagtatacgatggagttgttgaagaaagagtatgcaagagaacttcagattctgaatattgaagtaccgaagacagataatattccggcagtaagattcgacgagatcaaacgactggtatccgagaagtatgacagaaagatcaagaacccatttgacctggaaccagaggaagagacattgatcagccgttatgcgaaggaagaatgggatgcagattttgtattcgttactcattacccatcaaagaaacgtccattctatgcaatggatgatccggaggatccgacttacacgctcagttttgacctgcttttcagaggaatggagatcacaaccggcggacagcgtattcatgattatcatgaacttcttgcgaagatggagaagcgaggtatgacagatgaaggcatggagcagtatttaagtgcatttaagcatggaatgccaccacacggaggtcttggaataggtatggaacgtctgacaatgaagatgatgaacgaagacaatgtaagagaaacaacattattcccaagagacttaagtcgtctggaaccataagaagaaaatacaaaaaacgggtcaatccccctggattgaacgaaaaaactgttggatgtgaaggtctgaactgagaaagagaactgcccacaggatgttgtggtcagaaacttaaggagtagaaacgagggaggatctttatgtttaagaaaaaagaatgttatctttgcggaggtaaattgattgatggccgttgcagttcctgtgggctggataacacaaagctggagaaaaagaattacaggctgaatgagagcagctttgatcgcaagaaaaaaatgacatattcccagaaacgacagaatgagactggagagacaaaaaaacgggagaaaaagcaggatgcgggacatctctgtgagagtcataacggacggaaaagaacgcagacagaatatcagcaaaaagaaaatccgcggattgaaatcccacagacagggcagatgcagctgggtgggccgacggtatttaatccggcaaggaaggttcatgcaggatcttacgaggaacagaaaaaggcaaggaaaatcagtggaattcttgcgggaatcatcgtagcaatcgtagcatttgcaagcattgcaggttccgttggtgatttcatttcctcatttggggatgattttcattcctcagattatgactggaatgatgatggcagcgaagtggattctgagtatgatccatatatgaatacaacgagagaactttctgagacaggagcaacttatgattgtgtattaggatatggggagtatgagatcggagcacagatcccggaaggaacttatgaagtggagcttgtctcaggagaaggctccatgcagcaggatgatcctgagaattcgatttattactattcttattttagtgaagatgagtcagatacggatgcaggagattatctggatgatgtgagactgtatacaggaggtcatctgaagattgatacaggactggttgtccagtttcattctgagaatgcacagacggaacagatgcagctggaagaaaatccgctgacggaacaggtaacattgaaagccggaaacacttatacggcgggaacagatttcccggcaggatggtatgatgtgaccgaggcatcaggagtcgactgggcggagcttcattacaagatttatcttggtgatttttatgataaggaaaatgaaaatctcaattatgaaaattatggactctggttttatgatacagatggatcagaatcttatagaaatgcagttttcccggaaggaacggagctggaagtggatgatggggacttaatcctgacgccgtccggctcagtaaaaaaccagaattatgacagtttctatgatatgtaccgctacaggtcgcaataagctgagaaatttatgatactgattttggaaattgtcaggattagcaaagacagagtagaaagaaaggatgattaaattggcaaataaaatatccgatgaaacaatcgagtatgtaggaatccttgcaaagctggaactttcagaggaagagaaagaagcagcgaaaaaagacatggagcagatgctggattatatagatacattaaatgaacttgatacaacagggattgaaccaatgtctcatgtatttccggtacagaatgtgttccgtgaagatgttgtgacaaacggagataacaaagaagcgacacttgcgaatgcaccactccgtaaagaggacagttttgaagtgccgaagacaattggttaagggagtgagagcagatggatttattaaaacttacagcccttgaactgggcgagaagatcaaagcaaaagaagtaactgtacgagaagcagtcgatgcagtgattggacagatcaaagaagcggagtcagagattcatagctttgtgacgatagatgaagaaggtgcttatgcacaagcggaggaaattcagaagaaaatagatgtgggcgaactgacaggtccacttgcaggagttccggttgcagtaaaagataatatgtgtatcgagggacagcttaccacatgtagttcaaagattctttccaacttcaaaccgacctatacggcagaggcagttgagaacctcagaaaagcaggagcggttatcattggtaagacaaacatggatgaatttgccatgggaagtacaacagagacgtcttattacggaccgacacgcaatccgcacaacacagcgcatgttccgggaggttcttctggtggttcctgtgcggcagtggcagcatctgaatgttattatgcacttggatctgataccggcggatccattcgtcagccgagttctttctgtggagttgtcggactaaaaccaacttatggaaccgtttcccgatatggacttatcgcatatggatcttctttagatcagattggaccggtagcgaaagatgtatcggattgtgcggcaattcttgaaacaattgcatcccatgatccgaaggacagcacttccatggatcgtgatgattgtgatttcacagaagcacttgtagatgatgtgaaaggactccgtattggaatcccaagagactatatgggagaaggtctggatcctgaagtaaatgatgctgtgatgaaggcagcaaaagtactcgaagaaaagggtgcgattgttgaggcgtttgatctgcgacttgtaaaatatgcaatccctgcttattatacgatcgcagatgcagaggcaagttctaacctggaacgttttgatggtgtgaaatatggttatcgtacgaaagattacgatggacttcataacatgtacaagaaaacacgttcagaaggatttggtcctgaagtaaagagaagaatcatgcttggatcttttgtcttaagttcaggatattatgatgcttactatctgaaggcacttagaacaaaagctttaatcaagaaagagtttgaccgtgcattccgtaattatgacatcattctcggaccggcagcaccgacaactgctccggagcttggaaagagcttaagtgatccgatgaagatgtatttgggagatatttatacaatctcagtcaatcttgcaggtcttccgggaatgagcgttccggttggaaaagacggcaaaggacttccaatcggtatgcaactgatcggaaatgtatttgaagaaaaaactttgatccgtgcagcatatacctatgagtgtgcgacaaagaagatgcatgaaacaccggcatctgtcggtcttatgtcagaaaaggaggtgcgttaacaatggcaaagcagtatgaaacagtcattggactggaagtgcatattgagctggctacaaagacaaagatcttctgtggatgcagcacagaattcggtggcgcaccgaatacacatacttgtccggtatgtaccggtatgccgggatcgcttccggtgttgaataaacaggtcgtagaatatgcgatggcaatcggtcttgcaacaaactgtaagattacacaggtgtgtaaatttgaccgtaaaaactatttctacccagataacccgcagaactatcagatttcccagctgtatctcccgattgccagagatggatatgtagagatcgagagtggttcgggaaagaagaaagtaagaatccacgagatgcatatggaagaagatgcaggtaagctggttcatgatgagtgggatgatacttcacttgtcgattataaccgaagcggtgtgccacttgtagagatcgtatctgaaccggatatgcgttccgcggaggaagttattgcttatcttgaaaaattgcgtatgatcgtgcagtatttaggagcatctgattgtaagcttcaggaaggttctatgcgtgcagatgtcaacctgtctgtccgtgaagtcggatccgatcagtttggtacaagaacagagatgaagaacctgaactcatttaaggcaatcgcacatgcaattgaaggcgagcgtcagagacagattgagttgatcgaagaaggaaaacaggttgtacaggagacaagacgctgggatgacaacaaagagcattcttatgcaatgcgttccaaagaggatgcacaggattatcgttatttcccggaaccagaccttgttccgatcgtgatcagtgatgaatggatcgagaaaatcaaatctcagcagccggaacttcgtacggagaagctggagcgttacaaggaacagtttgatattccgcagtatgacgcagagatcatcacaggttctaagaaaatggccgatctttttgaggcaacaacagcaatctgtgagaaaccgaagaaagttgcaaactggctgatcggagagaccttccgtctgatgaaagacaatggaatggagccggaagatttaacattctctccggagaacctggcaaaattaattgatcttgcggaggcaggaaccattaacagttctgtggcaaaagatgtattcaagcagattttccatgaggatatagatcctgagaaatatgtcgaagaacacgggcttaagatggtgaacgatgaaggtgcactccgtgagacagctgctaaagtgatcgcagacaacccacaggcagtcgcagacttcaaaggcggtaaagagaaagcaatcggagcactgcttggacagacaatgcgcgccatgaaggggaaagcaaaccctggaatggtgaaccaggtgctgcgagagttgttaaaataaaatttgatttgtctgttaggattcctgtaaatggaacagatacatttattgactaagagccagaacagttaccgtgagtggtgcctgtctggctcttactaacatacggaacaaagtgtattcggaacgctcctgccttacatgtgtcctcaacaataaagagacaaaagtacttggttattcaaatgagaagtgatagttcaatagtgacggggccaaccagacaaatctaatttgttgtattgacagttttaagttttgaggtcaatatacatgagaattttattgatctaatattgaaattaagattgatatattgacagtctgaaaaatgtctgctatattacaagtagaacacagagaaataataaactatatatgttcaaaacaataagagattcggaaggatgtggaaagaatgaaacgagattattatgaagtgcttgggctgtcaaagggcgcagaggataaagaaataaagagagcatatcgtaagctggcgaagaagtatcatccggacacgaatcctggggataaagaagcggagaagaaattcaaagaagtgacggaggcgtactctgtactgagtgatccggagaagaagaaactgtatgaccagttcggtcatgctgcatttgatcagagcggtgctgcaggttccggatacggaaatgccggtacaggtggctttggaggattcggcggaaacggcggattcaaaggcggtacttaccgtagttatggtggaccgggaagtggatatcaggagtatcatttcgaaggtggcgacatggatgatatgtttgatgacattttcggaaatatgttccatggaggaagtgcttcaggtcgcagcagaaggacatcaggatttaccggaggatttggaggtgaaagctttagatcaaaaggttctgatatcaaggcaggtatcactgtaggatttgatgaggctgcatttggtggagataaggttattacactgagtaatccggaaaatccgggacaaccgggacagtcactgaaggttcatattccagcaggtattgataacggaaagtcaatccgtttaagaggaaagggaatgccgggaaccggtggtggtgaagccggagatcttctgttgaaagtaacagttgctccgaaacctggatatgagcggaaaggtatggatgtgtatacaaccgtatctgttccgtatacaacagctgtgttcggaggtgaggcattggtccatacactgtatggagatgttatgtgtaagattaaagagggaacacaatcgggttccaagattcgtctgagaggtaagggaattgtttcgatgaaagattcatccgttcacggagaccagtatgtgacgattcagattgaagtgccaagaaacttaagtttgcaggcaagacagaaattaaaagagtttgaagaaatctgtcaggggagttcaagaacagcataaataaatgaaaagaccagaggcttgttttacaaattgaaacaagaacctctggtcttttctgctgtttagaatattgctgtagctgtttagaagttactgtgagcagtaacgttttgcacaggtacaatttatagccactgactcagaaatttgaagccagtaacaaacgaattataattgggattctgctagtcacgttcccaacgaccggaagcaccacatggaagaaccaatcctgaatctgtaacaggaagtccgatctcctgagaatctacatgtccgttccaaggttttaattcagttgagatcatgtaggtaagtacggcaggagcaagtcctgttgtataagaattcacaaggaagaacagtgcatccttggaaagaatctttgtacaaagcttgatgagtggatggatcatatcttcaatcttccagatctcgccttttggtccacgcccatatgacggcggatccataatgattgcatcataagtgttgccacggcggatctcgcgttcaacgaacttcacacagtcatcgacaagccagcggatcggtgcatctcccagaccggaagaaaccgcattctcttttgcccatgtcaccatacccttagatgcatctacatgagtaacctgcgctccggcagctgccgctgcaagtgtagcacctccggtataagcaaaaaggttcagcaccttggccggacgtccagcattcttaatcttctcagagaaccagtcccagttagttgcctgctcagggaagagtcctgtgtgcttgaaactaaatggttttaaattaaatgtgagagaaccgtaatggatctgccactgctgtgggagactaaaaaactcccattcaccgccaccctttttgctacggtgataatgtccgttcatctctttccaaccgcggttcttcttaggagtatcccagatgacctgcgggtccggacggacaagaagataatttccccaacgctcaagcttttcgccacctgagcagtcaagaatttcgtaatctttccaattatctgcaatccacatgaataaattaatcctttctacaaaaataatcaatcataatcattcagagacgatctcaaaaaatgatacatttttgaaattgtttcgttttatatcgtctataacatttctattataatagaaagccctatagtaatgcaatgaaaattttcagattcagagatcaggtattgtcaaccggtattattcacactctgtgtgacctgcattcttataatacgactggttaaaatgcactaataacccactaaacagataggaatataaaaacaaaacgccgaaaacatataaaacctattgacgtagtaggttaataaggtgtatcatacgcctatcgaatctgagatgcgaaaaagtaacagagttacatcaaatgatagatggagtgatgagtatgataaaagtagaacatgcaaacaaaacattttccgggaaatacggtacagtacatgcgctgcaggatgtcagcattcatgtagagaaaggtgacatctacggaattatcggattttccggagcaggtaaatcaactttgatccggttggtaaatggattagagacaccggatacgggaaatgttatagtccagggagaaaatcttgggaatctgaaaaaaacgcagcttcgcaagcttagaagaaaaatcggaatggtttttcagcaatttaatcttcttgaatcaaaaacagtgtatcacaacattgcattgccattgattcttgaaaaggcaccaaaggaagagattgataagaaagtaaaagaagtactccggtttgtagaactggaagataagaaagatgtttatgtaagccagctttcgggaggacagaaacagagagtgggaatcgcaagggcactgacaacaacaccggacatcctgctctgtgacgaagcaacaagtgcactggatccacaaactacagaatccattctgaaactgcttaagaagatcaaccgggagatgggagttacaatccttctgatcacacatcagatgcaggtcgttcagatgatctgtaataaagtagcagttatggagaacggacaagtagtagaggccggaagtgtgcttgatgtattcggaaagccgcaggcacctgttacaagaagatttgttcagactgtagtaaatgatcagattccggaaagcattctaagtcttgtgaaagaacagaaagaacatttccgggtagagaggcttaagtttatcggaagcagtgtaaaacgacctgtgatttcagatatctgtcatgtggatggaattgtagtaaatattctgggagcgaccgtgcaggaattgcaggagaatgtaatgtgtgtgttcattttgcagctgatcggaacggaagagaaaatattagaagctgagaaacagattgatgagaatggagtaatcagagaaagagtggaggcgatttaatggaacaagagtattttggagtatcccttgaaaagttattgaccagtgggggacagacattatatatggttgcatggtcactgatcattggaacaatcataggaattattttggcactgatccttgtactttgtcgtaagggaggactgatagagaatctgatcctttacaatattgtaagtatctatattaatatagtaagaagtattccatttgtgatcttactggtagcaatcatgccgttgacaagggcaattgttggaacgaccatcgggagtacagcatcacttgtcccgcttgttatttatatcagtccatatcttgcacgcttgatggaaaatagcttactggagattaatccgggtattctggaagcggctgaagcaatgggggcatctacctggcagacgattcggtattttctgcttccggaaacacttggctctatcgtactcgcattgacaacaggtacgatcgggttgcttggagcatcagcaatggctggatatgtaggcggaggaggtgtcggagacctggcactgacttatggatatcagaggatgaatacaccattgatgatctttactgtagttgtactggttgtatttgtacagatccttcagcttgcaggaaatacaatttcaagaaaactcagacaacatagataattgattaagaaagaacgaggagaattatattatgaaaatcaagaaaattattgcaggattattagtagcaacaacagcattcagcctggcggcatgcggaaattcagattcaggagatacgaagaaaagtgacgcggatacatcagagaaaaaggaaatcgtctatggaaaatcccagggaccatatacagaacttttcgaagatgcaattgttccaattcttgaaaaagaaggatatactctgaaagctgttgacctttcagatcttcagacagcagatgttgcactaaatgatggagatgtagatgtcaatgtagaacagcatacagcatacatggacagtttcaatcagagttataacgcagatctggttgcaatcagtccgattccaactgttccggcaggcgtttattcagaaaaatatgattctgtagatgaaattccggatggtgcgaaggttgcagtcccaaatgatgcgtccaacacagcacgctgctatctgatgcttcagaaaatcggctggatcaagcttgacgagaatgctgatccatccacagttacacaggatgatattgtagagaacccacataatattgaatttacagaaatgaacagcatgacaattccggcagcagaatctgattttgattatattgcaatcacaggaagtgttgtatataatgcaggcattgatgcttctacagcactggccaatgaagatatttcagattatcttgtacttcaggttgttgtaaaagaagagaacaaagatgcagattgggcacaggcaatcgtggacgcataccattcagatgaattcaaacagtatatgaaagaaaacaatgatggattatggtggatcccggaggagcttcaataattaagaaaggcagtgatgaaaatggatcagacagaaaaattaatcctagaagcaatcgatcagcacagagatgagatcattgaatttgccagagatatatacgatcatggagaacttggatataaagaattcaatacagtagaaaaattcataaagaagatgaaagaattaggtctgcgcacagaaaccggacttgcaattacaggaacaaaagcgtatttaaatgaagaaaagaaagatacagcaagccttgcacttcttggagaacttgatgcacttaggattccggagcatgctcatgcgaatccagagacagatgcggcacattgctgcggacatcatgcacagatggctggaatctttggtgcggcactggctcttacagttccggagatcgcggaaaaactggatggacaggtggtattttttgcaacaccggcggaagagtatggtgaaattggattcaaaaatgaactgcgtgcacagggaaaaataaaatatggcggtggaaaatgtgagctgcttcgtatcggcgcatttgatgatattgatctttgtattacacatcacattgcaccgggggatgacatcatagtaggaagtggaaccggaaatggatttgtatctaaagtgatccgttgtttaggtaaggcagcccatgcggcaggaacaccggaacaaggtgtaaatgctctgtcggcggcgtcacttggtctgcaggcactcggtctgaatcgggagacattccgtgatgaggattgtgtccgtgtccatccgatcattacaaagggtggcaacctggtaaatgtagtgcctgatgaagttgtagtagagacattggtaagagctaaaacaatcgaggcatttacagatgcagcgaagaaaacagaccgatcctttcacgcaggagctactgcaatgggagcgaaggttgaaatcacaacacttccgggataccttccgacacttgcggaagaagcactcccagaattaaaaagagcagcagaactttctgcaccggaaacaaatgtgatcgaggcctcaggacatacgggaggatctacagatgtcggtgatgtccagcacttaatgcctgtatatacatttaatacagggggtgtaaagggtggactccatcaggtagaatttgaagtgacggatgaggaagaagcttatattgtcactgcgaagatgtttgcacttggagcctatggacttttgaaagaaaaagcagcaagaagcagagaacttgttaaaaattataagccggtatttgaaaattcagcaaagtatgcggagtttatggatcagtttgattcgaaagaagtattggaataattctatacatttccccacttttatggtataatttaaaagttattttaatgatttatcgatttaatgtgatgaacagtcgacgtaataatatcataaaagaaaggaattagagaagtatgttatctacgatagaatcagtaaatagtgctgtgaacaactttatctggggtgttccggctatgatctgcattattggagtcgggctttacttaagtatccggaccggcttccttcagatcagaaaatttccgtatgcgatgaaagtgacgatcggaagaatgctccgcaaaagagatgcatctgacggtgcactgactccgttccaggcagtttgtaccgcattggcggcgacggtcggaaccggaaatatcgctggggttgccggtgctatcgcaatcggagggccgggcgcagtgttctggatgtggatctcagcacttcttggaatgtgtacaaagttttcagaagttactcttgcagttcatttccatgagacgaatgcggaaggagatcgtgtcggtggaccgatgtattatatcaaaaatggtctgaaaaagcattggcactggctggcttatctgttcgctgcattcggagttctgactgtatttggaacgggaaatgcaacacaggtgaatacaattacaacagcaatcgattctgcactttttaattatggaatcatagaaaaggattctgttggaacattgaatctgattatcggaattgtacttgctatcctgatcggcatgatccttcttggaggaattaagagaattggacaggttacagaaaagcttgtcccattcatggcagcaatttatgtgattctggcacttggcgttgttgttctgaatttccagaacattccgagcgtatttggatccattttcgaaggcgcattttcaccggcatctgtgaccggaggcgccgtgggatctttctttatgagtatgaagaaaggtgtttccagaggaatcttctctaatgaggcaggacttggtacaggttctatcgcgcatgcatgtgcagatacgaaaaagcctgtaaagcagggattttttggaatcttcgaagtatttgttgataccattgtaatctgtacattgacagcactcgttattctgtgtagcggtgttccggttggatatggagaggcagcaggagcagaacttactattcttggatttacatccacttatggaaactgggtatctatctttacagcggttgcaatgtgctgcttcgcattttctacgattatcggatggggattgtacggaacgagatgtgtggaattccttcttggtacaaaagcgaataagccattcatggtactctatgcactcgttgcaatcatcggtgcaacgatggaacttggattgatgtggaatattgccgagacattcaatggtctgatggcaattccgaacctgatcgcagtattcttgttgtcaggtgtagttgtaaagcttgtgaaagaatactttgcgggtgaaggaaaagaaagttaaaaataaaactagatatagaagatttaaagctctggtgttttttgaaatcaccggagtttttttaattgagcaataaaaaacatcttatatccccccacctggcttgtgggtttattctgtttcttatacaataaattgcattgaaagaaaatagacatcatgaggagaaaacgatgaaacgaagaaaactatcacaggtgatcgtggtaaccttagcagtctgcacgttggcaggctgtgtacttacaggctgtggaagtaaatcagacaatgcaaataaagagactacacaaagcggatctacattaatctatggaagtaatgattacacaaggatcaatccggctattgatgagcatggagagattaatttacttctgtttgacggtctgacagcacatgatgagaataatgaggtagtaccgggactggcagaatcatgggagctggatgacgcgacaaatacttatacattccatcttagggatgatgtaaattggcatgatggagagcaatttacagcagatgatgttgagtttacgatcaaagcaatcatggatccggacaatgagtcagagattgcttctaattacgaggatgttacagcaatcaatgtgatcgatgataagacgatttcttttacacttcgggataagaatgtggcatttctcgactatatgacaattggtatccttccgaaacacttactggaaggcaaggatatgcagacagatgaatatttccataatccaatcggaacgggtccgtataagattcaggagtgggatgaaggacagagtattacacttgtaaagaatgaggattattataaaggagctccgaagattgatacaatcgtgtttaagattgtaccggatgataatgcaaaggcacttcagttaaaatccggtgagatcaatctggcaaaggtgacaccgaaggatgcacagaattttacagatgatgatacttttacagtatatgatatgaagacagcagattacagaggtatcctttataactttaataatgagttctggcagaggaacaaagatgcaattccggcaatcagctatgcaatcgatcgtcagaagatggtagacagcgttcttctgggagaaggaattgtagcttatggtccgcttcagagaaataaatataataatgaagatgtagagaaatactcttatgatccggcaaaagcaaaagaagtgttagaagcggctggctggacattgggagatgacggaatctatgagagaaacggagagaagctttcttttacaatcaatgtgatggaaggtgatcaggtgcgcgcagatcttgcggctatcgcatgtcagcagctgaaagaagttggagttgatgcaaaagcacaggttcagtcagaaatcgactgggcaaatcaggaagcatttttgatcggatggggaagcccgtttgatgctgatgaccatacatataaagtgtttggtacagataaaggaagtaattacagtggatattccaatgaacaagtagacacttatctgacacaggcaagacagacaagtgatgagaatgagcgaaaagaagcatatgcaaagtttcaggttgcacttgcagaaaatccggcatatacattcttctgttattgcgatgtagattatgtgacgaataagaagatccatggaattacaaaggatacagttcttggccatcatggtgttggaattttctggaatgtagaggattggacaatcgaatgaaaatagaagaaatactggcagtgaagcatttgtcagttgaatttcaaacttcagatggaaagaaacaagtagtaaaggacgtctccttgtcgttaagacaaggggaggtccttgctcttgttggagagtcaggatgtggaaagactgtactgtgccgatcaattttgaaattactgccaaagagtgcctctgtgacaggcgaagccattcaatataaagatcagaacctgatcggatataatgaaaaagagatgcagcagatccgaggacagggaatcgcgatggtctttcaggatccacagagtacgttaaacccgacgatgacagttggaagtcagatggaagaggctattttgttgcatgaaaaagctttaaatcagaagaaaagagagaaagatttcgagaaaaataagaagaaatcagcaaaagagcgggcaatcgaactgatgaagctcgttgggatcaaagacgcagagcagcgttatgatctatatccgtattatttttcaggtggaatgcgtcagagatgtgtgcttgcaacagcacttgcctcaaatccaaagcttttaattgcggatgaaccgacgacagctttggatgtgacaatccaggcggagattctgaaactgttgaaaaaattacagaaagaattgaatttaagtattctgtttatcacacatgatctcggagttgttgctcagatcgcagaccgggttgctgtaatgcaggatggaaatatcgtggaattggaagaagcaaaacagcttttcacagctccaaaacattcttatacaaagaaattgcttcaagatcatccttattatatgcatagaaatgaatcagaattaaaaagtgagtcgaaattgcatgaaaaactggtagagatttcacatttgtcctatgcctaccctttggatagaaaaagcgtgtttcaagcggtgaaagatgtgtcctttgagataagaagagacgagatttttggactggtaggtgagtcaggatctggaaagtcaacggttggaaaatgtctgatgggaattctaagtccggaagcagaaacattttcttatgatgggataaatcttcttgataaaaaagcaaaaaagaaaaatgcgagaagactgcaaaaagagcggcagatgatctttcaggattcaacatcttccttaaaccagaaaatgaaggtagagaagatccttgcagagccattggaaatacataaagtattttctgacaagaaagaacaacatgattttttatgtgaaatgatggaagaagtggaattgcaggaagaacagcttcacgtgtggccaccggagttgtcaggcggacaaagacagagagttgcaatcgcaagagcatttgcaatgaagccgaagctcttgatcgcagatgaaccaatcgcttcgttggatgtaactacacaggcacagatggtgaagctgtttcggcatttacaaagagaacatgactgtgcaatcctttttattgcgcatgatctttcaatggtgcgtctgttgtgcgaccgtgtcggagtgatgaaggatggaaaacttgtggagataggagaaaccgagcaggtgtttgaacatccacagcatttatatacgaagaaacttttggaggcgattccgattccggagatttcaggagaggagcagagtgatgaagaaacaatggcttaaaaaaatcggactgatcttgctatctgtttttgtgctctcacttcttgtgtttgtaatgtcgcggctggcacccggggatccgctgttttcttattatggagaacgtgcggagagaatgtcggtggaagaacatgagcatgcaatggaacgacttggattaaacgaacctatccctgttcagtatgtgaaatggcttggaaatgcatttcggggggacttcggaatctcttataaatataaacaagacgttcttacagtaatcgagggacgtttagtcaatacattattgcttggcggaattggttttatcctgacatttggactggcacttttgcttggaattttctgtgtgtattatgaaaatcagcttccagaccggattttgcgtaaggtgggaacaatcacaagctgtattccggaattctggttgtcacttatattgattttgatttttagtgtgaatctaaagctccttccgggaagtggggcatatgatcttggccaatcggcaaatccgttgagcagattgactcatctgattcttccgctgacagttgttgtgctgagccacctttggtattatgcgtatctgatccgtaaccgattgttggaagaaactagaaaagactatgttttactggcaaaggcaaaaggaatgtcgcgaaaaagagtattgttctttcactgtgtgaaaaatattatgccatcgttcatcagtctgatggcaatttcacttcagcatgtgatcgaagggacgtatatcgtggaaatggtattttcctatccgggaatcggaacgctttcttttgaaagtgcaaaatatcatgactataatatgctgatggtgctttgtgtatttaccggtatttttgttattgcaggaaatgtgatcggacagtctgtcagtgaatggatcgatccaagaatgaaagagataaacatgacaggaaaggcaagtcaaatataaggtggagaagatgagaaaagctgagaagaataatagttcatccgaaaatagaataaggatattcaaaatgaatgattttggaaaaaacaagtcttctgtaattgccggaagtattcttgcagtcatcatatttgcctgtgttttctgtcgtttctttatgacgaaagaccctacatacatggatctgaagaactgcaacatttcaccgaatagagagttcttttttggaacggatacgatgggaagagatatcttttcaatgattttatacggtggtagaatctcgttgtttatcgggttgatatccaccgtgttatcgactacgattgcggtgatctacggatccttcagtggaatcgcaccggagtggattgatgaactgatgatgcgttttacagaaattttattgagtattccttcaattctgttaattatctttcttcaggcactggcaggaaagaactcagttgttgcaatcaccgtagtgattgggtttaccagttggatgaatattgcaaaaatggtacgcactgaggtacgacagctccgtgagagtgaatatctgattgctgcaaaatgtatgggtggaagtttctggcatattttacgtgtgcatttgctgccgaattttgtttcatcgattatgtttatggttgtgatgaacatcagaagtgcaatcatagcagagtcaacattgagctttcttgggattggtcttccgatggaaatcatttcctgggggagtatgctctcgctttctgaaaaggcattgatgacaaactcctggtggatcattctgattccgggaatcgtgcttgtaatcacattactgtgtattacggaactgggagaagctttgcgtaaaaatgtgaatcagaaagaaggcaatttatagaaaatttctatagaaaagtttgataacccatagtaaaaatgttatactgaaaaacagaagcctggaggttaaaatacctgaacgaataggtaaaggagagcgatagaatggtaacagtaaatgctatgggagacaaatgcccacttccggtaattaagacaaagaaagcattagatgctttgacagctccggagacaatagaagttctcgttgataatgagacagcagtggctaatgtgacaaagatggcacagagtacaggcgcaacagtaacacaggagaagcttggagaggatgaatataaagtgacaatccaggcgcttgcaggagaaggaactcagacagcaccggcgggtgcggtttgcgattgtgttccgacaggggatacggtagttgtgatttcttctgacaagatgggaagtggaaatgatgagctcggaaaagtgctgattaaaggttgcatctttgcaatcacacagcttgatgagcttccaaagaagatgatcttctacaacggtggcgctaagatcacatgtgaaggatctgactctctggaggatctgaagaatctggaaagccagggcgttgagattgtgacttgcggaacatgtctggattattatggaatgaaagacaagcttgcagtaggaacagttacaaatatgtatgacattgtcgagtctatgaataatgcaggtaagattgtgaaaccttgttagaaacataggaacagttacagtaatttgaaaatgtgatggaaaagctgctgcaacagctttttcgtataccgagggaattattttgaaaaaatattcgaaaggaagtgggcgaaatgagtaagggactcaaagagattcatctgacacagatgacaaagacagctggttgagcggccaaaatcggtcctgagacccttgcccaggttctgggtaagctgcctaaattttccgatgagcgtctgcttgtcggtgttgagacatcagatgatgccgcaatttataaaatatcggatgagactgccatgatacagacactggatttcttcacaccggttgtggacgatccgtatctgttcggacagattgcagcggcgaactccttaagcgatgtatatgcaatgggaggagagccgaaggttgcattgaatattgtatgttttccaaattgtctggatccggagatcttaggtgagatcttgcgaggcggagcagacaaggtgttagaagcaggagccgttctggtcggaggtcattcggtgcaggatgatgaaccgaaatacggactctcggtaacaggcttcgttcacccggataagatttataagaattacgggtgtcagccgggagatgtgctggttctgaccaaacagcttggaagtggtattgtgaatacaacagtgaaagcacagatggcttccgaagcagccgcagatgaagctgcgaaagtaatggcttcattgaatcagagagcgaaaagagcaattgagaaacacacgatccacgcatgtacagatgtgacgggatttggattgctaggacattgtacagagatggctgaggcaagtgacatgactctggaattatatccggagcagattgaatatatgacagaagcgattgcatatgcaaggatgggactcgttccggcaggagcatataagaaccgggagtttgcagcggaaggactggatgcaggagacgtagaagaggtctatttagatctgatcagcgatccgcagacttcaggaggacttcttgtcagtgtcccaagagaagaattagatagtctgttagcagactttgaggcagtgggaatggagacgaaagtttctgttgtaggctgtgttaaagagcggcaggaaaaactcatccaactaaaaaaaggaaaaatggaaatgctgtaagagatttcttgttactgttcacagtgctctgtgagcagtaacggtttcttacggcatttcgctgtagaaagagaaaataaggagcagcagtagttggaacagttagatcagaataagaaaagagaaaatttacagaaagaaaagaatcagatctttcgcctgcttccgcgagtagatgaattgatgaagaaagaaaatgttcagaggctggcagaaaaagaaggatatgagcgtgttctcggagcagtcagagattctgtggagaatctgagaaatgaaatctcacaaggaatcaaaaagggaatcagtgagcatgaagcgaaagaaatgattcagaaatttctgtatgagatagaatcaagttcaaagaaatcagaagtgaaccatcttctggaacaagaacagaaaaaggagatccaaccagtttataacggaacaggagtaatccttcataccggtcttggacgtgcactgcttagtcatgagattgcggaaaaactgaaagcagttgcagagaactattccagtctggaatatgatttacagactggaaaacgtggaaacaggaccggatatgcagaagaattgctttgtcagatcacgggagcagaagcggcaattgttgtgaataacaatgccggagctgtacttcttgccttgagtgcattgacaaaaggcggagaagtgatcgtctccagaggagaacttgttgaaatcggaggaaaattccgtattccggaagttcttgaattaagcggtgctattttgaaagaagtcgggacaaccaatcgtacaaggatagaagattataaagcagcagtcagtgaaaagacgaaagcatttttgaaagtccacacaagtaattacagaattgtcgggtttacagaatcggtaagtgcagaagaattgtatgaattaagtactggtctgatagaatgcacgcaggaattgccacctgaaaacttcgagaatcatacggaacgaagcggaattccagtgattgaagatctgggcagtggtgtacttataaatctggaggaatatggtttatccaaagaaccaaccgtacaggaagaagtaaagaacggtgcagatgttgtttgttttagtggtgataaactatttggtggagcacaggccggagtccttgtaggaaagaaaaaatatattgatcagatgcgtaatcatccattgcttcgggctcttcgggcagataaatttacaatgacagcgatagaagaagtattgaaatgttatctggatcagaaagaagcggttcaaaagattccaacactaagaatgctgacaagacctgtggaggaaataaaagagaaagcaatggtctgtgctgatagatggaatcaagagggagcgtccgttcagattcaagtggaaaaatgtatttctaaggctggtggcggtgcacttcctgagacggagattccaagttatggagtagcattggaatcaactgagatcaccgttgaagaattagaaagcaggatgagaaatctttcagttccggtaattggaagaataaaggaagggcgtttccttctggatatgagaactttctcggaagaaggaatcgaatatctggcgacacagatcagacatgttatggaaagaaagcataactaagaaagaaaaacagcattaagaaagggactgtattagatggaaagacatgtgatcatcggaactgccggacatatcgatcatggtaagacgacactgatcaaggcattaacgggaagagatacagaccgtctgaaagaagagaaagcacgtggaatcacaattgatctagggtttacatggatggatttgacagacggagagcgtgtcggaatcattgatgttcccgggcatgagaaatttatctctaatatgactgcaggtgtggtaggaatggaccttgttcttcttgtaattgcagcagatgaggggattatgccacagacaagagaacatctggcaattttacgccttctgggtgttgagaatatccttgttgttttgaataaatgtgaccttgtggatgaggaatggctggagatggtagaacagcagatctgtgaagaaatgcaacagttgcttacagtaggtcagagaaatgatcaggtagaagataagctggaatataatgtggacattgtacgtgtttcagcaaaatcaggagccggaatagaagaattaagaagtcaaatcctgaaatgtgtaaaaaagcagaaagaaatgtggaaaatccctgcatttccaagacttcctgtggacagagtattttcaattaaaggaagcggaacagttgtgacgggaacacttcttgacgggaaaattcattcgggagatcgggtgatgatctatccacaacaaacttcgtgcagagttcgtggagttcaggtgcatgagcaggaggcagaagcttgtgaagcaggtcagcgaagcgcactgaacttggttcagacagaccgaagacagagcagtgatgggaagtttgtgtatcgaggaaatgtgatcgcaccggaaggaagtatgaaagtcagccgctatgtgaatgcaaaactgacacttcttccacaaagtaaaagaagtattgaacatcagactcgattacatttttatagcggaacaacagaagttctgtgcagagcagttccgttgtcctgtgagaaaattgagccgggggaatcagcctatgtccaattaaggttagaagaacctgctgtgttttgtccaggggacaggtttattgtccgattttattcaccactcgagacaatcggtggaggaattatccttgaaatgggagaaaaaaaagagcgaaaatatcatgatggggttttacaaagactggaactgttggaaaacaatctttggaatcaagaaaataagtgttcaaaggaaatcccagatcaagaaaagagcctgcaggaacagatttctttagaaaagagaattatggatgaattggaaagctggttgtctgctcatccatatcgaagaggaatgccaaagacagttcttttcaatcagatcagcaaagggaaaaaggaacagaatcgggaaattcagaaatgtcttatactattggaggaacatggaaatgtcggttgtataaggttgcaacaggaaaattctagtatagagctgatttctccggagggatataaagtaaaagagacggaagaagtttctaaattaagagaaatctttgccagtcaatcagatgagaataaagttttctttttgaacaaagtggaattggaaacattttttgagtcagcaagaaaaacgaaaaagaaaagtggaatacaaagtcaggatgaattgatggaaattctgaattatatgcaggaagaaaacgaaattacagaggtttgtgagagtgtttatacaacaacagagattacgtttaaaattagaacagaagtaagccgtatgttatctgtatctaaagtgattacactgagtcaggtgaaagaagtatttcagacaagcagaaaaaatgccagattgatttttgaatatacagatcgaatcggatttacagcaaaagaaggtgcacagacagaacgctccgcaggaaataaattgcaaagagaacaaatcagaggaaagtaaggggagagtgaatgaacttaaaacaactggaagcgtttgtgaaagtagcagaaacaaaaagtttttcggaagcggcaaagcagttattccttacgcagccaactatcagtgcacatgtgtctgcattagaaaaagaactgaatacctgtttccttataagaaatacaagaggagttgagctgtcagagagtggaaaagagctttatgcttatgcggtacaaatgcttgaaatcgaaaagacaataaaaggacggtttggaaaagaaataaaaccggagggaaatgtacttcgtattggtgcttcaaccgtaccggcgcaatatattcttccaaatgtaatgtctatatttcatgcagaatatcctggtgaaaaattgaagctttttgagacagacagtaaaggagttatcgatatgattctttcccatcatattgatattggatttacaggaaccgtgattgggaagggaaactgtaaatatcttccattttatgaagacgaattagttgtgcttactccggcaaatgagaaatttgttgaaaagctttgtggtggacaaatattggcggattggatcatggacgagccggtgatcttaagagaagaaggatccggaacaaagaaagaagcagaaaaaatgctggcagaacaagggattgatatgaagaaactgaagcttgcagcattgatggagaatcaggagacaatcaaaagatctgtaagtaaagggatgggagttacgattttgtctaaacttgcggcagaagaggaattgaaaaatggaacacttctggcttttccactgggcagtcaaggtggaaagagaatgatcaaccttgtctatgatgcagaatatccgttgcttccggcagcagagcgttttataaagatgataaagagaatgtatttgaagaaagaaaatacagggataggtgaatgcaaataacacgccctatttatagaaaaagcctataaatagggcagatccattacggattcctattagacggaaacagaaaagagaagtatactataactagtgatttgtatctgaaaagtaaacgatataaacacatacagaaaggaagagaagccctatgatctacatggataatgcggcaactacattgcagaaaccggaagaagtaaaagaggcgattctctatgctctcgagcatatgggaaatgcagggagaggcggaacagaagctgcacttgatgcttcgagaaatatctatgcagtaagggaaaaacttgcagattttttcaatgcagaaagtccgacaagaattgcatttactgcaaattctacagagagtcttaatattgcattaaaaggtttatttcaaccgggcgatcatgtgatcacaacagtgctggaacataattcagtattgcgtccgctgtattggtgtcaggaacagggagtagagcttacaattctaaactgtgacgaaaagggaaatctgtcatatgaagagatggagaatgcagtgcgggaaaacacaaaagcaattgtgtgtacgcatgcttcgaatctgacaggaaatatgatcaatctgaaacgggtaggacagattgcatcgaagaagcatattttgtttgttgtggatgcttctcagacagcaggtgtttatccaattgatgtgcaggaacttggggttgatgtattgtgcttcacaggacataaaggtctgcttggaccgcagggaaccggagggctttatgttagggaaggtgtggaaattcgtccgcttctgtgtggaggaagtggcgtggatacttataacaagcatcatccgtcccagatgccgacggcacttgaggccggaactcttaatgggcatgggattgcaggacttggcgcagcgattgattatctgaaccgtacaggaattgatgtgatccgtgagaaagaacttcatctgatgcgcaggttttatgatgggatttctcagatcccggatgtgaaagtctatggagattttacagcagaggaaagagctccgatcgtgactttcaatctgggagattatgactcttctgaagtcagtgatgaattaaatgaagtttatgggattgcgaccagaccgggagcacattgtgcaccactgatgcacaaagcactcggtacagtagaacagggagctgtccgattcagtttttctcattacaatacagaagaagaggtcgattttgcaattcgtgcaataaaagagttgtagagaaagagaggaaaaggaaatgaatttgtttgattcaaagaagaaactgggaatcgccggtgtcgtaatggggctggtagcagcaacacttgcttattttggtaacccagcgaacatggcaatctgtattgcgtgttttgtacgtgatacagcaggagcacttggacttcattccgcagaaccggtacagtatgcaagaccggaaatcatcggaattgtcctcggtgcatttattatttcaattgcgacaaaagaatatcgtgcaacagcaggatcttccacaatcgtacgttttgtactcggaatgattcttgtgatcggagcacttgtattccttggatgtccgcttcgtatggtgatacgtatgtcagccggagatctgaatgcatgggtagcactgatcggatttgctcttggtgttgctacaggcgtgtttgcactgaagaaaggtttcagccttgggcgtgcacatgtgacaaataaagtgagcggaagtgtacttccacttcttatgatcggagtacttgtacttgcacttggaacaaatcttttaaagagtagtacagcaggtccgggaagtatgcatgcaccaatcattatttctctgatcggtggacttctctttggagcatttgctcagaaatcaagaatgtgtttcgcaggaagtatccgtgatatcattcttatgaagaactttgacctgatcacaatcgttgtaggattcttcgcagttatgcttgtatataatgttgcaacaggacattttgttcttgcattcaatacacctggagtgatcgctcactcccagcacttgtggagtattcttggaatgtatgcagtaggatttgcagcagttcttgcaggaggatgcccgctgcgtcagcttgtacttgcaggtcagggatcatctgatgcaggagtaacagtgatcggtatgtttgcaggtggagcacttgcacataaccttggcctggcagcaagtggaacagcactgaatgctgagacaggtgagattgtagccggagctgttccgccagcaggtaagatcgcagcaattatttgtattattgtatgttttgtaatcgcatttacaaacaagagaagcgaagcaaaataaggagaaaatagttatgagagaagtagatgcaagaggattatcttgtccagaaccattgatgctgacagcagaagcgattaaaagtgacaatagtccggtaaaggttcttgtgacagaaccacatcagaaaacaaatgtggagaaatttgcaaaggatcacggaaagaaaacaacagtagaagaaatcgaagatggatttgctgttgtgatcgagtaaaatgaaatagtaaaaagccctgctccctttactgaatgtgaatttggtaaagggagcattttagtaataaaaaatgttttctatttgtctggtttcggttataataagagagttgagaaaaaggaaaatgtgaggataacagcatgtatatttcaacaaaatatctgcatgtatttcttgatatcggagatgcgctgctttcaagcggggcggagatatttcgtgtagaagatacattgaaccgtatgggatatgcatgcggtgcaacacagatgaatgtgttcgtgatcacatcgagtattgttattacaatggaatttccagaagaaaatgtacgaactcagacaaggagaatccgaaagaccggaggaaatgattttgagaagctggagaaattgaataatttgagcagacagttttgccagaatcctatgtctcctgaagaacttagggaagtcttcgatcagattgacaaagttgttccgacacagacaggaaaactcgcagggagtattctggcagcttttagttttgcgcttttctatggaggaaatctttgggatgcattactggccggattagcaggcatcttaatctggggagcacagagacatataagaaagtattgcatgaatgaagtgacgtttcaatttgtggcatcatttcttgcgggatgttttatttgtgttatggcgaggctttttccggctctgcacgtggataagattatgattggtgatattatgttgttgatcccgggattgatggcaacaaatgcaattcgtgatatattgattggagatacgatatccggggttatgcgttttatagaggcaatgcttcttgcagcagtgcttgcacttggatttatcggagcaatatttctgattgggaggattggttgatgacgtatattgttcaattatttacaggcgcagcgggttcggttgcatttggcatattgtttcatatgaagaagaaacaccttccattggcggcacttggcggttttctgggctggctgttatttatcatctgcagaggattctggggaggtgtgttcttcccgacattggcagcagcttttggaattgacttatatgcggagatacttgcgcgtagttgcaggagtacttcgacttcattttttgtaacatcggtgattccactgattccaggaagcacgctttattattgtatgagaagtgttgttgaaggaaatttacatcaggcatggaattatggacgagatacatttttatatgcattggggattgcggcaggtatgagtattgcctgggcaatctgtgattttttaagaaagataagaggaaaacaggagatctcataaatgagaaagaaagaattaaaacttgtggtgacatttcacacaactgcggatgcgatggcgatggaaaaagcgtgcaaggcagaggaggtaccgggcagactgattccggtgcctagagtaatctcggccggttgtggacttgcctgggcagcaccgcttgaggcggtagaacagatcaagcatgtaatgcaggaaaaggggattgagagagaagaacttcatgagtgcatggtctaatctttggattcaaggcaaaatgcgcataatctgtgttgaacagtggagtgataaatatggaaggaaaagtaatcatgtttccaaaaaagaaacgagaatatgagaatgaacgttgattctgagggcggtttgcgctatactctattcagtaataaaagaaaaaaggttactgttcacacgggagtgtgcagtaacgaaaaaagtgctgctcacagattcgtgggagcggtaatgaaaagactgctgatagttcggcagagaaggagcataatatgagaattacagatgacattttatatgtaggtgtaaatgatcacaacattgatttattcgagggtcagtatatcgtgccgaatggcatggcttacaattcctatgtgatcaatgatgagaaaattgcggttatggatacagtggatgcagcttttggcgatgagtggctgaagaatattgcagatgtattgaatggagcaacacctgattacctgatcattcagcacatggagccggatcattcagcaaatattcagaaatttctggaagtatatccgaatataaaggtggttggaaatgcaaagacatttacaatgatcggaaacttcttccgtgacctgaaacttgcagacgagaacaagctggaagtgaagaataaagatacactgacacttggaaaacatgagcttacatttgtatttgcaccgatggtacattggccggaggtaatggtaacatacgatagcaaggataaggtccttttctctgcggatggattcggtaagttcggagcgcttgatgtagaggaagactgggattgcgaagcacgccgttactatatcggaattgttggaaaatacggagcacaggttcagaatcttttgaaggttgcagcaacactggatattcagacaatctgcccgctgcatggaccggttcttacagagaatctggagcactacattggacagtataatacatggtcttcttatggaacagaatctgaaggtgttatgatcgcgtacacatctgtttatggaaatacaaagaaggcagttgaacttcttgctgagaagctgaaagaaaaaggatgccctaaggtcgtagtaacagaccttgcccgtgaggatatggcagaggctgtagaagatgcgttccgttacggtaagatcgttcttgcttcaacaacttataacggagatgtatttccgttcatgaagacatttatcgagcacttgacagagcgtaactatcagaataagacaattggtctgattgagaacggatcctgggcttctatggctggtaaagtgatgacaggaatgtttgagaagagcaagaatatcacatggcttgagacttcagtaaagattatgtcttctatggatgagcagaataaagcggacatcgagaagatggcagaggaactgatgtaagcaattttgatttacaggaaagaaagattttgttaggatagaatcagatggcggagcggatgaccagatatcagctggcgtttgctccgtttcttaataaatacatcaatgatgaattgtctaagcattatggaggcagaagagtaactggtgtgcttcctggtcttcaaaaccagtgtggggcgtggtacgtcccgggtgggttcgattcccacatgtctccgccaaaagaaaggaaaaagaatatgggtatgaatcagacgccggtgtccgaacgagtgcacatcggcttttttggtaagcggaatgcgggaaaatcaagcgtgatgaatgcggtaacaggacagaatcttgcggtagtttctgatgtgaaaggaacaacaacggatccggtttataagacaatggaacttcttccgttgggtcctgttgtgatgatggatactcctggaattgatgatgaaggtgaactgggtgaacttcgtgtgaagaagagttatcaggtgttgaataagacagacattgctgttgttgtgattgatggaacgtgtggcgtcagtgaagaagatctcaagataacagagcggattcagaaaaagaacataccttatataatagtactgaataaatgtgaacggtttacacaagaagatgagagattgcgggtacaggaaaataccgcaagttatttgaaaacagagaaagagaagattcttcttgtaagtgcagcggataaaagcggaatttatgagctgaaggaagaacttggagcattgaaaggaaaggaagaggaagaacgaaagattgttggagatcttcttgaaccatccgattttgtagtgcttgttgtgccgattgacagtgcggcaccaaagggacgcctgattttaccacagcagcagacgattcgtgacattttggatgcagatgcatctgctattgttgtaaaagaaacagaacttgcaggaacattagcttcacttggaagaaagccgaagatggttattacagacagtcaggtgtttggtagagtgtcaaaagatacaccaaaggatatcttattaacttccttttcgattctatttgcaagatataaaggaaatctggaaacaatggtacacggagtaaaggcactggatattctggaagacggtgataaagtactgatcagtgaagggtgtacacatcacagacagtgtgatgatattggtactgtgaagattccacgctggctgaaagagtatacagggaaagaacttataatagagacttcttcaggaacagaatttccagatgaacttagttcatataaaatgatcattcattgtggagggtgtatgctgaatgaacgcgaaatgaaatacaggatcagttgcgcacaggatcagggaattccgattgcaaactatggaatggtgatcgcatatattcatggaatattgaaaaggagtctgagtccatttccggagatagaaaaactcttataaaagtaaagaatgcgttgctggtcgcacatcgtgtgaacagtaacaagaatgcattataacggaaatgacgccgctttgctggatctgcaactccagcaggcggcgtcatttctatggtatgtaattgagaggatcctttagttaccagacagaaacatctgcacacgaaactggggaattcctacaaagaggctgtgcgctgacggtactgctgcggcagggatattcttggggaaaacatccggcgttagcgtactgcatgataactgaagtatctgacctgtaaaaacgaataaaaaaagacagtttctcctcggtaaataggaaaaccgcctttggtcttacaagtcgaaataataatatcattcgcacagagtgatgtcaagtatttgagaagaaaaaattatgagaattatgagaatattaaatggggttcagtttaaacacatcatgtattgaataaaagggggaaacaataatgatataaaacgagtttcttctatatataataggaagtgaatcgatcaataatcaaatatatatacatgagaaaacacaaaaataaagaagaaaaagattgtacttgaaaaaaaacaaaaaaagtacttgcaattttgcactctctcggatatactaagagagctgtgacatgatagcaatgaagcgcgaggttgctgcccggcaaatgaataagctggtgcaggttttccgtggagcgaatgtcaagttaggaaactggcgacaagtcactgtacgaatcaaaaactgattactatttgccccaatgggataaccagggtaggagtatgaaacaacgtgtgagtttctcacgacacacacgggagagtgtacagtcaccgcttgtcgtactgatgtgaaaagtacgaaaaggaggcgactttttttatggcaagtcaagtaatgagaatcacattgaaggcgtatgatcatcagcttgttgatgcatccgcaaagaaaatcatcgaaactgtaaaaaagaacgggtcacaggtgagtggaccggtaccacttccgactaagaaggaagttgtaacaattctgagagctgtacacaagtacaaagattccagagagcagttcgagcagagaactcacaaaagactgatcgatatcatcacaccaacacagaaaactgttgatgcactttctagattagaaatgccagctggtgtatttatcgacatcaagatgaagtccaaataataaggacatcttaattttaaacagtattcctaaaatttaggatgagcgcgaaagcgttccgctgtaaatcacaggaggtaattataatgaagaaagctatcttagctacaaaagttggaatgactcagatcttcaatgaagaagacggagttctgattccggtaacagttctgcaggctggtccttgtgtagtaacacaggttaaaacagttgagaatgacggttacagcgcagtacaggttggatatgttgacaagaaagaaaagattgtcacaaaagacaacagtggaaagaagtctatcgctcacagaaacggtgtgacaaaagctgaaaaaggtcattttgacaaagcaggcgtatccggaaagagatatgtaaaagaattcagatttgagaacgctgaagagtatacacttgctcaggaaattaaagctgatatctttgcagcaggagacaagattgatgcaactgctgtttcaaaaggtaaaggtttccagggcgcaatcaagcgtcacaaccagagcagaggacctatgactcacggttccaagttccatcgtcatgctggttctaacggttcagcatctgatccaagtaaggtattcaaaggtaagaagatgccaggacagatgggtaacaagaagatcactgttcagaatcttgaagtagtaagagttgatgcagagaacaatctcatcctcgttaaaggttctgtaccgggaccaaagaaatgcctggtaacaatcaaagagacagtgaaggcaaactagtctgacagctaagaaaggaggaacatacagatggcaaaagtatctgtttacaatatcgaaggtaaagaagttgatacaatcgaactgaacgatgctgtattcggtgttgaagttaatgagcacctcgtacacatggcagttgtaaatcagcttgcaaacaatcgtcagggaacacagaaagccaagacacgttctgaagtttccggtggcggaagaaaaccatggagacagaaaggaacaggtcacgcaagacagggatcaacaagatcaccacagtggacaggcggtggagttgtattcgctccagttccgagagactattccttcaaaatgaataagaaagagaagagagcagctcttaagtctgcacttacttccagagtagaagagaacaaattcatcgttgttgatgaacttaatttcgacgaaatcaaaacaaagaaattccaggcagtactgaacaacctgaacgttaacaaagcgctggtagttcttgaagatggaaacaagaatgttgagatttccgcaaagaatatcccggatgttaaaacagcacatacaaacacaatcaacgtatatgacatcctgaaatacaacacagtaatcgctacgaaagctgttgttgcagcaatcgaggaggtgtacgcataatggcaaacattcagtattatgatgtaatccttaaaccagttgtaactgagaagagcatggagcttatggctgacaagaaatatacattccttgtacacacagaggctacaaaatctcagatcaaagaagctgttgaaaaaatgttcaacggtacaaaagtaaaaagcgtcaacacaatgaaccttgatggtaagaacaaaagacgtggaatgactttcggaaagacagctaagacaaagaaagctgtagtagcactgacagaagacagcgctgatattgaaatctttgaaggtctgtaaaaaataagacattatacggtgcaaacccgtgaaacaaataatcagagcaaacgaaaggagagacagtaatgggaatcaaaacatataacccatatacaccttccagaagacagatgacaggttctgatttctcagagatcacaaagacaactccagagaaatccctcctcgaatccaagaagagaaaagctggccgtaacgcacagggtaaaatcacagtaagacatcgtggcggcggagctaagaagaaatatagaattatcgactttaagagaaagaaagacggaattccggcaacagttgttggaatcgagtatgatccaaatagaagtgctaacatcgcactgatctgctacgcagatggtgagaaagcatacatccttgctccagaaggacttacagacggcatgacagttatgaacggtgctggcgctgaggttagagtaggaaactgccttcctctttcagagattccggttggtacacagatccacaacatcgagctgtacccgggaaaaggtggacagctggttcgttccgctggtaacagcgcacagctgatggcgaaagaaggaaagtacgctacactgagacttccttcaggagaaatgagaatggttccgatcatctgccgcgcatctatcggtgttgtaggaaacggtgatcacaacctgatcaatgttggtaaagcaggacgtaagcgtcacatgggaatcagacctacagttcgtggttccgtaatgaaccctaacgaccatccacacggaggtggagaaggtaagacaagtatcggacgtccaggaccgtgtactccatggggtaaaccggcacttggtcttaagactcgtaagaagaacaaatcttctaacaagctgattgtaagaagaagagatggtaaagcgattaaataatcagattcacaaggaggttagaacctatggctcgctcacttaaaaaaggaccatttgcagacgaaagcttacttaaaaaagtagacgctatgaacgctgcaggtgataaaacagttataaagacatggtcacgccgttctacaatcttcccatcatttgtaggtcatacatttgccgtacatgatggaagaagacatgtgcctgtatatgttacagaggatatggtaggccacaagctcggtgagttcgttgcaacaagaacttacagaggacacggaaaagacgagaagaagtcaaaagttagataattttcatatattttgaaaggagggttcatccatggcaaaaggacatagatcccaaatcaaaagagaaagaaacgagcagagagatacaagaccttcagctaagatttcttacgcaagagtatctgttcagaaggcatgtttcgttcttgatgccatcagaggcaaggatgtacagacagcacttggtattttagcatacaatccaagatatgcttcaagcgttatagagaagttactgaaatcagcaatcgcaaatgctgagaataacaacggtatgagcgttgagaacctctacatcgaggaatgctacgcaaacaaaggaccgacaatgaagagaatcaaacctagagcacagggtagagcttacagaatcgagaagagaatgagccacatcacaatcgtgctcaatgagagataggaggacaatatgggacagaaagttaatcctcatggcctgagagttggcgttatcaaagactgggattccaaatggtacgcagaaaaagatttcgctgacaatctggttgaagaccacgagatcagaaagtttttaaagaagagattatacagcgctggaatctctaagattgaaatcgaaagagcatccgatcgcgttaagatcatcgtttatacagctaagcctggtgtcgtaatcggcaagggtggttccgagatcgaaaaggtgaaagcagagcttgcacagttcacagataagaagctcatcgttgacatcaaagaagttaagagaccggacaaagatgcacagcttgtagctgagaacattgctcagcagcttgagaaccgtatctccttcagacgtgctatgaaatcatgcatgtccagaactatgaaggctggagcactcggagttaagacttccgtatccggacgtcttggcggtgctgatatggctcgtacagagttctacagcgagggaacaattccgctgcagacacttcgtgctgacatcgattatggattcgcagaagctgatacaacttacggaaaagtcggtgtaaaggtttggatttacaaaggcgaagttcttccgactaaagcagataaggaagggagagatagataatgttaatgccaaaaagagtaaaacgtcgtaaacagttccgtggtactatgaaaggtaaggctcttagaggtaataagatttcttacggtgaatttggtatcgtagctatggaaccatgctggattcgttctaaccagatcgaggcagcccgtgttgctatgacacgttacatcaagcgtggtggtaaggtttggatcaaaatcttcccagacaagccgatcacagcaaaaccggctgagactcgtatgggtagtggaaaaggtactgttgagtattgggcagcagtagttaaaccaggccgtgttatgtttgagattgcaggagtaccagaggaaacagctagagaggcacttcgacttgcaatgcataaattaccttgcaaatgcaaaatcgtttctcgcgcagacttagaaggcggtgataacagtgaaaattaatacatttgtaaacgagttaaaaggaaaatccgtagaggaattaaatgaagaattagtagctgctaagaaggaactctttaatctgagattccagaacgcaacaaatcagttggataatacaagcagaatcaaagaagtaagaaagaatatcgctcgtatccagactctgattacagaggctaaaagagcatagtgaaaggagcagcaaccgtggaagagagaaatttaagaaaaacccgtacgggtaaggttgtcagcgacaagatggacaaaacgattgttgttgctgttgaagaccatgtaaaacatccactttacaacaagatcgtaaagagaacttacaagctcaaagctcatgatgagaacaacgagtgtaaagttggagatacagtaaaagttatggaaacaagaccgctgtccaaggacaagagatggagacttgtggaaatcatggagaaagcgaaataattatttgaaggaggtttacctgcatgatacagcaagaaagcagacttaaagtagcagacaacacaggtgcgaaagagttactgtgtatccgtgttcttggcggttctacaagaagatacgccaacatcggagatgtgatcgttgcaactgttaaagatgcaacaccaggcggcgttgttaaaaaaggtgatgtcgttaaagctgttgttgtccgttctgtaaaaggcgctcgtcgtaaagacggttcctatatcagattcgatgaaaatgctgctgttattataaaagacgatttgaacccacgtggaacacgtatttttggaccagtagcaagagagcttagagagaaacactttatgaagatcgtttctctggctccggaagtactgtaaggaggtgcctgagaatgtcaactatgaaaattaaaaaaggtgatatggttaaggttatcgccggaaaagataaagataaagaaggcaaagttattgccgtagataaaaaagacggaagagtcctggttgaaggcgtcaatatgctgacaaagcacacaaagccaagcatggcaaaccagaacggcggaatcgtacatcaggaaggttacattgatgcatcaaacgttatgttacttcataacggaaaagcaacaagagtaggcttcaagatggatggagacaaaaaagttcgttttgctaaggcaacaggcgaagttattgattaattcaaggaaggaggtccaggactttgagtagactgaaagagcagtatcagaatgagatcgttgatgcaatgatcaaaaaatttggatataaaaacatcatggaagtgccgaaacttgacaaggttgtaattaacatgggtgtcggtgaggcaaaagacaatgctaaacttctggagtcagctattgcagacatggagaaaatcgcaggacagaaagcggttgtaacaagagcaaagaattctgtagctaacttcaagatcagagagggtatgccgatcggatgtaaagttactttaagaggagagaaaatgtacgagttcgttgatcgtctgatcaacctctcacttcctcgtgtacgtgacttcagaggagtaaacccgaacgcatttgacggaagaggtaactatgcacttggaatcaaggagcagcttatcttcccggaaatcgagtacgataagattgacaaagtcagaggtatggatgtaatttttgttacaacagccaagactgatgaagaagcacgtgaattattgacacagttcaatatgccattcgcaaagtaaaaaggagagaaattcatggctaaaacatcaatgaaaatcaaacagcagcgtgcaccaaagttctccacaagagaatacagccgttgcagaatttgtggtcgtccgcatgcatatttaagaaaatacggtatctgccgtatctgcttccgcgaactggcttataaaggacagatcccgggtgttaaaaaagcaagctggtaagacgaaagcaactatatactgtgaaataacataggaggaatcacacacatgactatgagcgatccaattgcagatatgcttacaagaatccgtaatgcaaacactgcaaaacatgatacagtagatgtaccggcatcaaagatgaaacttgctatcgcaaacattcttgttgatgaaggatatatcgcaaaatatgaccttgtagaagatggagctttcaagacaattcacatcacactgaaatacggtgctgacaagaacgagaaagttatttccggactgaagagaatctccaaaccgggacttcgtgtttacgctaatacagaggatatcccgaaggtacttggcggactcggaacagcaatcatttctacaaacaaaggtgtagtaacagacaaagaagctagaaaactcggcgtaggcggagaggttctttgcttcgtttggtaggcattgagaacttggcgaggtatttccgagcctagtacgaaagcccatcccgaaacttggcgaggtgttttcgagcctagttgagtggatgattcattataaaaggtacgttctttgagctagcgagactacttgcttagcgaaaagaacttccttataaatgtaactgaaaacagagaagccaacgcagcttctccgagaatctaagttaaggaggataatggtatgtcacgtataggaagactgcctgtagcaattcctgcaggagtaactgtagaagttgctgagaacaatgtagtgactgtaaaaggtcctaagggaactcttacaaaagagcttccagtagaaatggaaatcaaagttgaaggcgaagaagtaatcgttacaagaccgagcgacttaaagaaaatgaaagctcttcatggtctgacaagaacactgatcaacaacatggttgtaggtgtaacagacggatatgagaaagttcttgaggttaacggtgtaggttacagagctgctaaatcaggaaataaactgacactgaaccttggttattcccatccagttgagatgatcgatccagaaggaatcgagactgtacttgagggacagaacaagatcactgttaaaggtatcgataaagaaaaagttggacagtttgcggctgagatcagagataagagaagaccggagccatataagggcaagggaatcaaatatgctgatgaagtaatcagacgtaaagtcggtaagactggtaagaaataaataaggagagtgtgaaaatggttagtaagaaatctagaagcgaagttcgtagaaaaaaacacatgaaattacgcaaccgtttcagcggaacagcgcagagaccgcgtttagctgtattcagaagtaataatcatatgtatgcacagatcatcgacgatactgttggaaatactcttgtttccgcttccactcttcagaaagaagtgaaagcagagctcgagaagactaacgacgttgaagcagcagcataccttggaaaagtaattgccgagagagcaaaagctaaaggtattgatgaagttgtatttgatagaggcggattcatttaccagggtaaaatcaaggcattagcagacgcagcaagagaagctggtctgaatttctaaggaagggagaacacagatgagacaggaacgtattgatgctagtcagatggaattagtagaaaaagtggtatcaatcaagcgtgtaaccaaagttgttaaaggtggtcgtaacttccgtttcacagctttagtagttgttggtgatggaaatggccatgttggtgcaggtttaggaaaagctactgaaattccggaagctattcgtaaaggtaaagaggacgctatgaagaaaatgatcagcgtatctcttgatgaaaactcaagtgtaacacacgatgtgattggtaaattcggaagcgcttccgtacttcttaagaaggctccggaaggtactggtgttatcgccggaggaccggcgcgtgccgtaattgaggcggctggagttaagaacatccgtacaaaatctttaggatccaacaacaaacagaatgttgtacttgctacaatcgaaggacttaaagcagttaagactccggaagatgttgcaagacttcgtggcaaatcaattgaggagatcttaggctaatcaaccgagaagcccgatcaagcgcataggaggtaagattgaaatggcaaatttaaaagttacattagtaaagtctacaatcggcgccgtaccaaagcatagaaaaacagttgaggctcttggacttaagaaactcaacaaaacagttgtattgccagataatgcagctaccagaggtatggtacagcaggttagacatttagttaaagttgaagaagaggcttaattaagataaggaggtaatgtcatggacttatcaaacttaagaccggcagacggttcaaaacagagtgataatttcagaagaggccgtggtcatggttcaggaaacggtaagacagccggaaagggccacaaaggacagaaggctcgttcaggagctacaagacctggtttcgaaggcggtcagatgcctttatacagaagaattcctaagagaggtttcacatgcagaaactctaagacaatcgtaggaatcaatcttagcgcacttgaagtattcgaggatggcgctacagtatccgttgagacattgatcgaaagcggtattgttaagaatccaaaagacggagtaaaaattcttggaaatggagagttaactaagaagcttacagttcaggctaatgcattcagtgcaaaagcagctgagaagattgaagctcttggtggaaaagcagaggtgatctaatgcttaagtccttgcgtaaagcattaagtattgaggatatcagaaagagacttctctatacattggcaatgcttatcgttgttaggttaggatcacagttgcccactccgggagtagatccgacatttattcagaatttttttgcacagcagaccggtgacgtatttaacttttttgaggcgttcaccggcggctcatttacaagaatgtcagtatttgccctgagtatcactccatatatcacatcatctattatcatgcagcttctgacaatagcgattccaaagcttgaagaaatgcagaaagatggtgaagatggaagaaagaaaatcgcagcgattacaagatatgtgacagttggtcttgcactgattgaatctatcgcaatggctgtaggatttggacgtcagggacttctggaagaatataatttcgtaaattgtgcaatcgttgtatgtacgcttacagctggtagtgcatttcttatgtggatcggtgagcgtattactgaaaagggagttggaaacggtatttctatcgtacttctgatcaatattatttcccgtgttccggatgatttcgtgacactgtatacacagttcatgaaaggcaaaacaattgcaaaggcaggacttgctggtgttattatccttgcagttcttctggttgtagttgtgtttgttatcattcttcaggatggtgaaagaagaattgcagttcagtattccaaaaaagtacagggaagaaaaatgtatggcggtcagtcaacatatattccgttgaaggtgaatacagccggagtaatcccggttatcttctcttcttcactgatgcagacaccaatcgtgattgcacagttccttggaaaaggaaatggaactggaattggaagtaagatccttgcaggtttaaactccaataactggtgtgatccagagaatccgatttattcagtcggacttgtggtttacattttacttacaatattctttgcatatttctatacatcgattactttcaatccgatggagattgcaaataatatgaaaaagagcggtggatttatccctggaattcgtccgggcaaaccaacagttgactaccttacaaagattttgaattatatcatctttgttggtgcgtgtggtttgatcatcgtacaggtgattccatatttcttcaatggtgttttcggtgcaaacgtttcctttggtggaacatcacttatcattattgtaggtgttgtacttgaaacaattaagaagattgaatcacagatgcttgtaagaaattacacaggatttttaaataataagagataacagttattgatattgttttctattaaacgtcttttagctcgctttgttctgtcctcaattgcaggacgaacagagcgggttaaacttgtataaggaggataaagatatgaaactcatcatgttaggagccccaggagcaggaaaaggaacacaggcaaagaagattgctgagaagtattctattccgcatatttctactggagatatctttagagcaaacatcaagaacggaacagaacttggtaagaaagcaaaaactttcatggatcagggtcttctggttccggatgaactggttgttgatctcgttgtagacagagtaaaccaggaagattgtaagaatggatatgtacttgatggattcccgcgtacaattccacaggcagaggcacttgatcgtgcacttgctgagatgggacagaagattgattatgcgatcgatgttgaagttccagatgagaatattgtaaaccgtatgtctggaagaagagcttgtgttgattgtggtgctacttatcatatcgtatatgctccgactgcaaaagaaggcatctgcgacaagtgtggcggagagcttatcttgagagacgatgataaaccagagacagttcttaagagacttggtgtttatcatgagcagacacagccgctgatcgattattatacagaagcaggagtactcagagaagttgatggtacaatcgatatcaacgatgtatttgctgcaatcgttcagattcttggagagtaagttttgttgatttcattcaggaggattaaaaatgtcaaaaactgacgtgattgaaattgaaggagttgtagttgagaaacttcctaacgcaatgttcaaagtagaacttgagaatggtcatattgtactggcacatatcagcggtaagctgcgtatgaacttcatcaagattctgccgggagataaggttacacttgagatgtcaccttatgacctgagcaaaggaagaattgtctggagagacaagtaagaattctacacatcaaataacgggaatgctgttgtttacaacgttccgtatctgaaaagataaaaagatattattttctgaaaagcatttttagaaaataatatcttttttaatttaggtcttgactttaccatatgttttgtggtaaagtatgaaatggtcatttttggagaggtgtgtccaaaaataccggaatatataggcagagcaaagtagggaaggaggatttgacatgaaggttagatcatcagttaaaccaatttgtgaaaaatgcaaaattattagaagaaaaggtagtatcagagtaatctgtgagaacccgaaacacaaacagcgccagggctaaggcattgaacacttgatgagtgcaagcgtaagcgtagcacgaatttagtgagaaagtctatcaggagacttggtgaggtattatcgaacctagtcgagtgatgctactgatgttttgtgcaattatcaagcggctgacagcatgacacgccaggaggtgtgtggagctgtttaatatacagtaaggatacatcgcatctgtccgcaggtaccgacagagcatgtagtctgggcatctgacagacgtttgtcatctttatattaaagagggaagatgctattgtatattgcttataatacccggcatttgcattggcggatgagagtatgatccgtgccgggaaagggtatgtagtttccgtacatacctgggctgggatatcggaaggatacattccggtaggatgcagcagtaaatgagttacaccagacttcatttataaaaagaagagactcatttcgcattcgcagcctcaattagggacaattaacaagaaaaccagaaaagaaaatggaggaaagacacatggctcgtattgcaggtgtagacttaccaagagacaaacgtgtagaaatcggtcttacttatatctacggaatcggtagaacaagtgcagaacgtatcttaaaggatgcaggagttaatcctgacactcgtgtaagagatcttacaagtgaagaagtaaagaagatcagcgcagtgatcgatgagactcaggttgtagaaggtgatcttagaagagagattcagctcaacatcaagagacttaaagagattggatgctaccgtggaatccgtcatagaaaaggacttccggtacgtggacagaaaactaagactaatgcaagaacatgcaaaggtcctaagagaactgtagcaaataagaagaaataatatcgtataaaataaagaaagtaggttagtttaaatggctaagagagttgcgaaaaaagtaacaaaaaaacgtgtcaagaaaaacgttgaacgcggacaggcacatattcagtcatcattcaacaatacaattgttacactgactgacgctcagggaaatgctctttcatgggcaagtgcaggcggtctgggatttagaggttcaagaaaatctactccatatgcagcacagatggcagctgagacagcagctaaagcagcattagtacatggtcttaagacagtagatgtattcgtaaaaggaccgggatcaggaagagaagcagcaatccgtgcacttcaggcatgcggaattgatgtagtaagcatcaaggacgtaacaccggtaccgcacaacggatgtcgtccaccgaaacgcagaagagtgtaattatactctgctgtataagaaaagcagttatttaatagtaaatgttgacgcagcggcatgagtaccgctggcatgtataatattaggaggatagaaatggcagtaaatagagttcctgttcttaaaagatgccgttcattaggaatggatccgatttacctcggaatcaataagaaatctaacagacagttaaaaagagcaaacagaaagatgagcgagtatggtcttcagcttcgcgagaaacagaaagcaaaattcatctacggtgttcttgaaaaacctttcagaaactactatgcaaaggcaaaacagcaggaaggaatgacaggtgaaaaccttatgatcatccttgagtcaagacttgacaacgttgttttccgtcttggacttgctagaacaagaaaagaagctagacagatcgttgatcataagcacgttcttgtaaacggcaaacaggttaacatcccatcttaccttgtaaaggctggagatgttattgaaatcaaagagaacaaaaaaggttcacagagatacaaagagattcttgaagctacagctggaaacatggtaccagagtggcttgaggcagacgctgagaatcttagaggtacagtaaaagagcttcctaacagagaagcaatcgatgtaccggttgacgagatgcttatcgtcgagctgtattctaaataataattacgatttgaaaggattgcgcaggcatttatgcagggcaatcctaactaatctgaataagttgattagatacagttttgtaccccctcaacatatattaagcccataaggagggtctgtgtagtgtttgattttaataaaccgaatattgaaattacagatgtttcagatgacaagaaatacggaagatttgtcgtagaaccgctggagagaggatacggaactacgcttggtaacgcgctgagaagaattatgctttcttccctgccgggagcagcaatcagttctgtgaaaatcgacggtgtactgcacgagttcagttccatcccgggtgttaaagaagatgtgacagagatcatcatgaacttgaaatctctggctatcaagaacacatctgagtctgatgaagtgaagacagcttatatcgagttcgaaggagaaggcgttgtaacaggtgctgatatccagtgtgactctgatattgagattgtaaacccggagcaggtaattgctacattaagcggtggcaaagacagcaagctttatatggaacttacaatcacaaaaggaagaggatatgtaagctcagataagaataagacagaagatatgccaatcggtgttcttccgatcgattctatctacacaccgatcgatcgtgttaacctgacagttcaggatacacgtgtaggtcaggttacagattatgacaaactgacacttgatgtctggacaaaaggtacaatggctcctgatgaggctgttagccttgcagcaaaagtgttaagtgagcatctgaaactcttcatcgacctgtcagaggtagctcagcaggcagaagttatgattgagaaagaggatgacgagaaagaaaaagttcttgagatgagcattgatgaacttgagctttctgttcgttcttacaattgtctgaagagagccggaatcaacacagttgaagagctcacaaacaagactccggaagacatgatgaaggttcgtaaccttggtcgtaagtctctcgaagaagttcttgcaaaactgaaagaactcaatctggaactgaaccacggagaagaataatattctatatccgtactatgataaattatcaggacacttatgtcctgcacaggctgtgattacagttttgtgaattgcagcccgctgaagattgaatatcctggtggtaagcccgaagagcacagcaggagcatttgattagtaagcccgaagatgcataaccaaatgttaattaatggaggaaatttgaaatggcaaagtatagaaaacttggcagaacagcaagccagagaaaagctttacttagaaaccaggtaacagcacttcttaacaacggaaagatcgttacaacagaagctaaggcaaaagagatccgtaagcaggcagaaagcctgatcgctcttgctgtaaaagagaaagataacttcgaagaagttacagtaatggctaaagtagcacgtaaagatgctgatggcaaacgtgtgaaagaagttgttgacggtaagaaagttactgtttatgacgaagttgagaagacaatcaaaaaagataagccaagcagactgcacgctagacgtcagatgctgaaagttctcttccctgttaaagaaggcgagaagagaaacatgaaagatgttgacatggttgcaaaactctttgatgagatcgctccaaaatatgctgatcgtaacggtggttacacaagaatcgtaaagattggtcagcgtaaaggtgacgcagctatggaagttctgatcgagcttgtttaatttgataatatagctgatttttgactctcatataggacagaaatgtcctgtatgggagttttttgcatattagtaaagtgtttttcatagttaaaaatgtcaagtgaaaatttgcttttgtgaaaactgcacaaatgatgttaaaaaaataacgttaaaactttaacaactggtacattgacaattaattaacgaactagtatactaatacctgtaatcgggaaacataaaaataacccgatcggataaaacttgcaggttacgaaaacagtgactataaaaatgatttattcaagtacaggaggaatactcagatggcaaagaaagaggcggcaaaaactgtagagacaaagacagtaaacaccggattcattgataacgttgaagctcttgaagcaaaaatgaaagagatgcgcgaggcacagaaaatcttcgctacatttacacaggagcaggttgacaaaatcttctatgaagcagctatggcagcaaacaagcagcgtatcccgcttgcaagacttgcagtagaagagactcagagaggtattctcgaggataaggttatcaaaaaccattacgcagcagagtatatttacaacgcatacaaagatacaaagacatgtggtgttgtagaagaagataaggcatttggaatcaaaaagatcgcagagccaatcggacttgttgcagcagttatccctacaacaaacccgacatcaacagcaattttcaaaacactgatctgcttaaagacaagaaatgcaatcatcatcagcccacatccggctgctaaagcatctacaatcgcagcagctaaagttgttcttgatgcagcagtgaaagcaggagctccggaaggaatcatcggttggatcgatgccccatcactggaacttacaaacacagtaatgagagatgcagatatcatccttgcaacaggtggtcctggaatggttaaagcagcttactcttcaggaaagccggcactcggagttggagctggtaacacaccggttatcatcgacgatacagcagatgtaagaatggcagttaactcaatcatccactctaagacatttgataatggtatgatctgtgcgtctgagcagtctgtaacagtacttgaaagcgtatatgaggaagttaagaaagaattccagtacagaggatgctacttcctgaaaccaggtgaggagcttgacaaagttcgtaagacaatcatcatcaacggtgcactgaacagcaagatcccaggaaaatcagcttatgaaatcgctcagatggcaggcgttgatgtaccgaagaatacaaaaatcctgatcggagaagttgaatctgtagatatttcagaagaatttgcacatgagaaattatcaccggtacttggtatgtacaaagctaaaacatttgatgaggctcttgagaaagcagctcagcttgtagcagacggtggatatggacatacatcttcactctacgtacatccggcagagacagagaagattgcaaaacatgcagcagcaatgaagacttgccgtgtactgatcaacacaccttcttctcacggtggaatcggagacctttataacttcaagatggctccgtcccttacacttggatgtggatcatggggtggaaactctgtatcagagaacgtaggagtaaaacatctgcttaacatcaagacagttgcagagaggagagaaaatatgctgtggttcagaacacctgagaaagtttacttcaagaaaggttctatgccggttgcactggatgagcttggaacagtaatgcataagaagaaagcatttatcgtaacagactccttcctttacaagaacggatatgtaaaaccgatcgaagataaattagatgaaatgggaatccagcatacatgcttcttcgaagtagcaccagacccgacacttcagtgtgcacgcaagggtgttgaccagatgagacagttcgagccagatacaatcatcgctcttggtggtggatctgcaatggacgcaggtaagatcatgtggatcatgtatgagcatccggaagcaaacttcgaagatatggctatggacttcatggacatccgtaagagagtatttacattccctaagatgggagagaaagcttacttcatagctatcccaacatcttcaggaacaggttctgaggtaacaccattcgcaatcatcacagacgctgacacaggtgttaaatggccaatcgctgactacgctctgcttccaaacatggcaatcgtagacgtagacaacatgatgacacagccgaagggactgacaagtgcttcaggtatcgacgttatgacacatgcaatcgaggcatatgtatctatcatggcaacagattacacagatggtctggctatgaaggctgttaagcttgtattcgagaaccttccatctgcatacgagaacggagcaaacgatccgaaggctcgtgaagagatggcaaacgcttcctgtatggctggtatggcattcgcaaatgcattccttggtgttaaccactccatggctcataagcttggtgctttccaccacctgccacacggtgttgctaacgcagtaatccttacagaggttatgagatacaatgcagcagaagttccgacaaagatgggaacattctcacagtatcagtacccacatgcacttgcaagatacgcagaactcggacgcttcgcaggatgcacaggtaaagatgataaagaagtatttgagaacttcatcgctaaacttgaagaactcaaagagaagatcggaatcaagaagacaatcaaagattacggcattgatgagaagtacttccttgacacacttgatgaaatgtcagagcaggcattcaacgatcagtgtacaggagctaacccaagatacccactcatccaggagatcaaagatctgtacctgaaatgctactacggaaaataaatcgcattgcataagcaggcatatgaccgttagaatctaaaatatacgaagagagacagaatgatgttgaaaagcattgttctgtctcttttttacgtgagcaacgagccaaagtctgtgcttgcacaagaccttggcgactgccgcgataacttggaaaatacagtttttgagttttccaagtatacgtgagcaacgagccaaagctatgattgttaataaatagacaatatataagagacaaaaaatcttgttaaaaactgcacaaacttgctctaaaggggttttatttctaaaaattgtgagatataatgacatcatcaaaacaaagtaagagccgtaaggcaaaaggaacagcccagcagagctgagataaaataagagcagacaagaaggggcgttcaagatataaggaggtctatattatgaagttagaagaaaaaaatctcatcgtgaaacgtgcttacaaatcagtctataaatgtgatgattgtatcgtgaaagtttttaatgaaggacatccgaagtcagatgtatttaatgaggctctgaatactgcaagagtagaagagacaggtctggacattccgaaggtaaaagaagtaattcagattgatggaaagtgggcaattgctattgagtacaaagcaggtaagacacttgaggacatgatggaatctgatatgaagaatctggaaaaatatatggaagactttgttgatctccagttacaggttcagagtaagaaatcaccgcttctgaaaggaatgaaagataaattagctcgtcagatcaatggattgaaagatcttgatgcgactacacgttatgaacttctgacaagacttgagagtatgccaaagcataataaagtatgtcacggagactttaatccgagtaatgtgatcgtaggaaagaatggaaagatgactgtggttgactgggctcatgcaacacagggaaatgcaagtgcagatgcagcaatgacatatttgcttttcgcactgaaagatcagaaagtagcagatctctatctgaaattgttctgcaagaagagcgatacagcaatgcagtatgtacagcagtggcttccgattgtggcagcagcacagttatctaaagaaaatgaacttgaaaaagattttctgatgagatggattgatgttgttgattatcagtagaaaatagagttgtttctaaaaaagaagcgctggaagatgaaaatgaaatcttccggcgcttcttaatcttctttttattattttaccaacttgtaaagaaaacgttatcgccaattacaacaccggttctgcttgtcgatggtgcgtacaggaagtaataacagtcggctacggcagcaagacgagctccgttgatcgcatcctgtgcaacctggatagaaagacttcgtggaccttgctttaatacacggtctaaggaacctgtccatacaggagcaaactgtccttgggcatagatgacatcatgaatagaattcggaaagcgactgctatatacacgattcataatgactgtagcaactgcaagcatagagtcgtaatcatagtgggcctcacattgcaggattgctgcaagaagtgtaaggtcatcagacgcaatggcagatccggaactattggagccaccagaagaacttgaacttccggaggatgaggaacctgaattgccggagttcccagaggaactggaagtattcgctttgttcgcactggcagcagcctcagcttttgcagctgcttcggcttttgcagcggcttccgcctgtttcctggcttcttctgcctgacgagctgcctcttcttctttggctttctgcagttttgcattcacttcattcaaattagtagaagttgcagcagcttttgcctgtaattgtgtctgctgtgtctgcaattggttctgtaaatctttcatggaagcctgctgtgcttccaggtctgctttctgatcggcaatctgctggtgaacatctttcagattgttcagagctttgcggtcgtagttacttaaattttcaataaaatcagctttgtttagaaaatctgacatattttctgctgagaaaagcatctcaagcattgtagcacttccgtgctcatacatatatttgatacggcttttcatatcttcatactgctgatcttcgtttttctgcgctttctcaagatcatcctgtgttttgtctatatcactgttgaggatctcaacctgcatctcagtatcagatatcttctcactcagggtgaggatatcctggttgatgccttttaattcgttctcaagggcagaggtctggttttgcagattgtctatcgtgtctgtagcatagacaggaagtgcagaaaatacaattgcaagggaacaaatgagcgcggtgcccgtatgtagcttgctttttttgtaaaatgccataatctcaatatcctttctttaaatgacattgcatagttgtcgaaaacctattatactataaaacagagaattaatcaaatttgcgcgaaacattttatgattgttttacaaaatgattaaaaagatgttactttttgtaacaattgacggatagaaaatacagaagataaggaaaaaagtatggaaaaaaaggaaattaagattgttggattagacctcgatggaacacttcttacagataagaaggaacttcttccttatacgaagaatgtaatcggagaggcactgcagaatggtacagttgttcttgttgcaaccggaagaccatggacaggagttccggaagaattacgtgagcttacggggatggattatgcactgactgcgaatggggcaaggattattgagacgagaaccggaaaggtactggaagaacatctgttatccaaagaagcagcaaaaaaagcaattgcaatcggaagaaaatatgatactctgttggaagtttattttgatgggcagggatatgctcagaaagatgagatcgcgcaggtgagaaagtatcataagaatccgaacatgtgggattattttctgagaacacgaatagcggtagacagactggaagatctgctggatgaaaaagaagggaatcttgataaagtacagatgttgtttgcagatatggaagagagagaagaggcatggaaagagctggagcgagaaggcgtctttgaactggttggctctcttcaatataatatagaaatcaacgcagttggtgtaaataaaggaaccggacttgtgaatcttggcaagatgcttggaatcaggcgggaagagatcatggcgtgtggggatggcgataatgatatcgcaatgctcaaggaagttggatttggggttgccatggcgaatgccgaagaaaaggtcaaagctgtagctgattatattacggagagcaacaatgatgagggggctgcaaaggccatcgagaagtttgttctgaaacgaggaggggaatcatgttagaagtattaaaggttatcattttaggaattgtgcagggaatcacagagtggcttccaatcagtagtacaggtcatctgattctggtagagcagctgatccaactgaagcagaacgaggcatttacgaatatgttcaatgtggtgattcagtttggatcgatcctggcagttgtagtaatttattttcataagttaaatccgttctcaccgacgaagacggaaaagcagaagaagatgacaattcagttatggattaaagtagtgatcggaacaattccggcactgatcggaggagtgttgctgaacgatctgattgaatcaaaactgagtaatgcatatgttgttgcattgatgttgattgtttatggtattttattcattgtaattgaaaaacgtaatgagacaagagaaccgaaagtaaaaagactctctcagctttctgtgaagacagttcttctgatcggagttttccagatgatggcgatgattcctgggacgtccagatccggcgcaacgattgtcggagcactggcacttggggtttcaagaagtgttgcagcagagtttacatttttccttgcaattccggttatgtttggagcaagtgcactgaagttgtttaagttcggtctggcatttaccccaatgcaggtatttctgcttcttcttggaatgatcgtatcctttgcagtatctgttatagcaatcaagttcctgatgaaatatatcaagaaccatgactttaaggcatttggatattacagaatcgtacttggaatcgttgtatttttattcttcggtatccaggctttattcaaataaggtatgtattattgaatagagtgcagtgtgttttactgttcacagttattgtgaacagtaaaattttgtatttccaaaagaaatcgtgcataattacgtcttgcattttatgaaaagcatgttataattattaacatgttttgaatttttatgcagagaaaagaggaggcgcttaatatgaagaagtttttatcagtatttcttactgcagcattagcagtcagcatgctggcaggttgtggtagtaagaacgaaacagtaacagcaaaggtaatcgatattgatcttacagatgaagaatatgcatttggtgtggacaagaatcagccggaacttcttgagaagacaaatgagtttattgcaaagatcaaatcagatggaacacttgatgagatctgcaaaaagtatttctcagacggagagccggaagcagtaaaatcagcaacacttgatacatctaaggatcagttggttgtagctacaaatgcagcattcgagccatttgagtatacaaagggtgaagattattatggaatcgacatggagattgcaaagcttcttgctgatgaacttggaaaagagcttgtaattgagaacatggattttgatgcagtttgtctgtctgtaagccagcagaaatgtgatattgctatggcaggacttacaatcaatgaagagagagaagaatatgttacatttacagattcttactattcagcatcccagcgtttgatcgttccaagcaatgttacaacattcgatgattgcaagacagcagatgacgttgcagctaagcttgctgagacaaaatcatctgaccagatcggtgttcagcagggaacaacaggtcagtactatgttgaaggaagcgaagattgggacttcccgggacttccggcaaaatgtgtgacatacaagagcggatcacttgcagtacaggatatgctcaatggaaatattcagtatgtgatcattgatgcagcaccggcagcagcaatcacagatgcaatcaacgcggttcagtaagagtatttactaagaatttacaggcagtaaaataacagaatttattaacgagggaaatacaggcagaagatgatgcatgcattttcctctttttggagaaaggaaacaaatggggaattttagtcagaaagtagacaaatttattgatatatttctgaatcagaatggctatgtgaaagtagttcagggactgcacaatactttgctgatcgcaatctgcggtctgattatcggtattgtgatcggtactttgatcgctacagtccgtgtgattccgaaatataaaactcttccgagagtattgaatcatatttgcagcttttacgttgcattattcagaggaactcctatggtagttcagctccttatcttttattatgtactccttccaatttttggggtgaagattaccggagtacaggtttctatggttgtatttggtctgaatagtggtgcatatatttcagagatcatgcgaagcggaatccagtctgtcgatccgggacagatggaagccggaagagcagtcggactcagttttggaacaagtatgatgaagattgtgattccgcaggctgtaaagaacattcttccgacacttggaaatgagttcatttctcttattaaagagacttccgtagtaagttttgttggcgcagctgacctttatgttgcatttaactatatcggaagtaacagctacgaattcatggtaccgtaccttgtaatggcgttaatctacattgcacttgtgcttgtgatcacattacttgttaaattattagaaaggagcctgaagaagagtgatagacgtaattaatctgcaaaaaagctttggggacaaagagattctgaagggaatcaatgttacgatcaataaaggcgatatcgttgcggtactcggaccatccggctccggtaaaagtacatttttgcgatgcctgaactgtatggaagacccgacaggcggaagcattatctttaatggtgttgatatcgcagatatgaaggttgatattaatcagcatcgccgccatatgggaatggttttccagcatttcaatctttataataataagacagttcttcagaatgtcatgatggcacctgcatatctaagatgtaaggacattgataaggcaaagaaaaagaatcgtatgatcaaatttaaaaatatgttccgtggaagtgacaagaaggaagaactgattccgatcactgagacaaaggagcagatcaagaaagaagtaaaggagcaggcaatggctcttttgaagagaatcggattggaagataaagcggatgtgtatccgtctacactttccggcggacagaaacagcgtgtcgcgattatccgttccatggctatgaatcctgacgtaattctttttgatgagccgacttcagcacttgacccggaaatggtaggagaagtacttgaactgatgaaagatctggcaaaagagggaatgacaatggttgttgttactcatgagatgggatttgcccgtgaggttgcttcaagagttcttttcattgatgacggtcagattaaggaagaagctgccccggcagaattctttgaacatccgaaagatccaagacttcaggagttcctttcaaagatcctgtaaaagaaaatgcgtagcattttggaggttggttctgaacagttacgaaaaaatatttaatttttaatctatagaatatctgtttggtattgtgttacaatattgaacagatatttttatatataaggaaatggtattgaatgaaatgtgatggaaagaaaaaatacgaagcagatgatttggcatgtgagaggctgcaagaaacagtagaaccacttgttgaatggtttcgggagaatcagagagatcttccgtggcggaagcatgtgaatgcgtatcgggtctggatttcagagattatgctgcagcagacgagagtggaagcagttaaatcttattacacacgattcctggaagaactgccggatatcaaagcgctggctgaagtgccggaagacagactgcttaagctgtgggaaggacttggctactacaacagggcgaggaatttaaaggcagcagcacaacaggtaatggaagaatataatggtgtattcccggatacatttgaagagataaaaaagttgaagggaattggcagttatacagccggtgcgatcagctcttttgtttatcatcagcagaaaccagcggtagatggcaatgtttttcgggtggttacaagaattctggaagatagtgatgacattatgaaagcaagtacaaggacaaagatagaacgtatgcttgaacaggtgattccggcagaggcaccgggagattttaatcaaggattgatcgaacttggggcaatcgtctgtctgccaaatggagaaccaaggtgtgagagctgtccgataagggaattttgtcttgcataccaggatgaatgtcagatggactatccggtcaagaaaaaggcgaaagagcgaagaatcgagaaaagaacgattctaagattctgtgataatgaggaaattgcgattcgcaaaaggccgggaaaaggactccttgcaggattgtatgaatttcctaatgtagagggacatttaacacaaaaagaagttatagaatatgcaaaagagtcaggtcttacgccggtgcgcgtgaagaagctgccaaaggcgaagcacattttcagtcatgtggaatggcatatgaccggatatgagattttggtggatgagttggaaaaagaatttcagaatcctgagatcatatttgcaggaaagaaggacctggagaaaaattatgcaattccgagtgcattttctgcatatctataaatgaagaggatgagaatactgtggtagctgaaaaatctggaaaataaaaatagaacgcttaaaatagagtccactctgttttattgaaaaaaagggcgaaatatgttataatatctcttatagtttaaaatgcatacgggagagttttagcagaaatgagtacaaaaacagaattatcgaagcagcagaaaaaatcacaggaaacaaaggaaaaaatctttcaggcagcgaagaagattcttcagaagagcggatatgaaaaattgtcaatcaagaatatctgtgaagaagcaggcgtgtcgaacggaagtttctatcatcactttaagacaaaagatgatttgctgtcttattatatagaagaccagcctacgatgggaccggatctgttggagacaccgaaaagtctagaagatgtaaaggacggaattgtccgtgtttatttgaattatgtagcttattgccgtgagcttggtgtagaatttatggcagggtattatgatacaaagaatcaggcattgaatccggcgataagaacagaacgtccatatccgatcgtgacagtacaggcttatgtagagcaggctgcgaaggatgggattattaacattagagagagtattgacgaatttacaacagatatccggatgatcgtgatcggaaatgtatttgaatggtgtctgagagagggaaatgctgatttcgagggcaacatgagtcgttctttaaggcggtatctggacagtacactggaggaaggttgatgatttatcactttattgtgaatccgcgggctcgttcagggcttggcgagatgctgtggaaacagttggaacctgagttgtgcagaaaaagaatcgattatcagattcatctgacaacaaagaaaaaggatgcaggaaagattgcatcagagattacggaagatggccaggagcacatgtttgttgttcttggaggcgacggtacactcaatgaagtactaagtggaattaaatcactggagaaagtgacgttgggatatattccgattggatcaagcaatgattttgcaagaggaacaggaatcccgggagatccttttgaagcattggacacaattctttcacccaaaagggttgaaaagatggatataggtgtgctaaaaagggaagggaaaggaagaagatttgcagtgagtgccggtattggatttgatgctgcagtttgtcatgaagtatgtgtttcaaaatggaaacgtgtattgaaccttctgaaaatcggtaagctgagttatgcggttgtggcaatggatcgtattataaaggatcggccggtgaaacttgaactgacactggatgatggaagcatgaaagtgtttgagaggacttattttgcagcatttatgaatcttccttatgaaggaggaggctttaagttttgtccggacgcttccggaagtgatggatttcttgatattatggttgtgtcggatctgtcgaagctcaagattctgtgtctgcttccgaccgctttttcaggaaagcatacaagatttaaaggggtgacgatattaaaatgtcgtagtgtaaaggtagtgacagatcgtgcactgccgttacatacagatggagaaccttcctttttatcaaaagagatagaagtctcactggaaaaagaaaaacttaatgtgatcgttgaatagaagaaaggtgatgaaacaggatgcatatagggattgttttagcgattgggttatgtattgtaataggaataccagctttcttaatttttttgctggctccaagactgtcgggcagaaaaagagtgcatccgtttcttggcgtaaagtgggcgcatagaggacttcatgataagaagcgtgggattccggaaaattcatttccggcatttcgtgcggcaatcgaagccggagatggaatagaactggatgttcatctgacaaaggatggacagttggtggtttttcatgatgatacatttgaaagaatctgtggaagacggggcagagtggaagatacttcatatgaagagatgcagaagtacagacttgcggagacaaaagagcggattccactattgtcagaagtactgcagttggtagatggaaaggtaccacttctgatcgaggtgaaacttcctaacacagatacaaagatttgcagaaaattggatgaagaactgcgaaaatatcatggcgaatacatgatccaatcctttaacagcctggtacttcgctggatgaagaaacatcggaatgaaatcccaagaggacaattatctgagaatctgacgaaaaacgacagaacaacgcattatctcttgagattttgtgtaaaatatcttttgagtaactgtatgtgcagaccggattttatttcttaccggtggtcggacagaaagaatccgggattatggctgaacagggttctctttaaaacgccggtagcggcatggacactgcatggagaaaaagatgttaaggcggcaagaagaagcttcgatatgtatatttttgagatgagttaaagaagagcaaatctgatttctattgaaagtgctgatttaaaaagtaaaggtgaacaaaagaagagacagatgttgataattcataagaaaaagaaaagaaatgttaaaaacttatgaagtcggttgagattgtgttttaaaagtgctataatcgagcctatcaaaaaagagcgttaaatgaaaatagcgcagaagtagcaagtgctgtatcggtttgatgaaaagcggaggagtgtcagatatgaaatggaagacaaagttcatagagacaatgaaaagatataagcatgcatgggtgtttttatacgcgttaatctatatgccgtggttttgttttcttgagaaacatgtgacgatgaattatcatgtggtgcagacagcattagatgaagagattccttttattgaatattttattgtaccgtatatgttatggtttgtatttattgcagctacatttttatactttttctttacagatgtacagggattttacaaactggcgaagatttcgtttgcaggaatgacaattttccttattatttgttccgtatttccgaatggtcaggatttacgaccggttgtgtttgagcgggataatatttttgtagatgcagttcgaatgctgtatcggacagatacttgtacgaatgtatttccaagtcttcatgtgtttaatactctgtgcgcatgtattgcaatccataagagtcaggcacttaagaaacacaaagctgtttgtattggagcatatgtgcttggagcgttgatcataatggcgactatgttcttgaagcagcattctgtacttgatgtgacaggagcatttattatggcttatctgttgtatcagtgggtatatgcagaagagacgaagaaagttccgggatattcaaagcgtccggtatttcagaataagtaagagttagaaaaagaattacaggaagtgcttttggctgatgaggtcaagggcacttttttgtatattaggaaagtcctttcctaatatacagaagtttctatagaaaagcatctggggaaatgttataataaaagccagtgaattactgtgggcagattagcctgacagttacgaataaagtattacatgagatttaggaggactagagcatgaagaaggttatgcttactggtgacagaccgacaggaagattacacgtaggacattatgtgggttccctgcgtcgtcgtgttgaattacagaatacaggagattttgatgacatttttattatgatcgcagatgcacaggcattgactgataatgctgataacccggaaaaggtacgtcagaatattatcgaagtagcattagactacatggcttgtggattggatccggagaagtctactctgtttatccagtcacaggtaccggaactgacagagttatcattctattacatgaatcttgtgacagtctcaagactgcagagaaatcctactgtaaagaatgagattaagatgagaaactttgaggcaagtatcccggttggattcttcacatatccgattagccaggcagcagatattacagcattcaaggctactgttgtaccggtaggagaagatcagcttccaatgcttgagcagacaaaggagattgtacacaaatttaattccgtttatggagatacactgatcgatccgaagattcttcttccggagaatgaagcatgccttcgtctcccgggaattgatggtaaggcgaagatgagtaagtctctgggcaactgtatttatctgtcagaggaatctgaagatattaagaagaaagtattcagcatgtttactgatccgaatcatatccgtgtggaagatccgggaagtctggaaggaaatactgtattcacatatctggatgcattctgtaaaccagagtattttgcggaattcctgccagaatatcagaatctggatgagctgaaagcacattatcagagaggcggacttggagatatgaaagtgaagagattcctgaacaatgttcttcaggcagaactggagccaatccgcaacagaagaaaagaacttcagaaagacattcctgcaatctacgagattcttaaaaagggaagcgagaaggcagaggctgttgcagcacagacattgaaagaagtaaaagatgctatgaagatcaattattttgatgataaggcactgattgaggcgcaggcagagagattttcaaaatagagtgttgttggaacagttagaatggaattttaaatgatatcaggacaggcggtgcagatttgagtttgcttacagtgaacttggatctggcaccgcctttgcttggtttggggtaaatttttgggcgtctgttcggagaggatcctttgaagtgagattttccaaagatacaaaaagactgtaaggaaatttccttacagtctctatagcgtgcgatagaagattcgaactcccggccttctgatccgtagtcagacgctctatccagctgagctaatcgcacattttgttgtttgctctgttgtatcgctcacaacaaaaaagattatataacggatattggaaaatgtcaacactaattttgaaattttttcaaaaaaatttgaagcggattttagaagctattttcaatctatcttttgtgcgctaccgagtgttattcttcaataatctgaatctccagatagtcaaagtcaatctcatcgacaaaattgtcctgatagaaacgcgctttggcgtggcgcttgaactcattgatcgttgagtcaagccagatcggcttgctcagatcaaattcatagcaaatcttgtcgagtgcatgaaagatcttatgtgtacgtgtgtcgtctgtctcatcgcagataacagtatcgcaaagcatgcggttgtctttaaattcttttccccataaacgaaacataatagactcctttccggcagcagaagaaactatctgatcttctgaaaatacctgtctcttgtatcctaacataagaaaaacaaaaagtcatttcttttttagagactttttggtatagtggaacggtaatgttactgttcactcccgtgtcaatcactccgctgattgacacggaggatgcgtgaggaacttgatgcggcaattcaggatctgagatcctatctcagcgtagagcggatcagcagtatgatagagaaatatcgcacagtgacgcagaagtatttgtatcagatgccggaccggatgaatgcaccgctgactgaagctcaatatgatacagttgcatcggcgatcccttccgaggtggaacaaaattatgagctctataaggagagtctggaaaaaccaatgccattctttattggagtaccggtaattgaggggaataccttgaagctgaactgggatgcatcctatgattttgatgcggagacgattacttatacagttgaattggcgaaagattatcagtttaatgagattgtatttcggcaggataatattcaaattccggaagcggagactacagttccggcagatggtcagtattttgtgcgtatccgtgcgacaaatacatctggacagacgcaggatgcttttgattattatgtaacagacgctggaaagaattatggtatgaaatgtttctacattacaggcggacaaaatgttgaggaagatatttatgaagaatgatttatcaaaagaacgcttccgtaatgaatggaaatatctgatcagtaccagtgaaaaagaactgctggagctgaggatgaagcatttgttgaaaaaagatccaaatgcaaaggaaaatggttatatgatccgcagtctctattttgaagattatttcaacagtgcttatgcggaaaaggaatcgggtgtcctaatgcgaaaaaaatatagaatccgtatttatgattgtagtgaccgttcgatcaaactggagcggaagaagaaattcggaagttatatttataaagaaagcgctccgctgacaaaagaagaattctacaggattcttgatggggattatcaatttttattaaagagtccctatccattgtgtagagaattttatgtggaatgtgtcagcaatctcatgcgtccacgtacgatcgttgactatgaccgtgtaccgtggatcatggatgaggggacagtcaggattacatttgacagtgatgtgagggcagcggtcggaagttatgacatctttgatccgtcccttccgacacttccggtgcttgaaccggggaaactggttatggaagtgaaattcacagagatgcttccacagatcgtgcgtgacttgcttccaccaaatgcacaagaattcacagcagtatcaaaatatgtactctgttatgaaaaatcgcagtatttgcatggatttgaatattggaatgaaacacaggagagaaaactattatgagtgtacaagatatgattaaaaagtcggtgctggaatccggcgtgtttgacagctttaatgcaccgaagatggcaatttcgctgatcgtggcgttgcttctcggagcagtgatctatatggtttacagcaagttttatgtaggggtgatcttctctcggagctttgcggttacgttggtcggcatgacacttctcacttgcatggttactctggcgatcagtacgaatatcgtgatttcccttggtatggtcggtgcattgtctatcgtacgtttccgtacagcggtgaaggatccgatggatctgctctatcttttctgggcgatcactacaggaatcacaaccggagcaggaatgtatgtgctggctctgatcgcggcagtagtgatgatcgcgatgatctttctgttctatcataagcagcagaagggcaggatctatatcgcagtgattcattatcagggagatgaggcaggtgatgaaattatccgcagctttggaaaaatgaaatatttcataaagtcaaagacgatgcgtggagagaagacagagatggcggttgaagtgttctgccgccagaatgagcttaatttcacagagaagatccggaagatcacgaatgtagaagatattacattgatccagtataatggagagtatcacggataaaataagatttagagagggcgtggacatttaatgttcatgctttttctttttgacattttttgattatttacatctccgatcgatattgtataataaaaaatgtagaaaaatattaaaacatagttgacagatgggttttataagtatataatacaaaccatcaaaaacacaccaactaagtaggttaataaagaaagtgaggatatagactatggcagcaatttataaaggcacacttggactgattggaaatacaccacttgttgaacctgtgaatctggaaaaagagcttggacttgaagcaacgattcttgtaaagcttgagtatcttaatccggcaggaagtgtgaaagatcgtgttgcgaaggcaatgatcgaagatgcagaagagaaaggaatcctgaaagaaggttctgttatcatcgaacctacttccggaaacacaggaatcggacttgcatcaatcgcagcagcgaaggggtacagagcaattcttaccatgccagagaccatgagtgttgagcgaagaaatatcctcaaagcatatggagcagagatcgtacttacagaaggtacaaagggaatgaagggagcaattgcaaaagctgaagagcttgcaaaggaaatcccgaacagctttatcccgggacagttcgttaatccggcgaactcaaaagcacacagagagacaacaggcccggagatctggaaagacacagatggaaatgttgatatctttatcgccggtgtcggtacaggtggaacactgacaggtgttggtgaatatctgaagtcccagaaaccggatgtgaaggttgtagcacttgagcctgcagcatccccggtactttcagaaggaaagggcggaccgcacaagattcagggaatcggagcaggattcgtaccggatgttcttaatacaaagatctatgatgagatatacaaagcagacaatgacgaaggattcgcagccgcgaagcttcttgcaaagacagaaggaatcctggtaggtatttcttcaggagcagcactttccggagcaattgcatatgcaaagaaaccggagaacaagggcaagacaatcgtagcacttcttccggacagcggagacagatactactctacaccactctttacagagtaggcacgaatatcaagacaaccgcaaggcattaattaagtaagattttaacttccaagcagctctggctgcggaataagaatacaaaacaggaattagaaaaaggagaataaacccatggcaaaattagagagaaaagacagaaattttaaatttgaaacattacagcttcacgtaggccaggagcagccggatccggtgacagatgcaagagcagtaccaatctaccagacttcttcttatgtgttccgcaacagccagcatgcagcagaccgttttggactgaaagacgcaggaaatatttacggacgtctgacaaacccgacagaggatgtgtttgagaagagaatcgcagcgcttgaaggaggtacagcagcacttgcagtagcatccggagcagcagcaatcacatatacaattgagaatttggctcagcagggagatcacatcgtatctgcaaagaatatttatggaggatctttcaaccttcttgagcatacacttccgaattatggaattacaacaacatttgttgacattttcaatctggaagaagttgagaatgcaatccaggagaatacaaaagctgtttacatcgagacacttggtaatccgaactcagatgtagttgatattgaagcaatcgcaaatatcgcacataagcataaaatcccgcttgttgtagataatacatttgcaacaccttatcttgtaagaccaatcgagtacggcgctgacattgttgttcactctgctacaaagttcatcggtggacatggaacaacaatcggtggagttatcatcgagggcggtaagttcgactgggaggcttcaggaaaattcccgtcactgacagatccgaacccaagctaccacggcatcagctttacaaaggcttgcggaccggctgcatttgttacaaagatcagagcaatccttttgagagatacaggagcaacaatttctccgatcagttcctttatcttcctgcagggacttgagacactttcccttcgtgtagagcgtcatgtggaaaatgcactgaaggttgttgagtatctgaacaatcatccacaggttgagagagtacatcatccatctgtagatccagatccgaagcagcaggaactttataagaaatatttcccgaacggcggtggttctatcttcacatttgagatcaaaggtgattctaagaaagctcaggatttcattgataacctggaactgttctcactgcttgcaaatgtagcggatgtgaaatcacttgttatccacccggcaacaacaacacacagccagtgcacagaggaagagcttctcgatcagggaatcaagccaaatacaatccgcctgtccatcggtacagagaatattgatgatatcattcaggatctggatgaggcattcaaagcaattcagtaaataagaatcagagaaaacagaaaaatctgtaagaagtaggagcagtaaaagctgctcctatagtgtttagaagaaaggagtagaagcgtttgaaattatcaaagaaaagtagatatggactgcgtgctcttattgatctggcggtgaattcacggacagagctggtctcattaggaagtatcgcacagagaaatgacatttccgctcagtaccttgagcatgtattttcagcccttcgcaaggctcatattgtaaaaagtatgaaaggttcccagggaggatattttctggagagagatccgaaagagatcacggttgcgcagattgtagaggcattggaaggaacttatgatctggaagatgaagttgatcgaaacaatgtgggacgtggagatcaggaagcaattcagcatctgatcattgatcgaatcaatgattgtgttcaggaaatcctggaagatgtgacgcttaaggatcttgtggatgcatacgaagggtatcaggattccgttgagggaatgtactatatttaatggagaaggaacgtaaggagcagagacagacagcatggcagaaaattatcaatttgaaacacgatgtattcacggggacggaggatttgtagagggacatccatacggagcagtctccgttcccatttttcagacagcaaccttcgcacacccgggaatcgggaaaagtacaggatatgattattctcgtgagagtaatccgacacggtatgaattagaaagcgtaatgtcctctttagaaggagcggatgacagtattgcatgctcgacaggaatggcggcaattggaatctgcctggagcttttcggagaaggagatcatattttatgtacagaagatctgtacggcggaactgtgcgaatgtttgaaagcattggcgaaaagcgaggattaaagttttcttatgtagatacttcagatattgatcttgtaagaaagaatatcagaaaagagacaaaggcactttatattgagacaccaagcaatccaacgatgaggattacagattttgcagagatgagaaaactcgcagacgaattcgggttactgattcttgcggataatacattcctttctccttatttccagaaaccgttacagttgggtgctgatattgtagtacatagcggaacaaaatttcttggaggacataatgatgttctcgcaggatttgtttgtgtcaaagggaaagagctgtcggaaaaattgcgttatacatataagacagttggctgtagcctgtctccgtttgacagtttccttgtacttcgcggaatcaaaactttatcagtgcgtctggagcgccagcaggagaatgcgaagaagatcgcactttggctgaaaaacagaccggaagtgacagaagtttattatccgggtctggaagatcatccgggttacgaggtgaaccggaagcaggcgacaggagcaggaagtatgctttctttccgtgtagatacggtggaacgtacaagaaagattcttgaaagtgtgaaattgatttcttatgcggagagccttggcggtgtagaatcattgatcacatatccaatgcttcagacacacggtgatgtaccggtggagataagagaacatcttggaatcacagaagatttccttagaatgtctgttggaattgaaaatgctgaagatctgatcaaagatctggaacaggcatttcaataaaaggagtaaaaatgagtgagaagaatttgaattttgaccagcctgtagagagaagaggaacccacagtctgaagtatgattttgcagaagaaagagggagaaagaaagatattcttccgttgtgggtcgctgatatggattttaagacgtcatctttcgtccaggaagcattgatccgtcaggcagagcatggaatttatggatatacagagtcagatcaggagtattacgatgcggtcagctcctggatggaacgccgtcacggatggaagatcgacaaggagtggatcacaaagactccgggaattgtctttgcactggcaatggcggtgaaggcttatacagaacctggggattatattctgatccaggatccggtctattatccattccgggaagtgattgaaagcaatgaccgtaaagtggccgccaatatccttatccgtaaggaagatggatcttatgcgattgatttcgaagattttgaacgccagatcgtggaaaagggtgtgaaattattcttattctgcagcccacacaacccggtcagccgggtatggacaagggaagaagtggagcgtctgggagacatttgcctaaagcatcaggtgattattgtaagtgatgagattcatgcagacttcgtatttgaagggaagcatcaggtgcttgtagatcttaaggacgagtataaagacattacagtgacatgtacttccccggggaagacattcaatcttgctggacttcagatttccaatattatcattccaaatgcaagccttcgcaaggaatttcagcatcaggtaactgcagccgggtatagtcaggtcggcgcacccggaatctttgcgctgatcgctgcgtatactcagggcgaagaatggtatcaggcgatgaaacagtatgtgaagtcgaatattgatttccttcatacatggatggcagaacatttaccacagatcaaggtgacaaagacagaaggaacctatctcgtctggatggatttccgggcattagggctttcagacaaggaactaaaagaactgatagaagataaggcagaggtttggctggatggaggagcgatcttcggagagcctggaagtggttttgagcggatcaacgtggcttgccagagagcgacgcttgtggaagcgttggatcggattgaaaaagcagtgaaagaaaacgttcacggatgattagataaaatagaaacagaaaaagatggataagcaataaaagcattacttatccatctttttctatgtagatctgattttccattgtattgaaacaactgttatttcgttccccctgaaataatgctatttctcaatcttgcatggaatggccggttcatgaaagtcagcaagtgtgatacttccaagataatcctcgataaggttatccagtttttcccaaatcggacgtgtcggacactgacccgcacgtgcacattccggtgcatgatcctccagacacgctacagctgcaaggcttccttctgtcgcatgaagaatggaagcgagagtgtattcttccggagattttgtcaggcggtagccaccaccttttccgcgaagtccaaggataaatccttgtgtgacaagagattttaaaatattttccaaatacttttcagaaatctcctgacgtgctgcgatctctttcagcggtgtgtaagagtccggatcctgctgagacagatcaatcatgactcggagagcataacgccctcttgtagagataatcataacctatttcctcccaagttacctataattttacattgtgaatagtgtatcatatgttaagaaaataaacaagctgtcgaggtaaagtgaaacagtgcaaaagcattaaagtttgttgaaaacaaacgaaaacgagtgtgtctaaaaatgaaataaccgtgaaattgtattaactttactggaatttacagtgcgtttgtgatactctaaagactgtaagtcctgatcggaatgctatctttctgatcagacagaaaagactgggttactgttcactcccgtgtcaatcactttgctgattgacacggagtgaacagtaacaagactggagagagaatatgaaaagattagtagtagcattacttctggcaagcacattgtgtatgacaggatgcggcgatacgaagaaaacagaaccggctgcatctacgacagaagaggtggacaaagcaagcagtacgatgaaagaacagatgggagacaacgcggttcttccaagtgattctgttaagagagttatggcaaagcagtggaaggtgattggaacagatactgtgtatgatctgaaagaagatggaacaggaactaaggatgacaccggactgacatttgagtgtggatttgatgaggataacaacattacaatcaagatcacaatggacggcgaagaagaaggtaaactgtatgcggttacgacagatgatacaggctatggcgtagtgctggagtccctggatggtggtaaggatataaaattactccaggcggatacagaacttctggatctgacggatgaccgtgcgaaggggctgatcggaaagtggacagacaacagcggaaatgaatataaattaaagaaggacggaaagcttgtgatcaagagttcctccggtgagacaaagggaacatattgtgttgcagagaatgcagacggtacattgaggctgaatctggttatctccggtggaacactggaatatgtctatacactgtcagatgatggatctacagtggaattatgtagtccgggaacagatacggtacataagtggacgaaagcctaaagtgtggtgaataaaagagatgcagtttgcgcatgaattgatcgttccggaagttggatttccttttaaactattcttatttgaaggcagagaaggacattaccatagagaaaaacattggcacagatcgattgagatttttgcagtgtgcgacggagaactggaatttaagatcgatgagaagacctggcatctgacagcgggagaatttatgattgtgaattcgaatgaggttcatgaagtagattctccgttgccaaacgagacgattgttcttcagattccgttgaaagtttttgaaaaatattatacaggagagcaatttatctggtttacgcatgaaccgggacgtaaggacgcacgctttatggaattgttggaagaactgtatcagacgtattgcgaaaagcagtgtggatatgacatgaagatgaacagtattttttatcatcttttatatctccttgtgaaagaataccgtctgacggaagttgaggatgcttttgtaaggaagaataagaatctgaacaagctttcagcaatcacatcttatatgaaagagaattatgcacaggagctcagtctggaagaagtggcaagaatttttggctactcgccaacgtacttgtcgaggatgtttcagaagtatgcgggaatcacatataagagctatctgcagaatatccgtctggaatatgcaatgaaagacctgaagggcggaaaatataatatcactgagacagcacttcgcagcggcttctccggaagcaaggcgatggcaagggcatttcggaaaaaatacggaattcttccaagtgaatatagagaaaatgcgtagcattttggaggttggctctgaacagttacgaaaatggaatataaataaaaagaaaaaatgactaacagtacaaaatatattgactgttagtcatttttattgtatagtgcaagaagagattaaaatgaccaatggtcataaactaaatataaggaaggaagcgaaaaaggatatgatggtaaagtttggaaaaaaagtagtgaaattcagagtgccgattctgattctcagtattttattattgattccgtctgcattggggtatctgcatacgagaattaattatgatgtattgacttacctgccggataacatcgagacgatgaaaggccaggatattttggtaaatgatttcggtacaggtgcattttcgatgtttatagtcgatggaatggaagataaggatgtatcgaagttaaagcagaagatcgaaaaggtggatcatgtaaaagatgttatttggtatgattctatcgcagatatcagtatgccgaagagcatgctgccgacaaaagtctatgatgcatttaactccgagaccggaacgatgatggcaatcttctttgatgaaggaacatcttcggacggaacaatggaagcaatctccgagatccgttctctggcgggcgagcagtgctttttaagtggtatgtcagctgttgttacagatacgaaggagctggcggagaaagagacaccgttgtatgtattgatcgcggttgtgctggcgatgatcgtacttggtcttacaatggaatcgttctttgtaccgatcctcttcatgctcagtattggaattgcgattgtctataacctgggaagtaactactttatgggagagatctcctatattacaaaggcactggcagcagttctgcagctgggggtaacattggattactccattttcctgatgcacagttacgaagaacagcagatccgttacaatggagataaacatcgtgcaatggcacatgcgatctcacagacattttcctctgtaatcggaagctccgttacaacaatcgccggatttatcgcactgtgctttatgtcatttacacttggtatggatatcggaattgtcatggttaagggtgttatccttggtgtacttgcctgcgtaacaatccttccatccatgatcctgtgttgtgacaagattattgagaagacaaaacataaaccattccttccggatatcggaagaatttcagacaaggttacaaagagatatctgatttatgtagcgctctttattattttgttattcccggcaatctacggaaataaccatacaggcgtttattacaacctggatgagacacttccaaaagatcttccgagtatcattgcaaatgaaaaattgaaggaagattacgacatgaatacgacgcacatgattcttgtagacagctctacagattcagcggacgtaggcaagatgctgaaagagatggataaggtggacggaatcaagtgggcacttggacttgactccctgatcggtccgtccgttccggcaagcatgatcccggattcagtgacaagatcattaaagaatgataagtaccagcttgtactggcgaactcagaatataaggtagctacagatgaactgaatgaccagatcaaagagctgaatacgattcttcataaatatgataaaggtggaatgctgatcggagaaggtcctctgacagcagacctgatcgacattacagataaagatttcaagacagtaagtgcagtatcaatcggaattattttcgtgatcatcatgcttctgttcaagtcaatctcactgccgatcatcctggtaggcgttattgagttcgcgattttcgtcaatatgggtattccatactacatgggaactaagttgccattcgtggcatccatcgtaatcggaaccattcagcttggatccaccgtagactatgcaattcttatgacaactcgttataagagagagcgtaaccatggcgcgaataaatacgattccatcacaactgcgcaccgtgtatccgcacagtctatcatggtaagtgcgttgagcttcttcgcagcaacgatcggtgtaggactttactccaacattgatatgatcagttccctgtgtatcctgatggcgagaggagcactgatcagtatggtagtcgtaatcttcgtactgccgtccatgttcatggtatttgataaagtgatcgtgaagacaagtaagggattcctgccaccgaaggaataatggggcgtggaatagaatgagagaggtatgccgaattaggatgctaaggcatatttcactttcagaaagaaaagataagaaatgggcattatttggctaattatttggtcgataatgcctttttaagttggtaaaatgaccatagaaacaaacgaaacagaaaacagacttcttgcagctatgaataaatggctgatcgctcatgaggatgcacagattgaaggtgcgttctgtggattaaaaggtgagaacgtcgaagtctgattgaaaatggatgccgggttttccccgaatcaggatcgtgttattcacaaggtttctgcatgatgtgtggaaaaccaaatgaaattacaggaaaagtgtggataacgtaacatgagaaagatagaaataataacaagtataaagaaagcgaggattttattatgagtaatatgccagaattaaaaatcggtgttgtagcagtgagcagagattgtttcccggagggtctttccgtgaacagaagaaaagcattgatcgatgcctacacaaaaaaatacggtgaaggaactgtctatgaatgtccgatctgtattgtagagagtgagatccacatggtgcaggctctggaagatgtaaagaaagcaggatgtaacgcactggttgtttatcttggaaacttcggaccggagatttctgagacactgcttgcaaaacattttgacggaccgaagatgtttgtcgcagctgcagaggagacacaggataatctgacacagggacgtggagatgcttattgcggaatgcttaacgcaagctacaatctgaaactcagaggagtaaaagcttacattccggagtatccggtaggaacagcagaggaatgtgctgacatgatccatgagttcgaaccaatcgcgagagcagttgtcggattaagtgacttaaagatcatcagctttggaccacgtccgctgaatttccttgcatgtaatgcaccgatccagcagctttacaatatcggagttgagattgaggaaaattctgaacttgaccttttcgaggcttataacaaacatgaaggtgatgagagaatcccggccgttgtaaaagagatggaagaagagctcggagcaggaaataagaaaccggagatccttccgaaactggctcagtatgagattactttgaaagattggatcgaggagcacagaggatacagaaaatacgttgcaatcgcaggaaaatgctggccggcattccagacacagttcggatttgttccatgttatgtaaacagccgtctgacagctcagggaatcccggtatcctgtgaggttgatatttacggagcactcagcgagttcatcggaactgctgtcagccaggatgcagtaacacttcttgatatcaacaatacagtaccggtagatatgtacaaagagagcatcgaaggaaaattcccatatacacagaaagatacatttatgggattccattgtggaaatacagcttccggcaaacttgctttctgcgaaatgaaatatcagatgatcatggcaagatctcttccaatcgaggttacacagggaacactggaaggagatatcaaacctggagacatcacattctacagactgcagagtacatctgacaatgtacttcgtgcttatgttgcacagggagaagtacttccggttgctacaaaatctttcggatctatcggagtgttcgcaattccggagatgggaagattctaccgtcacgtactgatcgaaaagaattatccacatcacggagcagttgctttcggacactttggaaaagcattgttcgaagtatttaaatacattggtgtgccggttgaagagatcggatacaaccagccgaagggtgtaagatatccaacagagaatccgtggggttaattacatagaaagttataagcatagaaaacgggcagagagccgtgccggaaacggcaaggctctctgtctttatacaggaggaacgacatgttatttgtaggagtagatcttggaacatccgcagtaaaacttcttctgatggatgagaatggaaagatcaagaatatcgtatcaaaagaatatccgttatatttcccacatccgggatggtcagagcagaaaccggaagactggtttgcacagagtatggaagggctgaaagagcttcttgaaggctttgataaggatcaagtaaagggaatcagttttggaggtcagatgcacggtcttgttgcgcttgataaggaagaccaggtgattcgtccggcaattctgtggaacgacggacgtactgcaaaacagaccgattacctgaatcaggtgattggaaaagagaagctttcagagtatacagcaaatattgcatttgccggatttacagcaccgaagattctctggatgaaggaaaatgaaccggagaattttgcaaagattgcgaagattatgcttccaaaggattaccttgcataccgtctgtcaggttctttttgcacagagtattcagatgcttccggaatgctgcttctggatgtggagcataagtgctggtctgcagaaatgcttgagatctgtggtattacagaggtacagcttccaaagctgtatgaaagctgggaagtcgttggaactttgaaagcagagattgcagcggaacttggcgtatcagatgatgtaaaagtaattgcaggagccggggacaatgcggcggcagcagtaggaacagcaacggtcggagacggtggctgcaatatttctctcggaacatcaggaacactctttatttccagtaagaaattcggagtagataagaacaatgcactgcattcctttgaccatgcagatggcaattatcatctgatgggatgcatgctcagtgctgcttcctgtaataaatggtggatggatgaaatccttaagacaaaagattatccggcagaacaggcaggaatcacaaggctcggcgagaaccatgtgttctatcttccatatctgatgggagagcgttctcctcataatgacccttccgcaagagcagcatttatcggaatgtctatggacagcacaagagaggatatgacacaggctgtgctggaaggtgttgcattcggactgcgtgattctttggaagttgcaagaagtattggtgtgaatccagagagaacaaagatctgcggcggtggagcaaagagtccgctgtggagaaagatcattgcaaatgtgatgaatatgaaagtagatctgatcgaaagcgaggaaggtccgggatatggagcggcaatcctggcagcagttggatgcggtgtatttgattcggtggaagaggctgcgaagaaacttgtgaaagtaacaggaacagaagaaccggatccggaactggtgcagaagtacgaggaaagatatcaggaatttaaagaactgtatccggtattgaaaggattttttcaaaagaaacaagcataattgaactccaataaaaaactcccaatagaaaatcatactctaaaagatatctgagatggaattctattgggagtttttaaaatatcaataaatcttacgctaaaaacaacgcatacagtatcacaagaataccaagcacgattctgtaatatccaaatactttgaaatcatgtttcttaatatatcccatcaggaattgaataacgataatagaagaaacaaatgctgttaccataccaatcagaagaattattgcttctgttccggtaaagttcagaccaaacttcacaagcttcagaagacttgcaccgaacataaccggaatcgcaagtacgaaagtgaattcagcagcaacggttctggagactccaaggatcaaagcaccgacaattgttgcaccggatctggatgttccagggaagattgcagcgatcagctggaaaagtccaatcaaaaatgcagtcttataagtaagttcgtccatactgttgatcttcgcaggtttgcccttgtgattattctcaacaatgataaaggcgataccgaagacaatcagagcaatcgcaacgcaagggtaattgtaaaaccatttctcaaacagatcattgaacggcattccaatcacaattgcagggatacatgcaacaaggactttcagccaaaggataatgatatccatcttcacataacttaaaattccatttccggatttctttcttctatgtgcatgttttgcctgacggcgtctgaccgtgtgacttccttccggtgcaccaaacgggaagatctggttccagaataagaggacaacagcaagaatcgcacctaactggatcacaacttcgaacatgctgtagaattcttcagaaacatctaatttcacaaactgattcaaaaggatcagatgtccggtgctgctgatcggcagccattctgtgattccttccacaattccaaagaggaaggatttcaaaaattcaatcattcttaatttatactcctttttattgatggattgcagctatactaagagattctagcatcaaatgcaatcatttttgtgcagctacacttatgctctaaagtggctcacggtttcttattataaaacgttggcaaaagatgtgcaagaaatagaaagtatttaaattgttaaatcgtcgatttaagaaattcctaatatttttccaatctatctcttaaaaaccatcaagtatcatgtatactatagttagaacttgatcatgtgataattatgttgctgcgctgttatcggtgtcagcaattatcgaggggtatgtaaaatgtataaaatattagtatgtgatgacgatagagaaatcgtagaagcaatcgaaatttatctttctcaggagggatatcagattttaaaagcatatgacggaatcgaagcactggagattctggagaaagaggaagtgaatcttctgatcatcgatgtcatgatgccgagacttgacggaatccgtgcaacattgaagatccgcgagaagaacagtctgccaatcattatcttatctgcgaagtcagaagataccgataagattcttggactcaatatcggtgcggatgattatgtaacaaagccgttcaatccgctggaacttgtggcacgagtgaaatcacagctgagacgatttaacgagcttggcggaacagcacaggagccaaaagagatgatttataaggtaggtggccttcagatcaatgatgatctcaagcaggtaacagtagacggagaatttgtgaaactgacaccgattgaatacaatatccttttgcttctgatgaagaatcagggaaaagtattttcaatcaatcagatttatgaatccatctggaatgaagaggcaattggtgcggataacacagttgcagttcacattcgtcatatcagagaaaaaatagagatcaatccgaaagatccacgttacctgaaagtagtctggggtgtcggatataaaatcgaaaaagcatagtgcgaacagtaaaaaaagcacatgcaaaaatagatagaaaaagcatgtaagagaacatagaaaaatgcataagaaggcatataagaaagggttaacaatgaagaaatggtacaggaagaccgtgacaaggacaattgttcttgttgtggcgattcttagcggagcattgcttgtgacaaatttgctttctctcctgacactggcgggggggatgagtttttcacagatccaaaagatgaatacacagtcttttgaagaatccgaagaattcagcaagatggtcgaaagttacatgtacgatgtacaggagaagctttatctgcagaatctttttgaaagtgacggcgcctacaatccgaaaaaactggtggatgtaatggaactgtcgaagaagggaaagatatctgagacgaatctgtccggcgtcacgtacacaatggaagagctggtgaactggggcgaaacttacagtgggacagataacgacaatctttacaaacagaatggcgtgatcgtctgccagaaaccagacggaaattattactactattatatgaatgatttcttctctcttgtaaatgcaggaaaacttcaatttcagatgggcgaacaggacagagatcagttcctggcaggattgcaggcaggtgaatttacaacttccggatattatacatttcagattacagatgaaaatggtgatctgctttatacagactgctggaattttggccagtctctgatagagaaatacgcaccggttgaggcagataatctgcttcaggttgtaaataacaatccacagttaaatggaagattgtcgctggtttacgataatatagccacagcattgcaaacaatctatgaagactggcaggattatgaaggcggttgggattatctggaagagggaaataccaattttacctatctgtacgcagatgaatcgacaaagaaagttactacaaataaagcagaatatgcaaattatgcggatgtaagagatagcatagagaatataatagcttctgcgtctaaaaaatctgtgaaatacatggtgatctatccggaattgaaagattttaagacgaatatgaatgtatcttattctgatcaatggcttaatattcgttcttatggttattattccggaggaacaaagtggaaagatgtttttgcagttgcggttgatacaaaatatccgattcaggatcaattttaccagaacagtattgagtatcagaataatattccgcatatgaaagcagcattgcattttatgattttcattggactactctttttgatcacagtagtgtggctgacattgggggcaggaagaaaaccgcaggatgaagaactgtatttgttaaagttcgattcctggaagacagagattgccgcagcagttattatttttgtctgggtgattggaagttatttctttttcgtagcaggaatagatggaattcatatcttatttgatggaattacagggttgtgtagttcatacagtgctgtggaaagtgatacatttattccatcatcctatgttccgaatgtatatatgcagactttaagtctcggagaatcagtgggtgtgttcgtatatggtgcgtttacatttacctgtttctttgccggctatcttagtctggtaagaagaattaaggcaaagagcctgtgggagaacagtctgcttcgaagtttcggtatatttattgggaaaatattacgagatgtgaagcttacaaagaaaacagcaggacttttgattctttatttcctgtttcagcttttcgtactttgggatagagatttcttcctggtgattctgctgctgatcgctgacgcagtgctattctattgcatggttgcaaatgtgatggagaagaaccgactgagaaaaggaatccaggagattgctgccggaaatatgagttatcagattccaattgacggactgcatggagagaataaaaaccttgcattgatgatcaacggaatcggaaccggacttaataaagcagttgctgaggcaatgaaaaacgaacgtctcaagacagatttaatcacaaatgtttctcatgatattaagacaccactgacttccattttgaattatgtcggcatcttaagacagacagatccagcggatccgaaagttcaggattatctgaatattctggaagagaaagcacagagactgaagactttgacagaagatgtagtagaagcatcgaaagtcagcagcggaaatatttcgctggaatatatggatcttgatctgtcagaaatgatccagcagacgcagggtgaactcgaagaaaaattcgaggcgagaaatctggcaatcgtcacagatcttccggcagaaccggctgttgtgcatgtcgatggaagaagaatgtggcgtgttctggaaaatatttacggaaatgcggccaagtacgcaatgcctggaaccagagtttacgcgactctgaaaacagatgatacaaaggtaagattttcattgaaaaatgtttccgagcatcagttgaatattcaggctgacgaactgacagaacgttttatccgcggagatatttccagaagtacggagggaagtggattaggactttccatagcgaagagccttacaacaatgcagggcggcacatttgacttgtatctggacggagatttgttcagggtagatattacatttccaagagtgaaagcgaaaggaaatgctggcgggacaacagaggaatcgaaagagaaaacaacaagcggtgtatcttgacattctattcgcgttatgctaacctttttaaggaatgaaaagcagtgataagcgaaacgcgatgaggaagagagtagtctgtaacagattctacagaaaagtcctgaaggctgtcaggccggatgttgagagggatggatggaagacagatgaagatggcttctgagcagcgcagatgagcctgaacagagtgagcaagtgagttgtttaagcagcaatcttgaataaaaagatccgggttagtctgtgaagggattcgccctttatagcgaagagtatcaacagtgagaaatgccgtagtattcaaagcagtttttactaacgaaagtgcagatactcatagaggtttctttccgcgaggaaggaacgaagagaagtggtaacacgaaagtaggattcgtcttctcagggatgcaagtccctgggagggcgttttttaatatattaggttctttcctaatatattaaaaacgctccgctagggatgttccggaaaatccagaaaaaaatcgtattagtaatcactgaaagttgagaaaagaatcccacattgtgggaaaaggaggcagaaaaatgtcagaaaaaccaaaatattatataacaacagcgattgcctatacatcaggtaaaccgcatatcggaaacacatacgagatcgtgcttgcagatgcaatcgcacgttacaagagaagccagggatatgatgtattcttccagacaggaacagatgagcacggacagaagatcgagctcaaagccgaggaggctggaatcacaccaaaggaattcgtagataatgtatcaacagaaatcaaaagaatctgggatctgatggatacatcttatgacaaattcatccgtacaacagatgaagatcatgagaaacaggttaagaagattttcaagaaactttacgacaagggagatatttacaagggacattatgaaggaatgtactgtacaccatgtgagtctttctttacagagtctcagcttgtagatggaaaatgtcctgactgtggacgcccggttcagcctgcaaaagaagaggcatatttcttcaaaatgagcaaatatgcagatcgtctgatcgagtatatcaatacacatccggaatttattcagccggtagcacgtaagaacgagatgatgaacaacttccttcttccgggacttcaggatctgtgtgtatccagaacatccttcaagtggggaattccggtagatttcgatccaaagcacgttgtatatgtatggcttgatgctcttacaaactatatcacaggaattggatatgatgcagacggaaacagtacagagcagttcaacaagctgtggccggcagaccttcatctgattggaaaagatatcatccgtttccatacaatttactggccaatcttccttatggcacttgatcttccacttccgaaacaggtgtttggacatccgtggctgcttcagggagacggtaagatgagtaaatccaagggaaatgttctctatgcagatgaactcgttgatttctttggcgtagatgcagttcgttactttgtactgcatgaaatgccattcgagaatgacggtgttatttcctgggagctgatggtagagcgtctgaactctgatcttgcaaatacacttggaaaccttgtaaacagaactgtttctatgacaaacaaatacttcggcggaacagtagaagataagggtgttgtagaagatgtagatgcagaactgaaagcagttgtagagaatgcttctaaagcagttgatgctaagatggcagacctccgcgttgccgatgcgattacagaaatcttcaatctgttcaaacgctgcaataaatacattgatgagacaactccttgggtacttggaaaagatgaatccaagaaggatcgtctttctacagtactttggaatctgatccagagcatttctgaaggtgcaagacttcttgaatcttttatgccttctacaagtaagaagatccttgagcagcttggtaacggacatgtaacagagaaaccggagatcctgttccagcgaatggatctcgaagaggttatgaagaaagttaaagaacttcatccgaaggtagaagaaaagaaagaggaagaagctgttatcgacattgagccgaaagatgagatcacatttgagcagttcggagcaatgcagttccaggttggagagatcattgcatgtgaggctgtaaagaaatccaaaaagcttctctgctctcaggtaaaagttggaagccaggtaaaacagatcgtatccggaatcaaagcacattacacaccggaagaaatggttggtaagaaagttatggttcttgtaaacctgaaacctgcgaagctggcaggcgtactttcagagggaatgttgctttgtgcagaagatgcagaaggtaaccttgcactgatgacaccggaaaaagaaatgccggctggagcagaaatctgttaattgaaatgtttgaaaattcagacaattaaaaccaaagtagataacaaataaaaaatataaaaaaatcaaatgaatatattgacaaattagacgccgaatgttattatataaccatcaaagagagaaagaaatctcccaaagatatttaactaagaaggcaaaagtaacagatgcctgattagattaaaaatacaagttcaacaggaggtcagtcccatggacagtatagtttcagatttttatcaatatgtcagtggtatgatgagtgaaggttcctgtgaagaaagagacctttgccaagcgtaaaagtccagtagaaagaaaagaagatcaaagatcggagagtacggaaactggaagcaaagagaaaaagatgaatcactcatagatgtattgaataaaaataccgcatataacatagaatgaaaaatgtgtaaagaaacattgaaaggacatgttataatctcagatttgttataaaagcaggaatgacttgacagaagatttaatacataaagtattgaatggatataaaaatcattcaggtgataaaataacagacgacaaaggtctcacaggaacgtagaatcgcgaataatctccgatacaaaatataaaattataataataatacaattaaataacactaaaaatgcactttcaaaaggaattgaaggtgcatttttttgacattacagacctcatatggtagaataatgaaagagtatcggctagtgcctaatggacacattcagaccaaaactaatatttcaatgacaatgaggtgagtacagtggataagtatgaatataagttaaagacagaagagatgctggaacttatggaagatggagaatacagaaaagcagcggcagcagcagatctgattgactggaagcgtgtccgtaacgcagggatgctgatgaatgtcagtgatatttatgaaaaaacaaaagagtatcagaagagctatgatgtgatgaatcttgcatatcgccgttctgaaggaagccgcaaggtgatctataagttatgttctcttgcaattaagacaaagaatatagatgaagcaatcgactattatgacgaatttatccagattgcaccgaaagatccgaacaggcatatccttagatatcagatcttaagagcgcagagagcgccgatcgaacagcagattgaggctctggaggaatttaaaaaggcagaatatattgaagagtgggcttatgaactggcgaagctttatcgcgaagcaggtatgatgacagaatgtctggaagagtgtgatgatctgatcctctggttcagcgagggtaagtatgtttataaggcaatggaactgaagatgcagtataagccattatcaccatcgcagcagcagaaatatgatcacagatatgagaagctttcttcagagacagaagaaataccggatctggcttcctatttaggagaagacgaggaaaaagattctgcgtcagaaggagctgaagcactcggagatacaagatcaatcgggctgacagaacagccggtgatggagaacgacagtacttccgatgtgattgacacggatgcggttactttggaagcgacagaagagccggataccgaagtagaaaatccggaagaagcaggagtagaaacagcagaagttatagaagcttccgaggatgagttagaagttcagccggcaacggtagagacaagtggagataagagaacacttagcaaagatactgcttccataccgattgtcagtaagaatccggtaaaaccagtcaagaagaaacttggagatacgatgcggttagatgaagctctgcagcaattactcaatccgaaaccggaagttcaggcagaaccgggagaagaagtcgaaccggatatgacagatctggaagaggatattgcagcaattgaggatgtagaagatcttgagatcgtgaatcaactgacagaagagaagaaagctgaggaagccaataaagaacgagtagttccatcagggatgaaagaactgataccggaaccggagacagaagaagaacttatagaacaggcagtggaggagacttcagaagatgtcccagaagatgcagttactatagaagcaggagaagcagaaccggaagaagttcttgaagtagaagaggcagaaccggaagaggaagaaatccttgaagtagaagaagcagaaccggaagaggaagaaatccttgaagcaggggaagccgaaccggaagaggaagaaatccttgaagtagaagaagccgaaccggaagaggaagaaatccttgaaatagatgcagctgagtcagaagatctgacagatgaatcagaagatttgtctgaggtggaggaactgatctcagaaactgaagttgtcaatgatgaagatgattcagaaggagcagcagtaagagagactatggacaataaaaataatgaagaaccaattttatcaccagagatacagaaactgattgatgagattgaaggtgttattccggaagaggaagaagtagatgcaacagtaagttcagaagaagttcttgaggtagaagaagaaccacatgaaaatatgggagagcttgcggatgatctcagactcggtgaggatgagtacgaagattatgatgcgtatgactgggatgatgcagaagagtttgacgaagacgatattttagatgattatgaagagtctgatgacgatttgttggatgattatgaagagtctgatgacgatctgacggatgattatgaagacgctgatgatgatctgttcggtgaggaagaagggtatgatgatctggatgcctatggttatgaagaagacgatgaggatgatgaagtaattaatccaagagatcttttcacagcagaagataagatttcagatgatgatcttcttggtctgaattcttatgaagaagtgccaaattttgaagatgaattcagcgtgaatccagcgcatagtgaggaaccggatgacagagagattccggatgaagatgacggaattgatatcatgtctgcgacgacaccattgagccgtaaagagactgcaaaattgatcgcaacaggtaagacatcaccattaccgttagatgagattgcagatgcaatgtctgatacaggatttatcgtgcatggtcgttatgatcttgaaacacagagcggaattggtacaagagcaggacttacagaggaacagaagaaactcttctcttatttcgtacctgtacgtggtatgagtgagcagctggtagatgtacttgagcaggataagaactgtacaaaccgcaaaggaacttccagaacaggaaaccttctgattattggaaataaaggaaatggaaagacagtcctcgctgttgatgttgtaaaggcaattcagaagcagcgtgatatccgtcagggtaaggttgcaattgtgacaggtgagtcactgaataagaagagaatcggagacattttccgtaaattgtacggcggtgcgctgatcattgaaaaagccggacagatgaacgaaaaaacactcgccaagctgaacaaagcaatggagcaggatacaggagaacttttggtagttcttgaagagcagagaaaaccactggatagacttctttcttccaacagagaattcagaagaaaatttacttccagacttgaagtgccaatctttattaatgatgagcttgtaacatttggacagacttatgctcaggagaatggttacagaatcgatgagatgggaattcttgcactgtacagtaagattgattctttacagagagaagatcatgcagtaacagtagcagaagtgaaagaagtgatggatgatgcgatcgctcattcacagaaagcttccgcaaagaagcttgtgaagagagtatttggaaagaatacagattcttccgacagaattctgctttcagagaaagatttcaacatttaatgacatatatttgttaagaattaatagacagtcagtaaaacgactgtctatttttgtgcaataatacattttctctttcttttttatacagtatcaagtataataaaactatagtgttcaaggggagaatgaaactttgttaccaattgaaagattcggtaatgtgccttgatctataagaaattgtatggtttttaaatcattacaatcaggaatatatttgagcagtgaggtggctttatggttaagaaaaacagcacgaagacgaaagtgcagccttatgagatcggagaacttgaccattatctttttgggcagggaaatcattatgagatttataaaaagatgggtgcccatgaggtgacaaagaacggaaaaagaggagtatattttgcggtatgggctcctcatgcagtaaacgtttctgtaatcggagagtttaatgactgggatgagacgaaagataagatgaagagaggagagcctctcggaatatacacatgcttcgtaccggaggcgaagaaaggggatttgtataagttctgtatagagacacaggcgggtgagaagatatataaagcagatccatttgctaattatgcagagctccgaccgggaacagcatccagaattacagacatttctaatctgaactggtcagacagtaagtggatgacagctcgtgagaagtgggataacaaagaagaaccagtgtctatttatgaagtacatatgggttcctggatgagacatcctggaagagaagatgaaggattctatacatatcgtgagtttgcagaagcaattacaaagtatgtaaaagagatgggatatactcatgttgagttgatgggaatcgcagagcatccgtttgatggttcctggggatatcaggtgaccggatattatgcaccaactgcacgctatggaacaccggaagattttgcatacatggtgaattatcttcataagaataatatcggtgttattcttgactgggtaccggcgcatttcccgaaagatgcacatggtctggcagattttgacggaacaccgacattcgaatatccagatccgagaaagggtgagcatcctgattggggaacaaaggttttcaattatgaaaaaccggaagtttctaacttccttctggcgaatgcattgttctgggttgaacattatcatgtagacggacttcgtgtagatgcagtggcatctatgctgtatctggactacggaagagaagatggacagtggattccgaataaatttggcggaaatgagaatcttgaggcgattgcattctttaaacatttgaattctgtagtttgcggaagaaataaaggcgttatgatgattgcagaagagtctacagcatggccgaaggtgacaggatctcctgaggatgacggacttggatttactttgaagtggaatatgggttggatgcatgactttacagaatacatgaaactggatccttatttcagaaagaatgcacatcacatgatgacattttctatggaatatgcatattcagagaactatattcttgtactttctcatgatgaggttgttcatctgaaatgctccatgttgaataagatgccgggagaaggatgggataagttccgcaacttgaaggtggcatatgcatttatgatgggacatcctggaaagaaacttctctttatgggacaggagttcgcacagcttcgtgagtggagtgaagagagagaactggattggttccttcttgcagaagaaccgcatcagcagattcagaactggtataaagatttgcttcatctttataagaagaataaagcattgtatgagttggataatgatccgaagggctttgactggatcaataaggatgatatcttccggagtattttcagtttcacaagacattcaaaagatggtaagaaaaatctgctctttgtatgcaattttacaccggtagatagaccagattaccgtgttggtgttccgagaagaaagcagtttaagcttgttcttaacagtgatgagacaaaatacggcggatcaggagaagaacgcccattggtttacaagccagagaaacaggaatgtgatggtcagaaatattcctttgcatatcctcttccgggatatggtgtggcagtatttgagtattaagttgtatagtataatgttttccacgaatagatggaacaggaattagacatacattaatttgcccctgcatagattgtaaaaaacaaactatgcaggggcttttctatgagagaatatattgaggagcgtgcagtggaaattgcaaattatattatagaaaataatgcgacagtgagacagacagcaaaacagtttcggattagtaagagtacggtgcataaggatgttacagaacgtctgcttcagatcaatccatcattggctcatgaaacacgtaaggttttagacaccaacaaatcagaacgtcacatccggggagggctcgctaccagagaaaaatatttacacttgcatgcttccaattattgaagttaatgttacaataaaagtggatattcaatcagaaacacggacattgagaggagattgttcaaatgcgggtggcaatcgttgaaagggatgaaaaagtattagaagaactgaaaaaaggtttaaaacgcgtagatccgaattacgagttggcggggactgcagggaatggacagtctgcatatgagatgataacagttatgcagccaaatcttgttatcatggatattgggcttccgcggatgaatgggttaaatcttttgagaaaattacgcacggaaggacgtgagttccgtgtgattattataacaaaggatgaagattttcaacaggcaaagcaggcaatcgatctgggggtggacggatatttagtacagccgttccggccgatggagcttaagaaggcattaagccgtattcatgaaaaaatcagaaatgaatattggatgcaggcttcttttactgttgaaaatgttctgttaagctgtagatatggagaaattatatcgaatcagaagttaaatgaaatgactatccggaaatatggttttacagtggatgatccgggatatttatttacggtttcaatggcagacgaatacgaggagcagaaggaaaatatacgtggatttctcgaagaaatctgtagacgtgagtgtggattttcggcatctgttatatgttcggatcgatggaaacaggtgtatctgatcatttaccgggtacgtgaagcaaggaactggaaagaatattttcaaaaaaatgtggttactgggttatgtaggaattttccggggacaattatttgtgtatggatagagacaaaacagctgataaagctggcagatgcaatgattcaggcaggaagtctcatggaatggaatcttcttcagccgcgaggagtcttaatctgtcagcagacagttgagaaatttgaagctgttccggtgcgttatccggtagaattagaacaacgaatgcgagaaatgattttcgatgaaaacaagaaaggaattgccagacaatttcaacttgtttgtgaggaaatgaaaagagaaaaatattttccaaaagaaataaaatacagtatcattcgtttttgcatggcagctggattgaattatagaaattatggcggggagattgacgaaacaaaaatcctgagtcttatgcagcagattacctatgccatcagctggaaacagatagagaaagcgattcaaggcttggaacggatgatatcatatgagcataaatttgagcagtacagtacgcttatccaaaaagcaatggaaattataagaaaagaatatgacagtggtattacattggaagaagcagcgagtcaactttatgtatcggaagaatacctgagttctcagtttaagaaggagacaggatataattttacagaaactgtgaggaaatacaggatagaaaaaataaaggagcttctcaggacaacaaaatataagatgaatcagattgcggggcttgtcggttactctgatcccaaatatatgagtaaggtgtttaaagaggaggaaggaattttaccgacggaatacagacgtaactccaatgggatttcataattaggagtaatttcatattgcttatagaaaaaagtagagaataagaggcatatttaattaaaaaaatacacttttataaaaaatttcgcccttttaaatataaaaaatgtgctatgatatatgtgaaaagtgaaaaggatttcatagccgttgaggcagaaagaggtgaaaagaatgagcacaatgaacattactttcaaacacccggatgagatcattgatttcttgaaaacagtatgtaaatttgactttaacatggacatgagaagaggacgggcagtagtagatgcgaagtcattacttggaatcatgaatctgggattgaataacgtgattgaactgcagatgtatgcagacgattgcacagaacttgaaagacagctagaaagatttgcagcataaaatggaacataaaaatgggatgtcggacatttgttcggcatcttttttgatatattatacccataacagtggatacatagaatgcgcactgcggtgtacgatgtaggtgtcgcaagcgaccaccgcaggcgtaagaggatgccgaggcacattctttgttcaggatagatcagaaggggaataattaccgtgtatagtaatagaaattgtggataagattttattttacataaacaaatacttgtaaatcaatgcttcctctactataatgaaaaacagaaaaagatatataaataaagtaaatagttttgattggattttacaggaggaaagatttgaagaaagaattagtgattgtccttgactttggtggacagtataatcagctggttgccagacgtgtcagggaatgtaatgtatattgcgagatttattcttataagacagatattgaaaaaatcaaagagatgaatccaaaaggaatcattctcacaggcggaccgaacagctgttatgagccggattcaccgacttattcagaagaactgttcaagcttggaattccggttctcggactttgctatggcgcacagctgatgtctcatgtacttggtggaaaagttgagcgtgcagatgtaagagaatatggtaagacagaagttattattgataaaaaagactccaaagtatttgagggtgtttcagagacaacaacatgttggatgagccattttgattatatttcaaagattgctccgggatttgaaattacagcacacactgctgactgtccggttgcagcagctgagaacgcagctgagaaactgtatgcaatccagttccatccagaagtacttcatacagtagaaggaacaaagatgatcaacaactttgtaaaaaatgtatgtgaatgtgcgggtgactggaagatggatgcttttgttgagaatacaattgcagagatccgcgagaaggttggaaacggaagagtattgctcgcactgtcaggtggggttgactcttcagtggcagcaggacttctttccaaagccattggaaaacagcttacttgtgtattcgtagatcacggacttcttcgtaaaaatgaaggagatgaagttgaggcaatcttcggaccagaaggacagtttgacctgaactttatccgcgtaaatgcgcaggaaagatattataacaaacttgcaggcgttacagagccagaagcaaaacgtaagattatcggtgaagaattcatccgtatcttcgaagaagaagcaaagaagatcggtactgttgaattccttgcacagggaacaatttatccggatgtggtagaaagtggtcttggcggagaatccgctgtgatcaaatctcaccacaatgtaggaggacttccggattttgtagatttcaaagaaatcattgagccgcttcgtgatcttttcaaagatgaagttcgtaaagcaggacttgagcttggacttcctgaaagacttgtattccgtcagccattcccaggaccgggacttggagtacgtatcatcggcgaagtaacagctgagaaagttcgtatcgttcaggatgcagatgctatttatcgtgaagagattgaaaatgccggacttgataagacaattggtcagtattttgcagcacttacgaatatgagaagcgttggtgttatgggtgatgagagaacttatgattatgctgtagctcttagagccgttaatacgattgatttcatgactgcagaggcagcggagattccgtatgaagttctgaataaagtgatgagcagagttataaatgaagttcgtggggtgaatagaatattctatgatctgacgagtaagccaccgggaacgattgagtttgagtgatgtgaaaacagcgggaagccagtatttatgcggcttcccgttttctgtgcttgcaaaatgcttgcagtttcttgatataattaaatagtagaataaggaatatatctatagaaataaggtcttgaaggtgaatgaaaaatcattttcgagacttttttattattagaaataaatgaacgtaaaaaatatttcaaatcaatacttgacataataggtatgacgtgatattttataaccataaaggcggaatgtcatatatatttcaacattaatgatgaaatgaactgtacaagatgatgtaaaggaggtataatgataaaagattaatttgtgtgatttgaaactattaaaggatagatatttagtatgacttggaggaaacaggtatgacattagaaaatatagcaagtgtaacagcaggacagattatgacaagggtgacagctgataaagatgctggcaatcaggttgtagaaaatgtgaaagtattagttcctaaagcgattgtatcgggtgtaattgtaaaagaggatttaggcaaagcagaacttggtaagcagattgatgaagaaaaatacacacataaaggggatgtggtaataaagctttcaacaccatacgatgcagcatatgttgatgaagaaaatgcagggcttgcaattccatcattttgtgcagcaataagaattactgatgacgataagatggatgctatgtatttggcagcttttcttaattcgtcatatgtaagaaatgagcttactgcaaaggttgtaggttcagcaagaccaatgattaagataactgatattagggctttggaagtacctgaacttaatatgaaggacatgaaggatataggaaaagcttttgtacttagtggattaaagaaagccactcttcaggaaatgatagataatgaaacaaaactgatggaaaacgttgtattagcaagcataaaggagggcattggtaatgaagaataaaaagctagaaaatctatgggttgctgcgaataaattacgtggagcatttgagatgacagaattacataaagtgatgctttatggattattatttaaatatcttgagttggagaaggaaaaattcagtttttatgatgaaaaattttctcttggatatttatcgttgacttacggaaaacttgtagattctaatgggttattacaatatgtaagtgcggttgaaaaagagtttagaatcgaagaaggtgtgttgagagaatcttttgattcagctattgagaaggcggatgttgaaaatgtgagaattatttttgaggaagttaatagtttggatattgaagatgagattgaaatctataatattgcaaaaataatattggatagaatgattataagcggtggaggacgagcaagcggagagtattgtagggctgaatcattaccggaaatcgttaaagctcttattgatgtagaagatgatatgtcagtatatgatgcatgttgtggaactggtattttggtaaattctgtagcaaatggtaaaggaagggtttttgctcaagatattaatgtttcaattataggcattgctgctattatgacgattctaagtggtaacaaaattggagcagtcaaatgtgcagattccttatataatccaatagcgcacaatgagaagtatgatagaattatatttgagccaccatttggtggaaaatatagcaaagagtatataatgaatatacctcctgaaaattgcatgtatgaacataccagcgattcacgatatctctttatcagacatgcacttgcttcattaaaggataatggaattgctgctatacttgttccaatgggagcgttgtttagttcgggcagtacaggtagtattagacaaaaactggtagatgataattatattgaagctattattgagtttcctaatggtatgatgatgccatatacagttatccccactgcgttggtgattcttagaaaaaacaaaattaatgatgatattgtaatgataaattcaaaggatttctttgaaaaaataccaagagcagtaaccatttcagatgaaggtgttcaacgcattactgaaatatatcaaaatcgtgaagttattgagggagtatcaaatactatcacgaaagaaatcgcagcagaaaatggatataacttatgtacaacgcagtatgttacacttaaagcaagtgaaggaattgttgtagaagataacagaaagtttattgaaaactatgaggaattactacagaaactgagaaatattgataaggagcttgatgaagtacgtagtcggtttgtaaaggaggtttgattatgagtaattttcaattcttggaatcacattggacagaccttgccaaacttggagatttatcagaaaagtatgtatattctgaccccaatacatccatcattaagcagggtatattatcagaagtaatggtaaagtatatgcttgcatatgacggcatagcagagccggcatatgataatacacatgccaacagaatcagaatacttaagaataatgatttgttaccaagagagattgataacactttgtatattcttagaaaagccagaaatgatgccgctcataatgctgctgatgaaggtgaaaaagctcttaataatttgcagttaatgtatgaattatgtgtatggtatatgcagacatatggtgattataattatgagccgacagggtatgtacagccagttgatatgactgtatgtttagctgaccttgaaaaagaaaatgcagaactggaagaacgcaaccaacaattattgattgaaattgagcaaatacagaaaaatggtggggcagacagtaaacgtagaactgtagcgtaccagaaggcacttaatgtgcatttgtcagaagcacagacaagagaacttattgatgagcagctccgaaaggtcggatgggaagctaatacaacggaacttagatattctaagggtacaagaccaactaagggaaagaatcttgctattgcagaatggcctaccgattcaaatacaggaaataatggctatgcagactatgctttatttataggggaaaagcttgtaggtatagtggaagcaaagaagaagcatacaaacatttcatcagtgttagatggtcagtgcaaggactatgcaaagatgattaaggcagaacaccagaagtatgtaataaatagatttggtgcatatatggttccgtttctttatgctaccaatggcaggccatatattaagcagtatgaacagatgtcaggaatatggtgcttggatgtcagagaaccatttaacgcaccaaaagcattatctggatggtcaacaccagaaggtattgagcaggcactcgaaaaagatattgtagaggctgataagaagttagctgctacaggatatgaagtattgcaggaccctgatggtctgaatcttcgttattaccagattgaggcgattcaggctgccgaaaaagcaatagcagaacataagcagacagcacttcttgccatggctacaggaaccggtaagacaagaacagtacttggaatgatttatagattccttgatgctgggagattcaagagaatactgtatcttgttgatagaacatcactcggagatcagactatggatacattcaaagaggttaagcttaaagaactgcttactttgaatcagatgtatgatgtaaagtcattagaggataaagagtttgaaaaagataccagagtacatattgctactgtccagagtcttgtgaaacgtattatgtataatgattccgccaaaggacttggtgtgtcagattatgacctgataatcgtggacgaagcacacaggggatatattctggacaaagaaatgggagatgatgaggtactgtatcgtgatcagaatgacttccgcagtaagtacagggcggtaattgattattttgatgcagtaaagattgcacttacagcaacaccggctcttcataccacagagatatttggaaagcctgtatattcatatgattatcgtacagcagtcattgatggattcctggttgaccatgatgcaccacatattatcaaaacaaagctatcagaggaaggtatcagctttgaaaaaggctcaacagtaccgatatatgaccctgttacaaatgaaattacaaacagttcagaattggaagatgacctgaaatttgaagttgaagattttaataggcgagtggttgacaaaagctttaatgagactgtcttacaggaaattgcaaaggatattgatcctaacgaaaaagggaaaactcttatctttgcagtagatgatgctcatgcggatatgattactcagatattaaaagattattacacgaatcttggaatctctgaggaagcggtcatgaagattacgggctcaatcgagaatggtaatccggtaaagataaaggaagctattcggagatttaagaatgaaacgtaccctaatatcgttgttacagtagatttgctgacaactggtattgatgtagaggaaattgtaaatctagtatttatgagaagaatccgttcaagaatattatttgaacagatgcttggaagagccaccagattatgccccgaaatcgggaagacacattttgagatatatgatgcggtaggtgtctataatgcgttagaacctgtttccacaatgaaaccagtagtagccaatccggcaactacatttgatgatttaattgatggtattgattcattagataccgacagagcaagagcgaatcagattgaccttatcgttgcaaaaatgcgtaggaataaatcacagatgagtgatgaatacagaacacaatttgagcagataacaggaggtttgacaccagagaaatttatagagaaaattcatagtatgccagtcgatgaggcaattgagactgtaaagaataacagagcggcattggaatatgtacgcaggatgccaaaggagagagaaaagttcataagtgatgagccggacgaacttcgtagtcataccagaggatatggtgatgctacaagaccagaggactatctgaaagaatttagggactttattgataacaatatgaacgagatagcagctttaaatatagttgctacacgaccaaaggaattaacaagacagtcactaaaagaattgaagattattcttgatggcaagcatttcaacgaaactatgctgcagacagcatggaaagaaatgacaaatgaagatattgcagcggatattataagctttattcgtcagcgaagcattggagatgctttgattagtaaagatgaccgtatacataacgccattgtaaagaccaaggctaatcatccggagcttagcaaaattcagttaggatggttagacagaattgaagcccagcttcttaaggaggtagtgctcaacagagagacttttgattcggatgcatttaagaacaaaggtggttataatgcggtaaacaaggcatttgggcagaaattagatgagtttattgatgaaatcaacggatatatgtattcagcataaattacaaggagagaatgatagatgacaaatcaggaaatagtagcaaagttgtggaatctctgtaatgtccttagagatgatggtattacatatcaccagtatgttacagaacttacttacatcttgtttttgaagatggcaaaggaaacaggaaccgaggataagatcccagagaaataccgctgggatagattagtagaaaaagatggacttgcgttgaaaaaattttatgaggaacttcttcgtgagcttggtgaaaattgtaccggacgtatccaggaaatttattcaggggcaagaagtaatattgaagagccggcaaacttaaagaaaattattacaaacatcaatgatcttgactggtattcggcgaaagaagaaggactcggaaatctttacgagggattattagagaaaaatgcaaatgagaagaagtcaggagcaggtcagtattttactccgagagtactgattgatataatgacagaattaatagcacctcagccgggagaaagatgtaacgatcctgcatgtggtacatttggatttatgatagcggcagatgcttatgtaaaggcgcatacagatgatttatttgctcttgattcggaacagcaggcatttcaaaagaatgaagcatttaccggggcagaacttgtacatgaaacccataggctggctcttatgaatgcaatgctccatgatattggtggtaagatatatttgtgtgatactttatcaaatcagggtaagcaaatgaaagaatttgatgttgttcttacgaatccaccttttgggacaaagaagggtggagagcgtgcgaacagagacgattttacatttcagacaagcaataagcagcttaatttcttacaacatatttatcgttcacttaaagcagatggtaaggcaagagctgctgtggtattacctgataatgtattatttgctgatggtgaaggtgaaagaatccgtgaagaccttatgaataagtgtagtctccatactgtacttaggcttccgacaggaatattctatgctcagggggtaaagacaaatgttcttttctttaccaggggaacaacagataaggataacactaaggaagtgtggttctatgatttaagaaccaatatgccttcatttggtaagactaatccgttaaagccagagcattttgatggattcaaggctgcatatacagcagaggacagaaagaatgtgtctgatgagagatggagctgttatacatatgaacagatatcagaggaaggaaagaatcacagccttgaccttggattgattcgtgatgattcggtactggattatgatgatttaccagatccaattgaatctggggaagagtgtattgcccagctggaagaggccgttgatttgcttatgagtgtagttaaggagcttaagtttctggaaggggctgagtgatatggcaaaagcgaagagtaaaaagattatgttggaggacgcccttgttcctgtagatgagcaaccatatcagataccagagaattggtgttggacaagaataaagcatgtgtctgatgttgtgactggaagtacaccaagtaaaaaacatgctgagtattatggtggtgattttcctttttttaagccggcagatttagaggctggtgataatgttgtagaggcaacagaatatttgtcagaagaaggcaaaaatgtatcaagaattattccaaagttatcaacagcagtatgctgtattggttcaattggaaaaactggattgattagagtagaaggcactactaaccaacaaattaattcaatgatacctaaaattaatccattgtatttgtattattatagtaaatctaatgtatttattgaagaattgtggaataaatctacggccacaacgatttcgcttgttaacaagaagaatatggagacaaatacaattcctcttgcgccattagcagaacagaaaagaattgttgagcaaattgagagtttgttttccaagttggatgaggcaaaagagaaggcacaagagatattagacacttttaacgacagaaaagcagcaatactatataaagcatttcaaggtaatctaactaagcaatggaggaaagaacactcagatataagtgccatagaatatttaaggaaaatagagaaaagtggagaagactttagtaagaaggagttcaaattttgggagagtaatgaattgcctaaaacttgggctgaaagcaaaataggtaaccttttgtattttgcgggaaggataggatggaaaggtttaaaggctgatgagtacactgaagaaggtccattattgttatctgtttataatttaaatgatggtgatgaagtaagttacaatagagtatatcacattacaactgaaagatacgaagaaagtcctgaaattatggttgaaataggagatgtattgcttacaaaggacggcgctggaataggaaaattgggatatgttaaagaattaccgcaagaggcaactattaattcttctctattgttgataagaccaggaaacaccgcaatatcaaagtatatattctatcttctttcaggtccagaattacaaagtattgttaagaaaagaattacaggaagtgcaacaccacatttattccaaagggatattaaggaatttacaattccgataccaccattagaggaacaagaggaaattgtaagaattttagatgatgtattagagaaagaaaaaattgcctatgaatctgctgaaaatgttatttctcagatagaattaatgaaaaaatcaattcttgccaaagcttttcgtggtgaacttggaacaaataatccagaggaagaatcgtcaagcgaattgctgaaaagtataatcgagggggagaaataattatgctcgatagtattattaattggtgttcgcataatattacctacacaaatattagaaatattgcagaactgttctattttattgtattgactggagcaatggtatattatgctgcaaagtcttatgaaaaaagtgttgaagcaaaacctgaaattatttcgcatatttatattgattataaagataggcttgaaaggggacaaagttgctatccattgtatttagaaatatataacaacggaactggagctgcaaaaaatttgaaaataacgacggataatgttcagctaactgagaaattctctatttttagtaataatttgggatttatacagccaggaaattcaaaatatgttcctattggttcattgaacatgacgatgggccccaattatttatctgtatttgatggagtactgaagcaagaagaacttgataaaacatccttttttattgaatacgataatcataaaaaggagaaaattgatatgaattttgactacgttatgagtatgccacacacaccattaggaaagacaacagaggaaacagtagaagaaaaacaggcaaagcaagtcgaagtaattagtaagaatattgcatcattgaatagtagtcttgcaagcattgataagaagattaaaaagtaaaatttgacttcatgaataaaagcactatcgctggtgtgtgatagtgcttttactaggtggttaaacagctctttttagtgttctaaaaatctagatcagaaaaataagtttggagtatgtatttttgtaagtctacgtctttttttattaaatctagaattctattttcgtatttgtcaactattatttttcgagctaaatctttggttaagcatcctttgaagttgacaaaacgaagtgcagaattataatcttttttttcaatgaagttgttgattttcgtgatggtgtcatcataaagggctttgatataatcagtagacgtgatgttttgtaattcgcatatcaaaaaattgatgtcgtatttttcatgcaaaaaattttttttgaataatgccatgagatgctgtgggtagggaagatgaataatattattgcttgcgcggaggaggttgtggtgatggaggtggtgtatgtgtgatcggtaaaaataattcgctgttagcgaaaaaagatattgacaattaaattatcattcgctattatataagtacagcataacgatactatttgtatcgaggtcaaatcccataaattggagcgcttagcgcttgaggaacattcttaaatgtggatgttctactgttaggggccggcatgttacgcaaagacccgtagcacgctgcaagcaccgcacgctctgcctcgctcggggagctcggcagagctcaaagggttagataggttgttctgtatgcaccacacttctttcggggtggaagttgtacactatattaccaacttctaaaggagtgaattatatgaaaaaaatgctgctcgtgcagaatgtccgaatgacacctcagaaacctaacaaaaaatctgagaaaaagcgtaagaaactaagaagcaaaatttttaaatttctgtttcaaggaatcgaagcaatatggatgctggtacagataatacagtatgttcttcagatttttaagtaaagaggtggctatggaaaacctatctaattttgattattcgtcgtaagactttatattatataaattattttcggaaggaggaaccggcttgatcggagatattttaaagcgcacaagaacaatatatggttataaagcatctgaattaagtgaattgcttggtatttcaaaaagctacctttccgaaatagaaaataataaaaaacaaccttctttggaattacttgagaagtattcaaagatatatgatatgaaattatcatctttaatattgttgtcggaaaattatgaagaggcaagcaaaagcaataaaggtgataaatttattagaaatatgatgattaagcttattgaaaaaatgacacctgatatggaggagtaatgcgggaaaaaagccataagtatgatattacacagtgtgcattatataagataaaaggttccaaacaattgaaaaaagttctttgtataactgaagaagaatataaagatatattatctattgtacattatcatagttttcaaattgacaaaaaggatagtacagagaagagaaatattacagctccagataaaagaattaaggaaatacaaaccagaatattaaagctattacagaatgtggagagacctatatggctaatttccggagaaaaagggaaatgctatatagataatggaaaaagtcatttaaattcaaattattttttgacgatggatatcaagaagttttatgataattgttctagagaatatgtttttcttttctttaagaaccgattgatgatggcaggtgatttggcaggattatgtactgatatagttacttatgatggaggaattccgacgggatgtcctaccagtcagatcattgcatattatgcatatgaaagtatgtttaacgagatatatagtgtagcatgtaagtatggatgcgaatatacggtatatgttgatgatatgactttttcagcaaaagagccatttgatataaatcgaatgaaaaatgaagtggattgtattttgagaaaatatggacataaacctaaatataaaaaagtaaagtattattcaaaaggcaagagtgttccgataacaggtacgattgttacaggacagcatgaattgaaagttccaaatagattacaaaagagagtgtatgatgactttcaagaattgaaatatcttggcggaaaagaactgtcagatattgaaatcagaaagctgaatagtttgaaagggagaattttagcttcgagaaacattgaagaaggaaaatttccagaaatcaatcgattaactaatttgataagctgaataaaaaataatagttgaaaaagttttttttcgaccatataatataagtgaaggatacaataattgtgtatgagccatactatagaaggaggtgttagatatggcaacttcaagtattactaagaactttgtcgtttctggtcaaagacaagtagaaaagtttgctaatgctatcgaggaatcctatcaggagtctcttcatagagcacaaacaccagacttaaggattacacatttgcatggcgcagaagaagttagaaaatttatggcaaaaaggaagaaaacaaatgcttaatgatgtaacagtctttaacattcgtgaatacttgtctgccaaaggcgataaagatctcggagaggatgagttacgacaactcctttccgagtttttttgtgataagaatccggatgtagagagatttttgaaagaacaatcaatagaatttacaaagaaaaatcagtccgttacatatctggtattttctaatgaagatgcttcattagttggatattttacaatcacgattaaaccaattactgtaaatgcagaaaattttagtaatactatgaaacgtaaaatagccagagtaagtgaattggatgaagaaaatggtacatatacactttcagcatatcttattgcacaattgggaaagaactttaaggatggagctaatgagaagattactggagaacagttacttcatgcggctgtagatactataaaggaacttcaatatatggctggaggaatggtaattttccttgaagctgaggataatgataaattaatgcatttttatgaagataagaatgggtttaagcagtttgatgtccgagaaatgaaatgtagggataaggatgagattcataaattggttcaattgttgaaggtaatgtaagataatacatgaaaacgcagtatatgtatgattgcaaaatgcttgcaaaaagcctcaaaacaatgaagaatacatagaatatcaagaataattatacaaaatatagcaatataacgcttggttagacacaatatatagttgctgaaatcgagtttgaatagttgaagctgagctgtaaagcctttgtttacaagggttttacagcttttcctttataggattgcattttcattgcattatttttcttcaactgttctgtgatagattgctgtatgttgattgctggtataattagcaatgctttcagtagcagattgtacttgtaatattccagtcagctttttagcaacttcaagattcgtatttggatacagatgaccataagtgccgagtgttgtctgtattttttcatgtcctaaacgttccttgataagtaaaggattttcgcccatgctgataagcaatgaagcgtgtaaatgtcgcaaggcatgaattttaatacgatgaacacctgctaaatttgacaacttttccaaagctctgggaagcgttgttttactggttggagttccgttataacttagtacaagtggacaatcgggaagaacctgttgctgaacactttgccaagcctttagctcattgagtgtatctgaatcaatataaatagtacggatacttgcctgtgttttcggctcaacgaatttatagtccgtcattgttcggtaatatgatgttttggtaatgctaagcaagcctgtttcaaaatctatgtctaaccaatgtaatgctgacgcttcgccaattcgtataccagtcataaataataaccagaacgatataaacagataatgttcataatagtctttcttacagagtaaggaaataaccttttgaaattcttctaatgtccagaaatcaactttggttttcttgcttttgatattgcctatcatacgagaaggatttttcttcgcaattccaagaacaatagctctgtcaaatgcgatagaaagcattccctgtacgatacgaatgtaattagggttaaaatcttttgcaagtttcaactgccagttttgaacatggataggttcgatttcgtctgtttccattttgtagaaataggaaaagtgtttcttgatggtagtagcacgattaagaaaagtgctttcttaatagggtcttttgccatgatttcactccttacatgatatgcaagaagtacaatcaatcgtttgtgtctgataatgtaatccctaataattcttccacggcttctttgggtactctgtccaatttacgggattggtaataagtatgccctttttcaatcataagtttttttgcttttcttatgatgtctgccgatgtccactcttcaatgaattatcatacgaatatatcttcaatactttataattcaagagtaataataaggctattggcatgtacttttgcaacaatatttccgccaagaatggccacaagtgtttttactaccgcaagtcccaatcctgtacttccattatgtcttgatttatcgcctgtataaaaacggtcaaaaagtcgattgcaatcaatttctgaactgtcactcattggattttcaatggtaaatataatattattattttctttttccataagtgttatttttatcgttccaacagaatacttaattgcatttgtcaacagattttgtaaaattcgttctaccatatttttatcagaatatacgtatattgaataatctgggagatttatttcgggtaaaatattctccttttctaatgcaacggcattttccgtaattaaatttattaacgtattagatatattaaacttttctttttctggaactgtctgctgttcctccaaaatagaaaggtcatagaatgtttctaccaattctttcatttttccggctttgctaaaaatcacttttacacgctgtgcttgactggattccaaattttctttttgcaataattgtaaatgaccaagaatgactgtaagaggtgtacgcaaatcatgtgatatattagcaacagattcttttaaatactcttcattgcgtaatacgcctgcaacagcctgtcgttgtctgatattatattgattcaatataccagccagtttttctaaatctttatcaatcaacgaaatgtctaacatctgctgtgaatttccagaattcaattcattaacttgatccgcaagattacggatttgtttttttaattgaatatatcgaaatagcagtattactaaaaatattattatgataattaaaatccattctatgttagacattttctccacctatttaaaatcacatttacaaaattttatccacgaaagcaataccaatataccagaccatatacatcctactaaaatagctatcggttgaaaaaaggttttcatgctgacaacgattctgatttgataagtaggtaaaaaaccgactggtaatctcaacatcattccatagccaagatataagctaagaccaaaaataataattgctgtaaccgaagttgcttttacagcatcctgtaaatagcaacaaataagtattgcaattagaaatatcgcactattaagcagacaagaataaatgattgcttttataatattgtaaaaaaacattcccacgtctgcaacaccaaagcgtccaaattcccttatgcaccctgaaactggatagacaagagccataagattaaaagcaattaaatacgatattattttacttgtaaaaatttgttttctggaatgtccagcactgacctctaagtttattgttctcttagaaaattcctgtcctaaaatcaatgcaagtatagccgacatgatgataagaagaaacgtagaatcatacaccattccattaaaaatatcagcaagagaagaagcaatttcttctgtcggtcccatgacctctgtaacataagtatctgctgtaaaaaatcctaaaataaatattccaatcataccacaccagtaaatagaattatgtaacaactgatatttttccagttttaataatttatccataaaaaacacctccggttatttcaagtctgtatgtaaaaaagcactacctgcaatgaaatataaaataaaattccataagaaatctacaaacaagcaaaagtttgtcgaatagaccttttgcaatgaaattaacctaagttgtcccattggtattattctgctgattatttgtgcagattcactgttcagcaaaaaaatcataacaaaaaataaaaccattgaaactgtcagtgttttccccatatcacgaaaaataaaagcaaaaaacatcggtaatgcacacagtgttatcatggcaaacagagttagtaaaaccatagtatatgtgctatcattccaaaaaagtttttctccaatataaaattgactaataattccatgtacaaataatggaaataccagaatgatcatacaacctatttgagatacaattaactttactctaaatatagaacttcttttatgtccggcagtaatataagtatttaaagttcttccactaaaatcacttccaatgaacaatgctataaacactataatcaaaaaatagagtaacggaatattgtataatgatgccataattaagtttgaagagcgttctttactatctaacagcaatatgctacttaaaaggagattgaatattccaatttcccaaaaataccaactgtgaaacaacttatataactcagtttttaggagatttgacatcttttgttcctcctattttgctcaaaaaatagtcctccaaagtatcgccagatacagaaagtcctgttacaagaatgtgcgattctgccaaagcagacgcaactgtctctaaatcattcaaataatcatacaaacgaattatgccatctggcattagtttaaagttatctgtatgaagattctcttccaaaaccagaaccgttttctgaacatctgttgttttaattgctatatgtcgtttacaccgtttatttaattcataatcagaaatctcttctataatttttccatggtcaatcagaataaattctgatgctgtttgatacaattcttctaagatatggcttgaaaccaaaatggtcataccatattctttattcaaaatttttaataaatttctgatttctacaattccagcagggtcaagaccattgataggctcgtctaaaatcaatagttctggtgtatttaaaagtgcaatcgctatccccaatcgttgacgcatacctaatgaaaaattgcggacactctttttacctgtatcttgcaatccaaccatatctaatgtccttttaataactgatttatctggtatgcctcgttgaatacgctgtacttccatattttgataggcagtcattgacgggaatagagcaggcgtttcaatcatacttccaattcgtttacgctgtttctgcaattcttctgttccagaatttccccataaagaaagtgtaccacttgttggaaacgcaagccctgtgactaatcttaaaaaagtagtcttacctgctccgttttgaccaataaatccataaatttttcctttttttatttgtaaatttatgtggtctaatgctaatgtttgtttatattctttggttaaagactttgcttctaaaataattgaactcatatcccaaacctcctttacttaaaccagtataacgggcaattttaaagaatttcttaaatcgtaatgagaaaagttaaaaaaataataaagctaaggaacgtttaatccttagctttatgtaggcggtagccaatgccccaaacagtatcaataaattctgtatcagagcatatcgcttttaatttattgcgtaaattactgatatgaacattaagtgtattatcttcagcaatatattctgtatcccaaacactttgaaaaagattcgattttgaaaatactttatctggatatttcatcaacaattctaaaatgccaaattctttagcggttaaggataattctattccattcaaaaatgctgtatttttctctaggtctaaagtcagattgttatgttgcaaacattctgtctggctattttgaaattgtactcttcgcagattactttcaattctggcaagcacttcttccatatcaaaaggttttgtgatataatcgtctgctcctagacgaagcaagtcgattttattttgtgtagtttctttcgctgaaataataataacaggtatcgtaaatttcttgcgtacatcagataaaataatatcaccactccgataaggaagcataatatcaagtataatcaaatcaattttttctttattcaaaaaatccagaacatgaagtccatcatattggcaatgcacagcatatcctttttcttttagaaaatcagccaataacgcatttatttctaaatcatcttcaataatcaatattttattcattagcctacctcattcctgcaatgctactttcccattatacatttaaggttgtatttcctcaataccattgcaaccaattatatgagagggattcttattttgtcaatctaattgtaagcagaatagtatagattggataaacaattatcatactactctgctgtaacatttattctacaatcttccagttatcgtccttatgaagcacaagctcatactgtgagatttgcgtcattttcgacttgttatccagatactttacggacacgctgactttgaggttgtcgccgtctttggtaaagacagggtttaccagttccgaaaatacatagtcgccggatacaggagcaatcacaccgtctttgacatagtaggcaagttccttttccgtagctgtcggatagagcttaaagaatgtttccaagaaagcggtagcgtccttaactgtgtcggaactgacactgacatcgacttcctgtactttcggttcatactttgatttctgtaccgacggagcaagggtaggattctgggtaatgaccattgcaccgtccttatctacatgaacggtcacggtatagttttctgtgactgcctgtgtctgttctccctcttttacctgctgatctacttcgtaggcaacggtaaaatcgtccgttccagactgttctacattccagaccagcacatttgtaaccgtaacactggttggtatgtccgttctgatggtatcagcgttcaagtcctgtaattctttggtaaggcagactgttttttttgttgcctgcatttagaaaaaaatacgtaaacgctcaataggtaaatagtaggtaccacgatttttgctagttttcatgagataattactttaaaaaatctaaggttttttagagggaggataatctcatggataaaataactcataaagtccggtgtgaacaatggacaagtatcatcaaagaatgtcttgctagtggaatgcctaaaacgacctggtgtcgagaacatggcatttcggacaaatcctttttttactggcaacgaattctccgagaagaagcataccttactacattagagagcaccttaacgcctgctgtcaagagaatccaactccaacaactacagattttattgaaatcaaaatgactgatcaagcaagttcatctaccagtccttttaaaccggatgttgttatccgaagaggcgctgtttcaattgaaatatcaaatacagctacggaagaacttctaaacaaggttggaggtcttctccatgcttaatgatgctgttggatttgaaaaaatttttattgctacagggtatacagacttacggcgtgggattgatggtttggcatctactattaaatttcagtttgacttggatccttttcaaaagcatatcttattcttgttctgcggaaaacgcaccgatcgaatcaaagggctcgtttgggaaggcgatggattcttgcttctttataaaagattgaacatcggtggctttagctggccgcgtacaaaagaagaagctatggaaattacaccagagcagtttcaaatgttaatgcaaggattgtccattgttgcaaaatatccgatcaaagaactgaaggatccacctaaaaccatgtagtattgtgcaattcgtagaaaaaatattttatttaaaaaaatagttattcacaaccagaatcttatggaaatgattcttgttattaaagatacatttgatgcaagctgtcaaagggagaaagtctcgacagtgatatgaacgtgcaggagccagtgaatgtcatttatcagactattatttcagttaagtcattgtgtttttcttccattgtgatttctactgatgcattggcatacatcattttagaacacgaagagaaaaatacaatgacttttctatctgactaaaaatggttaattctaagcggctttaggtggtcaattttccccgcccctaacaaaagattattttgtgtatattctatcttgttttgtttatggtgcatacatatactaaatggtaaaattaaagttaatttagatatcatttgtgacaaagcgcacttcaagtttatcagggcgtgaataactttctgtatattcaactaaattaccattttcatcgtatcctatgaattcaatatagttgacgatagaggtggcacttggaagatgaaggtgcttttgaagtttttcgccagcttctaccatcatcattgtctcattaaattttacaggcaaatgatttttggatttcatataatcataaagcgatatgtgctcaaaattgtaattatcgatatctgaaaaaaaatgaataggaacataggtaaactcaattgcaagaggttccttgtttccaagacgaattcgatgaataccatatatttcatcttcttcagaaagtccaagtttatctgcaaagtattttttgtttttgattatacctgtgcctaagcatttattggaaatttcaataccaaagttacgaactaaagaggtaaagctggcattttttgattcatttagtactcctaaagcaactcgattttgttcgggtttgcggacaaaagttccctttccttgaacgcgaattaagtaatgttggctaattaattcgtcaaagatgtcatgaatcaaataccgacttacactatacattgttgcaaaatcccgttcgctaggaagcaactccccaggaagatattcctgtgttttaatttttgtaatgatactagattttatttgtgcggctaatacatcatcattgctcataaaactacctccctgataaaaccaaaacgatcaattagcatattattttcaaaaaagactgcaagatgtccttgtttatcatacatgagccctttgtatttcattaaagggctatcaacaggaatatttaaaatttgagcagtctttgtgtctgcgtaaagtaaggtgactttttgattcgattttgccaaggttatttgacaattgtttgtaatcaaatcaattgcaggagcagaagcagcaatttgttgggtgagatctggatagatatattcaggaatataagttgtattgatacaaattagttgagtatcatctgaataaagccaaacaattttgtatattttcgatttttcaggaagtaacatttcgcttgcaagatagttatctgcttctatttttttgaaatcatataattcgtaagttaattgtccgctatcttcctctgaatgtaaggaaaaattacgaatggattgtaaaatgcgtttaggtgctacgtaataaccacttcgtggttttgagataattgttttatcttgaagtaacagatccaaggctccacgaacagttaagcgttgtacatgaaacagctctgccagctttcgttccgaaggcagtttgtcacctggaagatagtgttcttcctttagcatgtatttgatttcttttgataatgcaacatctaaagttaataaattttttttcataagaactcctaatattataatttacttgtaaattataatcaaattatacgttgtcagttcttaaaaagcaaatggaaaggaaaaaagaaatgaataaataaaaaataaatataaaaactggtatagtaaacttgaaatgcgtttcataccagaataaaagaaatatatgcattgtgtataaaaaaaagcatttatatttataaaaatacaacaatatttaatattctttgcgtgaaatattgaaaaaaatgaaaaaagtggtatattaaatttaaaaatagtcaccaatataaaagaagggaaagggaaaacactatgttgaaatttaatgaacagaaacagattgaaagtgtgaatggagcgcttgctctgagaaatcaaattaatgaattgattgatgggatttgtaaagaaggatacaagaatatttgttggctcggtatcggtggaacatatgcatcttgcctccaggcagaggttcatatgaaagaaaaatcaaaactttcattttttgttgaaaacgcagcagagtatttgacaactggaaataaaaaagttggagaaggaactattgtaattatttcgtctgttacaggaacaacttctgaaatcgtagatggagtaaaaaaagcacagaagagtggagcaagggtgattggttttattgatgttgctactgcagaacttgcaaaacttgtagactatgtgattacatatcctgccaatgaacaattgaaattttatatggtagcagatagatttatgtacaatgcaggagaatttccagaatatgaggatttatacaaggagttggatcagtatttggcaactgcacttgtggaagttgaaaaggaagcagatgctttcggagaagaatttgcaaatcgtcataaggacgacaaaattcattattttattggggctgggaatcagtatggtgccacatattcttatgcaatgtgttattgggaagaacagcattggattcgtacaaaatctatccacagtgcagaatttttccatggaatgttagaaataattgacaaagatacaccagttacagtatttattggggaagattctcagagatcattgagcgagcgcgttgcaaacttcttgccacgcatttgtggaaaatacaatattattgataccaagaaatttgaattaaaaggaattagtccagagtacagaggatatatatcacatttagtgatgcatgcggtaacacagagaattgatgtacatatggaaaaagtcaattgtcatcctatggaaatcagaagatattacagatgtctggactattaaggtggcaaaatggacagaaagataagagtagcagcaataggagataattgtattgattattatgattcattgaatgaatcatatccagggggaaacccagtgaatgttgctgtatacataaaacgattaggtggagaaagttcttatacaggtgctgttggaactgattcattcggaaaaatcatgataagtgcaattcaaaataaaggagtcgatacttctcatattcaagtgctggatggaaaaaccgcagttacacatgttgacattgtagatggagatagagtgtttggaaaatatgaagaaggtgttttggcagactttaagctaagagaacaagacatttcctttataaagaaacatgatttagcggttacaggaatttggggaatgattgaagatgagcttccacttatttcgaaagaaattccagttgcatttgattttgccaataaatttgcaaatccaattgttgagaaagcgattccatatgtgacatatgcattcttctcttttgacgaggaatcacgcaatgagtttagacagaaatatcatagcatgggcttaaaagaaaaagaaaattgtacggaacaattaaaggaattcatgaaagcaatgcaacaaaaaggacctaaagtcattattgcaacattggggaaaaatggaagcattgggtatgatgggaattcttggtatcgatttggaatcatagagtgtaaagttgttgatacaatgggtgcaggcgacagttttattgccggatttttatatgggattttgaatggattgaatgttcaagattcgatggaagcaggagctcagaatagtgcggtaacaatagggtataaaggggcatggtagaaggagaatataacaaatgagaaaaaaaatagtggcaattttattggcagctacgatggcaattggtattacagcatgcggaaatcaaagtgaaagcaataaagacgataatacaattacagtatggtgttgggacaaaacatttaatatttttgcaatggaagaagctgcaaaaatttatcaagaagatcatcaagatgtgaaaattgatattgtcgaagttggagatgtagatgtacagtctagacttactacggctggtatatcaggagatctaagcacattgccagatatttttttgatgtctgaccagtcattccaaaaaaatgtaatatcttatccagatatatttacagaaatttctgaaaagaaaattgatttttcagaatttgctcctggtaaaacagatttttctgttgtagatggaaaacactatggagtgccttttgacaacggagtagcaattgcttgttatcgtacagatattttgcaagaagctggaatgactttagaagattttacagatattacttgggatgagtggattgaaaaaggcaaagtagtactggaaaaaacaggaaaaccattattgacaacgacagcaggcgaatgtgatttgcttacgatgatgttacagtctgcaggagcatctttgtttaatgaagatggaacagcgaatattgcaaaaaatgacactttaaagaaggtaattgatacatattgtaaaatgaaagattcaggtgtgttacaggaagtaaataactgggatgaatacactggctcaatggtgaacagtgaagttgcaggtgtgattaatgggtgttggattatgggaacaattcagacagctgaggatcagtcaggaaaatgggctattacaaatattccaaaacttacaaatgtaaagggtgccacaaactattcaaataatggaggttcttcctgggcaatctcagggaattgtggaaacgtagagttagcagaagattttcttgcgtctacatttgctggaagtacagagttatatgataatattctctcttgtggagcaatttctacatggacaccagcaggagattctgatgcatatgcagtaccgaatgaatttttctctggtgatgcagtgtttgaaaaaatagttgactattcaacaaaagttccttctattattacggggccatatttcaatgaagcaagagacgcaatctctgttgcgacaacaaatattacaaatggtgcagatttagagaaagagcttaaaaaaacggaagatactgttaattttaatatgggacagtaaaagagattcctatcatacaaggggatggaatgtagaaccatcacccttatggatagagaggaggagtttttgtgtctaacaaactaagaaaaatgacgttggaaaaaaagcataatttaacaggatgggcttttttggcaccagcaacatttttgattgcggtgtttagtttttggccaatgatcaaagcgttagttttatcttttcagacggggaaaggtagaaatatgcagatggctggatttacaaattacatcagaatgtttcaagatgatgtatttattcagtcaataaaaaacacatttttttatttcattcttcaagtgcccattatgcttgtagtagcgttggtgttagcttgtattctaaataaaaaagacttacggtttaaaggatttttccgaacaatgatttttgtgccgtgtacaacttcattggttgcgtattcaattatttttcggtctttgtttgcaaataatggattagtaaattatgttctagtgaatattggaattttggataaaccatataattttttgacacaaccatttgcggcaaaaatggttatcttattgggtcttttgtggagatggacaggatataatatggtatttttcctttctggattgcaaaacattgaatattcagtatacgaagctgcaaaaattgatggagcatcagcaatacagacattttttaagattactgttccattattaaaaccaactatcttgttaacagcaataatgtcaacaaatggaacattacagttatttgatgaatcagttaacttgaccgatggaggtcctgcgaatgcttcaatctctatgtcacattacatatataatttatgttttaagtatgtgccgaattttggatatgcagcagcgatgtccttcttcatattactgttggttgcagtattagcatttatacaaatgagggtgggtgataaacgtgattaaaaaaatgaaaaatataggaatgtatgcattcttgattttggttacttttatttcagtatttcctttgtactggatggtaagtgcatccacaaacaaaagtgtggatgtatcaaaaggtgtattatcgtttggctctcatttgggagaaaacttcaaaaatctgctggcaaatcaagatgtaggggctgcattggtcaattcatttaaatatgcaatattacttacaatagtttcgatggtgatatgttccttggcaggatatggatttgaaatttatcatgataaagcaaaagatgccgtgatggatgtgattcttcttgcaatgatggttccatttattacgacattggtcccattgtttcagatggttgcaaaaatgaaaatgttaaatagtgcgttgggattcattttaccaacggtatcaactccatttttaatcatgatgtttcggcagagtgcaagatcatttcctcttgatattattgaagctgccagattagatggactttcggaaattagaatcttctttcagatgtttattcctacaatgaaatcaacatatgcagcggctatgactattacatttatgaatgcttggaatagttatatgtggccgaaagtaatcatgacagaatccaagagcatgacaatgccaatggttgtagcaaatctgacagagggatatgtaacagactatggaatgcttatgttggcagtcttaatatgtacattgcctaccgccttagtattctttattttacagaagagttttgcagaaggtattactggagctgtaaaataataaatgatatctataaagaaagggattagaaatggaatataaaaaaataaatatgccaggtcttctgcatggtggagattataatcctgaacaatggttagatagaccggatattcttgaagaggatatccggttaatgaaattagcgcatgtaaataatgtttcactaggaatattttcgtgggcatttttagagccagaagaaggaaaatatcagtttgactatttagaagaaattattaaccgtttatatgacaatggcatctatacaaatctagctacaccaacaggtgcaatgccaaattggatgactcaaaaatatcctgaagtaatgcagacagatgaaaacgggatacagaatttaccaggaaaaaggcataatttttgttacacgtctgctgttatgagagaaaaaactagaaagttggatttgaaattatcagaacgctttggaaaacatccaggagtaattctttggcatatatcaaacgaatacggaggaaattttagggatgcttcttgtcattgcgaagaatgtcaaaaagcatttcggaaatggttgaaaaaaaaatacaaaacattggatgcattgaatcatgcatggtggagtgcgttttggagtcatacttataccgattgggaacagattcattcaccttctccgaggggagaggatgaattacacggtttgaaattggactggaaaagatttgtgagcgaacagttacaggacttttgtagagaagagattcgagctgttaaaacatattcggatcttccagttacaaatatggcatggcataatgtgacgaatgcggcagcgaataatgcggttcagcaggtacttgcatcaaccagtggacttacgacgatcgcaccaacctggtttagtcttgcggatacggaaggtaatatcagttcaattgcagatgcggactatgtgaattatgcacatacggcaggactggaagtgtgggctgtattccgggattttcatggtggaacgaattcctatgatgagacctatgagacattgcgttatacatcaaaaagagcaaaactggaagatcaggttgtagctgcggcagtggcagcaggagtggatggaattaatttagactttgaattgatttcttccaagtgtggtgtgcattacgtgcagcttgtgagagagctgtctgtgaagtgccaccagaataatcttgtattttcagttgataattatgtgccacagtcatacaattcacattatgatcttaaagagcaggggattgtggcagattacgtggtgattatggcttatgatgaacatacagaaggatcctatgaagcgggatcagtggcgtcgatcagctatttgcaggatggaatagaaaaaacattgaaaaaggtatcagctgataaagtaattgccggaattccattttttaccagattatggtttgagacagcaaagagcccggagcaactttcggaagaagctggcacagaagcagcatcctatccgaataaagtatcaagtaaggcactgggaatggaagaagcagcgcagagtgttgtgaatgcgggagcaacagcacagtgggatgaaaagacacagcaaaactatgcaaaatggtctgcggatggcggaacctaccgtatctggcttgaagatgctcaatcattggaagcaaagctgaaggtgatacaggaaaataaactggcaggtgtggcagaatggagtctgggaaaagaagaaagcagtgtatggaagctcatttctcagtatgtaaattaaataaaagataagttaaaaaacggcttctcattgcatatagatagaatatgtgaagggaggtcgttttttgcaaagaaaaatcaagttgatgatagggattctgattatgacagggcttatcgcaggttgttggaaagtttcgaaaaacttacagaaagaattaaaagaagaaatggagacaatcggagaagctgaaaagtcagaccggatagttgttttagatgcaggacatggtggtactgattcggggaaggttggaatcaatggagtgaaagaaaaagatatcaatttaacgattacgaattctgtaaagaaaattttggaaaaagaaaatatacaggtaatcatgaccagagaaacagatgaacagcttgcacaaagtaaagtagaagatttgaaatacagagtaaagattatgaatgaagtttctcctgtattagcagtcagtatacatcagaacagttatcatgaagaaaatgttttcggtgcgcaggtcttctactatcagacatcgacggaaggagaaaaagctgcggggataatacaggacgctttacaaaaggtaaatcctgataataccaaaaagataaaagcaaataatacatattatatattaaaaaagacggaagtacctacagtgatcgtagaatgtggttttttgagtaactataaagaagcacagaagctggttacggaagattatcagaaatcagtagcagaagcagtggcagaaggaattttgtcttatataaaagaaaatgaatagcataagagaaacagtttttttttagaacaaataatgatataataaaatttatggaaacgattattagaaaaatagataaaaaccaaataaaccaggatgtaatagaagaagcgggaaatgtattaaaacaaggaggtcttgttgcatttcctacggagacggtttacggacttggggcggacgcattaaaagaggaggcggcaaagaaaacatatgcagcaaaaggacgtccatcagataatccgttgattgttcatattgcagactatgaggatttgaaaaaagtggcggtgaatattccaccggagacagacgcactggcagcacatttttggccaggtccgctgacgatgatatttgaaaaaagtgagagtgtaccttacgggacaaccggaggattagatacggttgcggttcgtatgccaagtgatccaattgcagcggcattgatccgggcggcaggtggatttgtttcagcaccgagtgcgaatacatccgggcgtccgagtccgacgacagcagagcatgtgcgggtggatctggaaggtaagattgatatgatcctagatggaggtgcggtagatatcggattggaatcgacaattcttgacatgacggtagagccgccaatgattttacgtccgggtgcaattacagcggatatgtttgaggaggtaatcggaccggtcggtgttgatgagacattggttaacagtgaaagcaagcaggcgccgaaagctccgggaatgaagtaccgacattatgcaccgaaggcgaaaatgatgattgtggaaggaaatataagagaagagattcttgcaattcgtcagcttgcctatgccgcgcacagggaagggaagaaagtcggaatcattgcaacgggggaaacagttcagttctataattatgggattgtgaagaatataggaacccgtgagaatgagaatactattgcaagaaacctttatcgagtgcttcgcgaattcgatgaagaagacgttgatctgatttatagtgaatcttttgctatgaacggaataggaaaggcgattatgaatcgtcttgaaaaggcggcaggacatatgcacctgcaggcaacagagatcacaaagaagcagaagtatcgcagagtgatttttgtcagcgaggcggattcggcagtaggaccaatggcggcagaattactatgtcaccaggatcttgagcaagagtatattattgaatccggcgggctggttgtgcttttccctgaaccggtaaaccagaaggcagaggcaattatgaagagtgctcagatgacgttggaaaatcatgtgtcaaagcagtttgatggcagcaatctacaaggagatacacttgtattgacattgaatgagacaattaagaacaaagttctttcggattatgaaaatgtaaaaaatgtatatacaataaatgaatttgttggagtatcagaagaacttccgaatccttatggaaaacccctgacagcttatggagaatgttttgagatactgacagggcttatagataaacttgcagacaaactgaattcatatgcaaaaggagaagaataatgtcagataaaagaacagattatttatcatgggatgaatattttatgggcgtggcaatgctttccggaatgcgatcaaaagacccgaatacacaggttgggtgttgcattgtaagtcaggataataagattctttccatgggatataatggtcttccgatgggatgttctgatgatgaattcccatgggcgcgcgaaggcgaagatccgttagagacaaaatatgtatatacaacgcatagtgaattgaatgcaattctgaattataatggcggaagtcttgcgggagcaaaactttacgtatctctttttccgtgcaatgaatgcgcaaaagcaattattcaggcaggaattaaagaagttatttatgattgtgacaaatacgcggatacagcgggagtgaaagcatcaaaacgaatgatggatgcagcaggagtgagatatcaccagtaccatcgaacaggcagaaaaattgaatttgagatataaaaatacaggtacgcttgcattgcgcttgcgtacctgtttcaaagaaaagggagatagaagaaatgattcggacaatacgtgtagaagaaataacaaaaaacatcaaagaaatgtgcattgaagcaaatcattttctgtcaccagatatggcagaggcaatgaaatgtgccgaaaagaatgaggaagcaccacttggaaaacagatattggaacagttgcaagagaatttgaagattgcaggagaggatatgattccgatttgtcaggatacaggaatggcagtagtgtttcttgagattggtcagaatgttcatcttgaaggaggagcattggaagatgcggtaaatgaaggtgtacgtcaaggttatgtagaaggttatcttcgtaaatcagtcgttggagatccgttgatccgtgagaatacaaaggataacacgccggcagttttgcatacaagaattgtagatggagaccaggtaaagataaaagtagcaccgaaaggtttcggaagcgagaatatgagtcgtgtatttatgctgaaaccggcagaaggaattgaaggtgtaaaagatgcggttcttactgcggtaaaagatgccggaccgaatgcgtgcccgccaatggtggttggtgttggaattggtggtacatttgaaaaatgcgctttgatggccaaagaagctctgacacgtgaagtcggatcacattcagaaattgaatacgtaaaagagttggaagaagaactccttacaaaaataaatagccttggtatcggacctggtgggcttggagggacaacaacagcacttgcggtgaatattaatacttatccaacacatatcgcgggacttccggtggcggttaatatttgctgtcatgtaaatcgtcatgtgattcgtacaatttaattcaacaggctaagtgaaagaggaaagtgaaatggacaagcatataacagtaccaatgaagaaagagaccgtggcaacactgaaggcaggagattatgtttatcttacaggaacggtctatacagcaagagatgcagcacataaaagaatgtatgagattttacaggaaggcggggaacttccaattgatattcaaggtcaggtgatttattacatgggaccatcaccggcaagagaaggacgcccaattggctcggcaggaccaacgacagcaagcagaatggataaatatgcacctcagctcctggatcttgggcttggtgctatgataggaaaaggaaaaagaaatcaagcggtaattgatgcaattgtacgcaatggttcagtatattttgcagctgttggtggagcgggggcgcttctttcaaaatgtatcacatcttcagaagtggtagcgtatgacgatcttggaacagaagcgatcagaaaactgacagttgaaaattttccggtgattgtagtaatagataaagatgggaataatctttatgaaacagcaattaaggattattgcagaatggaggagaatgcatgagaagaattctactgatggtattgcggaatctgttgatcgtgccggggggatggattaaactctgctatcgggcttcacatgtggataaatatacagaagaagataattatgaatttttgcgttggattgtttttcgtgcaaataaaggcggaaatgtaacaatcgatgtacatggacaggagaatattccaaagcaggatggatttatgttttttccaaatcatcaaggtttgtatgatgtattggcaattgttgaagcgtgtacgcaccctttttctgttgtagctaaaaaagaagtggaaaacgttccgtttttaaaacaggtatttaaaatcatgaaagcatttatgattgatcgtgaggatgtccgtcaggcaatgaaaactattacaagtgtaacaaaagaagttgtatcggggagaaattatcttattttcccagaaggaacgcgttcaaaaaatggaaataatgtcggttcttttaaagggggaagctttaaagcagcaaccaaagcaaagtgtccgattattccggtagcacttgttgattcttttaaaccgtttgatacaaacagtaccagaccggtgacggtgcaggtgcattttctgaaaccgatgctttatgaagattataaagatatgaagaccgtggaaattgctgctgcagtagaacagcagatccaggaaacaatcaataagaacctgacgaaagaaaaggtagaagagaaatgctaaaggaatgcttggatcaagttagaaaaaaagccccagtggtgcataacataacaaattatgtaacagtgaatgatgttgcgaatgtgattcttgcatgtggtggcagtccaattatgtcagatgagccggaagatgtagcggacattacatctatatgtggagggctgaacattaatttgggaacattacataaaacgagtattgagggaatgcttaaagccgggcatcgctctaatgaactgggacatccggtattattggatccggtgggagcaggagcaagcaggttcaggacggagacggcattaaaattaataaaagagataaagttttctgtgattcgaggtaatgtttcagaaattaagacgctggcttatggaagcggaagtacaaaaggcgtagatgctgatcttacagaagccgttaatgaaagaaatttgcaacagagcatatcatttattaaaggttttgcgaaaaagaaagaagcaattgttataattacaggagcaatagatcttgtgacagatggcgagaaatgttatgtaattagaaatggacgttcagaaatgggaagaataactggcacgggatgtcagttatccggtattacgaccgcttttctggcagcaaatccgaaaagaaaactggaagctgctgtggcagcagtttgtatgatgggtgttgccggtgaaatagcatggacgagaatgcaggaaggcgatggtaacgctacatatagaaatagaattattgatgccatctataatatgacaggagaaaaactggagaaaggggctaagtatgagctttactaaggaacaattaagggaacagatgttgctgtatgctgttacggacagacattggctgaatgggcagacgctttatgaacaggttgaggaagcgctgaaaggtggcgctacctttattcagttacgtgaaaaagatttgacagaagaagagtttttagaagaggcaaaaaagatacaacagttatgcaaaaaatatagagttccattcataattaatgataatgtgaagcttgcgaaggaaattgatgcggatggagtgcatgttgggcaaagtgatatggaagctcttgatgtaagagcgcagctgggagaagataaaatcataggcgtctctgcacggacagtagagcaggctttattagccgaaaagcacggggcagattatctgggggttggagcggtgtttcaaacaggaacaaaaacagacgcacgggaagtagaacacagtgtgttgaaggaaatctgtactaaagttgatattccggttgttgctataggaggaattacacaagataatgtaaaagagctttcgggtagtggaattaatggtgttgcagtgatcagtgcaatctttgctcaaaaggatattgagacagcaactgcaaagctgaaaagctgcgtagaacagatggtttaaaaatttgttaaaaaaatgaaaaaaagtgattgacaagatgacggtgtattgctataataaatctcgcactgttggtgcacacaattgaacaaagctatagattctatagtagaattcagtgtacggagaaatactcaagaggctgaagaggcgcccctgctaagggtgtaggtcgggcgaccggcgcgagggttcaaatccctctttctccgtttaacttaaatcaaaagagcgggacgacagaagtctggcgacttctcctgattttgaagaaagttaaaaatcatgtaaaaagaaaataaaaaaacttcaaaaaagttcttgactttctaaaaaatacatgataatataaatgagctgattcgctgaaacaaagcgaagaggtaaaaaaataaaaaacttcaaaaaagttcttgacaaagcgaaatgcttatgataaaataaatgagctgtcgcaaatgaacaaagcgaagtgagaaccttgataactgaacaatagacaacaacaacccttgaaaatttctttaagacacgcatcctccgtgtcaatcagcggagtgattgacacgggagtgaacagtaacctgtccctatcatataaaaatccataaagtattactcttccattcgtctgatcgttagaacaagtagataacccaatgatcctgttccacccctcttttccttttttctcaggaagatgatactgcacggcatgtgcctttatatattccatcagttcttccagattctctttcttataatcttgtggattataaataacttcatcatacgcatctgtctccacacaggcgaaccactggattttttctaactgttcattcaaatatagcgtacctgttttgtgcgattcaaaatactccttttctttataattcatcacatccccaaacattgcgccattatccatatggtgaccatataataaactgtaactgtcaataaattttctgtcatttctgctatccaaaaaaatacttcctgaaagagcaaactctccataaatatcctgattaatatattctagatttgtttctccctgcacaaccggataatcaatctttgttccgtctaccgtcagccaggcacacacatccggattgattttctgaagttcctgcagggacggactttcatccgttttccctgcaggtttatatttcatcaattctccactgataaacgcacgtcggttgatctggcaggtatcccataatgaatatgcaccataaagaagcataagaataataaagagcgctgccagaatttccaatatcttatttcccgcttttataactttaaaaaacagctcttccctctgctcccctgcctcctgaccttctgtcgtttcgtttatcatgctctttttctacgaaagaaaactgatccaaatgcgcctgccgcacccacaagtagtacgtatggtgtgtatttctttgcaacgcctgttactacagccgcatctttctcattcacatactgaactactgtaccatcttcttttgtagttcctgtctttgttccggtcgcagttgtttctccatcaatcgtagtagtatatccatctttattcgcatcggtctctgttaccgtgtatttatcagattctgtcaatccataaattgtaattgaacctgtatcagaaatctgataagaagtttctgcttcattgcttgtgatgtattctgtaagtgcctgtgcatttgcatttttcttcactacaactttgtagagttctccctgtccaccattcaccgcaaccttgaattcgaaggatttatttttaactccctgattacctgtgatcgtttttttgatcgtcacatcatgcgttgtatcattttctgcaccataatcattgataaattcaagatcacctttttcaccattattttctgtaattacatttccaacataaagtgctccatctgctccgttatatacaaaaagataaacatctctgcctgctgtatcataatcgattccttcataagagcctgcatcttcagtcacaacataatgataaacaccagcatgttcaaatacccctgcattaatttccaatgttgcattcttgctgtaagctgctgccagtgtatcttctcctgatggctggaatccgattgtctgagaggccgtgattccacctgtcactccggcatatactacattatctctccaattttctgctgcttcaccattctccacatgaaacgaaaatgaagtgtttggctggtatgtatttccatccgttgtcaccgttttcttcaaattcagctgtgtgatcggttcattttcctcggctgacgcatttaccacacaaactgacatcatcatcatactcgccattgccattgctgaaatacgtcctgctgttttcttattcataatctctacctcactttttactctgatttccgggtttcagatatctgaccggcggagcaccgtaattactctgccttttatctccttgtccttcacagctccaaaataccggctgtcttttgcatttccccgttgatctcccagaataaaatattctccgctattcagcgtcagtggatagaccgtgtcactttcgtattgcggtgtattatagaaaatatcattttccacaatcttacttccattgatctttaccttttcgtcctctgtaatctctactgtatcgccgccggctgcgatcactctgcccacatatttctctcctgctttctgaagaaccaccacatccccgcttttcggtttttccagtcgataataaaagagcagatctcccgcactgatgcgtggcgacatgtcattgtttttcatggttgtaatcccaaacaacagcccgaataaaacccacagaaacaccagaagaaatgcaagacgaatcagaaaaagatgaatctctccttttaatttcatgaatctgtttctttcctctttcttcgaagaaacagaaaaactgctcctcctgttatgcctattgtttctatcaggattgtaggaagcaccctgttctctactcctgtcggaacaaccataagcggttgatactgattcgtataagttactgttgcagtctgctccttcgttacatcaattcgtgctgtcatcccctctgcctgactttcctgtcccacgagataaaaggtatgctccagcctgtagttattctgctcctgagcaatctccgtcactgtatattccccaggttcaaccgcctggagcgatgcactccactgaccattttgcggaagtttcacttcttcgatcacttcttctccccgttttatctgaaatgtaaaggactcgtccggaatctgacttgctgcaattccttccacctgctttgtgattatcagattgcctgttttggccggtgggtttgggagatcctttccaaaagaaatgttatcgagcaggtttccatttgacagatttccatttgctgccgctactgccacaaaataaaatcgagtaacatattgccctgccggaactgtataatctccatagtgataagtccattttccagttttatctgacaataccgcctgcacatcaggattactctgatcaaatcccgatcctgccggattccaatcagaactcattgatttcgtatcgctgatgataaccgccatcgtgtctgttccccagcgtcctgcatgttccaatccccagtgaagaactgtccctggttctgtcaaaacatcctgataaagagcccctggttcctcacagtttaattctgcgaactgatttccctgtgccgcactactgatgttataaaccggttttggatcattaaccgtatttccataataacttcggcttccatctgcaatctcgatataataatctctctgagttccagagccaaaatatgcacctttcgctgttgttttccaatataaatcattcgttccatttgctacctggataaaatgtgcattcttataagtcagtgttcctgcatcagatacttttggcgtctcaaaacttccattctgaagcttgtcataataattcaccttgtattcggaagaataaactgtcaccgcctcatttactgtcactttcacacgaaatgtcttctgtgcaccatctcttgcaacttcataggattgctttctactatccacagtcgctgtatcctcaatgtctttccattgaccgttttcacttacctgccactgataagcaatctgatctgattctgttgttccgctaacatctgctgtcagagaaccttttgtaagaatctcatctttaagagcaactgaaattttctctgaatcggtacttttcccttcctctgttactattccagactcagggggagattcttttgcgtctggtttctgcatttctgatcgggaagtctcttccgcatctgtttcttccgggagcacggtacaatctgttccctctgtggtttgtacagcctcaacttgtacaccttctgccagtacctgaacacccatcaacgacagcatcatcagtaccgccatcagaaatgcaaaatgtcttctcagctttcttcgcattttgccctctcctgtcttaaattgaattgttacctttcaggaagtactgtcgatatattttatatctgccctcctgtctaatatatgtatgacgctggatttctgattatgacttgaaagagataaaattagatttctttaagattttttacattttttaaaattttctcttgcaaagaccatttaaatatgataatatatttttcgtcgataagacaaggaaatattcctccttagctcagtcggtagagcattcggctgttaaccgaagtgtcgaatcgcctttggcgatggggcgagatgcattcaagtcaaaacatgcatcctccgtatcaatcagcggagtgattgacacgggagtgaacagtaactcttattcttctgtttttgtacacagttctgattcttttcgttctttccaccaacggctcagttcatccggtgccggacgatccagataacgggtttcttctccatttacaagtgttcttgcattctgttcttttacaaatccgatccttactgccggaacacctgcattcttcaagctttccaatgtctcttctccatgctctgtcagcacaagataacttccggctgatgtgagaagatatggattcagctgaaagaattcacagatttccactgtttcctgcttaagtgcaagttttgaaaaatcaatctcaaaccctatcttttctgcctctgcaagttcccataagccacagagtacaccaccatccccacattgtctgctctttgcttcttctgtaagctgtaaaacctgcttcggaagtataagtgcttccttgcaacgctttgttttttctatgaaagacggtgtaaatcttgtgcgaagatctgcttctgcctcgtcaactaatcgcagtgttccttctaatcctgtatagccacaaagaataatttccgttcccggaatccattttttcatctgctgttttggattttcttttacaccgacagcagtaatctgaatcactggccgcaaaacatactctgcactttcagcctgtacacaggtaatggaaagtcctgtctcctcacaaatctctgtcaggattctcataatatcttttaattcctgctcgtcagaactttcaggaaacaaaatctgtactgaaaccgctgttggtctgactctctttgccgcaagatctcctgctgatttaattactgcatatttcacctgtgccggtgcttttccgcttactgaagtgctactccagacaaaatccttttcgtcagatatcagttcggaactactttcttcccacgcagtttttcctgttgaattcctgtttcctttttggatctgtttctttacagaacgattccagatcgtctgcgttactctccctgtccgcatcacactctccttagaccagatatggaatcaccatcgttgcaaccattgcaacaataaccaccaaaataataattgacaccaaacgtcttacttttttatcataaaaattcatcttttttctccatttccattaacaaaaccatatgcaaatatctttctaatatctgcaacgctatactagtcctctattatataaatcgccgcatcctgattcagcttatttctatgtctgtaatcaaaaagatgcaactttccattcaatcgctccagatgagtcatctttcgcagttggcggctgtcgtatccttcataatccttcagatacttgtgctcttctgcctctttcttataaaattcagacgctacatctttttctactttgctctctccaagaaatgccggacgattcttcacattatctctcaggtaaagatctaaagtcatgctttcaagcaccttctctttaaaatcctcttctttcttctgcattttctccgaacatgtgaattctgctaattctgattctacaaagtcccacaatatctcatagcgagtaagtcttgaatgattcaacccaaacaagcctttcttctcataataattgcccattttctcatacatggaaaatgcggatggaaacaattccacaagaagtctcatcgtatgactaaactgaaaactgttatagtaaacttccaccatctcttctactttcttcagacggatcacatcactgtatggaagccattttgttgaaagcacttcatacggcggacgattctggcaaagcagctcatactctttcatcttctcatgcatcacagatccatgcagtactttcagaaatccaagctgaaactgatccggttccatagcataaacttcattaaaagaatgagcaaaactatcataattctcatatggaagacctgcgatcaaatctaaatgctgatgcacatttcccttctcatgaatccttgctaccttatcacgtactttttccagattcatggaacggttgatctctttgatcgtctgtttattcgttgactgaattccaatttccagctgaatgagtcctggacgcaaacttcggatcaactcaatctcttcctcattcagaagatctgctgccacttcaaaatgaaaatttgtaatccctttatcatgctctttgatataattccagattgccatcgcatgatcatgcttacagttaaatgttctgtcaacaaacttaacctgtggcacttcatgatcaataaagaactgcagttctttcttcacaagttccaggttacggaatcgaagacatttatcaattgaagaaagacaataactacaagaaaacggacatcctctgctcgtctcataataaatgatacggttcttgaaattctcaatatcaccatagacaaacggtactttgctcagatccataatctgtcgagacggtgtcgcagcaatctgtttttcctcttcccgaaatgtgattccctgaatattgatcaactcagccgcaccacggccttcataatatgccacaagttctgcaaaagtctcttcaccctctccgcgcatgataccttctgtcattggatatttttccagaacttctcttgcattataagaaacttccggacctccaagccagatcttcgtatccggcagaatctttggaatctcctgtatcaattgtcctacttctgtcacattccataaataacaggaaaggcagagaacatctggtgcctgcttataaatatccatcaaaatctcatcaaatggctgattgatcgtatattcagaaattgtaatattgctagccggatgctgctcttttgcatatgcgcgcaggcaatagaccgcaagatttgagtggatgtactttgcattcaccgctgcaagcaaaatcttcatctttttataaacctcttttcctgtcaataatgtatatttgtaaacattttcctttttaggtcttacctctctattctgaatgaagatgtgagaaatgtcaagatatgtgaagttgtgtatataacattgtatataacataaaaagggaaagctgttactgttcacacgatgtgcgaccagcaacgcatctcgccattttaaatcgcgatttaaaatggcgagatgcgttgctggtcgcacatcgtgtgaacagtaacagcagaggctgccagaaatgaaaagtttcggacagcctttttcttatagttgtaaaggagagtgaatgatagaatggatgaaatgatggaaatcctgaagaatctggactggagcccattatttatatcaataaaaacgggaatcgtagctacgatattttccttttttcttggaatctatgcagcacgtaaggttgtgaagacaactccggggaaaaaggctattatagatggaatactgaccttgccaatggtacttccgccgacagtggccggcttctttctgttactgatcttcagcaggagaagaccgtttggaatctttttatttgaaaattttggaatcaaagtagtacagacatggcttggatgtatcattgctgccacagtaatttcatttccgctgatgtacagaaatgcccgtgctgctatggaacagatcgatgtgaatctgatctatgcaggaaggacacttggcatgtctgatacagaaatcttctggaaagtagtgatcccgaccgcaggacctggaatcgcatccggaacgattcttacatttgccagagcactcggagaatatggagcgacatctatgcttgccggaaatattccgggaaagacaggaacaatctcgcagaagattgcaatggtcattcaggacggagactatatgacagcgggcgtgtgggttgcgattgtcatggtgatcgcattcctggtgatcttcctgatgaatctgatctcgggcaagaaaatgaagaatgtcaagaggtggtaagagatggcgatagaagtaaagattcagagaaaacggaatacatttgagctgaacatagattttaaaagtgattctaaacgaatcggaatcctcggcgcatccggatgtggaaagagcatgacactaaagagtattgcaggaatcgagccgccggagagcggattgatcaaaattgaaggaaagacagtttacgacagcgaaaataaagtgaatttaaaaccacagaagcgtaacattggctatctgtttcagaattatgcacttttccctacaatgacggtggaaaagaatatcgccgccggattaaaagggaaaaagcaggagaatgcaaagcgtgtgcgtgagatgattgagaaatttcagctgacaggactggaaaaacgattcccggcagagctttccggaggccagcagcagagggtagcccttgcgagaatcatggcttataaaccggatgtgattctcttagatgaaccattttcagcacttgatatgtatctgaaggaccgtctgcagcaggaattacaggagcttttcgaagattatgagggtactgtgatcatggtgtctcacagcagagatgaagtgtaccggttcagcgaagagctgctgatcattgatcagggacagattgtggcagcagggaagacgaaagaattgttccagaatccgcagagaaaagaagcggcacggctgactggatgcaagaatttcacaagagcagtttatgtggatgagcataccgcagaactgatagactgggggattacattacatacagaacaaagaagtatcccggaaaatatcaactatatcggttatcgcgcacatgattttgttccggtctggggaggatgtggaaagaatcagattccatttagattagagagtaaagcagcgcttccttttgaagataactattatctgaagcctgcaaatgaagaggcagatccgcctgtgatctcctggtttgtacagagagagaatcaggagaagatcagggaaaaaggaatgccggatgcgctggagctggtggaggaagaagtgctgttcctggaatagcatcttcccatatagatgatttttgagtgaaccgttacgttttgaaagaaatgtaaaaactccttttcaggatatttacatcagggaaaaactagtatataataagcacgtttttcaaaaacacatcccgtccgttggttacgaaacaattcttgtgaacagtaatcaacggacgggatgtgttatgtatgtagtcactgataaatacggaaaaggaggagcaaaatgaaatcagtacagaatgatatgactgttggaagcccaatgaagatgatcttaagttttacatttccaatctttctgggaaatgttttccagcagttttataatatggcggatgctgtgatcgtaggtaaattcgttggaacgaaagcgcttgcagcagttggaagcacaggaacaatcatgtttctgatctatggatttgtagttggaatgacagccggatttactgttctcacagcgcagaagtttggcgcaggagacatgcaggggatgcggcgcaccgttgcgggggcaggaatcctctcattcttgatcggactgtttcttacggttacctttatgttatttatgaaaccgctgttacatctgatgcacacgccgtctgatatctttgcagatgcatataagtatattatgatcgtcagcggaggaatcctggcgcagatgctttataacttgttatccagtattttaagagcactgggaaacagtaagattccattgtatttcctgatcatcagtgcgttgctgaatatcgtgttggatctggttttaatcattgtatttcagatgggcgcaccgggtgcggcaatcgcgacggtagtagcacagggcatatcaggtgtactctgtcttatttatattatgtggaagattccgcttcttcatctgaaaaaggaagactggcatgttggcgggcagatttgcgcgattcagttaaagatcggacttccaatggcattgcaatattctatcacggcaattggaactatgatggttcagtctgccctgaatattttgggatctacgcttgtggcggcatttactgcggcaagtaagattgagcaggttgtgacacaggcatatgtagcgatgggaacaacaatggcaacttacggagcccagaatatcggagccggaaatgtaccaagaatccgtcaaggtttcaaggcgtgtacgattcttggtatcggttactctcttgtagcagcaacatttatcatgacagtaggaaaatacatgacctatctgtttgtctcagaggatgtggatattatcatgagttctgtggatatctatctgaaatgtatcggacttttcttcattccgcttgcaattgtgaatatctacagaaatggaattcagggactcggttacggactgctgccgatgatggccggtgttgctgaactgatcggaagaggtgtggtagcacggatcgcagcaagagagagaagttatcttggtgtttgcctggccagcccggctgcatgggtgctggcagggggcctcctgatcgcgatgtattattatattatgaatgtccatatgaagaagatgtttggggattataatcagaaggtctgattattcacaatgtgcattgcatcgcggctcgcattcaaccatttggatttctcagtttcaaagcgttcgaaaagccaggcaatggcttcatccattccctcatcggagagcggaaatgtcttctgttctttctcttcttccggtgtatcttcaaagcaccatggttctggataaatgaatacggtgaaggttgtgctgctttttccgtcatctccgcgaaagaaatagcgcattccgtgatgtgtacctgaaaatggttctttcttaagtcccccgtaaggaatcagttttttatcaatcatagtaatacaatgtcctttcgaaaaaagtaatttgttttgttattgcgtttttgaaaaaaggaagccagaagtctggcttcctttttattatagtggaatgcgttttcttctgcaagaaatgatttattccatagcttttttggcaaattcagttgtgacaagtttttcataaggagcgcgtgaatccagttcaccggcactttccaaaatatcctgaagcagctcgaaactctctttttcaaatataagatctgctttccaggtgtcctgtgcataataacggtttacaatcgctgtgatggttttaagatctgtttcaggaaattgaggggcaatcacggaagcaatctcctctggcgtgtgaatctgaacaaaatccatacctttttgaagcgcatttgtaaaggattggataatctcaggatgtttgtcgagataactcttctttgcgctgtaggcagtgtaaggaacatagccgctgtcagtaccaagtgaggctacaacatatccttttccttccatttccaaagcggttgcacttggctcgaattcaacagtaaagtctccacttccctctgaaaaggcggcagcagtggaaccaaaatcaattccctggttgatgttgaggtctgtttgtggatcaattccatttttctttaaaatatattcaaataccatttccggcataccaccttttctaccaccaagaacatctttcccctttaaatcagtccacttaaaatctttcctctcttctctggcaacaagaaaattaccggcgcgctgagtcagttgggcaaagttgacgacagaatcgttagcaccttcgttatatgtgtagatggatgcttctgatcccatgaatccaatatcagcttcaccggagatgacagcagtcattgtcttgtcggctccaaaaccagttacgagagtgagttcaattccctcatcttcaaaatatccattttcaatggcaacatacataggggcatagaaaatagaatgggctacctcgttcaatgtcacagagacaggagcagaactggtatctgatttggttgtgttggatccggtttctgttgtgtcgattttggaatttgcatcattatctttggaagaatcagaaccgcaggctgataacagtccaacagtcagagcagaagcgagtattacggaaatcaatttctttttcataaatcctccagagtgatataagattctcgtttaaaatatgcaagaaaagagaatatgtgtcaaattctactccaaaggggtgttcattttggaaaatatcctttatgcttagtgtaaacagaaagtaggtgaaatgtatggatcttgttaaaattggaaaatatattgcagggaaacggaaagccctgggaatgacgcagaaacagcttgcagaaaaattaaatatgagtgacaaatcagtatcaaaatgggaacgaggcatttgcttacctgatgtgtcggtttatatggaactatgtgagatattgggaatcagcataaatgaatttcttgcaggggaggatattgacgcagaaaatgtagaaaaaaagtcagaagacaacattatacaagttacgaaagatagtaaaaagaaacagaaaaatttaaagagcattttagcagtggtaacgacatttgcagtgatcatggttctggttttaggagcagttttcgttcataaggtgatgcagccgaagaattatattacagcagttgaccggacaagtgcagaaatgaaaaccgcagaattattgtcgggagcagatggggcatatctttttaatttttatgcaaaagaagagtataagacattgacaatttatttgtcagagtatcaggcgggagaattgattaataaaagtaaagtggcagatttggactatgatgggatcgaatcggctaaaagaggtgtgattgctgtgataccggattttgaattgtttcgagtgaaattgatcatagcagacgattattctaaatgttctacagattttccgattctggaaaatgtagaaaacagagaatattatggaagaagtgcgacacaagtggaaggtgaagttccgattcagcgggatacagaacagggtctgatggcattgatttacggagaagatggattggaagcaattccggtaaaagaaatggagcagggaaattttagggagaagaatgattatgtctattatctgtccttccggtttggaaaataattacgtaaatgaaaatatgagaggtaagatgagatgaaaacaagagaagaagctgctgcctatggattaactttcccggacagctatgaagacaggccttttaaagaccaacgatggcaggtgatccgtgtaaagccaggtaaaaagatatttttgtggatttacgaaaaagacgaattgatccatttgaatgtaaagacggattcgagatggagagatttctggcgtgcagcgtatccatcggtaattcctggatatcatcagaataaagagcattggaacacaattattctggatggatctgttccggacaaggatattgaacggatgatcggtgagagctatgatcttgtaacagacagtcctacaaaaagaatttatgaagctgtgaaacggattccgaaggggcatgtggcaacttatagacaggttgcgaagatggcaggaaatgaaaagatgtcaagagcagttggaaatgcgcttcataagaatccagatccagatcacattccatgtttccgtgttgtgaatgcgaaaggcgagcttgccggagcatttgcatttggcggagcagatgtacaggcagagcttttgagagaagacggtgtggaagtagtagatggaaaggttgatctgacaaagtatcagatggtggatctgatggaagagtaagatagtactgtttcttttgggaaagatagtgtataatacttacgagtgattgctgttcgcaaagtactgcgaacagcatctttgtatagtgcaaagagcaggaaagaatacatcattatggtttcgcttttgaaggcaaaaaagtcctgatcggataagaaatggagaaatgaatgaaaattaagaaagtggcagtcctcggtgccggagcagtaggctcttatgtaatctggggattatcgagcagaaatgacatagagcttggagtgatcgcagaaggagaacgagcagagagactgaaacagaatggatgcacaattaacggaaaaatataccatcccaaagtatggaaccccggagaaacagacgctgtcgatttactgattgttgcattgaagtatggctcactttcggcggcattggaaagtattcagaaagcaaccacggagaatactgtaattatgagtctgatgaacggggtagacagtgaagagattattgcagaaaaagtaggagtggagcatcttcttccggcagtgatcaaggtcgcttcacataaggaagaagatggctatcattttgatcctgagacaacaatcggaattatttttggcgaacttactgcaccttacgatagtgatcgcatcagggcaattgaagaactgtttaaggataccggaatccatttccgggcgacagagtatgcaagagaagagatgtggagcaagtttcggctgaatgtctgtaacaatctgccacaggcaattctcggcgcgggagttggatgttaccgtgatagtgtgcatatgaaggcaatcagtgatggactgaaaggagaactggaagcaattgcgcaggcgaaaggaatcgatctgagtaagactgaggcgtcttccgggcgtggaagtgcagtaccgccatctgcgcgttattctactttgcaggatttggatgcaggaagacacacagagattgatatgttttcaggtgcactgatccgtatgggaaaggaacttggaattccgacaccgtataatgagtatacatatcatatgattaaagcactagaagagaaaaatgacggacggtttaattatacaggagatgaagaaccgacctggtcaaaataaaacagggaacaatttgtggcagaggcaggttatgaaaaaatattgaaacagtgatgttgaaacaacataaaaaggtgaggtaaattaagatgaaagaattatacgaagcaatcgaagcaaaaattaaagcaagcggttatccgagagcaatctccggagaagatgtatacaacgacatctgtgaccagattgacggaaaagagaatgggagttatgtattgttatccaagttcgaagatgatgtgatttttgagtatcatatcacgattcaggatgaagatttcaacctggggattttgacaatgcgaacaccggaaggcgtgtttgagacagattttgatgcggaataaaggggggatttcagacgatagaaaaagcgaaatgagaggaaaaacctttcatttcgcttttttgaaattccgaaagattctcactgacgtgagtttctaaagcccaaactcgtttaataacttcttctgatattctctgtctactgctgccttgagaatctcatcacttctattaagctcagataatttaagattcagttgattgattctgctttctccaagagcttccccttcttctcgtttttcatctaattcatctttcattaattctaataacgcattacacatatctctttttccctcctttagtcgattctcgtttgcttttactataatctccataacagcctgatacagctgattctctttgttctttttataatcctccaaaagctgccttgtgacagacatgtcttccagtgtatctgtcaaactatataaccagagatttctctccggtgacaatcgatttgttacaagaatctgaatcggtaagatatctccaatgctctgctctgctctgctctgctctgctctgctctgctctgctctgctctgctctcaagattgtcctccccaactcacactatttcaagttttattttccaagacggctcttcaccagatttacacccgatttcagcatgtccacattagttaaaactgcataaactgcagtaatacaaagtgctgcaaactggatcatcctatttccgcaatagtatgttcctatgagcatcccaccaataaggacactgccaataataataggctttctaattttcatgtgtacagttttatttacgtcaatataacgaacaataaacattgaaagaaaggcaatcagcgttgaaagggatgctgcaaacacttgtatcttgttaattaaaatcaaatcgactgcgatgttaataatagccgctgagattgatgtgtacgcaatcttttttgcgtttttttgtgccacatagacacaactatataatccaaccaatacacggaaaagcatcgcatacattaaaatcaaaatctgattatatgcagcgctgtattttagattaaccattatgggaaaaacaaaaggcatacaggcaacaataccaaaacaagctgctgcaaataacttgaacaatgatgtcattgtttctgtcaaaaattcatccctatcttcatcaccatagtgcaatgaaactgtttctgtccaagataaatttaagatattataaaaacttataaatacatttggaaatttgtttgcaacagagtaaattccatttgctgctgttgtaagaaaatgtgcaataattgttcgatctgaagcatttacaacccaccaagccaaattatttggaattagcggaatggagtacgttccaacacttttaaatatactcaggtgaatattttttggagaaatatattcccagcattttgatgcaaatatcaaataaattaatgtaacaatctgtgcagataacgtggaaacaaacaatccttggagtcccattttcaaaataaccaaagcaataacatttaatattgtcgttgttgttgccgagataaaggatgctaccgtatatttgacactttctcctaatccccttacaaactgcaagaacagtgctgtaaatacctgtaaaatcacataaagcaaaaggaagtatgcattttcgatatgtaatttgggagtaattattagatacataccaaaatagacaacagattgcatcatactagaaaacaacaatgttgacaaaagtttgctttcttcttctttgttcccacggtaatctaacataaacctaaatagtccttgatctagttgccagtttaccaaaggcaataataaagctgaatatgtgactaataaatcaaatgtaccatactcttccgttgataaaattgccgtatataaaggcagtaggaaaaagctaatacactgcgtacataactttcccactgtcagtatggccgtattttttgctaattctgttttacgactcattagtatctcctataacaagttctgccttgatatgtggctataaaataccaaggcagaactgcttattttaatatcctatcaatgtaatccagtgacctgtgacgttcgttgtccagtagtaaattcactacattccattcaatttttggtatgttcaatccatttgcagattttccttttacaagtccacatttctctaacttgaaaatattgagaatattaagaaccctatcttttctttcaatctctgtttccacataaaaaggtgtgttcaagataatagaaaaagctgtagcatgaaacgaatttgttactacacattttgcacctgcaatccactgcaaaaattctgctgggcccgcagttccaatgtgcttaacatcacgatatttaaaccacgtttcctgatcccacaacataagaagttcatagcctgtttcttcgcttaattttttagcaaactccagcgccggttcagcggtcttactatatcccattttgaaaaaaaggatgtaatctttttttactggctttgccgccaaacgcaaccaattgctttgggttgtgaggaaaaccggatctaatacaatttcaatgtttttttcttttaatctttgattaagagcctctttggatgcactttctcttaccgagatattcttaaacctttgaagacactgaatcatttcattcgattcatctgttgaaaaatcagcaccgcctgtacttgctgcgtaagctattttttctactgagtcatcgatctccggcagaaagtagtgcatatcatgctcagtaagattgtaattccatacctgatccgaacctacaataattttttcaaaggagttgcaagtcttctcaaaagaatcttcactttggcattgtcctgaacaaattgtattttcttctctgaatgactgaaactttgaatttcgcttgatcttatccggaattctcagtatgcttttaataataactttcggatgcttacttttgaatgggctaattgaataatccttataaataaactctggctcataatttataagttcacattccataccgccatgttctataattgtcttttgtaacgatacagcctgtagcaatgcgccaaaattatttgcagaatgaaaagttaatataccgatcctgctcataaattttctcctacgaattctttctcacatctatctaacactgctgcaataacctgatccatatcgtagtacttgtactcgcctaggcgaccgccgaaaatcactttgccctctgcatctgccaacttcttgtactcagaatacagcaagctattcttggcatcgttgaccggataatacggctcatcacccggcttccattcgctgctatactcacggctgatgatagtcttgggcagatcattgccgttctcatccttaccgaactcaaaccatttgtgctcaatgatgcgggtccacggcgtttcgcggtcggtgtagttgaccgcggcattcccttggaagcttagcttgtcgaggagctcgttctcaaaacggacagagcgatactccagtgttcccagcttataatcaaagtaagcatcgatgggaccggtgtaaaccaccttgtcagccagcgcatcaaactcagccttgttttccagatagtcagtattcaggcgtacctcgataccgtccagcaagttggcaatcatcttggtgtagccaccgatgggaatgccctgatacagcgcattgaaatagttgttgtcaaaggtcaaacgcacgggcagtcgcttgatgatgaaggcaggcagatccttgcagtcacgaccccactgcttctcggtgtaacccttgatgagcttctcatagatgtcgcgacccacgagagagatggcctgctcttcaaggtttttcggctcgccggtgatttctttgcgctgttcttcaatcttcgcagcggcttcctccggtgtcacaacgccccacattttattgaaggtgtacatgttgaagggtagtgaatacagctctcccttgtaattagcaaccggggaattcgtaaagcggttgaactcggcaaactgggtgatgtagttccagacctttttattgttggtgtggaagatatgtgcaccgtacttatggacattgatgccctcaatattttcggtatagatattacccgcaatgttgggacgcttatccacaactagcacagattttccatgcgcttttgcttcatgcgcaaatattgctccgtaaagaccagagcctactactaaataatcatatttcatattctacctcgcatatttgatgtaaaagagatgttaattgccactgcgactgcatagaaacaaaaagtcgaatcatatataggatttcctgtcattccatataacaacacaaaaaattgaattgcaaacgaaaccgataaggctaattttatacttgtcaattcgacatcacgttcttgatgactaagataattaatatttttccatgttattactatacttgatgccattgccataataaacacacagaaacctaaaagtcctgtttcgcataataattcaaggtatatattatgacacccagcagtggcacccgttagcgcactcaagccggatttatatcgaaatccataccatccgattcccaatattggattttgattaaaaatagagcacgccctatcccacataagaatccgcaataaacttgcattatcagatccggctgtttgaaatcgttcaaatactcttgcaatatctggaacataatccataagaaaattcaatcctatcaaagcagccgccgctgccatcatgagcttgaaagactttaacaaccttttttcaggattaacaacataataaacgactattaaagttgctacgccgaaaagtaaatgtgctcttttagatgtaagaagaagtgcgataactgtagcaataccagctatcattatatattttcgcttcttttcgtgaccatttaaggtcaaaaatacagcccatacagtcaataaaactattgtaatatatgttccattttgagagtaatgatctgcaagagccgctcgatacccatacaatccgtcttgtgttccatcttgatattgtttgtaagttgtattaataaaaagctgatacaatccattattcacaaaaaacaaaagagttgcaataacatttgctattcctacggctgttattatttggggtgccttttttatccaatcacaacttttaacgctggcaaatatgaataagtaagcgcctattaatcttattgaattgtagtagcctccactcaaaaattcttgatttctaaaaagcacaaagaaaaaacaaagcatccaaggtataataatacttcttttcttataatacagcggtaataataaaggtatcgctccagaaagaaccaaaatatatagtctcgctttataaggcaaaacgaactgagcaatcccccaataatttcctgcaatcagcagcgtaattaaacttagcgttataaataatgtgtgattaatttttactttcatttctactcccgtcctctatatcgtatttttttcttttcaccaatttcaagcaagagtagaagtataacgcaatattcttatcatacaaaaaaaacttcagtctctttttgaacggttgagtattacgtctgtttaaaacttcgatccatggagcagtatgtaaaacttttgaaaattcagacactttcttattgaatgggtcagtattttcctctgctaaatatgctctaaaacatatatgttttagcttcataagtaaccaatctgtatatgcggcatgcacaatgcctgttgaagcaccatactttttttccagaatatccactggaagagttaattgtcccacgattttaggattatatttattcaacacactataatcattttgaatataataataccatttttcataaagcattccaattcggtaatccttagaactatttaacatggttaatgcccaaatagtatcttcgccaactgcaactcctgggataaattgattttccagtgcaatctccttcttcaggaaatgtgcccaacatccttctccattaaattcccatccatcctgatcaggtctccacctctcacagctttttgaaaaaatatgacactccaattcttttttcttatgatcatccaacagttcaaattttacgttcttttctctacttggaaaaatacttggccttttatctgttgtatttatcattccaactataacatcacaatcataatcctcaacagcttggaccgcgctttctagtaaccacggagttaatatatcatcaccatcaacgaataagatatactgtcctgttgctttattcactccaaaattacgagctgctgagaccccttcatttttcttgtgaaacacacttatacgagaatctaactgaaccaactcatctagtctattaccgtaataatcttcacttccatcatcaataataaccacttcaaaattggggaaagtttgagcaaggatactatccaaacattttaataaatcttcatattttgtattaaaaaccggaataattatacttactatcatcggttaaccctccccatatcttctatttgatgcgatattctgccaaaccaattcgctcacaattttgttttctaccgttataccacatcaacagtttgtttttttgtttatttaaaacaaccgtaggcttgtaaactgcatctgcatcccaggattttttttctggtgaaataacaggattatccatacttctaacccaattatgtattccgtcatttgactctgccatacaaactctagctgtatccacattttgatatccaatgtagaacatatagtatctatcattttccttcaaaatatcgcatccgcctaccttgcattgatcatacttttcattcgacttttcaagtatagggttatttgcatacctttcccagttaatgccatctttactttccgcatagcaaagaacatctggttcaaattgctcaccagctgcataccacattttaaagattttttcatctttgtcccagagaacacacggattcataaccgagcctttttcgtatggctcactcggaacaagaattggtttttgttgcattcttgtaaatcgaatgccatcatcacttgtggcgatgcctattgcactattatttctactttgtccagtgtaccacatcaaccattttccatctattttacaaacagaagcgcgattaacccgttcttcccagcttcccttatcccctgcttctaaagcaactttccatttttcccattctgtaccatccgtagaatcagtacatattattccgctattttttcgttccgagacaaaaaggcggtatctatcttctatcattactacaaatggatcaaacacggaggctgtcgtttcatcgccaaacactggcgatccatatttttcccaacctccctgctgaggagcgtaatcataagttgcttttttattatggatatattcaatttttcttcttacctttgagaatacgctgctcatcaaaagtctcctatatgtcatctaatgcttgctgcaatttctgaaataatattaatataattttttgcaaatttttcaacagtgaattcattattaaacatttcaattattccagctttggcatcgcacaattcatctactggcatttttttaatatccaatatcctatcttgtgcttcttccaacgtatcataaaattttaatcccggttgcttgaactgttcaaaatacttattcccgcctgtgcgactcattacaacgggtactccaagtgaaagaacctctaataatatcaaatcaaagtatgtttcatgatttggcaatacaaaaacatctgaagcggcaataagtgaatgtggatcatttgtccatcccacctcaatccagtgatcgtttttcaatcccgtcatcggttcttcttttccagctattagaaaatatacattcttatccgcaaggagcttttctccaagtctttttaagtcagcatatccttttatttcattgtgccttccggcataagaaatcacaaaagcgttgtctggaattccgtatttctttctgaaatcttctctatttacttttgctttacatccaactattccagttggcatataacgatactttttttcttctcggagttgttcataaccttcccatgtatgataatatggttcctccgcttccttacatggaaaaataatataatctgcgcgcttaaaagaataggcatccatttcttcaattctgtcaacccattttttcaacatcttataatcaaacggattcagccacgctagtttttccttaaactttgcgcacggagaatgcgatgttagaattacagttcccttataattttccaaagtttttctacataaatacattgcatcaattgaatggaaatgaatcatatcatattgatgtaatttctcgtctaatggatacgcctttttttcataaaaaatgtcatcaactgctcttctaaattctcgcaaacgttttggtattttgtctttatttttgacagtatcccttaaacttttaggtgccgcttcataaaaagaaacatctatcggaaattcctccttattcaatgtatctaagccctgtctcaaattaaatagataccctgccggacctcctactggtttaagcatactttctggatagtatattaaaagtttctttttgctcatatgttttcctccgttaccgttgccgactcgcaattacatcttaccgtcttttactgtaatcatgaaggcctgtgttcccccaccccacgaacaatatacttaacgatagattttactttttctttcgccacaattcctggtgctgttttcaccaaggcttttccaaagttattgtacctgttatagttttcaaagaattgatcacgcgatttactgcattttgaaggtttatttaactgttcattatgtgaaatcgcgttattgatgtcgacatctaaaaggtttaatccagcactctcaatcagctctttacctttttcactctgacaaagaattagtgacacaccatttttcacttctccacttagttcggttccccaagaatctcccagcgttatatcagatactctgtctaaagtagcaaacttacacgaatagcaattttctgtataatcatatgagtgaaggaatgcgataaggtaattatccatagtatgaaacgctgcaataggtttcccgtctctattcaactcatataaactttttattcgaaaattgatatctgtaagggtatttatatcatgtccatattcttgaaggcactttttaagtaaataaggtgatggagttccatgacatatcaaatcagcggtaactaaattggtcttatctttaataaattgattcaccgctgctacttgacagggcaatccaataaaaagaactttctgatttgctttcaatagtgattgaatttttccgtaaattttttccggattactcttaacatattttgatcctgcaaattttcttgcaactgccatctcatttgttacttcaaatacaaattttccgctgtcaaacaagcaagatgctacatatccaccgtgctttataaatgcgcgaataattgcagatgcagcacccccagatgaagcatgttctcttatttcagaatctgcccatccttgataccaccatttcggcttactcatgtcattatcattttctcgtggacacactttcgtgcaaagtccacagtcaacgcattttttagtatcaaccagagcattataatacttcaaatcatctttgattgtaattgcatttctatggcacttttccacacaagccatacagccattacacatattcaattcacatactgtcttcatttttcacaccactcaaagcattgctaagccatagcaaagaacgttttctttctgccgcaagtatctcatttacacggttgtaatcaatttttgattcaacaatgctcaaatctctttcattttttgcaactcgatttgttaatcctaaaatttctaagatgctttgcaatcttgtactgtattttcccggatatacaattacaaattctttgttgaaattcaaagaaaatgctgtcgcatggaacgaatctgttataacatagtctgccccatcaattaaggcaaggaaatcttcaaccggtggattacagaacatttttccattcttgtaaaactcatgtaattgataacttaaatacctaacttccaaacctgttttaattgaaagttcttttgcatacgcatcaattcttggatttctgttcaaattgtaaattagaatatacctgtccttcgtgaactttctggaagaaatttttctccaatcttctccacttaataacaatgtgggatctaaaacatttgtactattctcgattcccaatttatcaacaatctctactcctgatagttctctcaaagaaatactatcgtatctttttaaaagacgcctcgtttcatttacttcatctgattctaatttactttttccaaaacttgcagcatatgatatttttctggctgactcaggagcaaatgccagataatacggatattcaattctttcattccatccataattccagacctgatcgcttcctgtacaataaacatcataatcaaaattttcgctttctaattctttctcacttttatatgttttaggtgtcatatcaatataatcattgagaaacttaaaaaacatccgaaatcgtataatgtaagatggaataattattgctcttgcagcatttctaatcaaaaaactcttttggaatttttctcccttgttctttatcctttttagcatcccgagcggagtaaaacgttctggataataatcaatgacttcacattcatagcccatatctttgattttttcttgtaatgcataggtctgcaaaaccgacccgtaattaaccactcgatgttgtgttattatcccaacctttttactcatatatcaataatcctttcaactattactttgtttccacaaatctatatatcttttttccattgattttgcagcagttcttatatcaaactttttcgtaattagttcaattttatttcgttccttgtttattctttgttggctgatagcatctacccataagccaagattttcattgccgattttcaaaaattttgtgtcagagcatatcttaacttccctcgtcacctcatctgaaaagaaacaaggaagtcctgaatactgcgcttctattcctgttacaggaagtccctcaaacaaggatggtaaaacaaaagcatccattgcctgataataattctctacatctttatgaaccccggcaaagataattttatccttgatttccaaatcctctgctaaattttgaatctttgaaaacagctctccttctcccagaagtaataacttgatattcggtgtcttttgctgaacttctttaaaaattcgcaaaagatactcatgatttttctgtaaattaaatcttccaacatgaccaataacatactcgtcacggataccaagcattttccgcatttcaatgcgcttgttttcatcgaacgtgaatctgtccacatctattccatttggtacaaactcaaaagtgtcttttccataaagatacttacctgcttccgttgagcacgccagacgaacattagcattccattttgttgttctgaataacaaatattttgccgtccctttcaaggtatgcaaaaagccagctccatggctatgagctattctccatggtacattatatttctttgctactccaagataaaaaacagcaagactacttagatgaccatgaatgatttgatactctttatgctcatcaaagaacctgttcaattcagaaatatacttaacaacatttttatcatccaatactgtaaaatggtaaattttaccgcccagttcctgtatttcatcctcataaagaccaacagctgcatgatgaactacaaaatcaaactgcacctttgatttatcaaccattcggtacaaattcattatatagttttccattcctccagcatttaatgatgctacaacctgtaaaactcttatcggttctgtcataattatttttatccctatattactttctcaaaaatttcatgtaaaagctttttctcaatgaattcggaagcgcgcaaacaaatgcttgccccaaaccactaatacaaaaatccatcaatgacatataccctttcctatactgtccccacttaaatttcaaaacagtttttgcgtatttaatgccgccacgacgtttaaaaaagtcttcactagttcgtatataatacagaggttccggaatattataactttttatgtgatactctagcaccattcttgcaaacagatcataatcttcatacagcaagactgactgatagttgccactttttaacaccgcactttttttatacataactgttggatgcaatactgaacatctacggtgcataaatcgttcgatttcatcattctcagatggcactctatgaattgatataacattatctatatcatctacaaattcagcctcataagatccaaccattcccaattttggatcttctctaaacttctccaactgcctttcgcatctcgtgctgaccacataatcatccgaatccattctggcgataagctcatttttagaattttctattccttttgcaagtgctggtcccaacccaagattagtttcattgactataatattaaacgttttaggatacgccgtcacaaaattatttatcacttcatcaagttccgtcgtgagaggaccatcttttacgataataaattcatccggcttaacagtttgattcagcatgctttcgatactcaatgataagtattcaggtttttctttatagtataccgacattaaaactgtatattttgaattttgcatcattatctcccctcattttccgtcatctctttttcatttctttttaatctatctacacatccaaattcaggatgatatcagcgtgtgttcacctaagtgtttttccttactgtcataccctttcggcgcagcaatcatatttctacttttctccggtttattgagtacacctgtcttgcttttgcaagcatcgaagtgttgttttatactgtcaaaccccgtccatgctcataccccatttttgcgaagtgtcggtttatacactcaaagggcgtaggcgcgtatatgttgttgaaactgtatatatcatccaccctcaaccttattccaaccgtcacaatgaacaaatcatgcagatttttcaccctcgacaccccgtccttatgtacctatcatctccacgacaggtctactcaacagaaaagttgcgaagtagaaaacgccatttttttcgtttttttcatgactcaacaaaccgtagcaaagtagccctcatatttaccagcgatagtgtactcaatagaacattagcagagtaggtgataagctcatggatttttgatgaatttatcatctgcgccaccatttttctcatgccacccacatccgcgttatccctctcaaaggtgttcctcatccaccggcaaactgtgtaaatatcacccattttcacctcatatatcagggcattttgcaacgaatcttcggtatgttgagtgtgaaaatcgggccttttttgactatgctacgttgcttctgtttgttgagtagacattggttggaaccactattacaacaaaatcagcatatgcagccttagcatccagcgttgctgtcagattcagttctttttctgcaaggtatttttcaatataatcatcctgtttgtttcagaatggtatttcacatcttcataaaacctgtatctctatcacacactcacccgaatctccccatcctctttcttcacatcaaacacaagcggatgctccttcccccactccggatcttccttctccttctcattccattccttccatttctgaatgaaaccattgtggatcaggttctccgccgcaagtcttgcctgaaccgcttcgtcataattgtcgaaaagaccaacataatagcgttttcccttgaacccaatatccacacgataccgattacaattcttcaattggaaaacgccccggaaaccactcatgttgtcttttctgctttttcttttttctagtacttcaacacaggttccgtctacgagatgtcgtctctgcgcgatttcctgacggttcttcttctgtaaacaaccacagctatgataattaccatgcacgagacctgctgccgtcacgtcaacttcatttccgcaatcacagacacaatgccaataaacggagccccgtttatctcttttctctgtcgcatacttggctgtcaacataccgaactttcttcctgacagatctgccggtcttcttcccataagccttcaccctttttgcaaaaaatttcgtagagtagattactctacgaaatttttacggaaagccttggaaatcaagagattccagatgtctgaccaaaaatttgacggtaaataaatgctgtaaaatttataattatgattgattttcaaatacatgtgattgcaaaagtgcgaagtgacttagataaattaagataactattttaaattttctgatctgatagcttgtaaattgactgacaattgaccataaatttgacggcgaatagataaaaatccattcaaaaaaggagattaaaatgacgaaagtgtctttttttcgactttttttgctaagagattgtataaattcatgaaatgaacgtatatacattgacagaaatgtttgaaaagagtagactgaacatgataattatactaagatttgaaacaatttaaagaaaaagcgtatttcgtagagtaatctactccacgaaatacgctttctttttctattctgaatttttctctttttcccaatacacctcaaagaaactgccccggattataaatacaattatttccacatggctgaccatcaaagattttcttattcaattgatcgatatatctccctgtctctttttcttctctttgatttccctccagaacccccagcgcaaccttcagattccgaatatcccggatcatatcttccacataatttcctcgtcctaccagtttcagatgggtaatccctgccgcctccagctgtggcagcgcacacagagcacatccactcttcccacagagatattgttgttcttgttgctcttctgtctccaatgttctttttatcgctcgttccatacgctcttccatctcagcatctccccagtaagttgtcctgcacagataacccatctcgtcacagtgaagggaattgcagaatgctcctgtgaactgacacaattcgttcaatgcaaaggcctcgaattccagtctttctgcatttacagcttctatcatctgccgcatcgatgcaactgtatttttcctgtgaaagatgatccggtcgatttccattttctggaaaactttgattgcctcccggttcatttctccggcttcaccgctgagatggatcttacaggatatgcctttttgtctcaggtacaaaatcaatgccggatcggcaaggatgaagctgtcgaatccgattttcatacactgtttcacaatgtctgcaatctcttcatattgttccggaatataatagagagaattcatcgcgatatgcaccggctttctgtacttccggatcattgctgagaggatctctaattcgctgaaagaaccgagctgcacattataggccagcacttccctgcggttcagtggaagtacggttccatatttttttgtccagttgtatggcacatatccgcaaaacaattcgtccgctcctgccaggacatatggaatatattcatccacagatccaagtcctgcaacgattttcatccttcgctctgctttttctttttcattctgttttcttttctgtgtctccattcttccatcatccttctgtttttcacatttcacaatagattgaccacaaggcggttccattttattccgagttctctcttcaactgctccggttcatccaacagatgtttatccaatgcgaacagactgttgtattttcccttcatatataaatgctttggatagaagaagctatgttccagacacggtgccggacattcctgtctctccctttgttttccacgttcgccgtgctccaacacagcgcaaagtgtacaatagctcgacgtatttgtctgatagaacggcacgtgtagatgattatgtatcttttgcggtatttcctgtgtataaccgcagctttcccactcataactgctgattccaatgctttcttccagataggtgcgataaaatcctgcattcagattattctgttccaacagcgtcttatctcccatcttgtaggacattctcggatcttttttcctcttgtttaacagagttccaaaacacgggatcagatgttctgtccgcttcacaagatgtgccagtccccaatcattgactacaacctcaagtcgtttcttctccgccccggaagtctcctgttgttcacaccactcatccaggcgtgtcaacagctgttctgtctgtgcaagcctgtcttcccgaataaaggaaaaagcaacggtcacttccatccgttctttatctgctttctcaagaagtgcaaagaactgttcttctttcggaaatagatgtggacagaattggttaccgatatacaaccggtccggttgtcttcccaggatccgcgcatctttgattccatgctgctgccagtattctttcatgaaccgttcaatcggtctggtcagatattgttcgtatagtttcggatgatccagttctactgctaattctgccggcagatttcggaaaatctccgcattctgaaaccactctttattttgttctgtttcattcttgaaatgttcctcttcttcctgcgcgggataaccggtcatttcttgcgccagatgtgcatcatcctcttccagcttgagcgaaatgtatcggctgtattcgacacagagcttctgaaaggcttctttataatcttcctgaactgtgaaaacatcataggcttgatagaattctgtctgttccccggcctctatctgaaaatgacgaatttcaatctcccgatactctgcctgatccatctgatagaagcagatcttgaatgctttcggataaatgttctcctctgctttccctctcctgcaaagccggatgcggaatccttcggatgaaatctctgtcaggcggatttctctttgcctctcttctattgaatcttctgtcataactccggccagaagtccatatggaatcatctgaattcctttgatccttcgctttttcatttgcttcctctctcttttaaaaaatccttgcttgaacaaagaatgtgcctcggcacattcttgcgcctgcggcggtcgcttgcgacacttacattatacgccgcagtgtgcatcctaagcggagcgttttttatatattaggaaagcactttcctaatatataaaagatcgtgctgtcagcagaactctctgccgacagcacgattcctatactttttacttatatgattcgattagatgttcagaagatcactgaatactttcagggctccgtctgtctcatgtgcaagtacgcgttttgcaaggactttaccgagctgaacaccttcctgatcgaagctgtttacattccacaggaatccctggaacatgatcttgttctcgaagtgagcaagcagtgctccgagagatgctggtgttaactgctctccgataatgatgcttgaaggacgtcctccttcgaagttcttgttgcggttctcatcttctttaccacatgcaaatgctacgatctgagcagctacgttcgcgcagagtttctgctggcttgtgctgtcctggatcacaacatctgtaccgatctggctgttcttgaatcctacgaactgaagcggcacaatatctgttccctggtgaagaagctgatagaaggagtgctgtccgtttgttccaggctctccgaagataaccggtcctgttacataatcaaccggctcaccaaagcggtttacggattttccgttagactccatatccagctgctgcagatgtgcagggaaacggctcagtgcctgggagtatggaagtactgctgtgcttgggtatccgagtacatttctctcgtatacaccgatcaatgcatcgagcatctccgggttctctttgatattcttattgagggacagtttatcctcagctgctgctccgtcaaggaactgtgcgaatacttccggtccgaatgcgagggaaagtactgctccgccaactgctgatgtagatgagaaacgtcctccgatatagtcatccatgaagaaggctgcaaggtaatcatcactcttggcaagtggtgaagtctcgcttgttactgcgatcatatgcttggatgcgtcaagtcctgcattcttaagagcatcctttacaaaggactcatttgtcaaagtctcaagtgttgttcctgacttggatacaagtacgaagatggaatgagcaacatctacagaattcagaactgctgccgcatcatccgggtcaacgttgctgatgaactttgcttccatcttgaatgtatcattcttctttgcccagttctcaagtgcaaggtacattgcgcgaggaccgaggtcacttccgccgataccgatctgaacaactgttgtaaacttctctccggcaccgtttgtgatctcacctgcatgtactttgttcgcgaactcagcaatcttcttctgctgctctacatagaaagtacgcttgtcaacaccgtcagcctcaacagcatctccgagctgtccgcgtgtcatatggtgaagtacgagacgcttctctcccgtgttcacaacttctccgttgtaaagtgcttcgaacttctctgtcagctgtgcttcttctgccagtttctcaagagctgcgagaactgtgtcatccactttctttgctgcataattgtatgctaatccttctgccatcggaacactgtagttcttcacacgctctgctccgttctctccggccatcactgttgcgagatctacactttctgtcttctcaagttcctgataagaagtaagcttatccaaattgttccaggtaatcatcgttgattcctccttcaaaaaataatcaagttcattatacaatcaatcccgtacaaattcaacccacaaacgatattatcagagcagctccgcaaacagacgtaagatcagctgtccgagtcttaaacccgcacttcttccttctttatactgctcggtcacttctctgctttctcccatcgtgcggatcagatcatcccggatctccagcactgcgtcgcaatctgccaggaagcatccattctcaaagtgatggtacaggctgcggtaatcgagattgatcgttccgcaggtcgccattttatcatctgccacactcatcttcgcatgacagaatcccggtgtccactcatagatacggactccatgcttaaccagattatgataaaaggaacgggtcacactgtagaccatcttcttgtccgggatacccggtgttatgatacgcacatcaacaccacgctttgctgccagtgtgagtgcatgtgtcatctcgtctgtgataatcaggtatggagtgataaaccagcagtatttctccgctttgttcgccatactgatatatacttcctcgcctacctgctcaccatcgagcggactgtctgcatatggctggacataaccacgctgttgtgcctggtatgcatagtggatcacatatttctccggtacaagttcttttgactttacatttccggctgcattccacatttccagaaatgctactgtcatagacttgactgcatctccttccatacgaatcccggtatctttccagattccatacggatgtgtgatgttgaaatactcattcgctagattgtatccacctgtgtaagcaacctttccgtcaatcacagtaatcttccggtgatcgcgattgttcaggaacatattcagtcccggcagaatcgggttaaatacacggcatttgattcctaaagatttcagttttgttgcaaaatccatgttcacaaaccaaatcgatcccatatcatcatagaagatacggacttctacgcctgctttcacacggtcttcaagtaccgtctggatccgttgccatgcctcttcgtcttcgatggcatgatactccataaagatgaacttttctgcctttgaaagatcctccagctgtgcatccagccctttgattgcctcatcataatatgtaacatctgtgttctgataaaccgggtaactagagtaattcgtcagataagaagcgattgcccccgcctgcggactctcttttttcatccattcgagaatctgtctgttatccggaagatatgggagcagttttttatcaatctcttcatatcttgcccgcatcttcttcgtgcttccgttcagacctacgagaagatacagactcacaccaagaatcgggaatgcaagcatcagtatgatccatggcattttcatcgatgaagtcttatccatgctgtaaagtccaagcacaagaaagattgccacgattcttgttgcccagtcaataatagttgcgtattcacttacctttgtgaacagaaagagaaggaagacaatctccagcaagatagatactgctgtgaagatcagcctctttgttccgttctctgtctttttctttccttcgaatgtactgccgctcaaatctacatgccccttttctcttttccttttaataattgctattttctctttgcatagaaagacggagaatccgatcactcagattctcctgactcttttaattaacacatactataacagatatggaaggaaattgaaacaagtattttctttttccactgtttttttattcatgtctaagtgcctcgattggattcatgttcgccgctttcacggacgggatcagtccgaagataataccgatcagtgtggagaacagcactgcgatcacaatcgaaactccgctgattgctaccggaaccgctgagactttggatataatgtacgcaagtgcgattcctccaagaacacctataattcctccaagcagtgtcagtaccgccgcctctgtcaggaactgtgtcagaattctgcgctttctcgcaccgagtgccttctttaatccaatctcgccggtacgttctgtaaccgacacgagcatgatattcataactccgattccaccaactaacagagaaatgctggcgatccagatcagctgctgatttgtcgagttactgatctcctggatctgtgttgcctgttctaacagatcttctcctttgtattttacggtatcatctgaaactgtcagcatagcatttaaaatatctgcggctttctctcctgccgctgtcatatcatctgtgctttttgcacgcacgacaaggttctgtggttcgtcatactggtagatgaccggccatacattatccggaataatgatctttccgctctggtcatctgacatgtagcggtagtaatcttccattgagttgatcaccggctgggactctgctttctttgcaaccattccaacgacaacaaaaggctcgcccttgatctcaatcgttcttccgatcacatctgcattgtcgaataaacttgccgctgttgttttgtctatcaaggctacttttcgtccttcggaataatctttgtctgttaatcctcttcctttggttacctgatatccgtaaacatccagataatttctgtcaattccaagaatcacgctgttacttaatgactttgcgccgcggtaaactgcgtcgtattcatttcttgtatgatataaagacgctgtctccacttccgggagttcaacgacctcctgcagtgtctcgtctgagatctccggcactccgtccgggagtgactgatactgcagatcgatcggccagtcaccctgatagagctgtacatttaccgcgtcatttcctgcaccgaccagattcttcttaatctgttcattcgttcctttgatcgtagacacaattgctataatggaaccgattcctatgatgattccgagcattgtgagcgcagatcttaatttatgattccagattccctgaaacgccagtctgatgtcttctaacataatggcacctcactctctttcattttgatactgttcagtcttcttaataatagtcgtacagggtatctgcttcctgtgtctttgcgccttctttgacatctctgccgtaagggaacgcgatcaggtcgtccattgtgaggccggaggtgatctccagtgaattgtacatatttttgccaacctctacatactgttttgttaatctgccgttatcgccccgcttgtagacataatagcggtttccttcctcgcggacaaacattttttcaagatagatcgatccatcactacctgctgcaattccattcatcgacagattcacagactcaccattcgagagatttgcgtctccgtggatcacgagcgtgaacggatagaaggactgattctggttctctcctgtggaataatcgcttaccggtgagttgccaacacctgtaactgtcgcttcgtaggattctcccgactgccaggacatgacagtcgcagtcattccttctttgatctgatcaagcattgtctctccgactcttccggtcacatagaaaccttcttctccgacaacgctgacaaccggtttgttctcattctttgcagatgcttcgtcagtcgcttctttgactacaccttctaccgtacttttgatcacgccgtccccgacctttttcttcagctttttcagttccagttcagcggatctcttggaaagatccagatctttgatcttctgctctttctccttgatttgcttctccacttcttcctttgacgggaggtccggggtgtctgggataaccggatcttctgaaatatccggttccggagttggctctggttccggagttggttctggttccggagttggctctggatttggagtcggctccgggtctggagttggttgtgaatccggtatgactacctgtcctgtttttccatcgaggatccagcaggaaatgaatttggtcggcgcttctgcgttatctactacatcaaaggcacacacttgaccctcttttaatactttaagcataaacggtgcatttacggctgcccccggtgcacaaagataacgatacggtttttccattgttccgtctgcgtcttctttattataaggaacagaatctaatgtaatctcactgtaaacctcttttccctttaatgcttcagggaatggacgctcaattgtggaagacggtacatcgtcttttttattatcatctttggatgtgtcatccttcgcattatcatctttcgaagcatcgtcttttgaagtatcatcttttgaggtatcatcttttgtgttgtcgtcttttgtcgtatcatccttcgaggtatcgccatccggttttttattctcatcctcttttgatgtattaagaacagttatctttacagcactcatcttctgtacagttggctgctgttctccatcttcacttgtctgcacgacggatgcccctgtatctgccttcgcggtcttcgtctccttgagctgggtgatctctttctgcaagttctgaatgttcaggtcaatcccctgaatctgcatttctttcatctcaagttccagggaagaaagtgtcgtgtcatatgccacaagacggtctccaactttcaccgtatccccggctttcacgtaaacctgtgtgatcggcatagtatcatccacgtaaatgtcctgcttctggttcgttgtgacggttccgtaacttgcaatcccactatcatcgtaccagccgccggaattcaaactgctgacaggagctactttaacagcctttccgctgttcttcactgcgaaaccgattccaagtgcaagaacgatacagcctgctgccacaggaatgccgatctttattattttctttttattcatccacactctcctccgttcccggaactccttcctgcattgcattttcttctacaggttcttcgtaaccgccctcggctcctgacatatctgaagtactgcctgatgtacctgaatcgttcttcacaacagctgcaccttttttgcactcctcgcttggccatacaatgtaatcagaagctttcagtccgtctacgatctcacaggttcccatatcttcgttcgtctctccgagtgtaacagaacgcttctccagcttgtcattatctcctgctacccatacatatggatgatctgaatctgcgtctacaatgtagtcacgcatcagccacatcttgtctgcttccagtgaagtacttgtctcgatatagacatgctgtccaagcatcaatccatccattgtatccaatgtgacatagaatggatactttgttgcctgattatcgctgttctcagaaccataactcatagaatcctgggaactgttctccggcttctctgtgtctacgttatctactgtacctgtccagatctcatcttcattcactctggagcggatcgtcacctgtgtgcccggtgtcagatctccgatgttctgctcgcttatctttcctttgattctgtattttcctgtagaaaggatactcataaacggttgggactctcctgtagaagggtctgttccctgctgttcgttaatctcctgtacaattccggcaactgtagaagttactgtagactgttccaggctcttctgtgtacggtttacttccagctcttttactttataattgtactcttcctgcttgatctccatctgaagttcctgtatctgtgtcgtataggacagctgttcgctggccggtgcactcttcttctccgttgtaagtaccgagatctgtgaattcaggctgctgatgttgttcgtgatcttctcaagctccagttttccctgatctaatgtcatggcaagctcttctgtatcgtattcaaacagctttgttccaggctccacttcctgccctttttcaacaaagatctgttttaccttctgattgtctgccagtgtcagtttcaacgtatcctgtgcttcaaccactcctgtaaaccggttctgtgtcccaagtcctgtccctgtgatcattccgacggaatccgcatagagaacattctctccatctgctccacctccgcctgtcagattcttcacaagaatcagggcgatcactgccacaaggaagatacctccgccgatcaacattccttttttctgttttgtatccaatcttcttttttctttcggctgactggagctctgtgtgtcggatgactgctttctgattccccgcatcgtttgccctcctgctttattttatttttacttctttttgtgcaaaagataaaaatctccgaaacatccggtacaatctgcacaaaatattctctcataccatcagtatacaagaaatgtgcctaaaaagacattgatattttcttaagattttttatcttttttctatagccggctcacagactccttctgccccggcaagcagaatcatcagaagcaaatctctctgtggtccaagccatgcttcttttggctcgtaccattcctgaagggtatggattgcgtcttcttctccacctcttccaacagtgattgccgggattcccatactgatcgggatattcgcatccgtactgctctcataccgatactccggttcaatccccagcagttctgccgcccggaatgctgctttcacgatcgcacagtcctttggctgtgcccccgccggtctcacaccgcgtccttcgatctgcactttgatctgcggctttgaagcatcccatcttgcattttcttcttccactgcctgtttgatcactttatgaagttctttgtccaatcggttcagctcttcttcgctgtccgaacgaaggtctaccagcatggatgcagaacctgaaattgtatttacagaagttcctccctggatcacgcctacgttaaatgttgtcttcggctcattcgggacctggaattctgcgatctgtgcgattgctcgtcccattgcatggattggattaggaatgccaaagttctggaaactgtgaccacctcttccggtaaatgtcacctcataacggtgacttcctgttgccgtatagatcaccccgcccgtatactggttatcaatcgagacaaatgcatctacctctggacattcttctgaagctttgttgtcgtatccgaacagatacttcacgcctcttagatctccaagtccttcttcacacacatttgcacaaaagatcaagtccccttttgtgtgaagatctgcatggatcattgctttcgccactgcgatcatctccgccactgcatgtgtgtcatcgttaatgccaggacaataataacgatttccttctttccttatcgacagatctgtcccttccggaaatactgtgtctgtgtgtgctgcaagcattacacttggtccttcaccggttcccggccagatcccaagcacatttccaacagcgtcaatcctgacatccctaagcccgatctcccggaaccgctcccggatatactccgcttttttctcttccttataggaaggtgccggaatctgacacatattgagcgtgtcctgagtcgttaccggatcttcttcctttatatattccaatgcctgttttattttttcattttcaagaatcatttccctgtttcccttcgttctgtgtactttgtattttgctgtaataaacacttttagtatatcatattttcttaatgataccgtgattttgcggattttctataacagtaatttttttattgaactttttcatttatcgtggtatactctgactaaagttttgaacttttaaattgaactttttagagattttcgtattgaagcagattttaaattgaactttgtattttgttaatactttattaatggggtctgatccccggaaggataaccccagaaaggagctttatggaaacctttgcagacagattaaaagccgctatgaacgagcaaggcctgaagcaggttgatcttgttcgtcttgcccagcagaaagggatcaagcttgggaaaagtcatgtcagccagtatgtcagtgggaagacaatcccgcgtactgacatcttacattttctggcagatgccctacaggttgatcctgactggttaaacaataataatgattccacactgtcagatgttgataagatacagacatccgcagataattcaggaggtatgaaagtgagagaattcaagaaatcatccaagttaaataatgtattatatgatgtgagaggtccggttgttgatgaggctgccagaatggaagagatgggaactcatgtactgaagcttaatatcggaaatccggctccattcggcttccgtacaccggatgaggtgatctatgacatgagccgtcagctttctgactgcgaaggctactctgcttctgccggtctgttctctgcacgaaaagcgatcatgcagtatgcccagttaaagcacctgccgaatgtaacgatgagcgatatttacacaggaaatggtgtcagtgaactgatcaatcttaccatgtctgctcttttggatacaggggatgagattcttatcccgtctccggattatccgctctggacagcttgtgctacacttgccggtggaaagcctgtacactatatctgtgatgagcagtctgactggtatccggatatcgaagatatgcgtaagaagatcaatgaccgtacaaaagcgatcgttatcatcaatccaaacaatccgaccggtgctctttatccgaaggaagtactgcagcagattgtagatctcgcaagagagcaccagctaatcattttctctgatgagatttatgaccgtcttgttatggatggaaaagagcatgtttctatcgcttctcttgcaccggatctgttctgcgtgacattcagcggactgtccaagtcccatatgattgccggattccgtatcggatggatgatcttaagtggaaataaaaatattgcaagagactatatcgaaggaatcaagatgctttccaacatgcgtctttgctctaatgttccggcacagtccattgtacagacagctcttggcggacaccagagtgtaaatgattatattgttccgggtggacgtatttacgagcagcgtgaatatgtttacaaggctctgacggatattccgggaatcagcgcagtaaaaccgcaggctgcattttatatgttcccgaagattgatacgaagaagttcaatattgtgaatgatgagaaatttgctcttgatctgcttcgtgacaagaagatcctgatcgttcagggaagtggatttaactggcatcagccggatcatttccgcgtggtttatctgccgcgtattgaagtgctgaaagaggcggttggtaagatcggggagttcctgcagtactatagacagtaggaattcaaaaaatgagctttggaaagccaaaactttccagagctcatttttttcagattgagggcgaagcccaactttatccaagcagttctcttaccatctctgcatcaaattcaactttctccacatgatttacctcaatctgatacagtgcattcgctgcgatgtgttctgctgcctgttccagatcacgaattcctgatgtgttggagtacagttcaatcacttcattgagtgcctcttctgtcataatgcactcttctgccttcaggctcatgcgtttcagcaccttcggaagtgcaaatttggagaagattactttcttctcttccggtgtataatccgggatatcaatgacagcgaaacgggacatgagcggtgcactgatctgatccttgtcattcgctgtagcgattggatatacaccaacggtaggaatcatacactccatgtaattgtctgtaaatccaaggttgtccagcagtgtaagtaaaacatctgccgggtttccgtttccctttccggatgccgccttatccagctcattaataatgaataccagattggattcccctgccatggagaatgcttccatgataatacctggctttgcgttcgaatagattcttgaacttcctgtcagctgttccggatcgttaatggaactcatgtccagtgttgtccaaggaagtttaaggattcttgcaacggcataagcaatctgagatttacctgttcctgccggtccgacaagcagaagtccgtacgccggaagtgtgtgtgtacggttgatctgaatgattgtctctatgattctctgctttactttctccattccatacagctcttcatccagaattcttctcgcttcatccggatcgattgcttcaaagtaattactcttccactgaatattcatcatgatagaaagtgctctctgtgcgtgacggcgctcttcctgagagacctcgtgagaacgtgcaactgcaagatttcttcttgcccacagacgaatgttatccggaagtgtacgtcctgcgcacgtcataaagtctgtaatactctgaatacttgtaagcttcatgtcatctccggactcttcctgctcgtcatcattgatctcttcttttggcgcatcacttgcaaacagccgctcgatcataaactgaaggaagccgtcctcagcagataattttgttccgcctccaaatgcgatctcacggattctgtaaacggcataaccatccggcttattttctccggaaagacgtacattaatgtgattttctccaagccattttaaaagactgacaaaacgtgcatccactttcaggatatctgcactgcacgttccgtccttttcatcaaactcaaatgcggtctgcttattctgattggtaaatacaccgcaggaatgatgattccacttccggttctggttatccagaacaagaatcggacactctggtgtcgcatggtcttcgttggaacaaaatgttgtataagtacactgaacttctttcttatcttccggtgcactgttaaagtcaaatactggcatactttcatctcctcatgttttgttttcagaaacattactattctaccacaaactttttgaaagaaaaaggaagaatattatgcatcttccgggtttatttctatcgaatatcttaagagatcctaaaacttggctacatttcttgtaacttgtatctttttatgctacgatacttttcagaaggatcttgtcaacttctgacatttttcgaactaattcatgcaaaggagaatcttctatgaaaatctgtccaaaatgtaattcactctgcgaagacagtgcttctttctgtcaggaatgtggtgctccgcttcccactcctaatgataatgctcatacacaggagaatcaaaagcagcaggaaagccagttccagcagaatgcatattaccagaatgcataccagaacaactataatcagaacaattattaccggaacggggcaactgcaggcattatgccacgtaatcttgtacttgcaattgttttttcttttctcacctgcggcatctacagtatctactggatgatcaagctgaatgatgaggtgaatcagctggccggagagccacaggcaacaagcggaggcatggtattcctattttctttgatcacctgtggaatctatggtatttactgggcttataagatgggagaacgctgtgaccgcatcagaggaatacaggggaattcttctattctctatctgattctctcgattttaggattagatattgtatatttctgcttattgcaggatatgatcaacaaagaggtatcttaatgcaaagaggatacatagaaattcttgtcacatacaagttttctatgtatcctctttcttctatctttctattgcattagacatggaaacatccaccgccaataaattctctcaaaagtgaattcgttggcacagtgtcatttccgattcctacgaaataatccaaaaatttcaacaaccgctttgcttcaacatattccggagagtctttgcttacaccaagaagcaacggctccacatactgtttcaacactgccagttcatagatcagggaagagttaaacatcacatctgcatattcctgatatgggaaaatattcttctcttctcctcttctcactgacggccacattgagatggtctttgtcgccgatgcccctcttgttcttgcatccctgacaagtcttcggatcaaacgtccgtctgtagacggaatccggttatgctcatcaatattcagctgtgttaatgcactgatatagatcctgaatttccggtcatcacataactgttctgtcagcttcggattcaggcaatggattccttcgattacaaggatatcattttcaccgagtttctttggctttgtttcaaaattccgtttaccggtcttaaagtcaaaaaccggaagatagacttcctcgcctgccagcagattgctcatgtcctcattgaacttttccacatcgattgcttcaatgcattcgaagttataatttccatcctcgtccttcggtgttttctctcgatctacgaaataattatctacagaaatcggatgtggatgaagcccgttcactctgagctgaatggataagcgatgtgaaaatgttgtcttgccggaagaagaaggtcctgcgatcagaacaaactttacccccggacgatctgcgatctgctttgcgatctctccgatcttgcgctcctggaatgcctcctggacaagaacaatctcacgcatatcatcctgcgtgatcatgtcattgagcgcgccgacggtatcaatcccctgctggtctccccatctcacagactcactgagtacacgaaacagcttatcctttggcacaaataaaggcactttctccggttcgtctttcagcggcatctgaagtacgattccgccctgatacagatacaatgcaaaatacttcaaatctcctgtatccggcatcatataaccataataatagtcacggaattcattcatggcatacagattcacgtaggaacttctccgatactggaacagacgttctttatcaaacatcccatatcgatggaataattccactgcctcttctgtatggatcaactcttttgtgatcggaagtctctgctgtacaagttcatacatgcgttcttcaactttccattggaattccattcccacatgatcgattccttccaccgtacagtaaaatcctgcacctaatgaaaaatgaatccttacccgcacctgctgcggacactcatgaccaatcacatcgtgtactgccttaataaaaagaaagcagacacttctccgatacgtgtcataccccgccgtatcctgtgttgtaataaattgcagcgtacagtctccggaaacctgttttctaagttcttgcagacgatgtccatccagcatcacaagtgcgatctgatgtttatactcttcctgaaaatccttcgcgatctcctgataagacgtccccttctcataaagatactcttttccgcttatcgtaaccttacatttctgactttccaactcctcagccacctccactgtctttgtgaactgctttcttcccacagctgccctgctgaacattattatgcgttcacttctgattatatgatctggaacggatgctcgattggatctgtaagtacatccagcaccggaagcttcttctcaaagaactgcttcatatcttcaataaaaatatattctgtgccataatgtcctgcatcaattactgcaagcccctgctctactgcatcaattccatcatgatgaccgatatctcctgtcacaagaacatctgcccccttctcgagagcaactgcaatcgagctctttcctgatcccggagaaattgcaagacgatgtaccttcttctgcatatctccaaatactttcagacttccaagttcaagtctgtgtttcacatagacacagcactcttccaatgtcatatctttctccagattaccgattcttccgattccttccggattcccttcttcatctgtataggtaacatctaacacttccccattctgaagatccatgatctttccggacagttctgccataccaagcacatcataattcgtatgcattgcataataggaaatgtcgttctggatcagcttcacaattcttcttgtaataaaatcttcatccgtcactttctttactgctgagaataaaagtgggtgatgtgtgatcagcatgtccgcaccttccttgatcgcacggtcgatcacaacatctgttgcatccagtgccagataaattctggacacctctttctctgaacgtcctgcaagcagtcctacattgtcaaatcccaaagctgctgttcgcgggaatgttgcctctattacctgtataatctctttacactgcataatatttcatccctttctctgcttctacaagttcctgttccaattcttcttttctctgacgaatccggtcagaatctttcgctttcaatccttctaaaatactttgataaatgcgtatctctctttccagatactctctgagtaccggatgttgtttctccagcaaaagctttccatattttaactgaaccgtatcccagcactttacttctgtatcttcgcctgctgtatcagctaccggtggtcttaccttcatcataggataatattttccatcttcacagaccatatcttcttccagaaattcatatcccttctcaagaagaaatgcccgcactttctcaatctctgactgtggctgaaggatacactcctcaagctttcgcaccacttcctctccttctgtcaggatccggatcacaagtccgccgcccattcctgcgatgaccgcagactggacttctcccggctgtaatgcctgaaatccattggaaagtctcgtctctatctctgcttcaagtccattctcgcggatatgttcctctgctcgctgcaatggtccttcattgacatcaagtgcaactgcttctgtaatcttcttctgctgtgtcagataaatcggaatatatgcatgatccgttccaatgtccgctaatttataatgggcggtcacaagatctgcgaccgcctgtaatcttttcgataattccatcattaatccagataatccctcagttttctgcttctgcttgggtgacggagcttacggagtgctttcgcctcgatctgacggatacgctctcttgttacatcaaactctcgtccaacctcttcaagtgtacgtgctcttccgtcattcattccgaaacgaagacggaggactttctgctctctctctgtcaatgtatccagcacttcatccagctgctctttcagaagtgtctgtgcagctgcctcggccggaaccggtacattatcatcctggataaagtctccaaggtggctgtcttcctcttcaccgatcggtgtctcaagagaaaccggttcctgtgaaatcttcaggatctcacgtacacgttctaccggcatatccatctccttggcaatctcttccggaagcggttctcttcccagttcctgaagaagctgtctggatacacggatcagcttgttgatcgtctcaaccatatgaaccgggatacggattgttcttgcctgatccgcaatcgctcttgtgatcgcctgacggatccaccatgtagcataagtactgaacttatatcccttgtgataatcaaacttttcaactgctttgatcagaccgaggttaccctcctggatcagatcaaggaataacatgcctcttccaacatatctctttgcaatgctgactacaagtcttaagttcgcttctgcgagctctttcttggcttcctcatcgccttcttccattctctgtgcaagctcaatctcacgttctgcactcagaagaggtaccttaccgatctcttttaaatacatacggaccggatcttcaatactcacgccttccggaactgacaggtcgatattctccatatccacgtcgtcttcctcagatatgataatgtcatccagatctacatccacctcatccggtgtatctccgctaatgcgcagcacatcaatgttatttgcctcaaggtaatcaaataccttctccatctgatctgcgttgagttccatatcattgaaaaaatcattgatctcctggacatccagtatgctctttttctttttaccaagtgcaaccaggtctttcaatctatcaagaaatttctgtgtaatatcgtccatgtgttcttccttccttcgctgcgcgcatccgcagcctgtcttgttttattttatccttattgaattgtaatattcaaattcttcaggttctccagcttccgtttttcttccatcaaatgctgtaacccccgcatatctgtcgggtcgagattcattgtctgatgctcaatgctataactcttcacccgcaggatcgtctcctgtaaagcctgttctctctcttcctttgtcttcagctctttgattcttgtgttaaacaaagaggctgcttctctgtgatcttcttcctctgtgaaatgattcagtatcttcgcaggattcaaggctccctgctttctctgctcatataaaagttctgcaaccgtccgatacagactttctgtaaaatcacccgggcttatgtactgactgatctgatcaaagagcctgtcatcatcgatcatccaggtcaacaatgctttctgtgaagtaaggattccgtcttccttttgcttcttctcagatccctctgcccgtttcggtcttgcgaccggtctcgccattccggcattcacagccatctttgcgaccatcttctccaggctttcctggctgacccggtatgctgttgcaacagcttcgatatagttgttacgctccagctcatcttcgaattcaagcagtctcctcgacacttccctgaagaaatctgtcttgccttccggagaattcatatcatattgtttctccagcatctccaggctgaacatgaatccattacgcgccgcatggatccgcttctcatattcttctgctccaaggttcttaatgaactcatccggatctttatatggatccatccttacaactttagcagaaatcccggcctcccgcaagatcggcactgcgcgaagtgctgctcttgtaccggcttcatcactgtcataagtcagataaacttcctggacataacgcttgatcagagctgcatgtcctgctgtcaatgcagtccccaatgaagctaccgcattcgtaaatccggactgatggagagagatcacatccatatatccttcgcaaagaagaaagtatggctttcttgatgttctggcacggttcagaccataaagattccggctcttatcaaaaacgactgtctccggtgaattcagatatttcggtttcccatctcccatcacacggccaccaaatccgatcacacggttattgacatccataattggaaacatcacacgattccaaaacttgtcgtacacaccctgacgttcatccgtgttgatcagtccggcctgtcgaatcaggtcttcactgtatcccttctctctcagatacttatacagatcatcactgtatttgttcgaaaatcccagtccaaacgctgtgatcgtctcatctgagagttcacggttcttaagataactgtaggcctgacttccacgctctgatttcagctgtacgtagaaatactttgcagccagcttattcatctcaagaatcgtagactttaaatctgctttttccttcgcttctttcgagtattccatctccggaagttcgattcctgctctgtccgcaagaaacttcactgcttctacaaaagaaaaattctcatattccataagaaatgtaaaaacattccctcccgccccacatccaaagcagtaatacatctgcttctgtctgctcacagaaaaagacggtgatttctcattatggaacggacataatccaaaataagagctgcctttcttctgcagccggacatatccggaaatcacatctacaatatcattccttgatcttacttcttcaatcagttcttctgagtagtacatgagtgcctccgcttaatgtttaaagaatactctattatatatattcgacaaaactcttctctttcctttttatttttttaattttcttctttttttcttttccaatattattttccaagcagaacggttttatatataaaaaaaccaagaatactttgttctgtactcttggtcttatcttactgcggaagatgggacttgaacccacacgatcgcattgatcacaagatccttagtcgaacccacgtatccagcttggaaggctggtgttctaccattgaactacacccgcaggatgatcggggtgacaggattcgaacctgcgacctcctggtcccaaaccaggcgctctagccaagctgagccacaccccgatatcagtttttttcctcgcccctgcggctttgtgtttctttcgtatctcccgcagcgacaagatatattatatggcatgtttctcagaaagtcaacaggttttttaaagtttttttacttttttgcgactgtttttttacctgtttttcgcaagaagagtgtgcaaattgtttcttttgttttagttttctgataattagaacaattatagatatttttgctcaaaactcaattttccgtccccatcgacttccatgatcatatagctgcctcgtcttccctcctgacgtggaaaagatagacttcccgggtttaaaattgtcattccatccttctgaagaaagaaaggacgatgtgtatgaccaaacattacgagatccgctcctcttgatctgccctcttctatgatggtttccatccccatggacacataataataatgtccatgggtaataaatgcatgataaggcccaatctcaaactcctcttctctcggaagttctgtaaaaaagtcgttatttcctcttataatatgtttctcacactctacgacagcctccagatagtcttctccaccttctacatctccaagatggataaacatatcaattttcccagcctcttctaatgcgcggtccagtgcctggtgtcttccgtgtgtatcactgacaatcagaattttcatgcttcttcctcgttcaatttctcttcaagcaggatttttattgctcgaagtgcttttcctctgtggctcaatttatttttctgctccggtgtcatctccgctgttgtacatccgaattccggaacatagaagatcggatcatacccaaatccattcgcaccgacaatctcgtgtccaatttgtccttcaatcgtctcacggactacgcttgttgttccatccggaaatactgctgcaaccgcacagacaaatcttgcggtacgctcatcgtccggaaccccttccagtctgtccagaaggattctgttctttatatcataagaagtatcctctccggcaaatctcgcagaataaattccaggtgccttatccagatagtcaatctcaagacctgaatcatctgcaagaacaatatcgttgaccagcactcgtgatacagctcttgccttgatctctgcattttcttcaaagctcattccatcttctacgatttcttcatcgactcctgcctcacgcatcgatacgatctccataccaagatcagcaagaatcatccggatctctttcatcttattttcatttcctgttgcaaatacaattcttctcttcattttgctttctaccttctattctttttcaccatcaatctggtgcagcgtttcttatttcttcggtctcggtggctttggtccctggaactgatagaaatatgttttcagcataccattataaatcttacggtttttatctgcttttcttccgaaataacgttctgcgtcttcataacttgtgatcatgtatgcagaccagctgtcaagtttcctaaagctctcgccaaattcacgatataaaccaggaagtgcctctttctcctcaagacgctctccatatggtgggtttgttataataaatccatatttcttcggatgactcagtgcactgaccggtctctcctggaaatggatcagatgatccacacctgcattctctgcattctgtcttgccatccgcacaacatccccatcaatatcatatccctggatatccgtctcaatctgatcatcgatcagatcattcgcctcatcaatggcctcataccagagtttcttatcaatcagattcgcccagctctcagccgtaaaagaacgattcattccaggtgcaatatttgctgccatcattgctgcctcaattggaaatgttccacttccgcaaaacggatccactaagatacgctcttttctccacggtgtcagcatgatcagtgctgctgccagtgtctcagaaatcggtgccttgccggctgacggacggtatcctctcttatgaagagaatctcccgatgtatcgattccgatcgtaacgatatccttcatcaaaaatactctcagtggataagaagctccatcttcctgaaaccactgtacatgatatctgcttctaagacgatctaccatcgctttcttcataattgactgaatgtctgaagggctgaacagcttactctttaccgatgaagctttcgccacccagaacttcccgttcttcggtatataattctcccacggaattgcttttgtcttctcaaacaattcatcaaaggtaactgctttaaaacttcctgccttgagcagaacacgttctgctgtacggagaaatacattcgctctgcacgctgcatctgctcctccgtaaaaggtaactcttccatcttccacctgtgcgatctcatatcccagatcctgaatctccctttttaatactgattcaagaccgaaatgacatggcgcaatccattccattctttccatatctacctcatattatctttatgtacttattaattgttactgttcacacgatgtgcgaccagcaacgcatctcgccattttaaatcgctcaagtcaaaacacgcatcctccgtgtcaatcagcggagtgattgacacgggagtaaacagtaacttccgaagttttctttagatgtagaataccacactgccattcttttttaaaccgttattttccactacatctgtcgttcataatttgttcatttatcatttaaaaatctttcatcttcttatcactttttcttcatttctctcacatatactataagcatcaaaggaaaaaacaaaaaactttgaataaactttttcataatacatgccgggaaccagtaaatggttacccggcatcctcccttttatggagacttttttcttattccggaacaaccggatcatttatcacttcttgtttcgtttcctgttgtatttcctcttctacagatttttccgcagtttcctctgtttgctgttctgtcgtttgctctgcttcttccttgttttccccgttattctcttctttcgtcgtttcttctatcttcttttcacatgctttgaccgattccagaatctcctgaacccgttcctccatctctttcttccatttcatatcttccaatgctttttttctttcctgttcagtttcactatgttcttctggtattgtttttacatcgtctgctttctgagcttgcactgccgtttcacttttcccaactgtattgttgctttctcttccccggctcatcccaattcctgctgccgcaattactgccccggcagcaaataaaagaaccgccagtttgacattccgaaattttactttctgttccaaattccattcctcacgttcctccggaagatcacgtatcacctggctgatcttgtcataatgccgtcttccgccaccggtacaacgttcaatgatccgctccaatctgcgttcttcacttctgctaagttctggaatctgctctgtatatgccagtaaaaactgcaatattttaccatatccgaacaaatccacggaacaatttttcctgctgcctgacgctgtcgggcggataaaatgacttctcaccgctttctgctgcatcttcttcataacaaattcattttcctgtgcatccggattcaaaagcagcaattctccttcttctgtcacaacaatactatatggggtcagacaacgataattctgcccacgtctcgactgctgatactttcttatttcccctgcaatctgtcggaaccattcaaataacactgctttatccaactgtgtattatcccgcagataataaatcaaaagttctccctgcaggcaatcgatacttggctggcattcggttcctttttccacgaagcgaagtacttcatacattttttccatatttaattctactgcaatctgtcatctaaacgtgtgcggccccacaccgcacacgatacaatacctgtccaattgaaaattatcagaatctgatacgaactactcttcagaatctttcctgattcttcagtcagaacgactgaagtgtgactctcatattaattgaattcttccagtctgtcaagagctgcggcaacaactttatccatgtcataatatttataatctcccagtcgtccgccaaagattacattttcttccttttctgcaagcttcttgtattcttcaaacaatgcattattcttctcatcatttaccggataatatggctccatgccaacactccattctgatgaatactctctggaaataactgtcttatcctgcttgccaaactcaaaatgcttatgctcgataattcttgtatacggaacttcacgctctgtgtaattgacaacagcatttccctgatagttctcacaatcaagaacttctgtctcaaatctgacagaacgatactccaatgctcccagctgatatccaaaatattcatcgatcattcctgtaaaaataatcttctctgcaatctccggattctcttttctgaattcaaagaaatcaatccctgtgcgaacttctgtcccttccagcatcttctcaacgattgctgtataaccgccaaccggaattccctgatatctgtcattgaaatagttattatcgtaaacaaatcggaatggcagacgtttgataataaatgccggaagttctgtacactttcttccccactgtttctctgtataacccttgatcagcttctcatagatatctcttccgccaagaaaaagtgcctgttcctccagattttgtggatctgtgattcctgtctctttgcgctgtttttcaataatctcttttgcttcctgtggtgtgcggatattccacatcttactgaatgtattcatattaaatggcaggttataaagttcatctttataaactgctaccggtgaattgatgtaattattaaattccgcgaactgattcatgtaatcccatatctttttatcagacgtatggaaaatatgtgcaccatatttatgtacatggattccttctatgtcctcacagtaaatatttcctgcaatatgatctcttcggtcaatcacaagacatttcttcccttttttctttaattcatgtgccatgacagctccataaagacctgctccgacaatcagataatcgtattctttcatttactccttctttccgcagaacgattatctggatccggtaaaattcagagattaacctttctgccttctttcttttcatgttatggtgtgtttatgataacacattttctaataaatttgaatctctatcaaaaatacggtatacttaacagcaaaaggaggatgaattatgcttataaaaaatggttttctaattgatcctgcatctgatacagaacgtcttgtcgaccttcgcatcacagacggtctgatccagacactcgcagatgccggaactctgacacctgaaaatggagaggatgagcttgatgctgcaggacttatgatttctccaggacttgttgacacacacattcatttccgtgatcccggatttacttataaagaagatctccataccggatctctagcagcagctgccggtggatttacttccgtgatctgtatggcaaatacttcaccggtcatcgattctgttccggttctcaaagaactgatggaacgggaggctttggaagacatccatattttccaggctgctgctgtctcctgcggactcaagggtgaagagatgacttctatgaaggaacttgccgctgccggtgcctgtggattcacagatgacggaatccctcttaagaacgctgcatttctctataaagcaatggaagaggcaaaggcacttgaccttccgatcagtcttcatgaagaagatcctgcatttattgaaacaaacggaatcaaccacggacctgtatctgatgcgctgggcatctacggatctccttcgattgctgaagaatctcttgttgccagagattgtctgctggcgcttcgttccggtgcacaggtcgtgatccagcatatcagctccggacagtccgttgaactggtacgtacctttaaagctatgggagcaaatctgcatgcagaggcaactccgcatcatttcactttgacagatgaagctgtattaaaatacggcgcacttgccaagatgaacccaccgcttcgtacagaaaatgaccgccttgctatcatcgaaggtctcaaagacggtacgatcgatctgattgctacagaccacgcgccacacagtacggaagagaaatcccgtcctatcacacaaacaccaagcggtattattggtcttgagacttcccttgctctcggaatcacttcccttgtacgtccgggacacctgacattaagccagctgattgagaagatgacgatcaatcctgccagcctgtatcaccttccgtgcggttctgtcgcagaaggaaaatcagctgatcttgtactgtttgatccgaatgagaaatggactcctgagacttatgcttctaagtcttctaattctccatttaccggatgggaattgtatggaaaagtaaaatatacaatctgtgatggaaagattgtatacaaggattaatctaagaggtcccctgcagaatctttcatttccgcaggggacctcttctttgctcattaatcctcgatcgctgttactgtataatctttgtcttcgactgtctttttcagcacttcattactgatttcggaattcagtgttacaactgctgttcctgcctcatggctgacttctgctgtatcaacctgctcaagtgcctcgagagctttcttcacagccgcctcacagtgtccacacatcattccttcgattttcattgtctttgtcatctttgtctcctccttgttttctgactcatttttgtctgctaagacaatatctgaaacagtattttctgctgtttctacctttttcatctttctttttctgtctttgctggcatcgtacattttaaacagattcagtctcaatgcatttgttactacacagaaactggacaggctcattgccgctgctccgaacatcggatttaatttccaaccaaaaaccgggatccagattcctgctgccagtggaattcctatcgcattatagaaaaatgcccagaacagattctcatgaatgttgcgcaatgttgcacggctcatacggattgccgccggcacgtcacttaaccggctcttcatcagcacaacatccgctgcatcgattgcaatatctgtccccgctccaatggcaattcccatatctgccctggtcagtgccggtgcgtcattgataccgtcacctaccatcgcaacctttcctttttctttcagcttgcggatcacctgttcttttccttccggaagaacacctgcgatcacttcatccacacctgcctgctcaccaattgccttcgctgtgcgctcattatctccggtcagcataacaacatggattcccatattctgaagttctttcactgcctgtggactatcttccttgatcacatccgcaactgcgatcatgccaaggaactgctcattccttccaaagaacagcggtgtctttccttgctgtgccaactgttctgcctgttcttttatgctggaagagatcttcattttgtcagaaataaatttgaaatttcctccatatagccggtcctctccaagttttcctgacagaccatttcctgaaaccgcctgaaactgtgtgatttcaattttctgctctgcttccccattttcttctgcctttgcaagaattgcccgggcaagcggatgctcacttttcttctccaatgcatttgcaaaaaataataattcatgttctgtcattccgtccgcagggagcagatccgtcaccttcggttctccacttgtgattgttcctgtcttatccagtgcgacaatctccgtctttcctgtctcttccagcgaaacagctgtcttaaacatgattccattcttcgcgcccattccatttccaaccataattgcaaccggagtggccagacctaatgcacatgggcagctgattaccagaacagaaattccccttgcaagtgcaaatccaacaggctctccgacaagcagccatacaatcattgtgacaactgcaatagaaataactgccggaacaaatactcctgaaactttatctgccactttggcaattggcgcttttgttgctgccgcatcacttaccatctgaatgatctgtgacaaagtcgtatcctcgccaactctcgtcgcctcgcaacgcagaaaacctgactgattcattgtagccgcagacactttatccccttctgctttatctaccggtatactctctccggtcagggcagcttcatctactgcactgtttccttccagaacaattccatccaccggaatattctcccctggtcttacaacaaactgatctcctcttcttacctgatcgatagaaacttcctgttcttttccatcacgcaggagcgttgctgtctttggtgccagcttcatgaggctttttaatgcatctgttgtctttccctttgaatgcgcttcaagcatctttcctactgtgatcaacgttaaaatcattgctgctgattcaaaataaaattcatgcatcagctccatcacatgatccatatcgcctgccgtctgcgctgctgtcatagcgaataatgcatacacgctatatccataagatgcacctgcaccaagtgcaaccagcgtatccatatttggtgctctatggatcatgcctttccatccactgataaaaaacttctgattgatcaccataacgattgtcgttaacaggagctgcgccagccccatcgccacatgattcccttccagaaataccggaagtggccagccccacatcatatgccccattgacagatacatgagcggaatcaaaaaacacaaagaagcaatcagacgccttttcatcttcggtgtctccctgtctttcaacgcatcttccgcacagttctgctcactttgattcatcccatgcccttcattctttgcagatttcaacgttgccccatatccggcttcctcaacagcctcaatgaccgcatctgctgttgctgtaccttccactcccatggaattcgtcagaagactgactgaacagctctcaactccggggacttttccaaccgctttctcaacacgggcactgcaggctgcacaactcattcccgtcacattatattgttccatcttactcctccttcaagttgtgatccggactttttgtaccagatctctcttcagatcttttatcgcatcaatttctgaagtgtcgtcacgagctcgtcaatcgtttcatcttttccatcccggatatcatctgccacacatgtccggatatggtttgccaaaagcactttattgaaactattcagagccgcattcaccgcagatacctgaatcagaatatccggacaatacgcgccttcttcaaccatccttcgaactcccctgacttgtccttcaattctactcagacgattcatcagatctttatattctttttccgggcggtcctttgtcttgtgacaacatcccggacagactttcttttcttccattgtatttctcctgttgtataacccccagggggtatattttctaattattaatatataccccctacaggtatatttcaagtactttttaacaaaaagttattgttcatgctacgtgcggttgctgcttacgctatatgcggccggcaacaacaaagaagctgtcatggaacatttcacaattgtatctatgttccatgcagcttctctgcaatccattattatgttcgttattatatttcctgacaaatctgtcttattctacactcttgagtgattcaaccatgttaatcttctttaacttaaaatacatcactccattgacaaacaaagaaaaggccactgtcagaagaaaggcatacaagaaacttggtggatcgatatttcgtccaaacataaccgaatcaatctccactgtctcaacaataaagcggtgcagaatttttccgatcaacaatcctgccagtgccccaatcaaggtcagcaggatattctctctgtaaacataagaagaaacttccttgtcataaaatccaagtacctttaatgttgccagttctctcttgcgctctgtaatgttaatattattcagattatacagcactacaaacgccagcattcctgctgaaataatcaatacaataatcacgatgtccagactctccagcatatgatccacctgctttttcaggcttgtcgtatagctgatgctaagtgttccatcacacttcattatattttcgccgacatcctttgcctcctctgttgtacggtcctgagttctataataaattgaattatagaccggagcctcaccgaatgtcttttcatagacttcagatgtcatatagagataatgtcccatatagttctcacagattgcactgatcaagaccgttttctctccatcatctgtatcaatcgttaatttatcaccgacattgatttccagcagtttcgctactttttcagtcaggattgctcctttatcatccaatgaataaatttcttttgttttccgatcccggatcacgacaaactttttgaatgcttccacatcttttggtacatctaaataaacttcctgagaagactctcctgaactaatctcaatatttttcaaaagattttctgcagtcactgataccttcttatccgtatccagttctttctgaacctcatttctctcttcttctgtcacatcttcctttaaaataacgtctccatcataaagctgaatctgttcgtattgaagcggaacgattgctgaaatagaatcttttaatccaaaaccaaacaacatcatgcccatacaaccgccaattccaaatactgtcatgaagaagcgttttttataccgcaccaaattacgcacggtcgatttccatgtaaaattcagatttttccagataaacggaactcgttccagaaatactcgttttccctgttttggtgtcggcgggcgcatcaattctgctgcctgctctcgtaattctttcatacaggagaacaatgttgcgattactgtacatgcaagtgccgctgcacatgctgttacagcataatacaaattatacgggatcacaacatcatgcatatgacgatacaggatcttatatgcagtgataatgatatatggaattatcttttctccaattagaattccgaaaacaccaccagttaatgtcgcaaggatcgcataccagagatattttccaacaattgaagcatttccatatccgagagccttcaaagtaccgatctgcgttctctcctcctctaccattcgtgtcattgttgtcagactgatcaatgctgcaacaaggaagaaaatgagtgggaacactttaccgattgcccgcatacggtctgcattatctccgtatccactgtattctgtcagattgttccgatcataaacataccactttggcttttcaagatcatcaatcttctgctgtgctttcgcaagctcttctcttgcttctgtaatctgccgctctccatcttcaatcttcttctgagcttctatacgaccttcctcatacactgcccaaccgtcttccagctcctttgttccgctgcttaactgctgctgtgcctcctcaatcttcttctgtccctcactgatctgctgccatccgctgtcaatctgctgctgaccggatgtaatctgcgcctttgcctgatctatctgccgacttgcggtaaggattgcagcatctccctgtgtcaacacatccgtcagtttctgtatattatcctgcaataccggaataccttcttcaatctgagctatcccggcttcaactgctggaagcccttcgttaatctgcgtcaatccggcttcgatctttgtctggtttttctgaatctccgcttcggcagctttcgcctccagttccattttatccagatttgctttcaattcagtcaacttctcttccattgctgttttttcagcttccaactgttctaactgagcctttaattccggatcttcttctcctgcttcctgcttccggtcgtattcttctttcagtgcctcatagttctgtaaaagaagttcatactgtgtatttagttcttcataagactttttcaacggctgataaatctgctgatacgcagactgatagtcttctgcctgttgctgcaattcttcctttgctttcagaagctcgtctttcttttgctgcatctgtgtctgttgcgctaaaagttcttgtctctgatcttccagactttcttcctgctcttttagttgtgccagctgatttcttaatgttgtaagtgcaatctgtttttcgctaagttcctgtgcaccctgctcaacttgtgctttggactgatccagctccttttgctttgatatcagaagatttctcgactgctccagttcaagcttcgaagctgccagctgatttcttcctcgttcaagttttttctgcgctgcatcaagtttctctcttgcacttgcaagttcttcttccgcctctttttttccatccgccagatcctgctctgcctgagctaactcatcttgtgcttcatccactttttcctgcgctgtcgaagtaatctcatcatatctggcctgttctctttccgctttaattgcctgaacctttttcagcacagaatccacatgttcttcatattctttcgtaaatgcagtcgcttcctttgcaccttcaacctgcactgtaatctctgtatacacatctaatgaaaatgctttctccggaacgcaaagaaaggcactgacacttccatttccaattgttgtactgcctctgtgaaatgcaatatactccggactgctgaccgtaccaacaatggtaaatgtatctgtcttaagtgtatcttccaaagaatccgaagtcccactcgataatgtgatcttatccccaatcttcagattctttccatccagataatctgcatctattacacattcattttccttttccggaagcctgccatcttctaactgaacttgattcatcttatcctggagcgccataacatgaactgctacctggtttccccgaatcgtacaaagtacatctgttgcatagcttccttctgcatccaatacaccatccacagcacgaattgcatccagatcatcttttgtcagtcccattgtactcattacctgaatatccatcaggttcttctcatcgaaatatgcatctcctgaatatctcatatccggctctgatgcacggattccggaaaagaatgcacatcctatcgcaacaataaagaaaatggataaaaaacgtccaaggctatgacggatctccatataaaagttttttcgtaatgctttcttcatccacatcccctaccattcaatttcatcaatcgaagtcggattctcattagattctattcttgctacctgtccattttttatatgaatcaatcgatctgccatcggcgcaagtgcctgattatgtgtaatgataataactgtcattcccttttctctacacatattctgaagtaatttcaaaattgattttcctgtattgtaatccaatgcacctgttggctcatcacaaagcaaaagctttgggttcttcgctaatgctctcgcgattgaaactcgctgctgctcaccgccggaaagctgtgccggaaaattattcttccgttcccccagaccaacttcctccaaaactgcctgtgcatccaacggatccttactgatctgcaatgcaagctcaacattttccaatgcggtcagattcggcacaagattataaaactgaaaaacaaatccgatgtcatctctgcggtatcctgtcagctgtttggaattataagctgtaatatcttttccatctacatacagcttcccgcttgttgccgtatccattccgccgagaatattaagcacagttgtcttacctgcaccacttggtccaacgattacaacaagttctccctgctcaatcgaaaagctgatgtgatccactgcatgaatctcaacttcacccattttataagttttcgtgatatcctgcactttaacgaattccttcatctacattctcctgactctttttctcttcttctgcatctctcctggcaagcagtctgttgctcttttcttcgattctctacaggcgcagtttctcccactcttctcctgcaccaaatgtttcatgaaaacgttccggaagcggtgtatcctggaataatttcttctgatactgtacgatcaaactcgcagctaacggcactgcacctgaatattgccgtttcaaaaccttacaatatttctgacataacggatctggctttacactcatcactatgtcatgcaatgaatcgtatttccccactgccttcatcccaagaaacaacgcttttcgctttccagatgtcggtgccagaaacagcttatgataaaaaaccatcccttttaatgccttatagatctgctcggctgttacatctttgaaaaatggtgcgatcacttccgcatactccatcttcggctgaatgtgctttgctgtcagatagcgcaaaggatcatgataatcttccgtcagcatcattcgatccagttccatctcaatctcattgtgtgaaactcttccgacctgcataattttttcaacataaggatggcattcactgtctaaagcaaaatgacagataaatccataaatatatgcacgcgccgctgccggatcttttgctttctcaatcacttcaacagcatgatggaaaaactcatcggcaaattgttcatgaagtgtatgcccctgttcattcaccggatctttctttaatgcattataataaaataaaatatccggtccatgtaacccaatatcaaacaactctctatgcgcttctatagaattctgaaggggtcttggaagtgcgctgagcacctcttttccgaatttataatgtgcgtatgttgttggcataagaaacctctcctttttccgaattttcttgttaagatttataattactcatattattatattaacacattcttccctgtctgacagtaattatctttataaaaaatatgtgaaatgacattaaaaatgctaaatttttactgctttttcacttcttttaacgcaataatcacttgacatttatatttctttttactatattagtatgtacagcacacaagagaatgtgtctgttacagtagagagtatttattactctaccctgatcagggcttgtactggtttcgacagggatctcgaagatggaaaagctatccgtaggctgatgcgttaaattgcaaacttaaaattaaacgctaacgataatttcgaattagctgcagcctaaatgctgcatgtcagccctgaagcactcacactttaggaatctggcaccgactatgtgagaaacgatgacggcaaagctttgagctgtcaggcgtattatgaagctactaaacccgtaaggatgttagttttcgtacggcagagggaatgtcaaataactgactatgatagtagaagtacatgggacaggtttttggacgcgggttcgattcccgccaggtccactttttaatgaaaagtgtgaagactttaaaataacggcattatatctcgtaagatgagatgcaatgccgttattttttgaataatatccttgcctccaaatggaatgcataaaacaaaaaactctgagattcttgcaaatattgacttcacaaaaatctcagagaaaaaataatgccgcagaccggaatcgaaccgttttaagcaatcacaaatactgatagaaaggggctttgaggacttcatcacggttgcggtgttcaaaaagtgttcaaacgtttgtcgcatacaaactaaaaagttgttactttctgcatagtgtatttcctaaaatgataattactacgacatcaaccaaaataatccccaatgcaatatatacaaaaaatgcaggcaaaatattttcaagcaagcccattgtcaatgcaagaattgctataatagacattccaattcctattgttctgcataacttcttttcatcatatttttccttttcttcttttgaagccgtattatatccggaaataaaccaactcccgtgtccagaaagtaaaataatagaaaatacagcaaatatcacaaagacaatccacactatccaatcaggacctgttgctaaatctactaatttcatttataagcacctccttaaataccgatttgtctgtttcatgttatacacagtataattccattttataaaatattcaattaaaaaggtatgcgaatattttttatttccgcatacccatttatcactttattcttttacatatcgaattaactcaccaatttcacattcaaaatagttgcatagtttacagattaaatttgcgtccagtctttgaaattcatttctgcaatatctattgaaatttgaccttgggatatcgagttccttacaaatcatattcttactgatacctttttcttgtaacagttcttctattcttaattctaaatgtccataattcatgttccgcacctctacataaagtatatttattaaatctttatgtagtaattcactatatagtgaggtactatacagtcagtcccttgttaataacacaaaagaggtatgtacatgaaaaagaaaatcatagcaacaatcacaatgctctgtttactgaccgttctctataattatctcagactgccggactatcatattactaacagcatatcctttagcagtgcagataccagagatactgaattgactgtaattgtttacaaatgttggaaaattgatggattaatcaaagacattgaaaatgaacataacaaaatcaatggtacgcctaccaccttggaaatcaagctctattatccaacttattacttgcacaataatagcaaaccattccgaactacaaccattgaatataataaaaaagaatagcactctattactgcttttgaagtagtatcggctattccctctccttatattcttttgttcgtattttcgcaaactaacgttccgcaaggatgcccagtgcgacggttcctaacagggcggcgggtcgactgggcaagtggtcggctgagaagcattttctactcaacgacatatttaacgtttgattctctccgtccctcatatttctcctgtgccaacagtttatcaagaaattctgacacttcttccatgtcttcactgtctatcaaatccagttttatcaatacatcaaggtctgtctgattcttcggttgtattgagatcggctgagatgtatccacaaccactttcaactgttttgtcttatttgctgtttcaatatccgtagttaatcccataacgtggcttttactcacgccgaatatctgtgataatttttcccatatagattcatctctcggtgttccgtttccattttcatagttcgtaagcatactttgtgaaatgcctaattcttttgcaagttccgcaacggttatattcttttctttccgcaattcttttattttattcatagcaaacctcctttataagcacattatatttcatcaaattatctctgtcaatctttttatcggatattcagatattttctattgacattctgcaatgcttgttttatcataagattatcttaatatctgataatcagatatctataaggaggtgaaacgatgattagaggaaatgactttattttaaatccagacaaactgcaagaggaatttcagttagtagaagtttctgactgggtagacttttctacaaaagaaaaattaggattctactatacagttcttcttccaaaattaaagtttgaaaaagtcaaagtaggcattaaagctaacacagcgattgttaccaacgaagaacttgaacaaaaagggcagattccagtctcatttgatggattacatacttgggctagtctctataatggacgtctttctgtcaaagcagaagcttccaatatcagaaaagtgggaatgaaataatttccctactatgtcagccagtcagtgccggacaacgtcataggtgctgaactggctgacctctatacttgatatataaaacaacatcttccgaaaacaatcggaacattcattacaaaaattgggatatgaggtgagattcgtgagcaaaacaaaagagtgttttgcatacaatacgaaaatcattgaaactcctactacaaaagaagtatatatttacgaaaaccctatttttattcactcgaaagaaaaggcagatttaacagacacaagtaaccgaaaaaaatttgatgaaatgtcagctcataagcaatatgacagtttaaaacgcaagcagaagcattacgaacaggctcgttgggatattgcccgtattgttgactgcaactttgataacaaaacaaaatttgtaacgctgacatttaaagaaaacattcaggaaatcctgataactaaccgagaatttaagtattttatccagcgattaaattattatttgtaccataccaaaacccagttattaaaataccttgcaacgtgggagaaacagaagcgtggagcaatccattatcatgttattttctttgattttctgtatatagcaaaagaaaaattacagaatttatggtcacatggatttattaaaatcaatcgcattgatgtagacagcaaagaaaacagaggtcgttatcttagcaagtattttggaaaagaccttgatttgaaagaacataagaaaaaagccttttttaaatctcaaaatctgaaagttccacacgaaacaaaagtcatgctgaccgaagacattttacatgacttacaaaaagaaaatatcgtctttcagaaagaatacacaaggcaaatttacgataccaacgctttcttatctactggttcatgcttaaaggacagcagtgttatctacatcaaaataaaaaaagaaaatccttgcgtaaagggggaatcttatggataatcccgttacgttttcagatataacattattgaatacgttagccacctgtgctaacatgaccacagatgaagtcttcaaagattttaaaattatggcaaataaaaaaatcttgaagaatcacaaatatgaaatttattactcggaatcagaaaaaagctggcgtacttatttacccgatgaaaccaaacctaacaaacgccgtcctgttaagaggaagagtaaagagaaccttgaaaaagaaatcatcagattttatatcgaaaagcagaaagctgaaaaccgtcagaatgtcacactagaagaattatatgctgaatggcttttgtataaaagagattatacttccgtaaaagcaaaaacaattcaagaatatgtatctgaatggaatagatttttcaaagatacagaacttgttaaaatgaagataggcgaaatcaaaccaatcacgcttatccgctttttcagagaagctacaaaagaccgacagttcacgcacaagcgagtcagtaatgcccgttctgttttgaatggaataatgagttatgcgatcgaagaagaaattatatcacataatcctgtctctgatgtgaatttcaaacagtttacctataagccagtagaagtacaaagtgacaatgtattttcccgtgatgatacgcataagttattaaattatcttcggtgtatcatagagccatattctcttgcaatacagttatctttctatctgtttatccgtgttggagaaacaaaagctatccgttgggaagatattgactacaataacaggcttgtatatcttcacagacaggcgacctgtgaacgtacattgaatgatgatttaacattctcaagccgaaaagtaaaagtagtaaatcaaatgaaaggaaatacttctcatggattccgtaaacagttccttacagacgaagcacttaaaattcttcacaaagcaaaggaattaaatccaaatggaatatatgtctttgaacccaacggcgagattatgacaacagacagctttaatcgccgtttgaagaaatattgcaaagaagccggtgttccttatcattccagtcataaaatccgcttttacaatgcttcaacagcttttgacggaaataatcttacaacccttagttatttaatgggacatagtgagacagctacaacattgcattacttgcggaatgtcaataagcggaagaatgacaggcttgcttttcagaatcttggtatttcatcataaagtgttcaaaggtgttcaaacattttaaaacaaaaaaataagagaaacgctgtaaattcaacgtttctcccatttttaactaatgccgcagaccggaatcgaaccggtacgggtatcactacccacgggattttaagtcccgggcgtctgccagttccgccactgcggcattcctcaaaatgctctcgcatcttgaacgacccagaagagactcgaactctcgacctccgccgtgacagggcggcgctctaaggcgtgggtctgcaacaccctgattcaccggttcaaatccggtctgcgcctctgaagaacctgaaactgatttgtttcaggttctttttttgagtacctacgccaacaatctcagagatagaaaaaactcatgtgagttcgttagaagaaattcacatgagtttttctttaaaatagtccttatttattttcccagttctttttataaatcagatacagcggaagtccgacaaagatcataccaccgagcatatttccaagtgtaaccggaataaagtttgcaaggctgtgaagtggtgtcagtgtcgcaatctgttcagctgtaattccgtaagcttcttctgctttcgcaacataagccggattaagtgaagcaaggataccagccgggatatagaacatattggcaacgcagtgttcgaatccgccgactacgaaggcacagattgggaagaaaattgcccataccttaccggcaatatctcttgcggaagtagccatcagtactgcaagacataccaggatattacataagattccggaagtgattccctgcagtggtgaaattgcaatctttccaacagcaactttgattgtataagcaccgagaagcccgcctgagtagttcaggtttccactgtatacaatgagtagatccacgcaaagagcaccgaccaggttactgaaaaatacgatgaaaagatctcggaataatccgccccatgtgacacgtttgtcaaatacatccatgatgatcagacagtttccggtgaaaagttcgccgccgagaaatacgatgagcatcagtccgacagggaagatacatccggcaagagctcttgctacgccaacattttctactgcgtgtgctgctgtgctgcttgtagcaccgccgaaagcaataaacgcaccggccatgatgccgagcagaatcatttttccaagtggaagacgggttttgttctcgcaggccttgatactcagatcaatgacttctgcgggagtgttaaaatgattgtccatgatataactccttattcttttgtaattcggcagctctcttgctttgaatggtaacacagtaaaagaactgccgttgttatattgctattcgtcaagaatttaacgagaatattttatactagaaaatattggatttcaagagtggaaaggcatgtttatatatagatacaaaattcgggatttttattgctttaggacagttatttgtacggtttataagcatccgtaagcaatagtaattatgcaaaatatgtttataaagttattcatgtggaaaattttagaaaaatattgttttgtgtagaaaaaagatatcctcattttatcaacaaaaaagatgagttacgaacaaaaaacacattgaaaattcaagtgcatcaaattattctatatctacttcaaggcgtgggtctgcaacaccctgattcaccggttcaaatccggtctgcgcctcttagaaagtctggaaatgattgtttccagacttttttctttatgtgaaaataagtattagatacaacaaaatcccccatgagaagaagtaaaggttctgtcttcccatgggggattttgcgtgcaatattatagggcttatcagttaataaacaaaacttatgaattcgcaagtgctgtctgttttacatccggaattgcaatcaaaatcggataaagtacagcagaaaggatcagtccaccgattccctggaccaggttcgccggaacgcttgcgaatgcgccggctccgtagataaagtactcgcacaggcagtaaccgccggcaacgagaatgatatcagcaacaccgccgaggatgactgctgtgtaacggctcttggaattcttacctactttacggtaaagaagggcggagcaaagggataccagtcctttgatcacaaatgtgatcggaacatagacaaaatatcctccgagcaggtctgccatagcagatccgataccgcctgcgaggaatccccatgcaggtccgagaacaacaccagcaaggataacaatcgcatcacctgggtgaatatatccgcttgttccgggagtaggaatcttgattgacatcgtagcaacacaggcaagcgctgcgaacagtgcagccatgacaagtttctttaatgttactgttgacttagaattcataacaaaaacctctttcctttaagatttatcatactatacaacagaagtggactataaaaaagagccacttttacaaaaataaaccataccagtttaaacgggagacaaatttataaaatcttaagaaatgtagagagtatgctttaagatgttgatgaaataataaaagagatttaaatcagaaccgtttgtacctgtatagatacgttgccagggaacacagttcacaaaagaaggagaactacaaaagatgggatatcattcgatcatatatatcttcttatttcttccggtctgtctgttcgtctatcagcttgcaccggagaaatggagaggaagagtcttgctgggattcagctggattttcttttatctgctaagtgggaaattactggtttatcttttaggaacaacgcttttgacccattgtatcggcatctggctgactgtgatccagatgcaggaagcgaaggctgtagaaggtctggaacggaaacaaaagaaagcagtgaagatggaatatcagaaaaaaggacgaagagttcttgcacttggcatcttcattttacttggaattctcggctatctgaaatattttgatttctttacggtgaatttaagtcatctgtttggacatccggttctggaaggatggagaccggaaaatctattaatgccaattggaatttcattttatacattgcaggctattggttatatgacagatgtgtactggggaaccatacaggcagagacagaaatctggagaaccgcattgtttcttggattcttcccacagatcatggaaggaccaatcgcaagatattctgatgtggcagacacattgtatacaggaaaatcattggaatatagaaatgtggtcgatggttatgtaagaatcttctggggactctttaaaaagatggtgatagctgaccgtatggcactgatggtaaatcaggtatttgaccattatgcagactatcatggtgcggtgattcttgcagcagcgattggttacgtgattcagctttatatggaattctccggctgtatggacatcattataggaagtggaaagttgtttggtatctgccttccggaaaacttccgacagccgttctgtgcgaagaatccttcggaattctggcgcagatggcatattacactcggcgcgtggttcaaggcatatattttttatccggtatcggtatccggattggttaagaaatggaaccagtatggaagaaaacattgcggaaagcatattacaagactggtgacttctgcaatcgccctgttcccagtgtgggttgcgaacggagtctggcatggcgcacagtggaactatattttctatggaatgtattattttgtattgatcatgcttgggattgctgtggagctggttcgagaccatattttagaagtgtgtcatattgatccggagacgaaaatctggagaacaatccagattgcaaagacatgggtgattattgtagttggagagttatttttccgtgcaaatggattgaaggccggatggtatatgttctgcaatatgataaagcattttgatgcaggacaattaacagatgggacactgtatacactcgggctcgagcgggcagattatctggcagtgatattgggatgcctgatcgtcggaattgtgggttctatgaaagagcacggaatctctgtgcagaagaaaatgggagaactggctgtaccggtgcgttggggattgtattatgctttgattataggtattttaatcttcgcagcgtatggggatggatatcagattcaagatctgatttacgccggtttctgaggtgataagaatgagtaagataaaaagaggagttctctttattgtaatactggcagtatttctgttggcaagttctgtcgggatggaatattatgtggtgcatcagctgaatggagaagtgaccggaagaaaccgtccgtttgcggctcttacagttgagccggaagatacactggatctgctggtggccggtgacagcgaaagctataattccgtatcaacaatgcgattgtgggacgataaagggattacaacttatgactgtggacagggagcacagagaattccagagacttattacatgctgaaacatgcatttaagaaacagtctccaaagattgtgatacttgagacaaatacattgttccgtgatattggagcagtaaaaagtacacaggagatattaacgcaggcaggacagtattatctgccggttttccgttatcataatctgtggaagacagtagtagatgagccggaaatgcatacgaattacaaggggtttgtgatcagggatgaggttgatccatatgaaggaaaaccggattatatgaagaaaaagaaaaaatgtgaaacaatgcctgagtatgtaaaggtttatctggagaaaattgaagaactgtgtgaaaagaataatgcgcagttattgcttgtaagtatgccatcaccaaagaactggaatcataaacggcatgcagagatacagaaatatgcggatggaaaaggaatcacatatctggatctgaataagaaggtggaagaattagggttgaactggacagaagatacacaggataagggcgatcatctaaatgtttatggggcagagaaggtgacttcgtatcttggaaattatttagaagagaattatgaactggaagatcatagaaatgatccgatgtatgaagcatggaatcagctggccgaacagtataagcagaaccttgcaagaatacaaggaaaaatagaagtggcaaaagaaacgggtgtaggaaaatgatagcaaaagaagagttgaatattttgtggagcctggagcagacagcgaaaaagtatgaagacagggttgctgtttcggatgtaaatcaggagctgacttggaaaggacttgtgaagaaagctcaggtgataggtgcagaattaagtaaaaaggttcaaccgggaaatccgattccggttcttttagagaaaagttcagaaacactggcagtgatgcttggaatcgtttatgcaggatgtttttatgttccggtgaatccgatgaacccggcggaacgtctgcgaaagattatggagaagctggagccggaagtgatcatttctgatgagaagggaaaagagcagctggaagcagtcggagtaggactcgaagagaaagtgatcggaccggagacacttctaccgacaacaggaacggatttgttagaagagcaacgcagtaaacttgaacagatccagggacaatggaaagagacagatgctttgtatggaattttcacttctgggtctacaggaactccgaaggcaatcgtggtaagtcatggtgctgtcagccggtttgttcgtcattttacagaaatctttgagattacatcagaagatgtgattggaaatcaggcaccgtttgattttgatgtgtctgtgaaagatatttattccagtatcatgacaggggcacagcttgttttgataccgaaagaatacttctcgacaccgccgagacttctggattatctttgcgataagaaagtgaccaatctgacctgggctgtttcggcattaacacttgtgtctgcgctgaaaggattgaattacagagtgccggaatcagtgaaaagagttatgttcagcggagaagcaatgccgccaaaacagctgcgtatctggcaggaaaaactgcctgaagcaaagtttgtaaacttgtatggaccgacagagattacttgcaactgtacgtattttccgattgagcgacagtatgaggacagtgagaaaataccggctggtaaggcattcccgggaagaagagtaatccttgtagacgaggaaggtaaacaggtgacagaacctggtgtacagggggaaatctgctcggcaggagaatctctggcgaatggctattataaagaacctgagcagacagcggagaagtttgtgctgtatcctgtagatggaacagaacagagaatgtatcgaaccggagatcttggaagttatgacgaagaaggaaatatcgtatttgcaggaagaaaagatttccagatcaaacatatgggacaccggattgagctggaggaaattgagcgttctatgacagcacttgatggagtggagaagagctgctgtgtctttgatatggagaaaaatcgtattatgggattttatcttggagagaaagcagcctcagatgtcagaaaacagatgaaggaaaaacttccggtctatatggttccgacaaaattgattcaggtagatgagatgccgttgaacaagaatggcaagacagaccgtaattattttaagaattatggaaaaaataaaggctgtacattggggtttgagaggagcagcataagaaaggagaaaatattgtgaaaaaagaaatgctgtttaatgctgcaaaaaaatatgaaactccgctttacgtgtttgatctggatatcttaaaagaacagacagaacgtattcgtgcaggctttggtccggggatcagcctttgttatgcaatgaaggcgaatccatttctgacaggatatatggctcagtgggcagaccgcatcgaagtctgctccatgggagaatttcggatttgcaggaaactgcaagttccaccggaaaaattatttatttcaggtgttatgaaaaaacgggatgatatccgggagatactttcatattgcggaaataaatgtgcatatacagtggaatccccactgcatttccaatattttgcagaatggagcgaggaacatccggaggatggtgtgctccggttatacccgcgacttacaagtggaaatcagtttggaatggacgaagatacggtattagaaattctgaaaaaggcaaaggaacttccgggaatcgaggctgaaggaattcactatttctcaggaacacaaaagaagaatctgaagcgccatcagaaggaactggcatatctggatgaatttttaaagaaagcggcagaagagcagatcgatgtgagatgtctggaatacggctctggaacggcagttccgtatttccgcgataaaacggcagagacctttgaagaagctggattaaagggacttcaggacgctgtgaagggcatgcagtggaagggacatgtaacagtagagctgggacgcgcgctggcggcgatgtgtggctactatttgaccaaagtggaagataccaagacgagtgacggcattcattattgtattgttgacgggggctgtcatcagctcaattatgacgggcaaatcaagggaatgtatgaaccgtatgtgaaggtacttccaaaggaagtttcagtgaaggttgcggaagtttccaaaaataagaatgcagaagaaaagacctggaaagtctgtggatccttatgtacactgaatgatgttctctgcaatgaaattaccttgaaaggtttggaaaaaggcgccatccttgtattcgagagaaccggtgcgtattcagcaatggaaggaatggcattgttcttgagccatgaacttccgggggttgtactttacagcgaggaagaaggatggatccaggcaagagtacagcaggaaacttatgaattgaacatggtagaacagttacagattcaaaatgataggaaaagaggaagaaaaaatggaagaattattagaaattttaaatgagattgatgatagtattgactatgagaacgagacagctctgatcgatgatcagcttcttgattctttcgcgatcatcacacttgtatcagagctggaggatgcatttgatatcagcattgaagcctctgagatgatgccggtgaacttcaattcggcaaaggcaatctgggcaatggtacagagacttcaggaagattaagatttcaaaagcctgtcaatgatccgggaggcttcgcttcttgtcagcgtagttgtatcccagtcaggtatcagttctttctgttccgtcaggcgttctaagagtgcaatctgctttggtgtggcaggctgcacttttttaattttatattgaagttgaagaggctggaacactttcggatcctgtggctcaaaatagtgtgccagtgtctgataaagctttgcggttgcgagtgcatcatagtatgcgcggtgagcagcaggattctcaatatgataatagtcgcataacgcaccgagacttttagactcaaagtctttatgtactttgcgggcaatttttaaagtatcgattcccattttttcaaatgtaagaccttctctgactgcactgcattttacaaagctatagtcaaacatgacgttgtgtccgatcagcacgtcatcttcacaaaaggagagaaaatcgtggatgacttccgggcaggatcttgctcctgcaaccatatcatttgtgatatgtgtgatgttggtgatcatcggtgtgatcggtttgtctggatggacgaattccataaaacggtcaacgacctttccttcccggactttgagggcaccaatctctataatttcatgttcctgaggacttagcccggttgtctccaggtcaaatgcaatatatgatttcagcatagaatgctccttatctgtaatgttaataacttaatatcactatactaacattacagataagagaaagcaaattttataaaaatgattctaattctcgtatcatttcttcttctgttttgataatttttcttgccagcgcatcggcagatttgtcagccctgttcaatgtattggcacgttctccgagtgttttaattcccatgctgcatccatcaatcagaagttttgcaattttggagttatcatcattcagattcagtttaagttctgtgctgaaccaggaaaatgcggaagccatcattcccggagctttaacttcatttcccgaatcaatcaggtggtcttttgcattaccgcctaatcgagaatgacgatcaatgtatttttcaattaattggaataaggttgtatcttgggtgaaatctttgatttgctgcatactttcgattgccatctgacatccagtgttgcattcttcatatagttttcgtgtttgttcatccatgatgaaatcctcctttttatggtgcattatttgtgacgaaataatatcaaagatggaatacgtgcatcagttataagaaaagaatgtgggtttctttatatagaatgtggataaaatacaaaattatacggtattttgtgaaaaacataacggtaaaggacttttctaagaatatttgttgtgctaaactaaaaaaagagtttaacagaaaggaaaaatgtactcatgttaaagggaaaaactgtacttcttggagtgacaggaagtattgcagcatataaaattgcgtcacttgcaagtgcgctgaagaaattgcatgcagatgtgcatgtgcttatgacagaaaatgcgacaaattttattaatccgatcacatttgagacactgacaggaaataagtgtcttgtagatacatttgaccggaattttcaatatagtgtagaacacgtatcattagcgaagaaagcggacgtagttatgttggcaccggcaagtgcgaatgtgattgggaagattgctcatggcattgcggatgacatgctgacaacaacaatcatggcgtgcaaatgtaagaagatcgttgctcctgcaatgaatacgaatatgtttgagaatccaatcgttcaggataacctgaaggtactggagcattataattatgaagtgatcagcccggcggttggttatcttgcctgtggagatacaggagcagggaaaatgccggaaccggagcttttgcttgaatatattttgcgggaaatcgcaagagaaaaggatatgaaaggactgcatgttctggttacagcaggtcctacacaggagtccgttgatcctgtacgctatattacgaatcattctaccggaaagatggggtatgcgattgcaaaggtatgtatgcagcgtggagcggatgttacacttgtcacaggaccgacctctattgagaagccacattttgtaaatgttgttccaatcacaacggcgagagaaatgtttgaagaagtgacaggacgggccgaagaacaggatattattattaaggcagcagcagttgcggattatagaccacgctatgtcagtgatgaaaaggtgaagaaaaaggatgacgatctggcacttgaaatggaacgcacagatgatattcttgcgtatcttggagcgcataaaacaaaagatcaattcctctgtggattttctatggaaacagaaaatatgctcgagaattccagaaagaagctgaagaaaaagaacctggacatgattatagcaaacagtttgaaaatggaaggcgccgggtttggcgggaatacgaatgtggtcacagtgattacagaagattttgaaaaagagctcggcaagctgacaaaagaggaaacagcagatcgaatccttgatcagattctggcacagagaggggaagtttaaaagatgatactgacaatagacattggaaatacaaatattgtattgggctgtattgatggagataaaactctttttgtagaacgtttgtcaactgttcgtacgaagacagagttagagtatgcaatcgatattaagaatgtacttgatatttatcatattcatagagatgaaatcgaaggcggaatcatttcttctgtcgtgccgcagattacaaccatcgtgaagctggcggtagagaagatcctgaagaagaatgttcttgttgtgggagccggaattaagacaggattgaacattcgaatcgataacccagcacagttgggaagtgatctggtggtcgattctgttgcagcaattgttgagtatccggctccacttctaatctttgatcttgggacagcaaatacagtctgcgtgattgataaaaataagaattatatcggaggcatgatttatcctggaatcggagtttctctggattctctgacagctcatgcatctcagcttggcggaatcagtattgaagcaccggagcatatgattggaaagaatactacagagtgtatgaagagcggtctgatctacagtagcgctgccgcaatggatggaattattgatcgtctgcaggaacagcttggcggagaggcaactgtgatcgcgacaggcggactggcgaagaagattgtttctcattgtagaagagagattatcctggacgatgatctgctcctgaaaggacttgcaatcatctataaaaagaatcgcaaataaaaatgctgcaagtaaaaatataaaacgcatttgatacagaactgaaaaacaggagattgaaagattcaaaatatatctttcaatctcctgttttatatattaggaaaatgattctcccataagattctttaaaagtgattttaaacttacagtttgtcaccacgcttgatgtatcccggtttatcaggagatgcaatgatacgttttccacggatcaaacgagcatgtttgtcgattacgagattctcagcgtgaacaccttttccgataacaacgtctgcaccgatgacacaattcttaataacagcgccctctttgattgtacatccacgtccgataacacagttctcaacagttccttcaatcagacatccgttggaaataacagaggatgttaccttgctgccttcaaaatactgtgtcgggcaggagtcatttgtacgtgtataaattggccagttatcatggaacagatctgttgcttttttcaggtcgatcagttcaaggtttgcttcatagtaactattgaagtctgagattgttgcaaagtatccacgatgtggatatgcgcgaacatcaagttcctcacaagactcattcacgatatcagccagtgtgtacatggaggaaagtttgtgtgccttctgaaccaggtcaaggaacagatctttcttcattacataagtatccatgaagatatttctgttcttagcatttccaaggtttggctccatggagagaacacctttctgtttgttgatgttcagtgtctgacagttcgggaaatgatccttcgcattgtcaacagagtgatacatcagagtgatgtctgcacctgattcaatatgtgtcttgagaaatgcactgtaatcagctgtgtaaaccatgtagctaggcgcgatcacaacatactcagagttgatctcatcgaagcagtcaaggttttccatgtaagcagcgatatctgtgttgtaaataccgttgtcaatgttgctctcctggaagagagtaatcagtttaccacgtttggagttgatattgtaatgacgtcctgttccgatgtgttctacgagagaacgaggttttctgcgaacataaacctgcattacatcaattccactgttactcatgttagaaatcggaaagtcgatcacacgatatcttccgaggaaggagaaggcaccgatcggacggtatgcctgcatgtcatttacctgtatgttgtttcctgcaaagttgataattccaaaagctttactcatcttattcgtccccctttactcgttttgcaacgagctcgatattctcgctggctgcgtctccgacaacagcgttctttccaatcttaatgccatcggcaacaagggcacgtgtaacaacggcaccttctgcaacctcagcacccggcatgaggacactatcaatgacttttgcaccggcagcaactttcgcaccagtgaacagaacagaattcttaactgtaccatcaacgacacatccctgtgtaatgaaggctctttctacaactgcatcagctccgatatactgtggaagtgcagttgcatcttctgtatagatcttccaatttgggtcattcagatcaagcttattgttcttatcaagaaggtccatattagcttcccagagtgaatcaattgttccaacatctttccaatatcctttgaacttgtatgcatacagactctttccgtcattaagcatagtaggaatgatatctttaccaaagtcatggctggaatctgcattcttcatatctgcgagaagcatcttacgaagaagtttccagttaaagatataaatacccatggaagcgaggttgctctttggatgctcaggcttctcttcaaattcaacgatatgtcctgtctcatctgtattcataataccaaaacggcttgcttccttcataggaacttcgataacggcaatcgttgcatctgcgttgttctgtttatgatattcgagcatcttgtcgtaattcatcttataaatgtgatctccagagaggatcagcagatagtctggggagtatgtatctataaagtcaatattctgggaaatagcgtcagctgttcctctgtatacatcaaggttcgcatcagctttctcacgtggtgggagcacataaactccactgtccttcgcatcaagtccccatcttcttcctgctgctgcatagctgttcagaagtacggattcgtactgtgtcagaacacctacaatgtcaattccgctgtttgcgcagttgctaagtgggaaatcaataatgcggtattttccgccatatgaaacggctggtttagccactttttttgtcaaatcatggaggcgggttcctcgacctccggctaagatcatagccaacatgttatcgtgtttcataaaaagccctctctttcataatactacttctttagtatactcttttttgtgcgatattgctaggattttgcatagaaaaaataaaaaaatagcaaaaataatggaaaaatttatcgaaaatcatttgtcatttttcacaaaaaaagaaaataaggaaaatcagacagatttttaggcattattatatacaagtgaaaaggaacattaaaaaaattcctttaatatagaaagaattgattgattttaaagcaggagtgtggcaaaatacaaatcacagtattcatgaaaatggcaggtgtgagatgaaagcaaatgtgaaatcagttttaatgaaaaaatattgcagagtatatcaggcgggggcgaagcatttgatggctgcacttccgtggcgttcaccgaaaatgctcagtggatcaggagcagtgaagaagctgccagaggcggttcgagatagaggatttcataaagtattaattgtaacaggaccgaagatccgtgcgagggggcttcttaatgaactgctggaagagatgaaagagaagaagttgaaatatgttatctttgacggcatttctcaaaatcctacggatgaagaagttgaaaatggagtaggaatatttcttggagaaaagtgtgactgcatgatcgcatttggtggcggaagtgtgatggattgtgcaaaagggatcggagccagagttgcgagaccgaagaaagcaattcggaacttacagggacttttccgtgtgctacgtccgattcctgtaatcttcgccgtgcctacaacttcaggcagcgggtctgagacaacgattgcagcggtgattaccgaggttcagacacatcataaagcatcaatcaatgatttgcaattgatgccacgctttgcagtacttgatccgtgccttacagtaggactgccaccacaggtaacagcacagacaggaatggatgcgctgtgtcatgcagtggaagcatacacgaatgatacatataacagtgattttgagcgtctgatgtgtagtaaggcagtgcgattgattcatgaaagtcttctgacagcatatgaagacgggacaaatctgcaagcgagacaggatatgcaggaggctgcatttcatgcgggacgcgcatttacaagaggaagtgtgggttatgttcatgcaattggccatgcgctcagcgggctttatggagtgcctcacgggcttgtgatggcaattctgcttccgcatgtgatgcgtgcctatggctcttctgtgtatgataagcttgcggatttgtgtgatatctgtgcgatggaagtagatacaccggacggtatgatctcagccgaagttcgtgccgaaacatttctccagtggatggaagagttaaaagagaaacttggaattccgaaatatccggatatgatccgggaagaagatgtgaaccagattgtaaaatgggcacagaaagaggcgaatccggtttatccggttccggagatctgggatgcacaggagatgaaagagtttgttctggccatgatggaaggtgcgagacttgaaggtgcagaaaagaatgaataaccgacaaaaatcggtgagggatgtaatgaattggaggaaataatgacagtatgagtgacaatgcaacaatgaaaaacacaacgattcatgacatgacgaccggaagtccggcccgcctgatcatgcagtttatgataccaatgtttttgggaaatatatttcagcagttttacaacattgctgattcaatcatagcaggacagtttcttggtgtaagagcactggctgcaattggaagtacgggatccttgatgttctttgtgacaggctggctgaacggtctgagtagtggatttgctattttggtgtcacagtggtttggcgcgaaagaatatgagaggatgcggcattatgtggcgatgtctatttacctttctgctggctgggctgtgcttatgacgattggtcttggaattgcaaatgagccaatcttacgtttgatgaattataaggatagcattatgccggacgtaaaggcatatatgggaattatttatgcgggtctgattgtaacggcagcgtataatgcgctggctgcatttctgcgtgcactgggtgattcgaaatccccattgtattttttgattatttcagcggtaatcaatgtgggacttgatgtggcatttattatttatggcggtatgggtgtagaaggatgtgcctatgcgacagttatcgcacagggaatctcagcagtactctgctttatatatatcgtgaagaagttccctattctgcatcttaaaaaagagaatttcagattttctcttccagcttgcggaaaattgatggctcttggagttccgatggcattacagttttctattacagcgatcggaacaattattgtacagggtgctgtaaatgtttacggggaagattatatggctggtttctctgcggcagcaaagattcagaatgtaatctgcacagtattcgttgctttcggtgcaacgattgcaacttatgtgggacagaactggggagctggaaaagtagaccgtgtacgacaaggtgtgcgctgtacacagattatgattctggcttacagcgtaattgcgatgatactggtatttttctttagtaaatatctgacctacctttttatcagcccatcagagacaaaagttattgaagtatcagtgctgtatttccatacggtattctggtgttatccattcctgggaagtatcttcctatataggaataccctgcaaggacttggatatggacttgtgccgatgctcggaggagtgtttgaacttgcggcgagatctgcaattgtagttcttgtggcaggaaaaacaagttttgcgggagtttgcctggcggatccggcagcatggatttctgcattgattccactgatcccgtattatatctatgtgacacggaagtggaagaaacaagggaagatagcgatgtaaaagtgaaagcaaaaaacaggcgcagggaatcaattatgaagccctgcgcctgtcgcttgttaagttaaaattattctgcggcttcttcttcctcttcatctgaagtaagatcagaagcttttacgtgtacttctgtgatagtaactactgttgcatcaagatctgtcataagatcaacatctttgtctttggcaattggaagatcagcaacacgaattgtgtccccgattttcagaggtccaacatcaacttcgactttctctaccaatgcggcaggaagagccttgaaggaaatctcctgaagcatctgctgtggtactcctgaagacagtttctcgaggtttacaaggtgaatctctgctacagagtgaaccttctcagtgcttaccagtgcctgaaaatctatttcatctacatatcccttcaaaggattgtaatcaacttccttgatcagagcgtcataagtctcaccggcaacttccaacataacctggccacctttgttttcgactttcagaagtttttctatttcacctttatcaaatttcagtggaatagaatcttccagttcacgaccaaacaggtttcctgttacaaatccttcgcgtcttaatttttttgctttgattgacatgtctcttttttcagcttttaaagtattcatttatcttttcctccaaattactgaattcgcttagcagccttcaacttgtcaaaataataagtaggttttgttaagtgttctttttctttgctacagttacactatagcacccggtgtcaaggggaaggaaaaagcagggagaattgtagggtgaaaaattaaggttttgaaggtttaaaaaggtgtgataaatgaaaaaattaaggttgtataacgggaatattcagagaattgttgtgaaaatggcggaaatgaatgtttcggaaggatgcttcagaagaaaaatgacgaaattaaaaaggaatcaaaacatgtgtaacattattgaaaatgcaaatcctttatgataaaatttcaaacagaaactactgatattagtcgaaatatcggtatagaaatggggaagaaacaatatggatttacagacattgatcgttttgatcatcgagttgatcggaacgatcgcattttcaatttcgggggcaatggttggtatccggcgaaagatggatattttcggtgtgttggtgcttggtgtggtgaccgcagtaggaggcggaatgatgcgtgatgtgattttggggaagacaccgagcgcatttgtgaagccgatttatgtagaagtggcagtgatttctgcattagcgccatttctcttactttctattaataagagactggtgcatagcaaataccaggcactctatgcaggactaatgttcctgatggattcggtcggacttggaatctttacagcggtcggagtatccacaggatggacagcaggatatcatgataatatgtttttcttaagtttccttggagtactgacaggagttggaggaggacttctccgagatgtgatggcaggggttccaccatatatttttgtaaagcatgtgtatgcctgtgcatcgatcgcgggggcaatctgttgtgtactggcatatagaagctggggacagattccggcgcttgtgatcggaacagtagttgtgcttgtgattcgtatcggagcagcgcattacagatggaatctgccgtgcgtgaagctggaggatgaagaataacgaataggaaaattcaatttggtgacaagacactgatagaagtagtggtatagtgtaataatttagagacacccgttattttatcttgagaaggatgaaaatagcgggtgtttttatagtcttatttataaaaacagttcattttcttttcgtccggaacaagctttttttaacttctgggaagcagcaaccagcattagtggattcagcttgcgggaatgcgttggacagacgctgatacagcgcatacaggaaatacatttgtccttatcagtctgcgtaggattgtcagatggaattgctcctgacgggcatttcgctgcgcacaatccacaggaaccacaggtatgtgaagcaccagggataagcggaatcgtaccgtattcgcggtaaggcctgttacccggaacatgtactggtggaaaatcagtttttacagtgttgtttgttttctcttttatcttctgtgcaaaggaagcgagttctgtaagatcattctgatcaggtcttccagttgcaaactgatgcatgatggaatgttctgcgatagccgcaatagctgcctggcaagtgaagttcttttcaatcagagtatcttcaagttcgatcaatgtatcttcataagcacggtttccgtaaacggtgattagaatcgcagttgcattatttccgctcagggctttgattctctctaatgcaatggcaggaacacgtccaccgaaagaaggaactccgatgatacagagatcttcttcggaaaaattatttgttagatcagaattcttttcgcatagatcaatgctctgatattcgccaaattgttcagctataaatgtaactattttttcagttccaccggttggactgaagtaaattgcgtatatactcataaatattctcccctaattaaatgttttggcagatacaataattttagaggttttggagatgttttgcaagagcctggttgatattaaaagataaaagtgatatgatttgaatagataaaatattatctaaaaatgcataaaatggtttggaatagataaaatattatccgtagagcgaggtgggtgaatgcaacagttagtatgggaaacagcagaagaacttgatcaaaagcttgcgcaaagagtgcgtaatattagaaagagacgttcaatttcacaggaaaaattagcatctatgagtggtgtgagttatggctcgattaaaaggtttgagacgacaggaatgatttcattactttccttgacgaagattgcgatggcattggatatggcagatgaacttagagatatttttacaagtgtgccatatagggatatccaagaagttataaatgagacataatatcaaagagaaagcaggagaaaattatgagttacatcacaacatacacaggaaatcattttgatccgataaacccggatccggaactaatcaatattgtagatatcgcccatgcacttccgatgatttgtcgaggaaacggtcaagtcagtacgttctggtcggtgggagaacattgcattctgtgcgcgaaagaagctgcagccagaggatacagcaatcgtgtgatcgagggtgcacttttgcatgatgcaagtgagtgttatatgtcagatgtgccgcgtccgttgaagcaatttatgacagtatataaagagcaggagaatcatttgcttgatgttttatataccaagttcctgggttcaccgcttgatgagcaggaagagaagctgatcaaagagattgatgatgcggtattgtggtatgatatgaaatatttactgggtgaagactcagaaggagacaagccggagacgtgtatggtacctgattatacggtgagagcattcaaggatgttgagcaggagtacttggaaatatttgaaaaatataaggtcttataaatatcaaaatgatgaaaaaggacagagagttctgattgaaaaatgtcagaaatctctgtcctttttgtaagtatcagtatagttcgcaactttgtattctgcggattgtttatctcagtcgagaagactcccacttcttcaggtggtgagtaacagaaaatggatgaaaaaacgtaagaagtgttacggttttaaatggctccggtaatctgttggcgaaacattataaaactttttaaatgtacgtgaaaatgccagctggtcttcaaatccaagtgaattggaaataatcgaaacaggaagttgtgtagttgcaagtaaccttgcagcttttttgaatttcagttgaagtagatattttttgggtgagattccaaacttttcatggaaagcccgtgtaaggtaattctgatggatgccgaaatagtcagctacatcttttaacttcaaattctcagcataattgatatcaaagtaaaatttaatttcatcgataattgacagtttatttgtgtctgcttcatgaaaatcaacatctgaaaaaagcatggaaataatatgaagcaggatactatttccttcaaaataatgactggtcaatgaggcgtctaattgcatgatcctggaaatagaatcgtaatattttcgggtatccagaccatggatcacataaatatcttctgttgaagtcataatctgatagagatagctttccgagctgatgccgataaagctgatccatgcataagaccaagggtttgtttttgaggcttcataataagtgatcttacctgccggaatgagaaatgcatctcctgcttttaggtaaaacacatgctcattaatacgaaatactccctccccgttgagtacaaaatgaattagctgatatgatctcaaagtcggaccataactgtagccaggtgtacattcttcataaccggcactgtacagagaaagatcactattggctttatataccagagaatgtttggtttctttatattcaatcataagtctatcataatacaaaaagttagttttttccatatattcttctgaaaatgctatgttccaaaatagaaaaatatagtttaatatagtcaggcgccagaaagtaaggacgggaggtcatttagaaatgataaaacggcagaaatatcatctggaaccggacagaggtctgctaaatgatcctaatgggttagttttttacaaggatatgtatcatgtgttctttcagtggaatcgatttgaaaagaatcattcttacaaggaatggggacattttacatcgaaagatttacttcattggaattgggaaggaagtgctcttttgccggaccagttttatgagcaaaatggagtttactcaggtagtgcattgataaaggatggtcagcttcgcttattttatacaggaaataataagagcggcggtgtgagaaaaagcagccagtgccttgcagttactgaggatggcaagacatttcagaaaaaaggcattgtggtatcaacacctacggagtttaccgagcacttcagagatccgaaagtatggcaggacggcgatgactattatatggtgatcggagcacagatgaaaaatggaagaggttctgtcgcactatgcagctccaaggatgcggaaaattggaaattcgaattagtgcttgcaaaatccaaggagtatgaaatggttgaatgtccggattattttcaggtagatggacaaggaattttgctttattgtccgcagcacagagataatgaaagtgatagttcactttgtagtttttcggcttataaagagtttgattttaatgacatagtttcaggaaaaatagaagatagcaatatgcagaatctggatgaagggcgtaaaaagatggatcagggatttgatttttatgcgccgcagacatttacatcaccggatggaagaaaaattctgtttgcgtggatgtcaagaatggaagaggaagaagagaagctgtttggtgcaggagaatccagtatccattgtatgacgttaccaagagagctttcttatcgaaacggagaactgtgtcagcttccggtaagagaattggaaaaaagtttgtgcatacataagatttctgagcaggaaagacaaagtggagaaataattcttaagaacagagtatactgtgcaaaactatctaatcttcagaatgaaacttcttttgaaatagaatttcagaacagagaagttattctagaatacaaaaaagtagaaaaaataatttctgtaaagagaaaaaattgggttacaaaagattatgatgagagaaactgtaagattgattcgttggaaacgatagaatgttggtctgatatttccagtatggaaatttttgtgaatcagggaagcaaagtgttttctatgagaatgttcacagaagaagaaaatggaaaagtaaaaataagcggactcatgaaagaaacagtcgtggaaatgtatgatttaatgggagaaggagaggagaaaaatgagtgataaagaattagcaaaaaagattcttgaactggttggcggcacggaaaatgttgtgtcagtaagacattgtgcgacaagacttcgtattgtagtagctgataaagaaaagattcaggtaaaagagattgaaaatctggagaaggtaaaaggaagcttttttaattccggacagtatcagattatccttggaacaggtctggttaaccgaatctatgatgaagttgtaaaagttacaggaacaggcgacgaagaaaagtcagaggaaaaagaaaaggtagtttatggaaataaattccagagagcaatcagaatgttttctgatgtatttgtgccaattatcccggtgcttgtagctactggtttgtttatgggacttagagggcttctgactcaggaggcagtacttgcagtatttggtctgacagctgatagtattccgcagaatcttcttacatttacacaggtattgacagacacggcatttgcatttcttccggctttagtgtgctggtcaaccttccgcaattttggcggaagtccggtaattggaattgtattaggattgatgcttgtaaacagcagcctgccaagcgcttatgcagttggatcaggagaggcacagccgttgattttctttggattcttaaaagtaacaggatatcagggatcagtattaccggcatttgtgacaggaattgtcgcttccaagtttgaaaaatggctgcgaaagaaagttccggatgcaatcgatctgattgtgacaccattcttaacattgttggttggatgtgttctggcattgttcgtacttggaccaatcttacatacagtagagtcaggagttctgtttgcagtagaacatcttcttttccttccaatgggaataggcggatttttatatggatgtttcggacagcttcttggtatttttggtattcatcatattctgaatttcttagagatcagtatgttggcgcaagatggatggaattatctgaatccaatcggaacttgcggaaatgttgctcaggcaggagcagttcttgcagttgcaatcaaagcagcgtctaataagacaaagcaggtggcatatccggcatgtctgtctgcattacttggaattacagagccggcggtatttggagtcaacttaaaatttatgaaaccgtttgtaatgtcaatgatcggtggtggtgttggaggatttctggcatcaatcttccatctgagagcaacaggaatgtcaattacaggtatcccaggaacattgctgtatcttaacgagcagctgccactctatattctggtaaatgtagttgctttcggtgtggcattcggactgacatggatgtttggttttaataagaaaatggagcagtaagtatgagtattctatttcataacaaagggcagatcgtgcaattaagtaatgatacaataagttatgtgatggaaattgtggatggaaagtatctggttcatcggtatttcggacgaaagatccgaaattaccgggggaccggaaatcccctgtattttaagagagggtataatacggaacatgacagctctgtcgaaaatgtatcctttgatgattttccgtttgaatatccggtcggaggacatggagattttcgtattccggcttttgcaatcacacaagaagatggaataacattttgcgaaccggtgtttaaaagctggagtgtagtatccggtaagcctaaattacaaggtatgccgcagattcgtgttaatgaaaatgagtcggagacactggaagtgatctgtgaagatgacagagcagggatccgactttttctttattatacaatttttgaaaatcacggaattgttttacgacatcaaaaagtagaaaattatgggaagcagaccgtttttcttcagaatattcagagtatgtctctggaacttccggcagaagagtatgaacttatgacattatatgggacacatgctaaagaggcaaatatgcagcgtttcccgattcattatggggtgcagaaaacggagagtatcaggggaagcagcagtcctcagcatcagccatttttggcagcgttaaaaccggagacgaatgaatgcagcggagatgtctgggcagcgcatcttgtttatagcggaaatttcctcgcacaggtggaaaaggatcagtttggaaatgtacgggcacagattggaattcatccggacagctttaaatgggaattgaaaccaggagatacatttgcttctccggaagcggtattgaattatagcaatacggggctgaatggaatgcgccacaattttcattggctgtaccaacagcatctaattcctaaacgatttgaggaaaagacacgaccggttcttttaaactcctgggaatctatgtactatgatgtaacaatggagaagattgatgaacaggcagacctggctaaagctgcgggaattgaattatttgtattggatgacggttggtttcgtaaaggaaatgacagcagatcttcaatgggagactggatatgcaatgaacagaaacttccgggtggaattgcagcagttgcagatgtgattcataaaaaaggtttacagtttggactttggtttgaaccggaggcagtcagcgaggatagtgagttgttacgtcatcatccggactgggcgcttcacattccggggtatcaatcggtaaaaggaagacatgaatatctgctggacctttcaagagaagatgtccgtgaatatttatttaaaacattagatttttatttgagagatggaaaaatcaattacataaagtgggatatgaatcgaccgctgacagatgtgaattctgcatgtctgggagtacagcaaaaagaagagatcagtcatcggtatgtgcttggattatatgatattttggaacgcattacagaaaaatatccggatgttctgattgaaggatgttccagtggtggtgcgcgatttgatccgggaatgttgtattatgtgccgcagaattggacaagtgacaatacagatgcatttgaccgtgcgacgatccaaagagggtatagtcttttatatccgcagataacaatgggtgctcacgtaagtattgttccgaatcatcagaccggaagaagtacttctctggatgcaagatatcaggtagcaagattatttaatctgggatatgaacttgatcttacaaaatgttccgaagaagaaagaaaagaaattgctgatcagattcaggaatataaagaacagagaggctggctgcaaaagggagtgcttagttatcttgaagttccgaatgagaattatattgcatggtcggttgtttccgtaacgggagaagaatgcgaagttattatcatgcagaaactgtttgatccgagatattctcatggaagaattcatctctgtggtctgcatccggaatgggattataaagatgaaagtaccgggcagattttcggtggagatgaattgatggagatcggagtatcgctaccattaataaaacgagatttccatacatttgcatttcatttttcaaaggtaaaggagaattacggtgatcagattaattgcaagtgatctggatgggacacttctaaatgaggaaggcatgttatcagagaaaacagcggagtgtataaggaatgcacagcaggcaggaattctgtgggttgcggcaacaggccgttcgctgaaaacggcatctgagcttatgagaacagcgggagttttaccggaatatcttctgctaaatggagctgaattccgaaagagtgatgggactttgattttccaaaaatcaatagaagaatcttgtgcgcaggaaattatacagatgctcatggaaaagaagcttgattttgaaattaatacttcagtaggagatttttcgacagactgtgagttttgcgatacggctcgcccaatgcccgcagtggaaaaaaattttgatgcgcagattaaaattcaaaagatatttattttctcagaagagcaggataagttgaaaaatataaaagagtttttgaagaagagacacgatatcacaattacttcatctgcagtctggaacatagagattacagatcggcaggtgaataagggaactatgcttgaacaggtcgctgagtattatggatatagtaaagaagaggtattggtatttggggatgggaagaatgacattcaaatgtttgaaaagttcccacattccagagccatgggaaatgcagtagaaagcttgaaaaaaatcgcagagaaagtcattgaatctaataaagatgatgcagttgcacaagaggtatgcagattgttgcaacatccaagtttgtaagcgcttggttgatatcagaagaaaaaatgataaaaaggacggagagttctgagtgaaaatgtcagaactctccgtcctattatccatttattttacaacagctgtcgcgttcaatcagctgatgcggcacgataatctttgttgcaacaagattcggattttcaatatgattgatcatctgtgatgccgcctcgatacccagctgcttggaattaatatcaattgaagtaagctgtggagatgtcgatcttgcaaatagagagttgttgaatgatataatcgacaaatcatcagggattgaaacatgattctgaagacagactctttcaagagaaacagcaagaatatcatcacttacaacgattgcagttggcggttcatcctgcagtaacagagaagaaattgcttctgtgttatctcctgatacattcagaacttccgcgcagtattctggacggaaagggattccgtgtttagtcaatgccatctggtaaccggtttttctgtctgcggcaaaagtcagtgaactgtcggaacccagataagcaatcttgcgatgaccgagctgatagagatattcggtcgcgtcctctccggcaagaagattatcattgtcaatatataatgtctgatttgtgtactgtgttgcttttccaatcaagatataaagaagcccttcgctgaagagataatcaataatcggatcgtcctttcgagaataaagaatgatgaacccatctacttttccacttcgtgacatagactgaatcgcttttaagatctcatcttcatcttgacctgtcacaacagtagacatgtattgtctctggttacagtagtggctgatgccgcgaattgcttcaagatagaaagcattctcatatacttcacgggcagatgccggaaggataatcccgatcgtgcgggaatactgagaagcaagattgctggcctgaaagtttacttcgtaaccaagttcgatcatcgctttacgaactttttcttttgtttctgtgctgatggatgggttattcttacaagttctggagacagtggaaggtgatacacctgccaaagcggccacatctttaattgttactgccatattttccctcctgtgaggaaatgaggatgtcaggagtctgatacctattttcctttattttcacgtaactgttcagagccaacctccaaaatgctacgcatttcgtcacctactattttagtgaaagaacgcaatgatgtcaaatctgttgcatagttttttgcatagaaactgttgtgagaatgtacaaaaacagagcatataaattgtgcaaaaggcagaaatagaaaatagatctataaatagaattgcatttcgtacaaaacgtacatataattaatgcaaacggttgcatggaataatgcaacaaacagaggcgtgccacaggatgtgatggtatgcagggagatctaaaagagaaatttaaaggtggaaacgaaaggaaagaagaaattcaatctcaattttgatttgcttcagaaattaggtaaagttctgatgacggttatcgcagttatgccggcagcaggattgatgatcagtatcggtaagctggtacagatggcaggagcggatctttctatcgtaatgacaatcggaagtacgatggagaaggcggtggagcagtgaaagatgccaaacgtttggattacattttctgtaatacgcagaaaaaagtaaagtcatcgaaagtggtatgtaatggtaagaattacccggtagtatccgatcattatggagtaatgatcgaggtagaagattaagaggaggaagataaaatgagcgaaagagcagcaggtattttaatgccgatcagtagtttgccgtcagagtacggaattggttgtttttcaaaaagtgcgtatgaatttgtagattggctcaaaggagcaggccagagttattggcagattctcccgcttggaccgaccagttatggagattctccatatcagtccttttctacatttgcaggaaatccgtactttatcagtcttgatgaactgatcgaggaaggtgttctgacacgtgcagaatgtgagaaagtaaactggggaaaagcaaagggttctattgattacgagaagatttataaaggacgctatccactgcttcgaaaggcttatgagagaagtaagatcagtgagaatccggagtatcagaaattcgtgaatgagaatagctggtggctgtcagattatgcactgttcatggctgtaaaaggaagatttgacaatgtagagtggacaaaatgggcagaagatatccgtctccgttggaaatgggcaatggattattacagagaggaactgtattatgatattgaattccagcagtacatgcagtttaaattccacgagcaatggatgaaattaaaggcatatgcaaatgaaaatggaatcaagatcattggagatatcccgatctatgttgcaatggacagtgcggatacctgggcgcatccggaactgtttcagttagatgaggaaaatgttccgacagctgtagccggatgcccgccggatggattctctgcgacaggacagctgtggggaaatccgctgtaccgttgggactatcatagagagacaggatattcatggtggatttcaagactgcattatgtattccagatgtatgatgttgtcagaatcgatcatttccgtggatttgatgaatacttttcaattccgtatggggcagagaatgcgatcggaggacattgggagaaaggtcctggaatcgatctgttccgcaaagtggaacaggcacttggatggaagcaggttattgccgaagatcttggttatgtgacagattctgttcgtgagctggtccgcgagagtggttttccgggaatgaaggttctggaatttgcatttgattcccgtgactcaggttgtgcgaatgattatcttccacataactacccggtgaacagtgtggcttatacaggaactcatgacaacgaaacaatcgttggatggtggagcagtatcacaaaagaggagcaaaaactggcgagagattacatgtgtgaccagtacacaccggaaagggaactgtataaatctctgatcagcctgattatgcgaagcagtgcaaagctgtgtgttattccgatgcaggactatttaggacttggaaataattgtcgtatcaacactccgtctacggtaggaaagaactggaaatggagagtgaatacaagacagttgtcattgaaattgcagaaggaaatccaggagatgacacttagatatggaagaatgaactgggagacagtcgagcaggagtttaaaggataagatttcatgaaaaagagacggaggtttctgattacaagatgtcagaaacttccgtctttttcgttctctttaaatagtcatctttaagctatcgtcttttttcttaacgtccaaagagcaacaagtagtgtcaatatctcagccgccggaactgccagccagattccatttaattccaagaacctcggaagaactgtcaggaaaagaagcagcagagcaaaggaacgaaggaaagtaatcatacctgagatatatcctttgccatatgtcatcatacggattgctgcgaagatattgattcctgaaaataagaatccgagtccatataagcgcattccggaaactgccatgttaaagactgtgctgccgggagatgcaaagaaacgcactccaattggtgtcagcagataagtgcatccgtagagaatgatcggtgcaatcgcaaagaagcgataagcgtacttttctaaaacacgacagacagagaaatttctgtctccgtaagcatatcctagtggcgttgatagtcccatagaaaatccaaaataaattccgatacataagaactgtaaatacatgatgattgaaacagcagcaacgccgtcttctccggcgaaaagtagggcacttcggttaaagataacggttgtgatcgcaatcgcaagctggtttacgaattcagaagttccgttgaccatgctatgaaatgcttcctttatagataatccgtggaatgtaaaatgaaggaagttcggatgtgttacaaagtaaaccactcccattacaaaagaaagcagcaggccgaggaaagttgcaagtgcggcacctgtaattcccatatggagctgtccgataaaaatgtaatcgaaaacaatattaaaaatccctccggaaagtgctgtcagaaaactgtacgtcggagaaccgtcaacacggatgaaataagtgaacatctcttttccaaccacgatcggagcaccgaacagccaccagtagatataagctttacaatcttccatcaacagtgaggttgcaccaagcatctgcaggatgagcggcaaccggaaaagaataagcgcagagacaagagcgccaatgacaatggcagcagccatgcttaccgagaaagtccggctggcttcgtcatttttctttccaccgatatgaagagcagcaagcgcacttccgcctgtcgcaaaggcaagtgcgataccgtacagaatatttacaagcggatagacaacgttgatcgcagcgagtgcatttgttccaacataagcagaaacaaagattccatcaacgatcgtataaactgtagtaaataatgaggtcagataagttggaatgataaagcgtaataatttctttaatcgaatctcatctaccgaacgaaatataagagttttttccataaggaagcctccttgttaaaaaaatatcttagtataggataaaccttaaaggtacttgaaggtcaataaaaagattgctaaaataccagtagcaagatgtcggtatcttcatgaacgatgaagagaaaaagatcatctaatcatcaagaggaggtggaaaatatagctttggaatttcaaataggagagatatcccatttctttgacattcccgcatctacattgcgctattgggaagagatgcaggttctatcaccgaacaaaggggagacaagtcattatcgggagtatgcggtagaagatctgatgacaatttctgatgtgatcttttataaaaatctcggatttcagttaaagcagatccgagagatgaaatccaatacaccgaaacaacaggcaaatctgtttgaacagaagttatcggagcttgaacaggaacaggaactgctaaaacttcgaatgaaaaaactgcaaaggcatattgaggcggtgaagacgttggagaaattgagacagacgccttatcaggaaacagagatcgatacggagtgcattgtctcttttgagttgattgagcaggagaagttacttcaatatattgaagatccgtatctttattcccgcgtacagcatacggacacgctgcagcaggaacaacgtggtctgactgtcttgccggatgcgagcaatgtgtttgacgagtcacatattatctggcgtaagcatggcggcagatatatgacatttcttatgaaagaagaagttgccgagaattatccaaatgacttgcagaaacatatagaatatctacagcaataccataaaacaggggatgtgatcagtcgctttctactctgcgcacaggaagacggtaaggtatatgatttctataagacctttgtagagatttgctgatcattatgaataagaagaaacgatactagcgtggaaaaatatgcaaaacatagaattcacaaataaatcaaaaaatgggattgaaattcgcagaaacagtgactataattttttagttagtaagagaagtaatgagtggatgaaagacgtctaaggaggagttagatatgagcaatcaggagaatgtatttgaaacaattttagcacctatgaccggtacagcagtagcaatcacagaagtgccggatcctatttttatagagaagattcttggagatggaatcgcaatcgttccgacagaaggtaaggttgtaagcccggttgacggaactgtatcaaaagtagcagagacaggtcatatttatgctgttacttctgataacggagtagaagttgtaatgcatgtaggacttgagacagttgcactgaatggaaaatgtttccagatccatgtgaaagaaggagacaaggtaaaagcaggagatcttcttgcagatgcagaccttgagtttatcaaagaaacaggacgtaattccatcacaccgatcgtcatcggttcaagccttgaagggaaagagcttgtatgtgaagagggagaagttcaggctggaaaaacagttattatggaaattaagcagaaataagaagtctgaagatattgttccagaatcgatttagcttagaaggaaggttatagtatgaaagaagaaagatattcaatcatattcagcagcaaaacaggaaatacagcagagctggcaaatgcgattcgtgatgcattgccgcaggagaattgtgattatttcggaacaagcgaaatcgaagaaacggtatcagaaatgctttatattggtttctggacagaccagggaaatgcagataaatccgcattggagttattgcagaagataaagaataaaaaagtctttctgtttggaacagccgggtttggagagaatgaagcatatttccagaaggttctgaataacgttaagagttctatggataaaagcaatcaggtggttggtgaatatatgtgtcagggaaagatgccgcaagcggtgagagaccgttatgtgaaaatgaaagagcagccggatcatatgccaaatcttgatctgctgatcgcaaactttgaccgtgctttatcacatccggataaggaagatctggataaactcagagagctggttagagggtagaaaagtaaagaaaattttgtttgacttttagattaacaagaaatataataactacaaacgagtagcaagtaagcgtaaatccagtttaccggctgctcgttttcttttattaaaatagaagtaactgttcagaggcaacctccaaaatgctacgcatttcgtcggtgtggcgtatccgccaaataaaattttgaaaaattttcggatgatttacaagtgatactaactatgctaagatatagggatagtaaggaagaattaacggattacattaacgagaataaaaagttctttcagaacgttgactatgaaacgagtcaggcaatgaaagcttttctaaacatgaaacaaataccaggtgaagcagaacatgaggaggagatgattgatatgtgtaaggcaatacaggaaatgtataatgatggagttcgacaaggaagagatgaattgttaaaggaattaattcaaagaaagttacagaagaaaaaaacaccagatcagattgcagaagagttagaggaaagtgtggagtttattggaaaaattataaaagaaatgcaatagtgcattgctagaaagttcataattcagagatgatttcagaaaacaactatagaaattgaaaaagaagtgaaaagagttatctggaaacatattggaaataactagaggtaagaaaaataaaaagttattgattacaacaattaagatgaaatgtgttgtgattgatagcttttctgacattaagtgctatttaaggtctaaaagtattctattaaaagacaacaggataaaaaaataaataactgttcaaaaagccatggtagaagcttattatcctcttaaagacaagtctacttgggatatataacaggttttcagagagcatcgatcataggtgtgatcagcatagtgcaagcatggactttgactcgtttgatcgcgtaaatgcaaaaaggaaagcggttgaagtcgctttcccttaatttataactgtttggaatgaatctcccaaaatgcgatgcgtattctggacacttacagaatatcaatatactccccggccagtgccttattcatgcttcttactgcacagaattttccacacatactacaagtatcgctgtggtcatcttccggttttctgctgtcgcggattgcttttgcagtttctggatccagagcacattcaaactgtgcatcccagtcaagaacacggcgggcatctgccatcttatcatcgatatctcttgcaccaggaattcctttggcaatatcagcagcatgagctgcaatcttagaagcaatgattccctgttttgtatcttcaacatttggaagagcaaggtgttcagccggtgttacatagcagaggaaggaagcaccgttcattgctgcaacagctccaccgatcgcggaagtgatatggtcatatccaggagcaatatctgtaacgataggtccaagtacatagaaaggagctcccatacagatggtctgctgcactttcatgttagctgcaacctgatcaagcggtacatgtccaggtccttctaccataacctgaacattatgatcccaggcacgttttgttagctcaccgagacgcacaagctcttcaatctggcatacgtctgtagcgtcagccagacatccaggacggcacgcatcaccaagtgagattgtcacgtcatattcttcgcagatatcaagaatctcatcatagtactcgtagaatgggttctcttctcctgtcatgctcatccatgcgaatacaagacttcctccacggcttacgatgttcattttacgtttatgctttttgatctgttcaattgtttttcttgtgattccgcagtgaagtgtaacgaagtcaacaccgtcttctgcatgcatacggatgacatcaaggaaatcctgtgcagtcagagtagcaagatctctctgataatgaatgacactgtcgtatacaggaactgtaccgatcatagcaggacattcagaagtcagtttgcgacggaacggctgtgtatctccatggctggaaagatccatgatagattcggctccaagttctactgcgctcattactttctgcatttcaatatcataatccttgcagtcacgggaaactccaaggttgacattgatctttgtgcggagcatgcttccgacaccttccgggttcagggctttatgattcttgttagcacagattgcaacctttccttctgcgacaagcttcatcagtttgtcagtgtccatatgctctttttcagctactgttttgatttctggggtgagaatccctttacgagctgcatccatctgggttgtgtagtttctcatgttgttttgcctccattcgtatacgtgaattatataatttttgacgtcagcaaaacacggacagcgtacacaagaaaagctacggttccatgcatatgaatagatgcggaaaggaacgtaactgtttagctacactaccagcgaatgagtataagattatgctgacgccttcaacggagatgtattaatgactgtaaaataagaaagttattaatggaatactccggtgattacagattgattctgcattttcttgtgcggtacaaggtggtgcccccaatgtatcgcatgtaactgttcggaaattttgcagttacggattaagaagtcggaaaaagctgtgccattactccacttttctggaatactgaaatcagcaggaatgccaggatacttccggctactgttgagatcaggaatgggatcacatagataaataatcctgccggtgctgctcccataaggaataaagcaaccggataagcagcaattcctccgagaatacctgttccaagtgcttctgcaagacaagtaaggcttaaattcttacatttcttgtaaacaagtccacagcagagagctccgatcatactacccgggaaagccatcagacttccgattccaagtatattgcgcagaaggcttgcacagaatgcaattccaacgccccagccgggaccaagaagtacggctgcaaagatatttaccatatgttgaaccggtgcacatttacttccggctacaggaaagcttaaaaagcttccaacgatggcaagagcggtgagaacacctgcaagtgccagtttttttgtgtttgttgtctgtttcataacttgagtctcctttcaaatgtaaaaaaggatcctcacctgagtgaagatcctaccagctgtccgaagtaaaaagagatgcaagggcatctcaatcattacatggtatcaattccctccgttggcattatccaaatcaggtttaaacgggtcgaaacggtaacacgtctcctctcagccggttctgaccagctcccctttgacaatatttagttctttgtctgatgctattatgaaccgaaaaagtgaaaaatgcaagaggaaaatttgaagcaaaaggagaaaaaatttaaatcaggtttaaaattataagaagctgtattgaaaaataaatagaaaaacaatacaacttcttatttttatatattattacataaaaaacagaagaaaaagattgggtatactgcgaattgtattgtgacatgtattgttgtatattaagtacatgaagaaaaagtactgatcagagcaatgataatcagaacactgtaagtgataacggtaattatggttaattgtatggagaggtcacgggcgaatgaaaaaatttgaaaaaattgtaacctggattcaggaggaagtcaagtcgggaagaatggtttccggagagaagcttccttcagaacaggaactatctgaacaattccaggtcagtcgtcagacggtacgacgggcattggaagaattggtaaaagagaatattgtggaaagcagacgcggaagtggctcttatatatgtgaagatgcgggaatccttcttggaaatacagaaagaagagcagatcatgaagaaaaacgaatcgcagtaatgctgacgtatatcgatacctatatttttcctgttattatccgggaaattgaaaaaaaggtaacacaggcaggcggaatacttcaaattgcaatgacagacaattctgtagcaaaggagcggatgcatctggaagaatttttgagaacaagaagaattgatggtttgattgcagagcctgtaaaaagtgggcttccgaatccgaatttagatttatatcagaaattacagaaatcaggaataccggttttgtttgtgaatagtttctatgagaatctcacaattccgcatgtcagtctggatgatgagaaagcaggctacattgcaacgaaacaccttttggaatgtggacatacaagaatagcaggaatcttcaaggcggatgatgggcagggaagaatgcgatatgcaggatacacaaaagcactcatggaacattcacataaaatcaagaatcggcagattttatggatcgattcagaagatatccgtgagatggagctggtaagtgaaagaattttaaagcggttaaacggatgtacagcctgtgtctgctacaatgatgagattgcaagtaagttgattcaaatcttgcaaagtgcagatttgcaggtgccagatcagatttcagtgattggaattgacaattccaatcttgcaagattttgtgaagtaccaatcacatcggtaaataatccggcaaatgagattggaaagtgtgcagcacagattatattggataagattgataaaaatatggaaatgtactcagcggaatttgcaccggaacttgtgatgcgaaattctgtgaaattatataatgaagtcatgtagacagcagacgaaaggagaagaacaatgttagaacagttaaaaaaagaagtgtatgaggcaaatatgctgcttccaaaatacgatttggttacatttacatggggaaatgtaagtggaatcgatcgagaaagcggactttttgttattaaaccaagtggagttgaatatgataagctgactccggaagatatggtagttgttgatctgaacggaaataaagtagagggacgttacaatccatcttccgatacaccgacacatgttgttctttataatcgttttccaaaaatcggtggtgttgtacatacacattctgcatgggcaacaagctgggcacaggcaggaagagatatcccatgttacggaacaacacatgcagattacatctacggagaaatcccatgcgtgcgtaatctgacgaaagaagagattgaggaagcatatgagaagaacacaggagttctgattgcagatgagtttgaagctaagaagaaagattatattgcagttccggcagttctttgtaagaatcatggtgtatttacatggggtaaagatgcacacgaagcagttcacaatgcagttgttgcagaagaagttgcaaagatggcagcaagatgtgagatgatcaatccgcaggtaaaaccggctccgcaggaacttcaggataagcattactatagaaaacatggtgcgaatgcctattacggacagaatacagcaaaataataactgtcaagtataacataataacaaattaagtgataaataaaaaataactataaacattttataacaaggaggacacaaaaatgttaaagaagaaagagtacaaattctggttttgcacaggttcacaggatctttacggagatgaatgtctggcgcatgtagcagagcatgccaagattatcgtagagaagctcaatgagtctggagttcttccatatgaagttgtatggaaaccaacattgatcacaaacgaactgatccgtaagacttttaatgaagctaatattgatgatgaatgtgccggtgtcattacatggatgcatacattctcacctgcaaaatcatggattcttggacttcaggagttcagaaaaccattgcttcaccttcatacacagttcaatatggagatcccatatgacacgatcgatatggatttcatgaatgagaaccagtcagcacatggtggacgtgagttcggacacattttcacaagacttggaatcgagagaaaagttgttgttggacactggtcagacgagaaggttcaggagaagatcgcttcctggatgcgtacagcagttggtgtgatcgaaagcagccatgtacgtgtcatgagagttgcagacaacatgagaaatgttgctgttactgaaggtgacaaagtagaggcacagattaaattcggatgggaagtagatgcttatccggtaaatgaaatcgcagagtctgtagatgctgtaagcgcagcagatgtaaatacattagtagaagagtattatgacaaatatgagatccttcttgaaggaagagatccggaagagttcagaaaacatgttgctgttcaggcacagatcgagcttggattcgagcgtttccttgaggagaaaaactatcaggcaatcgttacccactttggagatctcggtgcactcaaacagcttccgggacttgcaatccagcgtctgatgcagaagggatatggatttggagctgaaggagactggaagacagcagctatggtccgtatcatgaagatcatgacagaaggcatgaaagatgcaaaaggaacatcgatgctggaagattatacatataattttgtgcctggaaaagaaggaattcttcaggctcatatgcttgagatctgcccatctatcgcagacggtccgatcagcatcaaggtaaatccactttctatgggagacagagaagatcctgcaagacttgtatttacatcaaaagaaggaaaaggtatcgcaacatcactgatcgatcttggagaccgtttccgtctgatcatcaatacagtggactgcaagaaaaatgaaaaaccaatgccgaagcttccggtagcaacaaacttctggacaccggagccggatctcgcaacaggagctgaagcctggattctttgcggtggtgcacatcatacagcattctcttatgatatcactgcagaacagatgggtgactgggcagcaatgatgggaatcgaagctgtatatattgataaagatacaacaatccgtaatctgaaaaatgaactcagatggaatgaacttgcatttagaaaataaaaaatcattaagaggataaccttcaatacttaaaaattcatcgaaaaatcattgaaatgaagaaaacgaaaaggtataatatctaattagaaaaaaagtctccgtaaatctgtccgctaagaaaatgcaaagcagacagatctgcggagcaaaaaggagtttaagtatgagtattaaaattggtattttaggttatggtaatcttggaagaggcgttgagtgcgcagtaaagcagaatgatgatatggagcttgtggcagtgttcacaagaagaaatccggaagatgtcaagattctgacagagactgcgacagtttgtaatgtagcagacgtagaagactggaaagataagattgacgttatgataatttgcggaggaagcgcaacagaccttccaaaacagacacctgtttacgcaaagatgttcaatgtgatcgatagttttgatacacatgcaagaatcccggagcattttgcaaatgtagatgcagccgcaaaagaaggcggacatgtaggaatcatttccgtgggctgggatccgggaatgttctcactgaacagactgtatgcgaatgcaattcttccagatggaaatgattacacattctggggcaaaggtgtaagccagggacattctgatgcaatccgcagagttgaaggtgtcaaagacggaaagcagtacacaattccggtagaggctgcactgaaagcagtaagaaacggagagaatccggaacttacaacaagacagaaacatacaagagagtgtttcgttgtactggaagaaggagcagatgcggcgaaggtagaagaagagatcaagacaatgccgaactacttctcagattatgatacaacagtacactttatcagtgaagaagaactgaaagcaaaccacagcggaattccgcacggtggatttgtactccgcagcggaaagacaggatggaatggtgagaataagcacctgatcgaatatagtctgaaactggattccaatccggaatttacatcatctgtactgatcgcttatgcaagagcagcttacagactggcaagcgaaggacagagcggatgcaagacagtatttgatattgcacctgcatacttaagcgcaaagagcggagaagagcttagaaaacatatgttataaaatcggatgcggcgatgacttacttaaatgagttatacgccgcattttttataggagggcaaaaatatgagaggaaaagaagagattaagaaaacaatcgaagaaggaaaagcggtgcttggaattgagtttggttctacaagaatcaaagcagttttaattgatgaggataaaagtccgatcgcatccggaagttatgactgggagaatcagcttgtagacaatgtctggacatacagcatggagaaaatccagaatggtcttcagggatgttaccaggatcttgtgaaagatgtagaagcaaaatataatgtgaagcttacaaaatttgcagcactcggagtcagcgcaatgatgcatggatatcttgcgtttgatgagaatgatgaattgcttgttccgttccgtacctggagaaatacgatcacagaagaagcttctgaaaaactgacagagctcttttcttatcatattccgcagcgttggagtattgctcatctgtaccaggcaatcttaaatggtgaagaacatgtaaaagatgttcgttatattacaacacttgcaggatatatccattggaaactgaccggcaagaaggtgctcggaaatggtgatgcagcaggaatgttcccaatcgacatagctactaagaaatttaatgagaagatgatggatcagtttgatgaacttacagcagagaagaatttcccatggaagatccgtgaaatccttccggaagttcttgttgccggagaagacgcaggtgtattgacagaagaaggcgcaaaactgcttgatcctacaggaacacttcagtccggaattccaatgtgtcctccggaaggagatgccggaacaggaatggttgcaacaaacagcgttgctgtccgtacaggaaatgtatctgccggaacaagtgtatttgcaatggcagtacttgagaaagacttgacaaagccttacgaagaaattgacctcgtaacaactccggccggagatcttgtagcgatggtacactgtaataactgtacatcagatctgaatgcatgggtgaatctgttccgtgaatttgcagagagtatgggaatgacagcagatatgaaccagatttttggaacactttataacaaagcattagaaggagattccgattgtggcggacttctagcttacaactatttctcaggagagcatattacaggatttaacgaaggaagaccgttgttcgttcgtaaacctgacagcaaatttaatcttgcaaactttatgagagtgcatctttatacttctcttggagcattgaagacaggaatgaatatccttctgaaaaaagaacatgttgcattggatcgaatgatgggacatggcggattgtttaagacaaaaggtgttggacagagaatccttgcaggagcaatcgatacaccggtttatgttatggagacagcaggtgaaggtggtgcatggggaatcgcattgcttgccgattaccttattaagaaagaggacaaggaatcgctgacagattatcttgagaacaaagtattccatgatgcagtgggaacaggaatggatccggttgcggaagatgtggaaggatacgagaaatttatggaaacatatgctaagggtcttgcaatcgagaaagcagcggttgaaaatttatagttacgtgtgttgctggacggtggcagatgaagtggaaatgatattttcaaggggctgtacatggtatcccatctcttcccatctggtcagtagttcatccaggatttcagcattagtggaagatgtgctgtggagcagaacgatagctccgggatgaatccttccgaggagtttggagaaagcttcttctttggatggctggttatcctgataccagtctacataggcgagactccagaagaaacttttgtaaccaagttcttttgccatttgaagattagcttcactgtattttccctgaggaggccgatagtatttggtcatattctttccggttacgtttttataggcagtttctacatattccagttctttttgaaaatcttctatagaagaaatatgggacatgtcggggtgatgccaggtatggtttcccacggtgtgtccttcttttattatctgtcggatcagttcaggctcagagtcaatgtaggttccgacaacaaaaaaagtggcttttacctgatgttttttcagtgcatcaaggatggcaggtgtatttccgttttcgtaaccggcatcaaaagtaagatacagaactttttcagacgtatcctgtgcgtaataagcatccatagatgcaagttcctggatcgaagcatttccaacaggagttttgccttcttcctgaaaacttaacccccagtttccttctgaagaaagtgtgagatcaggaagggcacaggaaatcgtccggggaatagaagtcacggagttctggttgacaggagaggggcgagccgaagttgactcattagaaaaagcgaaaatctgttctttaagaaatccagctccaatacctgaaaaataagagaagataagaaataaaatgcaatatttttttgatttcaaagggtgtatgggaaaatggatacatttccgggaaagagagagtttcattcgttcacctcggaaaattgttaatagaatatatgaaattgtatttctttttatacttgttgagcaggcaaaggaatgatatactaattcggtaattgtattgtatcccgcaagttgggaatgataacaaggaggaattgaataatgaaaacaaagaaacatgacactcgttggatggttagtgttgcacttatggcagcgatcgtgatcgtactggccaatacaccgcttggtatgatccagctccctatcattaaggcaacaacagttcatattccggtgatcctcggagcaattctgttaggacctggtgcaggagcaattcttggagcagtttttggtatatgctctctggtcagtaatacaatggctccgacactgttatcctttgcattttcaccatttttaagtacaacaggaattcctggagcgttgaaagcaatctggatttccgttggatgcagaattctgatcggtgtggtagcaggatggctgtgggtactttttacaaagattaaactgaatcagtttattgcacttccgattgtgggatttgttggttcaatggtgaatactgtcactgtaatgggaagtatttatttcctgtttgcacagcagtatgccgaggcaaaagaagttgctcttacagcagtattcggtctggtgatgggaactgtgacagcatctggtattccggaagcaatcgcggcggcaattctcgttctggcacttggaaaagtacttgttgtagttttccgcaagatgaaccttggggctgtgaatgtggagtctgcaaaataacagacagattttaaaatagaaaaaagatatgaatcatgaagaagttgaataaatgtggaatcaagactgttatcagttcacaaagttgtgaaatagtaacaaaaccacaaaaaatcaacttcttcatgttgctttttgatgaattttagttgctgttatagttgattaagtgtcaggtgtgtattataataaagctatatgatatgcaaaaactgttggaagatcagaacagcagaaagaagaggagaaaaatatggcagaggattacagaaaccaggcaatcggcgtatttgaactggaaagtgagtgtatctgttttgtagcacttgatgcggcagcaaaagcagcagcagtaaagattcagggtgtggagagaaatcgtcttgcggcaggagcctgcgtgaagatgagaggaagtgtctctgacgtgaaggctgcaatggaagcagcactggatgtagccagaccgttgacgaagattgtttcccatacggtgattgcatcaccttctgaggatacggaaaaagcaattgcaatgacaattaataaataggtatttgttcaattgtctgttgtacatatgagaagagtattgttttgtgaggaaatcagagaaggaaaagaaagggaaataagatgaagaaatatggagcatatggcctggtagaggtaaaaggagaatccaatgcggtgatcgtagttgaccgcatgttaaagactgcagaagtagagtatgtgacacaggacacaaagtgcggtggacatgcacttgtttttgtaggtggcagtgtatcagcagtaacagcagcggttgatgaagtgaaaaataatgcaccgtgtaaagttatacaaactgctgtaatctccaatccgtctcaggagatggttgacatagtagaaatgtttaagaatagataagagttaggattaagtaaaatggaaagagcaatcttgttttttgatattgatggaacagtgttgagtgaagtgacaaaagaggtaccgcaaagtgcgattgaggcaatggaaaaagcacgagcggaaggacatctgctgtttattaatacaggcagaacaatctgtagtattccgacagaggtgagaaaattccaatttgatgggtatttatgtggctgtgggacatatcttacagaacatgatgaagttttgctaaaaagctcgattgagaagcagagaggtatagaactgctgcgaaaagcaaaagaatgtaatcttggtgttattgcggaaggacaagaggattgttattttccagggcacatatcacgatttgacaggttagaatctacaagaagatattttgcatctagaggaataggaatcgaacagtctctagagagcgaaagatttgaatatgataagttatttgtttacgtagatgataagagcgattttgattcttttcgtgagtatcttggagatgacatggaagcacttgaccgtggcggaaaggcctatgaggtaattcagaagggattttctaaagcgacagcatgtcagtttattatggaaagatatgacatggatgcaagtcatgcgtatgtcttcggagacagcagtaatgatctggcaatgtttgaatatgcggagcatgcgattgcgatgggcagacatgattcggtattggatccatatgctgagtttgttacaaagacagtggaaaatgatggaattgcatatgccatgaagcattatggattaatttaacagaaaatagaaaacaggatctgtcagtaaagataaaactggcggatcctgttttttatatattaggcaggtcctttcctaatatataaaaaacgctccgctcaggatgcgcactgcggcgtacacggaggatgcgtgttttgacttgaatgcatctcgccccatcgccaaaggcgatttaaaatggcgagatgcgttgctggtcgcacatcgtgtgaacagtaacattatggctggcaacgtaataaaaaagaattcttcagaaacacttgactgtcaatctgctgtatgatttaatggaatgagcagttaagttgggcaaaatgcataacggttcgctaattggcctgggaggagaagattatggctgctactattcgcgatatcaagaaaaggacaggattgtcccttgcaacgatatcgaagtatttgaatggcggtaatgtgttgccggaaaatcgtatcttgattgaggaggcaatcaacgaactgcattatgaagtgaacgagctcgcaagagggcttgttacccacaagacaaagacgattggagttctggtttatgatatacagtgtctttttgtaggaagtatgctgcattatctgggaatggaacttcataaaaagggatatggaatgttgatctgtgattcctgcaatgacgagaagctgcagaaagaaaatctgcagtttcttctgagcaggaaagtagatggaatattggtatttgctgtaggtatgcatggaaagtttcttcatgctgcgaaaaaagcaaatgttccggttgttctggttgacagatcattccaggatgaagaatatgattgcgttgaggttgataaccggacagcaatctatcgtgcaacaaataaattaattgagaaccatcacaagaaaatagctgtgattgcctctaatattgaatataccggaagggaacgtgtgaaaggatattctgatgcgatgaaccaggcaggactggagattccaaaggaatactataagctgggagggcattcttttgaacatgggtacagaggaatgaaagaacttttggagcttgaagaccgtccgaccggtgtgatcttaggaaactataacaccatgcttggtggaattatggcattgaacgaatcaggactctcctgtccgcaagatgtctcgctcatcggagtggataatcttccgatgacccaggtgctgcgccctaaattatggctgattgtccagccaatggaaacgatgtgcgagaaggctgtagctatgctcctggagcgagtaaacggagagcaaaacggtatgccggtaaaaattagtttcagtacctctgtaagagagggagactcaatacgagaccttggatagtgcataagcaaaatgcacagaaaagcgtggtttttgttgtgagaatggataaaaaaatagtgaaaacaaacaaaaacgaaccgtttcgctctaaaaacggtgggaaatcttgacaaaatatgaaaacaaggctataatttattcttgtattaaaggtgtgcgggaaaattgaaaacacactttgaaaaacaaaaaaatcttaaagctttgaaagcgaaccgttacgctgaggttaagaggaatgggggtatcgtaagagttaatcgacaatccagtcaacaccagcaaagtaaaagatgggaggaagaaaattggaaaaaattaaacaaaatccttttgtaaaaaaggtaggatttaacagaattgttttgtgctgtgtccttcttctgatgtacggactcttctgtgcactgaccggaggaagcttcgcaggaatgaaccgaatcatgagcgcactcaattatgcttatttccttggatttttatcactgggtgttacatttgtaattgctacaggagagatcgacttctctattggaccggttatgttctgttgtgcacttatctcaggttatacactgacaacacatggaatttccatgccggttgcaatcctgatcagtatccttgtgggatttgcttttgggctctttaatggatacctggtagcttactggtcagtaccttcattcatcacttcaatggcaagtatgaatattgcaaaaggtcttgcgtcagtttacacaaagacacagtcagtcagctggccgcaggcagcagatccggacaacggatggttcagaaatcttgtaagatataacgggttcccggttggacttgttattcttctggtagctgcagttatctgtgcgattatcctgaacaagacaagaatcggacgttacatcctttgccttggtagtaacaaagaagctgttagactttcaggtgtagatgttaagaaatgggaaatgcttgcattcattatctgtggagttctcgttggaataggcgctatcttctatgtatctgcatatacaacagtacagcctggttatggagatcagtacaacaacgaagcaatcgccggatgtgtaatgggtggtacatccatggcaggtggacttgcatccatcagcggtacaatcattggtgtatttatcatcgctcttcttcaggaaggaattctggctcttggctttacaaaagattatcagcttatcattacaggtgttattgttatcgtcgcagtattcagtgacgtacttgcaagacgcagaaagaactaatttctcttctatattaagagatcagctttatgaatgatgaacgaaatgtttgattgaaagaaaggcaagggtaataaaatgggcgaagttatattggaaatgaaagggattgataaatctttcccaggtgttcacgcacttgaccatgtagatcttgagatcagaaaaggcgaagttcttgctcttatgggagagaatggtgccggaaaatcaactctgatgaaagttctcacaggtatttatacaaaagattcaggaacaattacatatgaaggtaaagaagttgagttccatagtgctcgtgaagcacaggacaatggtgttatcatcgtacaccaggagctgaacatgcttggtcatctgacagttgctcagaacatcttcatcggaagagagttcaagaagggcatcaagatcgatgacaagaaaatgaacgaagaagcacagaaactgttcgacagaatgaacgttgatattgatccgagagagacaatgtcaaaacttacagtaggtaagcagcagatgtgtgagatcgcaaaagctatttcacatgatgcaaagatcatcatctttgacgagccatcagcagctctgacagagacagagattgagcagttgttcaagatcatccgtgacctgaaaagtcagggaatgggaattgtttatatctcccaccgtatggatgagattaaagtgatcacagaccgtgttacagtcatgagagatggtacttatgttggaacattgatcacaaaagaaagtacaaaagacgacatcatcaacatgatggttggacgtgttatttacgaagatccgaaggagaagaacatgacacctccgggagcaccggtagttcttaaagttgaacacttgaacgctggtaagatggtacaggatgtaagcttcgaacttcacaaaggtgagatccttggattctccggactgatgggagctggacgtacagagacagccagagcactctttggagctgacccgatcgacagcggtgatatttatatcaacggtaagaaggttacaatcaagagcccacaggatgctgttaagtgcggtatcggttatctgtcagaggacagaaagagatatggtattgttgtacagaaatcagttgctgagaatacaacaatggcaacacttgaaaaattcatgagcggtccttttatcgataagaagaaagagaacaagattgctcaggaatatgttgagcagcttgcaacaaagactcctggtacagatcagctggtagttaacctgtcaggtggtaaccagcagaaagtcgttattgcaaaatggctgacaagagactgtgacatccttatcttcgatgagcctacaagaggtatcgacgttggagctaagaatgagatttacaagctgatgaatcagctggcagcagaaggaaaagccattattatgatttcctccgagatgacagagatccttcgtatgagtgacagaatcgttgttatgtgcgaaggtaagaagacaggtgagctggatatttccgaagctacacaggaaaatatcatgaacatggctacacgtgagattgagtagggagggaaaaagtaatggcaaataatacaacaaagaaggccggctctaataagtcatttattgacagaatgggaggacagaaattcatcgtcctgctcgttgttattgcactgtttatcttcttctgtgcaatgagccctaacttcagaaaatatacaacatttattaacattctggacttctcctattatattgtcctgatggcaattggagtagcctttccactgatgacaggtggtgttgacctgtcaatcggtactggacttgtatgttattcactcgttggtggatatctgatcgttcacaaaggaatgcctacaatcgttggtatccttgcagcaattattcttggaatgctgattggtgttctgaatggtgtactggtagcaatcatggacctgccggcattcctggcaacactttgtacttgtatgattactcgtggacttggttccattatcgtaggtggattcggaatctcatggccggcagcagcagcaccgggcggatggttcagaagtatcttcaagattcagtccggcggacagaatatcccgatcggtttcttatgggtaattcttctggttgttgttatgacatttgtactgaatcatacaagaattggacgttatacacttgcaatcggaagtaacaaagaagcaacaagactttccggagttaatgtaagattctatcatattgcagcatatgtaatctgtggattcttcgcaggacttgcttctatcgcatactccgctatcttcgctacagttcagccaggaagtggtgctggattcgagcttgaggctatcggtggagcaatcatcggtggtgtatccatgacaggtggtgtaggaagcatcacaggaacactgtttggtgtattcgttatctgtcttctgaagactggtcttccattcatcggactgacagctaactggcagcagatcattacaggatttgtcctgatcgcagccgtacttgttgatattcttaagagaaaagcaggaaaagagtaattttttccacttaaatttagaatttgtgaaaaatcacgaaaaagcaataattaattgcaaaaccattggtaatgtgttatattattaatgtgtgcggatagatagcagcgggaaaatatgctaaaaaagcgtgaaaaagaaagctgttactatagaagctaaacgaaacagactgtataaagagttttcggacaaagaagcctgggcaaactacttctgcagagcgatttaagaaatgcacgaaagaggctctgccagagaggcccggcattagggagaggaaaactggaagaaaactcagacaagcagtcacaaatttattttgtcaggaggacataattatgaaaaagaaagttttagcagttttacttggtggatgtatggtagttggaatgctcgcaggatgtggatccaaggcagatgacactaagaaagcagatggcgacactaagacagatggatcaggagattccaagggatatcatttcgaagttgttgtaaagagcttccagtcttcatactggcaggcagctgtacagggaatcaatcaggcttgtgatgagctcggtgttacagctaacacaacaggaccgaacgctgagtccgatatcgctgaccaggttaacatgctgaacaacgcaatcaacaaaaatccagacggaatcgctcttgcagcttgtgaccagaactcagttcttgattcactgcagtcagcacttgacaagaagattccggttgtatgtttcgactcaggtgttccggacgctccagaaggatctgtatacgcaacagttgtaacagacaacgagcaggctggtggaatcgcagcagagcatatttatgaagcaatcaaagacagaatcggaaacggacaggttcgtgttggtgaagttaaccaggatgcaacatctgctaacatttctgagcgtggtatgggattcatcaacaagttcatcgagcttgctaaagctgatggaaagacagtagcagttgtaggaaatgacttctatgtaaaccaggtaaaagataatggcgatcaggcatctgctgacgtagttctcgaagttgcagttccggcacagacaacagttgagctgtgtgctacagaggcttctaacatcatgaacaaagacgatacaatcgctatgttcggatcaaaccaggtatctgcagagggtgttctcacagctaaccagaacctgaacaaacttggaacagatgatgataagatcgttgcagctggattcgatgctggatcagttatcaaagccgctgttaaagatggtacattacttggtgctgttacacagtctcctctgatgcagggtaaaatctccatcgagactcttgctaagatctgtgatggtgagtctgtagaagacgttacaacagatggttactggtatgattctacaaacatggatgatgaggatatctctccaaacctgtatgactaattcatatctgtaaagagaagctgaattattaaagtgaaaagaaaggaatcgggaaattcccggttccttttttaaaataatatgttattatatcaaggaggaagataatatgttaaaaggaattccaaaaattttatcaccagaactgttgaaagtacttgctgagatgggacacagtgacagactggttatctctgatggaaacttcccggctgaatcaatgggaaaagacgcgattgtgatccgttgcgacggacatggagtaccggagattcttgatgcgattcttcaggtgttccctctggacagctatgtggagcatccggtaaatcttatggaagttatgcctggagatactgcggagacaccaatctgggatacatataaagagattatccgtaaatatgatgacagaggtgatgctgttgttggaaacattgagcgttttgcattctatgatgaagctaagacagcttatgcaatcattgcaacaggtgaatcagcactttatgcgaatgtaatgcttcagaagggtgttgtaacagactagtcacattttttaacgtaatggaggaacaatatgcttgatcatgtagaaaaaatatttgcagatatgaagccgatgatgaaaaagttgaagaaggcttcttataaagtaaatatggaggcttttatagagaatcatggacattatttccgtgagatgacagaatatacggagaatgcttctgataaagagacggcagccaaagagcttgcagtagactttacagataaggtttatgatgcatatgtttctccgaaaaaaggaaaaatagacagtgcaattcagacagatctgaatttctttatgatctattatgtatttccggcaattcttttgacagagcatgacgatgcgaaactgatcgcagaccatctctgcagcagatggggagaaaagtttaagaacagtaagattcagtatacagattatgattccctatatgtttcattccgtgagaagatatttggaatcttttaatacttgcaaatcaaccttacttgtgatagaataattaagattcatgtaatggcatgagaagattttagaagctatatttttatggtttaataagtgtgctgttacgttagtgtgtaggaggtcatagaagatggacattttgaagattgttttatacattatctttgttatagactgtatcgcattatcagcgattattcttttgcaggaaggaaagtcagccggattgggaacaattggcggtatggcggatacttattggggacagaacaagggacgttctatggaaggtgcacttgtaaagtctacaaagtttcttgctatccttttcctggtgcttgcagtagtactgaaccttaaggtttttaattaataacagatgatgaagtaagtataagacattctataataagactatagaatgtctttttttactttaagtagtgatgaaaggttactgttcactcccgtgtcaatcactccgctgattgacacggaggatgcatgtgcgatttaaaatggcgagatgcgttgctggtcgcacatcgtgtgaacagtaacagataaatcaatcagtgggagggagaacatgcgaagtccaaagaaaagaatccgccacagagataggaattatatgatatatgtgatgacgtttctcattgcgctgaccgggatactcggaattttaaagggcaatccggttcaggcagcggaagaagagagtacacagaaggggagcatctcgctcgtctgcccggttgaggggatggagttgtctctgtaccgtgtggcagagtatgaggagtcgggcagttttacattgacggaacaattccagaagtatccggtctcactggagcagaagagccaggagggctggcaggggacagcggatgcactggcggactatatcagacgtgacggaatcgcagcagatgcagtactggcatcaggttcggacaggaaagtatgttttacagatcttaaccggggactttatcttgtgctgggacagacaacagagctgcaggaagacggcaagacacagatctatgagccacagacagcattgattgcattgccggaggattcaaaggaaacttcagaagggacagatccttatcaggtgacagcggttctgaagttcgagaagaacgacaaaccgggaaatccagaagagacgaagattcatgtattgaaagtgtggaagcaggatcaggagaaagaacgcccggattctatcgtggtagagctgctgcagacggatgtggaggggaatacaacagtcgttgaccggcagatgcttacgaaagaaaaccagtggtcctatacatggaagaatctttccacggtgatgcgctggagtgtgtcagaggcagaggtgccgaaggggtataccgttgctgtcacacgtgaaggaaatacagttgttttgacaaatacagcgaagaagccgggaaagtcggatggagaagtgaatccaccatcgaagaagccaacggataaaacaacaaataaaacagtaaataaaataacagacaagacatcagacaagcttccacagacaggacagctctggtggccggtacttgtgcttttatttgcaggtgcgatctgtctgctggtgggaagagttttacgggatagaaaagaagagaagaatagatgagcaagaagaaaaagaattggataggaaagatatttacaatcacagggttgctgcttttcgcggcagcccttgctctttctgtatacaatctctgggacggttatcgggcagagcaaagcagagagaagctgttggaagaatatagagacaagaaccagaacatttctgatgagggagagcaggcagaagaatctgacggacagataccggattatcagttgaacccggagatggagatgccggaggtcatgttggaagagctggatggcgcagcgtgcatcggagtgcttgagataccagagattgatctgaagcttccggtattgagcaaatggagctacccgcttctgaagaaagcaccttgccgctattcgggcagtgcttatctggataatctcgtgattgcggcacataattacagaacacatttcgggaagttgaaagaactggagatgggtgacgaggtgatcttcacagatgcagccggaaaccggttcgaatacaaagtggcggtggtagaagcattgactccacaaagtgtggaagatatgacaagcggagagtgggcgctgagtttgttcacttgtacactggatggaaagaacagggtgacggtgcggtgtgacttcactgttttaccatagtgaattttgttatagaatggcgctaaatcagctataatttgtagaagattagtctattctaatctgaaaggaaaaatgttatactaaaggaaatgagtaatatgaggctatcatcttatgaaattattagtaactggaaacatcggatatatcacaactgaatttattaaggaagccttcccggagtgtcagattcttttacttggagagactgcattaaagtcagatcgtcgcaaggggatatcggtacatccaatgccacacgcagagaaggaatttgaagatatctttaagacttatgaatttgagggtgtgatttatttttctaattatctcacctttcatgggaagaaagacggtgagcttgagactttacgtaaagtattacattattataaaggaaatacgaattcacgattgctgtatattaccggtccggagggtttgtatgaagaaacgaccggaaagacattaatggttcgtaccgtagaggagttctgcaggcagtattgcgaactgcatcagatttctgttaagattctgtgtgcgccgtacctttattccggcacttacgaggaggattatttctttcaattattttcgaaggcactcaatcaaaagtcaatcctctttgaagaagcaccatctcaggaaatgtattttcttgctctgagtgatcttgcggacctgttatataagatttttgataactggaatgaggagagtacttatcttcagattccgcaagtgtttcattttacctttgaacagctcggagagaagcttaagcagatatttccattcgcacacattacatatcttgcagatgcgatgattcaggagagaacagtcactgacaagatattgaggaatgaatatggctggtttccgaagatttctcttttggaagatctctcggaaatatatgcacagtattgtcagaagacaaattataagatccgaaagatagatgctttgaagagctttctcaacagtcatgcgacagttgtaagaatcatcgagctgttgctcacattttttgtgttcgaggtactgaaccgagtggcagggaatcaggtgcagtttgagatgatcgatctgcggctggtatatatcgtgctgttcagcagtttatacggtattaattatggactcgcatcagcaggactggaatccctttcgctgttggcggcatatgcaaagacaggaatcggatggacaacacttttttacgaaccgtcgaactggattccatttatcttttatttcgctgtcagtgcaatctgtggatatgtacgattgaagaacactgagaatgttcggtttatgaaagcggaaaataaacttattttagataaatttttatttgcgcgggaaatgtatcaggagacgcttcgggataagcgtcagtacaagaagcagattctgggaagtcgagacagttttggtaagatttttgacattacgaaaaaacttgatgtctttcttccgcaggatctttttatcgaaacgcttcatgtgatggaatctgttcttgagaatcatacgattgcaatctattcagtgggaaagaaaaagcagttcggacgacttacgatcgcatcacaaggaatgaaagatgtgtttgctaattctatttgtatgaaggattatctggaggcaaatgaggcagtagaagccggaaatgtatgggtaaaccgggagttcctggaaggatatccaatgtgtataaaaggaattcaaaaagacggagagctcgtgatgctgatttttattcaggatgtaaagggcgagcagctttctctttattatctgaatttgttccaggttctcagtggtctggtggagaccgctcttttgcgtgcgctggaataccaggaagcggttaagagcaggcagtatgtggcaggtacaagtacattgaaaccagagtattttgaagaacgattgtattcatttcatgctatgagagaagaacagctggcatcctatacgcttctaaagctggattatccgcagatgtcacttgcagaggcggatgcagtgctgcagaagtctgtccgtgaaaatgatgtctggggaatttctgaaaaagaagagctgtttctcattctttcgcagacggacaggaaagtattgccgatcattcttgcaagactggagaagagtggatttatatgtcatgaaatcgatgctgtcgagagtgcggattaagtgagaaaagaaagagaagcgaagaattattgccggtcgcaacagattgtgaccggcatatttgtgggagagatattatgattcaaacagtgcttgggatacttctgatcttattacatattgtttgttgtgtattggtctggaggggaataaagacacattttctgaaagcgaaaaaatatctgatcggacttgtagtttttgttcctttctgggggacgatatgtgtgctgcttttgcatttacagaggctgacgaaaagagacaatagaatagagccgggagtggaaaagcttcgtgtgaatgaagagatttataaaaatatttttcaggcagcttcggatatggatgagaagattgttcctctggaggaagcacttctgatcaataagccggggatacgacgtgagctgatcatggatgtgttaaacgacgatccggaagaatacatggacattctgaaacaggctcgtatgaacgaagatgtagaggtggttcattatgcgatcacagctatggttgagctctctaaggagtatgacttccggttgcagaaactggaaaaactgtatgcggcatctccgaatgatcctgaggttctggatcagtattgtaattttatggaagaatatctgaatcaggggattctggaagcccagatggagaaagaacagcgggttcgttatatccggctcttgaatcaaaagctgaagataaaagcaacgctccatacatgtgtgtgcctgtttaaaaatctgatgaaaaacggagattatgttcaggcgggagaaattctggaacttatggatcagaaatggcatcacagagaagaattctggactctgaagatacagtatctggcggaacgtaaaatggcatctgagttacagaagtgtttaagacagatgcaggaggaacacatttatctgtcttccaagagtaaggaggcattggatttttggttagattaaaatcattgaaaacatttccgtttaaaagcatgttagtaatcctgtgcgtctttatgatgatggcagttgttctttttgctgaacgaagtggtattcaatatacagaaaagaatagaaaagttgcgtatctcgatcgagaagaggtagtcaccgaacagacggctgtgaagtcattgccgaagacctgtctggtccttcgtaacagtgcggatgaagcaagtgaacaggcctggacacagtttcagcaaatatttaaagatatgaaggttgggacggacgtagtcgatttgaagagtgattctgtgatccctgactatgatgagtatgaaacagtggttgtattattaagtgatatcagtccattgaaagagaaacttttggaactgtgtgactgggtttcggaaggtggaaatgcactctttgcgatgactcttcagaaaacggcatatacgtcgataatagagcagaagcttggaattatttcttcaggttatgaaaatacggttgtagacagtatttattttgaaccggggtttatgcttggcggcgggcaggcttatgaaatcacagatccatatgattctgcctggtcagtgcagctgagtgagcaggcgaaggttcatgcgcaggtagaggatgaaaacggtcagccggttatctgggaaaatcaatatggaaaaggaaagtttgtagtagataattttggattgtatgagaaggccgtccgtggattttatgcagcgtcttacagtcttcttacggatgtcggtatctatccggtgatcaatggatcagcattttatctggatgacttcccgtcaccggttccaaatggagacggtacttatgtgaaacgtgattatgagatgagcatcagcaatttttatatgaacgtatggtggccggacatgctggaacttgcctctgatcatggtatccgttatacaggtgtgatgattgagaactatggggatgcgacagacgggacgatcgagaagcagaaagataccaaacgcttcgaatattttggaaatatgttgctccatcagggcggggagcttggatatcatggatacaatcatcagccgttaagcctcccaaatacggactatggcgatgtgcttccatatgacacctggaaaaatcagtcggcgatgaaaaaggctgtaaaggaactggtacgatttggcgataaaatatttccaagcacatcgatgtcggtttatgtaccaccgtccaatgtattgtcggcagaaggtaggagaatgcttgcagaggattttccgcagatcaggacgatcgccagtaactatttcaccggtgagtttgcttatgtgcaggaatttgaagtggcggaggacggtattgtggaacagcctcgtatcatttcaggtgcgatcattgatagctatatgaagatggcagcattgtctgaattgaacatgcattttgtgaacagccattttatacatccggatgatcttctggacgaagatcgtggtgcggcacttggctgggaaaaattgaaagggaacttaagtgattatatggactggctggatgattcagcaccgtccttgagacagcttacaggttcggaactgtccggcgcgatccagcgctacggagcggtcacatttacaaagacagtgacagatcaggagatcagactggaactcgacaatttttatgatgaagtgtattttatggtgcggatcaacgaaggaacaccgggagatgtttcgggaggaaaacttacgcatttgaccggaaatctctatttgctcaaggcaaaggagccgactgtaaccatcgagaaaacagaataaaatacgaagcagtaaaatgcggcagataaggagttagttgtgagaatctgtcttatattagagggatgttatccctatgtgtttggcggtgtatccacatggatgcatcagtatatcaatgaaatgaaagagcatgagtttgttctgtgggtgatcggggcaaatgcgaaggatcgagggaaatttgtctacgaacttcctgaaaatgtcgtcgaggtccatgaggttttcctggatgatgccctgaggctgaaggattcagggaaaatgcttcatgcttttacgaaggaagaaaagaacagcttaaaggagctgatgttgtgcaaacgtccggactgggaggttttgtttcacctctattatgaccagaaactgaacccgatgtcctttttgaaaagtgaagagtttttgaatatattgacagagtgctgtataaaagattatccatatactccgtttgcggatgcatttcacacgatgcgctctatgctgcttccggttctttatctgatgggaagtgaagtgcctaaggcagatgtttatcacgcgatctgtacggggtacggaggacttcttgcgtgtctcggcggatatgtctataagaagaaagtgcttttgacggagcatggaatttatacaagagagcgtgaagaagagatcatccgtgcaaaatgggtacagccggcatttaaaaagcagtggatcgccttcttttatatgttgtcggatattatttatacgagagccttttctgtctcagcgttgtttaccaatgctatgcttgcacagattcagatgggatgtgacaaggaaaaatgtcgtgtagttgagaatggaatcaattacgaacgactctcttctattccgttaaaagaagaagacggatgggttgatattggcgcagttgtgcgtctggcgccgatcaaggatatcaagacaatgatttatgcgttttatgagttgtgtaagaaaagagatcatgtgcgccttcatattatgggtggcgttgatgatgaggagtatgcgcaggaatgctatgcgctggtcgatcagttacatttggaaaatgtgatctttacaggccgcgtggatattatttcctatatggaaaagctggattttacaattttgacgagtatatcagaaggacagccgttgtctgtcctggaatcatttgccgcaaggcgtccttgtgtgactacggatgtgggctgttgcagggaacttctggacggaaacgaggaggactgttatggatccgtaggatattgtgttccgccaatgtatcgtgagggacttgcgcaggcaatggatcagatgtgtgcttccagaacgcgaagacttcgtatgggcgcaaatgcacagaaacgggtaaaggcgtattatcgaaaagaagaaatgattgaaaagtatcggaaaatgtatcgggaggtggaagaagcagatggccggaatcggatttgagttaaagaaattattccagaaaagtggaattgcatcgactgcgaaagcctatggatatgccggaattatctgtacaggtccgatgttgcttggtattgtattgctggttgggattacccttatctgtgatcataccggtgcgacaaggcacaaccgggagcttttaaactgtatgattacttatacacttctcgcttcgctgactgtgacaagcttcttttctatggttgtgacgagatatattgcggatatgttgtatgaagaacgacatgaaacagtgcttccttccttctggggatcgacaacgattctgcttgttgtaggagggatcatgtacggaatctttcttttgttttccggaatcaatctgattgaccagtttttgtgtctggagtttttcggagaactgatcgtcacatggaatgcgatgagttatctgaccgcgataaaggattataaagggatacttctatcgtttgtgtcggcagtgacggtgtcgcttttgattggagttctactggttttgattggaattccacatgtagaggcaatgatgattgctgtaacgatcggatatgggatcatgcttctgtgggatgtgacactgctataccgttattttccacagagtgagagcagtgcgtttttctttctgcgctgggtggatcaattccttccgcttgcgttcataggcttgtttacgaatatcggactctttgcacatttggttattatgtggtgtagtccgatccatgtacatgtacaggggttattctatggtgctccgtatcacgatgtccctgcaatgatcgcatatctgacgattcttataacgacagttaatttcgttgtgtcggtggaagtgaatttctatccgaaatacaggaattactacagtctgtttaatgacagaggagaaattaaagatattttacaggcaggaaacgagatgaaagaagttttgaatatggagctgaagtatacggcactgaagcagcttcttacaacggcattggcgctttctgtaggacagcttctcctgacctatcttccgcttggatttaatgatcttatggaaggctatttcaggacactgtgtgtcggttatggactttatgcggttgctaatacaatgatgctgatcctgctgtattttacagattataaaggagcattatatgcaacaggaatgtttgcggcgtgtacgacaggatttacctgtatatctctatttttcccgcaagtatactatggctttggatttttacttggaagtgcagtattctttctgatctgtacgctgcggcttggatattttattaaaaaacttccgtattatattttgagtgtacaaccaatcgtggcggaagataaaacaggatttttcacacggttaggatgttttctggaagagaaaatagaaaggagagacgagcttgaaaaattataaatcaattgcactgggatgcgccctgttattaggaatgtcctgttgcctgacgggatgtacagcttcgggggaaacagggaatgcttcagaaacaaagacagagcaacaagaaacaatagaaaaggccgagacacaggatatcaatgacgttcatcttcgagataaggacagcctctatgaaaatgatgacgagacgagtgttgtgacaatgtatcttacggtttctcaaggaaattcttcggagggtacgaatcatacctggaaggaaatcaacagttattctgtttatgattatgacaaaatgggagtagaccgttaccagacagccgcgctcctccagattggagatgagtctggtccacagagtggagaggttggttacggtgaaaatgtgccgaatgcgacggtgcagatcagaggacagacttcaagtcgttatgcgcagaaaaactataagattgagttgaagaagaacaagggaacctggcgtgggcagcgcacgatcaacctgaataaacatcagacagacgggatgcgtttccgcaataagctgtcttatgatcttttgaagggaatcccacagctgatgtctctcaggacgcagtttgttcatttgtatgtcagagatctcaccgaagggaacagcacggaatttcaggattatggactgtatacgcaggtggaacagctcaataagacaggaatgaaaaatcacgaaatggattcgaatggacagttgtacaaaattaatttgtttgagttttttcgttatgaagatgtgataaaaaaagaagatgatccgacctatgaccagaaagcatttgaaaagcttttggagatcaagggagattctgaccatacgaaattgatcgatatgcttacggatctgaatgataattcaaaatcgattggtaatatcctggatcaatattttgacagagaaaatctgacatattggatggcatatcagatattgacaggaaatacagatacacagagtcgtaatacatatttatatagtccacagaattcggacacatggtatctgattgcgtgggacaatgacagttctttcaagacaactgaatatatcgttaaaaatcgatctgaacaaggtagttgggattgtggagtcagtaattactggggcaatgttctctttcgcagatgtctgcagtccgaggattttcgtgaggaacttgatgcggcaattcaggatctgagatcctatctcagcgtagagcggcacacgatgtgcgaccagcaacgcatctcgccattttaaatcgcctttggcgatggggcgagatgcattcaagccaaaacatgcatcctccgtgtcaatcagcggagtgattgacacgggagtgaacagtaacagtttctctgcatatttgcaaaaaatggctatgtttctttaacaaacacagccattttagcacactttattttagaaagctatagaaaatcctcagttctcgcccgaaaacggttctttctgacatttttcaccaattttctcccccatctttatcaatgtctctgcaccggttgcactgtttctcaccagatcttcatccgtctgcacttttcccggctctgtcaaaagaacgactgtagacccgccaaactcgaacattcctttttcttctccccggtgtacaacagatactttctttttatgattcttaatccgtccaaccataagagtaccgacttccatctgcaaaacggttcccagttcttctgtctgtacaagacaatattcccttgtattcatcttgtaaatcggagcatagtcatttgccaccggatttactgtatggaatactcctctgatctttcgctgtgcagatttcacaccatctgccacataacaatatctgtggtagtcatctaccgtgagacggattatataagctgttccaccttcatagcgtttcgcaagcttttcatccttcagaagactacggactgtatactgtgtctgtttgataagaaaaagtccatccctttgaatcggacaaactgtcactttcccgtcacaaggactgatcagcacttcttttcttccgtcaatcggacgttcctccactaaaatcttacgcgtaaaaaagtcattataagaagaataatgtttcttttcatagattgacagatcaatctgattctttctgacaaacgatggaatcaacagcctggacactctgctgtccagcacttttccgccaagtcgggataccccggatccaagcaatggtttcaacatcattcttgtcaatgtatgtccatagatatattccaggaatctgtcctgccctgttgttttctccatcctgtttccgtttctgtctgcataaatcataatctctcctcttacatgaatcttcgtctcaatgtccagactactgcaaccgctactactccgactaatgcagaaagtgtcttattccccggcttttttaatttgaaatccataacaaacagaagtcctacaagaagaaccatcgcatgcagtgcaattctgaaatcacagtgcaaaaatgggcgaagcacaacaagaatcggtaatgcgatcgacatggatgtgatcggcaatccctgataacactttctgttctctgttgtctcatcctgtcggcactcttctgttacattaaaccatgccagacggatcaatcctgccaacacataaaacataagaataagaacaccgacaatcccattcattcccatacaataacagatgatcgccggtccaactccaaaacagacaatgtcgcacagtgaatcaatctggattccaaaacgtttctctatttctgttctatccttctttgttcttgcaatcttcccatcaaacatatcacacagaccagacaatgcaagacacaatactgcaagatccagatgtccattcaatgacagcatcatcccaccaattgaaatccacagactgatatatgtaagtataactgtgtaatcataaacacctaacattttatttcccccttgcttttattcttatcagaataaccatccttttatttatgctttcttccttaagtttcttcctattgtaaaattcgccacgatcgtaaaaattgcactgatcaataattctgtataatatccaagtcctctgcttaagatcattcccgggatcaaaagtgcacttccaaaaactggttcaaaaatcatcgaaaacagtttttcactgattcccatcccccccggcagtggcagcatatccacagaaacggaaatcacagactgcagaagaataatcacgaatgcattcgttccggacagtccaaatgccttatatacaaaccaggttgctgtaaacagtgcgaacctctgaaataatgtgattgcaaatacattgaccagtaccattatatgatctttcagataaaccgctgttgtatgatactgatccatcgatgcattcagtttctcaattcttgtacttttatatcgcatcagatgcattttttccagcagttccatcccttttacaagaatagaacgcgcaagcaccggatgaaatacaaggagcagcatagaagccacacaaaatacatttaggcctgttccaagataaaaaatatgacggatattatacatatgtgttctgatgaatcccctgccgaagatcataagtccaagaccgatcacaacgagaaccattttataggtaatcgtgacaatcatcaatacaagcgttgataccgggattggaattttctctttcttcatataataaatctgcgccggctgtcctcctgttgcggatggtgtgatacagctgaaaaagaatcctacagaggaaaacaagaaacatttccatttctttagatgaataccaagcgtatgcatcatataaaatataataattgactctccccagataaagataatcacacaggcaacacccggaagcaaccagtatgaattcactgttttcagaatttctgcaatctcacttaaatcctccccatggaatactccatagattgttgccgcaaagacaagaaagagaaaaagtacattaaatatcattttctttttattttccattttctcctcctgctttacgaaccagatttctgtaaattttccatccgtttgtccggcagctcacaaaccaggtcagctccgctaccgcaactccaccgatcacatccacaattacatgctgttttgttacaagcgtagaaacaaagaccaacactgcgatcattacagatacgatcttataccaccccggtacttttttatctcccctgattccaatacaacagaaccagcttgccatacaatggattgatggaaataaattcaccggtttatcaatctgatataaaaaacgcatgccctgaacaaaaattccgtttcctacaagttctggtcttacatttgttgtcggataaaacacaaaaaacagaaaacaaatgattcttgcatacaaatcagccgtaaagaatctgtattttatctcttcctcccgcaatgatacaagcagataattaatcacccagaaaatgtaacatccaaaataaacaagaataaataccgggaacaatgggatctttgtatctaatgcaagtgacaggttatggtactcacttgtatctgtcaatctcggtgctccccagtagacagctgaattcaccagaaaaacaattaccggcgggagtaagatttctattattctctttctgtccaaatcccctgtcctttgtctcacttcttgttttctccattcttttcccattttatgatgtaaccagattgctccattgctatgtacttacatcattttatcccactttttcataataacaataggctttggcatttattaaagaaaaaagtgccattctttaaggaacagcacttttttctttagaatatcttcagaatttaccgcaaatgcatctcagggcttacatctcgtcttccctgtatccaaaatttttcatcatataatcgctgtctctccagttcttctgaaccttcacccacagcttcaaatttactttgcaatccagcaaacgctcgatctcaaatcttgcagtacttccgatttttttcagcatacttccctgctttccgatgatgatccctttatgggaatctctctcgcagatgattgtagcatcaatatgacacactttgtggttcatcttcatctgatcgattgctactgcgattccatgagggatctcctcattcaagctgtgcaatgctttctcgcggataatctctgccacgatctggcgctccggctggtctgtgattgtatcttcatcatagaactgcggtccgtatggaagatatttcataattacatttacaagctcatccgtattatcgcctcttcttgcagataccggaacgatttctgcaaaatcacattccttgcgatatgcatcaataaaagtaagaacctcttccttcttcaccatatcaactttattgataacaagaataaccggtgtctttaccttctttaactgctcaataatatgcttctcacctgcaccgataaatgtagatggctctacaagccaaagtacaacatccacttcattcaaagaacgttctgcaatattcaccatatactcaccaagtttattctttgctttgtgaattcccggtgtatctacgaacacaatctgaccttcctctgttgtcagaacagtctggatacggtttcttgttgtctgtggtttatttgatgtgattgcaatcttctgtccgatcagacgattcatcaaagtagattttccaacatttggtcttccgatcagtgtgacaaatcctgatttaaaattatcctgcatactttttcctttctttttccatcttaaagtgtctttatttcaaggaacatctctttctgctcctcaatcttctcttcacttccgatcacgcaaagttcatgtgcatcaagtaatgcttgaagtacatcggcaagtgcacggatgtctgactgctgtgcatcaaggatctgatttctctcttccctgatcatctcagcagatacatggttcatataaagattcattgatctgcttccctttgctgccggattcatcggacggtcgatattactgattgttccgataataaacttgttcatgtctctgtcatctacattgaagttcttcagataatccacaactccttcgtagatttccattgtcttctccagattcgggtcacggtaagataccagatatccctctccaatacgattgaagctgctcatgcatccgtaagctccgcccttcacacggacattctgccacagataatcatagctcaagatgactttcagaatctgaagtgctcctgtatactcaacaccatggtcgataaagttacctgttcttgcaacatactgaacttttgaagatgtcttgaatccctcgttgcgtttcacacaatgaatttcacacggtatctctgcttccttttcctctgtatgaagtgtgtctgcaatctttgcaaatgcttcttccatcggtgcaagaccatccgctgatgaagtataactgatgatcagattgtccttgcggaaaatctgctgtgcaatctgtcttaagttttcaatcagttctgctttcttctcctcaaagttttcctccagttcctttacaacctcatagtaaccgattccatctgtatcatctttgaacttcgccatcggtgaagtataagacagggaacgaagggctgctgttgtgtgcccggatgacaggaaggacatctgcagtctggatttcaacattgctaagatttctttcagacgcttctcatccccaagatcagattccatcagaatctcacgcatcatagaaaacagaacatccatcttcggatacagcgctttacctttgatttcaaatgtcgcacggaattctttctcctttacctttgttacgtctgtgtaaagctccagagaagttccgattcctcctgtgtgtacattgatctcattaaacagttcactgtattcataattctttgtattaataattccaagcacactctgcagaatgctgatatatggaagtttctcttccggaataccggacaggtcaaacaaaagcgctgtgtatccaattccattcgtctcaacttcatggtgtaccagcttcactccgcttgtctcaagctctttattataaatcggtgcgatttctctggaaatatcttcgcgtccgagtacaggaatcttcgccaaatcttccggtgccgactcttcttcctgatattcttccaactctttcgttgctctcacaagtgcatcgatttcttcttttgacaaactgtctttgtatgcttgaagcttatctgcaagttccttatccattcttgcagtacgtccacgctccggcttaatgatcacgatagaaccatgtgtattatccaggagatatttctggatcagttcttcaaagtatcctgtctccacctgttcttttaagaattcaaatgtcggaattgcctgcatgtggataaatggtttcgtctcatcatacagccagctgtcaaacaactgcagtccatacatcaatccacgcggataatttccgaaatcagcctcgcggaaacggaattcatgatagttgattcctgcgcgaagtgctttcttattgattccatttttcacaatatctttcaatgtatcttcaattacacgaacgaattcttccttctgctctacattcgcattcttagaaatcacagagaagatcggctgataaactccgttgtcataagatcctgagatatccttgccgaccccggcatccagaagcgctttcttcagcggtgcgcccggtgcggacagaagtgcgtaatccagaatctcaaatgccagatatagtttctcatccagtgtagtaccgatcactttattataagaaagataggtattatcctcctcactctcttcacttgcgatggaatactcctgaacgacttccttcatctctgtaaatggcttctgcagatgaatctctgaatccaccggttcattctcaaaatctgacaaatacttctcgtcaagccatcttaatttctcttccatattcatatcaccatacagataaatatagctgttagatggatggtaatactttctatggaaatctaaaaattgctcataagtaagttccggaattacctccgggtctccaccggactctacggaatacgtattatccgggaacagagagttcagaaccacgcggtcaagtacgccttccggagaagagaatgctcctttcatctcgttgtatacaacaccactgattgtcaactctccatctggatcatccagcttatagctccaaccttcctggcggaatgtcttgtcattctgataaatatttggataaaatactgcatccatataaacgtgcatcaggttctggaaatccttgtcattgcagcttgccaccggatatactgtcttgtccggataagtcatcgcattcaaaaatgtattcagagaacctttcacaagctcaacaaacggatccttcaccgggaattctttcgatccgcacagaacagaatgttccataatgtgtggaactcctgtactgtctgacggtggtgtacggaatccaattgtaaacaccttgttctcatcatcattttccataagaagcactcgtgctccgcttttcttatgcttcagaagtgtcccctttgacttcagatcagataaatcttctgtctggagtacttcatacgcattcagatcatatatactcattcttcttctccttggtttttgttcttataaatatcaaatttgttcaaagattgactattctttagtatatccgatttcactggtaaatacaaggaaagccagtggaaagaaaactttttcaggaaagaaaacctttccgtttttatcttataggttttatctataagttctttcttcatatatgcattatctattggaaaacttcgttcaaaaacgataaaatttatctataaagactttggttatgagtagattgttcctaccgtttatttttcagaaagtatacgtttaacaaaacaatctctctacaacagccatccacaaaaccaacaataaggagaacgattatggaaattattaaagatttaccggaagtattcgaagaattcgcagaacagcgtcagaaatcatttctcgctgtaaaacagttgaaagacaaaggaatccctgtgattggatcctactgtacttattttccaaaagagattgccatggcaatgggcgcagcaacagtcagcctctgctctacatctgatgagacgatcccagcagcagaaaaagatcttccacgtaacttatgcccactgatcaaatcaagttatggatttgcaaagacagacaaatgtcctttcttctacttctcagacgttgttgtcggagagacaacctgtgacggaaagaagaaaatgtatgaatatatgggtgaattcaaagatgtcttcatcatggaactgccacagtcccagcgggctgaagttcttgatctctggaaagctgagattctccgcttcaaagaatatcttgaagaaaaattcgaggtaacgatcactgaagagcaggttcgtgaagcagttaagcttgaaaataaagtccgcacatccttgaagaatctttacggagttatgagacatgatcctgctccgatcaaagggcatgaccttttccgcgttctgtatggaagtggattcaagctcgaccgtacactgattgccgacgaagttgacgcactgacagccaagattgagaaagaatatgcagaaggaaaacgtgaggataagaaaccgagaatcctgatcaccggatgtccgatcggcggtgcaacagagaaggtcatcgacgcagtcgaaaataacggtggaatcgttgttacatttgaaaactgctccggtgcaaaatccatcgatcgtctcatcgacgaagatgctgaagacatttaccaggcaatcgcagagcgttatctctcaatcggatgttctgttatgactccaaacccgaaccgtctggaacttctcggaagactgatcgacgagtacaaagtagacggagtccttgagatgactcttcaggcatgccacacatataacgtagagactctttccatccgccgctttgtaaacgaggaaaaaggaattccatacatgaatgttgagacagattattcccagactgatgtcggacagctgaatacacgtattgcagcctttatcgaaatgttataatctggtaactgttcagagccaagcaaaatttcaaaaaacagctataaaatgcttgcatttttaagaatgtttttgaaattttatttggcggatacgccacaccgacgaaatgcgtagcattttacgccacaccgacgaaatgcgtagcattttggaggttggctctgaacagttactctatttgagagataaatacgcaataatgcttattgataataatatcgtaacacgaagtgtaaataaaatctataaacaaaatgcatggatcgtgatagaattaccaatttgtcatttatttaacaaacagatataataaaaatagaaaaaaacaacaagattgaacagaaaaatccaatggattatattcaatttttacaatggaggaagaattatgtcaaagaaaaacccaatcacagtaagttcatggacacttggagatcagtgcaaatttgaagatcgtgtaatcgctgcaaaggaagcaggatatgaaggaatcggtcttcgcgcagagacttatgttgatgcattgaatgaaggacttcataatgaagacattcttgcaattcttgacaaacatgatatgaaagtaacagaggtagagtacattgttcagtggtgtgaggaacatcgttcttatgagcagaaatacaaagagcagatgtgtttccatatgtgcgaactctttggagtaggccacatcaactgtggactgatggaaaattattctgttgagtacacagcacagaaattaaaagaactttgccagagagcaggaaaatacatcattggtgttgagccgatgccatacagcggaattccggatcttaagaaaggctgggaagttgtaaaagcttctggatgcgacaacgcaatgctcattcttgatacatggcactgggtaagagcagatcagccatacgatatccttacaccggagattgccaagaaagttatttctatccagattaatgatgcttatgaaagaccatatgcagcacctattttaagagatgagtctatgcatgatcgtcttgcaccgggaacaggagcaaaagatacagcaggatttgttaagatgattaaagacgcaggagttgatccgaaggttgttggtgtagaagttatttctgatgcaatccttggaaaaggactgaaagaagcagctgcttatacatatgaaaacacagagaaagtattaaaagaagtttggccagagttggtagactaatttgaaaaacagatgatgccaaagagagaggtaaaatgatgaaattcaaaaatatgttttctccgattcagattggacctatgactgttaaaaatcgttttgtggttccaccgatgggaaataatttcgcaaattcagacggaacatggagtgacgaatctgtggcttactatggtgagcgtgcaaaaggtcagtttggtctgatcacaattgaagcgactgtagtacataaaggagcgaagggcggtcctaagaaaccatgtctttatgatgacaacagcattgaaagtctgaagaaaattacagatgcctgccatgaagaaggtgcaaaggtatctatccagcttcagaatgcaggaccggaaggaaatgcaaagaatgcaggagcaccgatccaggctgctacagcaatcgcatcagcagatggaagagacattcctgaagaagtatctacagaaaaagtgtatgagcttgtaaaaggatatggtgaagcagcagaacgtgcaatgaaaggtggagcagatgcagtagagatccacatggcacacggctatcttgtaaattcatttatgtcaccaagaacaaataagcgtgtcgatgaatttggtggaaactttgagaacagaatgagattttcacgtctcattattgaagaagtaaagaagaaaacagaaggaaagattgctgttcttgcacgtattaacagtacagaagacatgtttggaggacttgataatcatgatatgtgtgcagttgcttcttatttagaagattgcggaattgatggtcttcacgtatcccgtgcagtacatttaaaagatgagtatatgtgggctccgacaggaattcacggcggattctcagcagagcttgttgtaaatatcaagaaatgtgtttctattccggttattacagtcggaagatatacagaaccacagtttgcagaacagatcattaaaatgggaaatgcagatttagtagcatttggacgtcagtcacttgcagatccgcacacaccacagaaagcaatggaagaaagactggaagatcttacaccatgtatcgcctgtcttcagggctgtgttgccaatatgtatgcaggtaaaccaatctgttgtcttgtaaatccagtacttggacatgaaaaagaaggacttccgaaggctgagaaggcgaaaaaagtttacgtgatcggtggtggtgtggcaggtatgtgtgctgcatttacagcgaagagacgcggacatgatgtaacattatttgaagctacagataagcttggcggtaatatgagactggctgcatatccaccaggaaaaggtgatatcacaggcatgatcagaagttacattgtaaaatgtgaaaaagccggagttaatatcaagatgaatacaaaagtaactgcacagatgttgaaagaagatacaccggatgcagtgatccttgcaacaggagctgagactttagtacttccatttatcaaaggtattgaaaatccggatatcgtctatggtgttgactgcctggaaggaacacgcccggtaggacataaagtcttagttgttggtggcggtatggtaggtgcagagacagcagacttcttagcagaacagggacatgaagtagccattatcgaaatgagagacgcgatcggaccggatgtgatccatgagcacagaatttttcttatggaagcatttgaaaaatatggcatcaaacagattacaaatgcagctgtatcagagatcttctcagatggcgtaagttacaaaaatgtagcagataaatcagacgagacgatctacgaggcaagaggattcgacacagttgttctctctatgggattcagctcacgttatacacaccgtgatggacagaacgtagtttatgactttgcagaagaattaaaagacatcgtaccagaagtccacatggtaggtgacgcagtaagagcacgccgtgcactggatgccacaaaagaagcatatgaggttgcattgaatttataaatgaaattatatcaggaggattagaatcatggaaaaaagaatttctggacacacaggcttaatgggattatttggatcaccggttggacattcaggatcaccggcaatgtacaacttcagtttccagcatgacggattagattatgcatatctagcatttgatgtaacagaggaagaaatgccaaaagcatttgaggcaattcgtttattcaacatgcgcgctggtaactttacaatgccatgtaaaaatattgcagcaaagttagttgacaaactttctccggcagcagagatcatcggagcatgtaacgcatttgtaaatgataacggtgtgatcacaggatacattacagatggtgttggatttgttaaaaatcttgagatcaacggtgtatctgtaaaagataaaaagattgttgtccttggtgccggtggagccgctacagctattcaggttcagttagcattggacggagcaaaagaagttaacattttcaatataaaagataaattctacgaaagagcagaaggaacaaaggctaaattagcagagaagtgtccggactgtgttgttactgtagaggatcttgctgataaggctaaactggaagaagaaattaaaacttgtgatattcttatcaatacaacgattatgggaatgaaaccacacgaggatgtaactctggttgacaaatctttattccgtaaggatcttgttgttgcagatactgtatacaatccagagaagacaaagatgatccttgaagcagaagaagcaggatgcaaagcaatcggtggcgcaggaatgcttctgcagcagggggcagttaactacgaactgtttgttggaaaagagatgccacttgctgagtatcaggaatttcagaaggctcaggcaaaataattacattcacaaaaggagaatgatggaatgagagcaaagaaatatttgtggtctatcctttgtgtatatttttgctatttaacacatggtatccaggctatcattttaagtcagaacaacgtaaactttgcaaaacagtggggattcaatatggcagacccacagtcagcagcatatgcagcaggtcttgcagcggtaagtacagcagttgcatggacaggctttggtaaattcgtcagcgtctggattggtggagagatttcggatcatgtaggacgtaaaaaattaatgatcggtggagcagcattatatattctatgcttccttggattcttatttacaaaaagtgcattagttgcttctgtatgtggatttgtttcaggagttgcaacatccggtttctgggatgcatcaggatatccggctgtacaggaagcttatccggcagcacctggatctgcactgatcggaatcaaattttttgtttctgtttccggtatgatttatccattcatggttgttcataatgcaaacagcggaaactggaaattaaatgttattatcccgcttgtaatgtcagttgtttgtctggtacttgcaattattgcaccgtttgcttatgatgatcagaagaaagcgtcagaaggaaagaaagacaaatccgataatgcagtgcaggcagcaatgcttgtaaagccaaataaatttatcgtatttcttgtaatgttttatgcgttcctttgcatggcgatcatgtatggcgcacagcagtatacaaaagcatttggactttccgtatgtggactttccgagattcaggcagcaggtatgacttctatttatacaatcgggtctatctgtgcagtacttttctgggcgttcatgatggcaaaattaaaatggaacccgttaaaggttgtccttattgattctatctgtacagcagtggcacttacgggtgtactgtttatccatcaggtagcaatcatttacatcgcgatcgcaatgttgggattcttcgcagcaggaggtgctcttcagacaggtcttgcagttgttcagttatttaacccaggaccgaagggaagaaatactggtatttattacacatttatgggtgcggcaagctacctgatcccagtagtggcagcacagcttacaaaatcatctggtgaggcaagtgcagtatacagcctcatgattatgctgttagtatttgcaatccttgctattttaagttctctctacttagtagcacagcacaaaaaaatcttcggaaaaagtgcattataggaagtaacatagtaacaatctcaattcatacgaaaaaaatggactgttgttccaaaagatgttatcatcaaaaagaatgcagtcctttttttgagattaaattgttaaaaaatagacacttgtaaatcgaaaaatgaaggagaagcttaaaagatgagtccgaaaagaacaagaaaagtcaacgaacttccctatattccactcggcccatttcagtggcgtattccgggaattcattacaaattagaatatgtagaattttttcaaggtctgatccttggcgctactgcgttaagttcgattccgtatctgacggataatcttggacttccgtatgaacttgcatggagctgcgtcatcattgaagtatttatgtacatgcttcatggatggttaggagatccggttgtcccgggatggatcacaccgacattaccatttacactggcatatttaaatggattcccaaaaggaccggagcgtattcaggcaatgattgcattgcagctgcttgttgcatttgtatttatatttatgggaattaccaagcttgcagataaattcgtgaatggtgtgccgaattcaatcaaaggcggtattctgattgcagcaccgattacagtattgcaaggacagctctcagatggaagccagctgatgactgcgccaatcgcaacactttccggtacattgttacttgcgtttttgagtttttcaccgttttgtgaaaagaacagagaaaaatacaaaatattggatatcatggcaaaatatggaaacttattcccatatctgattgctatgttagcaggagtattgcttggagaattgtcaaaaccggttctcgaacttggaacactcatccgaattcctgactttagtaatgttttccacacagtcagtatttttgcagtcggatttccaccgatttcaaaatttataagtgcaattccgttggcgttgatctgttatgtacttgcgtttggagattttgttacatcacagacgttggtagaggaagcacaggacagcagaagtgacgaatatattgactttaattcaagcagatcaaacctgatcagtggtcttagaaacctgatccttgcaatttttgcaccgttcccaccactggcaggtccgctttggatcggtatgacagtatctgttgcaatgcgttataaagaaggaaagaaagcgatgaaatcgctgatcggtggaatgagttctttccgtatggcaacattcatcagtgttattttagtgccgatcgtgtcattcatgaaaccaatcatgggcgtgggttctgcaatcactttgttattccaggcatatgtatgtgcaagaatcggtatggactattgtaagacgagtacagataaaagtattgccggagtaatggcagcagtgcttgcattcaaaggttccggatgggctttgcttgtaggttttgcaatgaacatcttactgtctaatatggaatttcagaagaagaaattagagatttcagagacagaacaaaattaataaaagaattcaacaggagcagttagtctggaaaatagactagctgctttttgtgtaaaaagcagctaatctaatttttatattgtgaaaaatcaagccagtcccagttgatccaattttattttacaaaattaaatctgcaaatcctgtagatacaaggaataagatgagcattacaacaggaactacataacggatcataaagcgatacatgccggcacgtttaaaatgttctccgttcctttctacttctcctatgatccagtcaggtccgattacccagccaatcagaatactggtcagaagtgagatgaatggcataaggaagctgttgctgatatagtccataacatccagcagctgtccaacagatccatttggaagtttcagttcgaaataaagtttattatatccaagacagatcaatattgcagtaataagggaataaatcccaactgcaccacacatttttttacgtggcttatgatataattccatacagtttgcaaccagagtttccataacggaaacgcaggaggtaagtgccgcaaatcccatcatcaggaagaaggcaattgctgccggacgtccaaagattcccatggcgtcaaaaacttttggcagtgagatgaagatcaggcttggacctgaagccattccatcatttccaagaaatacaaagacagcagggatgatcatcattccggcaaggaatgcaactcccgtgtcaaagagttcaatctgattcgttgctttattcaagtcaacatcatttttaacataagaaccgtaagtgatcataattcccatagatacgcttaaggaaaagaataactgactcattgcatccagaagaatttccagaaaacgttttacggttaatccgtgaaagtctggttttaaataaacagacagaccttgcatacctgtacgaacagtaccatctgccgctgtgtgagacagtgtcagacagaaaatggaaatgatcacgattaaaagaatcaatccaggcataatgatcttggaaaatttttcaattcccttttctacaccgcgaaatacgatccaggcagtcagcgcaaggaaaatcagcataaatacaattggtgcaatatcagatgtgataaaagatgtaaaatatccatctgctgctgcttcagttccgtcagaaacaagatagacgaaaaggtattttgaaatccatccgccgatgacagaataataagtcatgatcaataccggaacgaggaaagttaaacgtcccagaaatttccattttggattaagctcttcaaaagctctcagtgcatttttctttgtttttcgtccgatcgcaacatctgttgtcagtaatacaaacccaaaagttaataccagtaccaggtataccagaaggaacagaccgcctccgtcctttgcacataagtacggaaacctccagatatttccaacacctacggcgcttccggctgcggctaagacaaagcctattgaaccggaaaagctgcttcctttttctttcatttcaaattcccctctcaataaagttaataaaaggctgtagaagttcagcccaatagctatattttatacgaaataaatataaaatcaagtgaaagaagtttcctttaaagaaactttatggaagaaaagtttcgtaaaactttacaaatcaactgcttttcagatataattataaaagaaagaaattaatgaaaagaatggatagtatgaggaaacaaaatgagtgattttacttgttatgtaggggaacaaatacgacaataccggaaagccgggaagatgacaatgcaggaactggcagatgccatccacaagagcagagctacgatatgtaaatatgaaagtggagaaatttcggttgatattgaaacattatatgagatcagccaggtgcttcaggtgtcgatctctcagcttaccacataccttccggaatcggtcaatgaaccggtcagttttccgggatgggggaaaaagagcccgttctttcaggcgaggagattatatttttatttttatgacggacgctatcagagaacaaaagatggtgttatcgatatttatgaaaagaagggagaacctggaaagtacgaggcaactctgacaatctgttctgtttctgcaaatggaagaagcagtgagattttttatatcggaagagtactttacagcgatatgttgattcgtttttcttttgtaaatcaatataatccgttggaagaggatcttctttatatttttaatcctctggaactcagagattttacaatggggcttttatgtggaatttcaagcgcagatcttatgccttgtgcttttaaatgtgtaatcacgttaaaaccacaggaacacacggaaagtttccgtcaccagttgctttttactaaaaaagatctgaagcgtctggagcagcttaacatgttgctggtagataatatgaagaaataagggagacatcagtgaaacgaaacaaaagacaattgtatgtaatgatttttgtttttgcaatgattgcgctggcctatacttgccgtatgctggatatgtatgatataggcaacggttatccgggggatgtccgcgcggcgctatatatagttttacttgctttgtggggatattctattgaccggaggatcattcagaagccggtactgcactgtctgcgcctgacagatgcactgatgttgctttggcttattcttcggacacttaagtatgaagtgatcacggatctgacagtggcgaggtatctatggtatttgtattacttgccaatgctgtttatcccgttgctgggggtatatattgcaatgtctttgggaaagtcagaggaatatcgtctgagtggaaagacacaactgttgacaattattcctgcactacttttcttatgtgttattaccaatgatcttcatcaaaaagtatttacatttaaaagcggaattccgggaaatccaggtaatggaccatattatcacaatgtggtgtattttttctgccttgcctggatggtgggctgcatgatatttacagttgttcatatatttaagaatagtcgtgtttcaaatgtaggaaaaagacgggtgatgccatttgtattttgttgtgtgacaattctgtatggagtgctttatctgatcggaatcccacaggtacgttatgtgtttggggatatgaatgtgatgaactgtctgatgtatatggccatttacgaaagctgcattcactgcaagatgatacagtcgaattctggttatattgaactgtttgaggcaacaacgctggcaggctgcattgcagatgaaaatgggcagattgttcttcgctcccatgcggcaggagaagatatgatctgtcccagggagggacagaaaatacttacgcctgatggaatgcgcatctcatcggcaccgatcagaggaggctttgttgtctggagtgataatgtacgtccattgatggatcttcgaacccggctgaatgaaaataaattggagatggagaagaataaaaagaaactccaggatgcctatcttgtacagaagaggctgtatgagctgacggaaaagaatcatatttacgatgaactggaagtgaagtttaaaaaacagacagatcagatacgtcagctgctcgaacaatgtaagaacgctgatccatgtgagacacggaaattcttgaaagagatattgctgatcggtacatacattaagcgcagtgcaaacctgtattttttaagcgaagaatatgaaatactgccacagcaggaattacgactgacagttgatgaagcagtacgggcaatgaccgcctgtggtacagaatgtggagtgctctatcgtacgacaagaccgatgcgttcagcagatgttgtgcgcttgtttgaattgctgcatgttgtggcagagaagacactgggagaattacagtcattgtttatctctgtgtctgatgatgaaatgaatttatctgtggaatgtagtatagatctgtcagtgatagcttcacaggaagtgacagtctgtcaggatgatggattgtggctggtccgtacacagataggaggacaggacaatgcatagattgaaacatttcgggttcaatgtaatcaaggaaagctttgatcagcttccttccggagtctgcttttttaattacaagggagacattgtactttgcaaccgacagatgtatcgtttgagccagtatttatttgacagtgatatgcaacatctcagagaagttgagcaggcacttcgctttccaccggagggagttgtactgcttccggggctggagggtacttatcggtttccagataaaagtgtctggagatttgaaaagacagaagttacagatcgttatggagagacttatacacagcttacagccgctgatattacagaaatgcatcgagtattggtacagattgctgctgataatcaaaaacttaacgaggatgaaaaaaagctgttggagctttctgaaaatgttaaggcaattgtcagagaaaaggagcagcttgcggcgaagtctgccatgcatgatggtcttgctgcaagtcttaccgtaacgaagcagtatcttgcaggaaatcttggagagattgatatagcagttgtacttcatgaatgggagaaaagcattgctttccgtgatgccgttcttttatccgaaaaagagaagttattcgataatgccagcagcagcggagtttccattcagataaagggggaagaaccaacagggagtgtggcagaattaatgtatgtggcgatgcaggtttgtctgaacaacgcaatccaatatgcgaaggcaacagaattgacggcaagtattcaggaaaatgaagataaatattcagtggtgatccgtaataatggaaagcctccggagaaggtgatcacagaggggggaggtcttacaaatctgcgtcgccgaattgaaaagtcaggtggtataatgacggtatatagtctgccggagttttctttggtgatggatctgccaaagacagataatgcagaggaagggggaagggatagcagtgaaaaaaatattaattgttgaggatcaggcgcttgcgcgcatgtatctttgcacatgcgttgaaaaatgtatagattgcgaagtggcaggtacgttgacccgggctgatgctgcactcagccggtgtggagaaggacatatagacctgattctgatggatatttgtaccgagagtgattctgacggtctgacagcggctgaatcggtcaaaaaattctatccccggattaagattgtgatggtcacttcaatgcttgaaggacgtttcctggatcgtgcaagaaagattggtgcagatagtttctggtataaggattccccatccggagatctcattgatgtgatcgaaggaaccctttcaggaaaacatttctggccggacagtgtaccggcagtacaactcggaaaggcactctcctgtgatctgtcagaccaggagcttgagactttgcgtctgctatgcgaagggaagacaaacagtgagatcgcagcaaaacttcatgtggcagaatcttccgttagaacttatatcaaccgcatgttagagaagacgggatattcaaatcgtaatcgtctgatggtagcagcagtcggtaagcgtctggttgtaccgggaaatcaacttgatgactgaaagaaaaaaatctatttgtcctcactttcgaggacagacggattttttcttttttgttataataaaagaaaagaacacatcggatatgtcgcaaaaggaaagggggatggtttgatgcggaaaattgtggtcgatatgcagaattttctgtttgctgattccatagcgaccgcattcagaaattcagattatgagatcgatgtgattcgtacggagtctccgaaggatacggttgaattgtgtcaggtgtacaaaccatttgttcttataatggaagtgacaggttataccccatggaatctctgtgagagattgaagcttcgtgatgaagtaaagaaaatgtgtccccactgtaaaattgctctcattgtagattccaatacggaacgacaggcagcgatagatattcgggatgcaaagaagaatggttttattgatcagtttttctacggatctatgacagctgaatatctgatggatcagatttatgcgatgtaaaaaggcagcaggaaacaaaccgtgatttgtctgtagaattttaaaatgtagacagatcataagttgaaaaaggaggagtcaatatgggacttattaaagcaggtatgggtgcaattggtggaacattagcggatcaatggaaggagtttttctattgcgaatctatgccgaaagaagtgcttgttacaaagggacagaagagaacgacaggtcgttcttctaatacaaaaggaaatgacaatatcatttctaacggttccggtattgccgtggctgatggacagtgtatgatcattgtagaacaggggaaggttgtagaagtttgtgcagagcctggtgaatttacatatgatacctcaacagaaccatctattttttcgggcaatctcggtgagagcattaaagagacatttaaaaccgtaggcaagcgttttacttatggtggagatacaggtaaggatcagagaatttattactttaatacaaaggaaattctggaaaaccgtttcggtacagcgaatccggttccgttccgtgtagtagactccaagatcggattggatattgacgtatcaatccgttgttcaggtgtatattcttataagattgttgatccactgttgttctactcaaatgtatgtggaaatgtagaacaggagtattcccgtgaagaacttgacagtactcttaagacagaatttatctcagccctgcagccggcatttggtcgtctgtcagagatggaacttcgtccaaaccaaattgtaacacacaacacagatcttgaaaatgccatgaatactgcactttcagagaagtggggtgctcttcgtggactgaaggttgtcagtattgctcttggatcagttactcttccggacgaggatgcagaactgatcaaacaggcacagcgtacagctatcatgcgtgatcctacaatggcagcagctacacttgtcggtgctcaggcagatgcgatgaagaccgcagcaggcaacgaggcaggagctatgacaggattcatgggcatgggtatggcaatgaacgctgcaggtggtggaatgaatgcacagaatcttttcgctatgggacagcaacagcaggctcagcaggcagcacagcagcaggcagctccgacaccacagccggcaccggtaccgcaggcagctccggcagcaggcggatggaaatgtgcatgtggtactacagtaacaggtaatttctgtccgaactgtggagcaaagaaaccggaaccgaaaccagaaccgggcgcatggaaatgctcttgtggagctacggtgacaggcaacttctgtccggaatgcggttctaagagaccggcagaggacgaaggctggacgtgttcctgtggcgcagtaaacaaaggcaaattctgtacgaactgtggagcaaagaagccggcaggcgcaccgctttaccgttgtgataagtgcggatgggaaccggaagatccgaagaatccgccaagattctgtccggagtgtggagatatctttgacgagaacgacagacagtaacggatgaccatcggttggaaaataactgccggaagcccggcacggaagaaaggagaatgagttatggcagacttgcaggaatataaatgtccttgctgtggcggtgcaatcgcctttgacagtaagattcagaagatgaagtgtccgtactgtgatactgagttcgagatggatgcactcaaaggttatgatgcagagctgcagaatgaacagacagatgatatggagtgggatacttccgcaggcagtgaatggcaggaaggtgaaacagatggtttacgcacatatgtgtgtaaatcctgtggaggcgagattgttggagacgccaacatggcagcaacatcctgtccattctgtgataatccaattgtaatgatgggacaatttgcgggagcgttaaaaccggatctggtgatcccgttcaaattagataaaaaggcagcaaaagaaggattgaagaaacatctgaccggaaaacgtcttctgccaaagatcttcaaggatcagaatcatattgatgagatcaaaggtatttacgttccattctggctttttgatacaaatgtagatgccacagtcagctatcgggcaacaaaggtacgcatgtggagtgacagtgattatgattatactgagacaagtcattttatggttcaccggggtggaagtattggttttgaaaatgttccggtagatggatccacaaagatggcaaatgatctgatggaatctatcgagccattcaatatttcaggtgcggtggatttccagactgcttatcttgcaggatatctggcagataagtatgatgtaactgccgaacaaagtattgaacgtgccaataaacgtgtaaaacattctacagaggaagcttttgctgagacagtaaaaggttatgctacagtaacaacagacaatagcagtgtacaattccatggcggaaaggcaaagtatgcactgtatccggtatggcttctgaatacgacatggaacggaaataaatacacctttgcaatgaatggacagacaggaaagtttgtcggtgatctgccggtagataaaggtgcagcagcacgctggacagtgatgctggcagctgtattctcagttgtaacgtatggtgctgcatggtttttgcacctgatcggactgttttagggaggtggggaaatgaagaaaagaattttatcgtttatgacgatcctcatcctctgtctaggtcttgcagttccggcttttgcggaggaaacagaaggattcgcgaatgaatatcctcgtgtcatcgacaatgcggagcttctgtctgcagatgagagggagctgttaaccagtaagttagatgagatcagtacgcgacagaaggtagatgtgacggttgccacaaccgatacactggatggactgacggtatctgattatgcggaacgattctacgagtctcataattatggttatggaccggacaaggatggaacaatacttctgatcagcatggaagatcatgattggtatatggcaacctacggatatgctattacagcatttacggatgcaggtatccagtacataggagaagagatgacgagtgatttgtctgatggtgattttgcggcagcatttgatacatttgctgatgagtgtgatgattttattacgcaggcaaaaaccggagaaccttatgatatcgataatgaaccacaaaaaccaatgtcatggttctggattccgatttcattagtagctggtatcgtcctttcattgattgttgttggcactatgaaatcaaagctgaaaacagtacgtttccaggcagcagctaataattatgtgaaagctggaagtatgaatcttactgagagcagagacatattcctgtataatacaatgacaaaaacgaaaaaagagaaaaatgattcttccagtggtggcggcggaagcagtacgcatacaacatcttccggaagcactgccggaggcggtggcggaaaattctaggagagatgttcgtatacggaataccgggcaatttaatagtgaaaaaagagaagctatttcccaaatgcttgggaattggcttctctttttaaatagtgtaattatctgtccacatccacaaaatgtttcctgaactcatcataaggacacgaccgtccccagtagaatccctgacagtaatccggtttcagaagtttcatcttctgtaattcgtcttccgtctcaataccttcaatacaaagtttcaaaccgagattatgaatcatgttactaaactgatttaacagataatattcatttttgtccgtgattgccttggaagtaaaaccacgatcaatcttaacaatatcagggtgaagttcactcagataatgaaagttggaataaccggttccaaagtcatccaatgctaattgcatgccggcctgttttaattctttcaggaagttttgtgccttttcatttttttcgagcagaatactttctgtcagttcaatagcaattgcagtgagcggaagaccagaagtgttcatttcgctgataaggtctgtaataacatctgattttgtaatctgcacctgggatacattaatattaactctgaaatcaggaatctgcatccggattttccggcaggcagttattgcttctcttatgaaccaacgtccggttggaataatcagtccgcttgtctctaaaagaggtataaactcagcaggcgagatctgtccaaattttttagaagcaaagcgtatcagcacctctgctccggtcagtttgtcctggcggatatccatgattggctggaagaatattgagaatccacggaaatcatgatttactgctgaatgaagctcatttgtgatctcacggatacgtaagaaattctggtactcttcttcctggaatatataacagcagtttcttccatgctgcttagccacggtcagtgaaaagtcagttcgctttataatctcttcataaccggtccgtgatagatccggaagcggcaggataccggcagaaatagtaaatactgcagcaaagttgttttcttcaataaactgattaatatgtttgcatatgtggtcataaaggttggatgctgttgtcatatcagaggatgttgtatctaatataataaattcatctgatgctatcttgtagaccttttggctatccgagatacaggataagatgcaggacgctgtttctcgaagaatgtagtctccgtaatcccatccatagttttcattgatcattttaaaaccgtcaattccgacatgaatcaagaagcctttattaagcgtagaaaccgaatttttgaaatatttttccaaagaagtctctccgagaagtccggtaatattatctgctttctgtcggttaccaatttcattgatacatccgatcaggtaaatcggctcttgctgatcgtcacgtatgatatagccacggcagttgatccagactggttccctgttaagatccagccagcggtactccatattatgtatgttccggtctgtgttgagcagattatctagttcagctttcagaagcggataatcttttttgtatacgaattctttaagttcttttgtcatattatggaattcatttccaggcagacaaaaacgatccagagcctgtggagcaatatagaaaaagtcggttctgaaatccagcatatacaggaaaccatctgtgcttgggctgagcagatcgatgatattacataattctttaagcgaaaaatcctgataaatttttgtgtggctgaagatttctttctgctgcttttcctcggaagatgttcctgcattaataagtgtgttgctgatcagaagttctgagctgcctgcatatgcaagtttccgttttcgttttatgcggtacagcatgagatcacttcgttttgcaaggtctttaaaagtgctgtccatttccggaagaaaacaggcatatccggaggaaatacttaatggatagttaaaggtatgctctgttgattctaaagtttgatttaattgagcaattttgtctccaatattattttccttattcttattgtagaaatatgcaaattcatctccaccaatgcggaaaagattttctttatcaggaaagaattgtttaatgcactgagaacatagctgcagagcttcatcgcctttctcatgtccaaaccggtcattaattattttcagattatccaggtcaaaaagaataagaccggtagtatgaagtttgtctttctgcacgttaagacgattcactttcttttcataggcatttcgattcatggtatctgtaagcagatccgtgtccgcaagtttctgtaggtaaatcagcttttgtttctggagatagtgatcataaaaacgtgatacctgaatccagaccagcaaaaggataaacagcatcgttccaaatgggaggaagatggatgtttgctggaaatgctggatatagtaagcaataagttctgcaacaccaaatgccatgaccagatatattggatatttaaaatgtctggtagcttcattttgtagttttatagattcataacgaatcaatgttacggtataaattacatttaccagcatgatcagatgagttaccggaagaatgcggaagatatcgatgactcctgtacattgaagcaatactgccgctgccatattgcacagatagagaatggacaggtgtacagctcctttacgatatttgcttttacagatatcatacagaataaagttaaaaggtactggaaacaggaaaaaagtaaagtagtctataaaataaagtgctcttggatctggaattaaaaactgcagaaaaccacattgctttagagtccaaagtgtgatcaaaagagaaaaaacaccaaggttcaggaaaatcatgtaggattcatctgacgaatattcatcatttttcctcattatagaaaagcataaaatcaggcagatgattcctaacgataagatttcgcagcttagaaccaatgaacagagactgttgctcaggatcttcagggtacagtctccttttgtccctccaaaaagatggaaagaatttccgtagtagtctgaatatacaggaataatcctgacctgcaagtgttttccatcactgttttttggaagatcgacaatatgccagcaagggccgggagacttcatgaatcttaatgtgtcagtatcatttccaaattcatagattttctctccatcaagcaatacctcagcccgggtatgggttgtcttgaacaaaatggattgttgattctgaaaagaatccggaagaatgacatcttcaattcgaatattatcttcggatcgttcggttgtcacaagctgggttgtattgtcaaaaactaaatattcacgggtcgtattttgatgaaagatccaacctgaaaagacagtgccaaacaggatgaacaggattaaagagatccataattttttcttaaatttcataactttttccttttatagaatatcacttccatccgggatcttggaaataatcgttcgattagtcctgaacagaaagataagtgagacaatcattgacatgatctcagcagtcaggaaagcccaccatactgcatgaagcccaccaaattttgccagtacatatgcagccggaatcagtactacaagctgacgcatgatggatacgatcatactgaacacggcctttccaagcgcctggaatacagtaccgcagatgatgccgaaccatgcaagtaagtaatggataccgatgatacgaagcgcagggactccaatcgtaagcatatcagcagatgcgttgaacattccgagaagtacctgtggaactaattcaaagcaaaggaatccgaagagcataatgcaaaatgctgttgccatactgagtttgatcgtcttgaccatacgttttctgttctgcgcaccgtagttgaatgcaatgatcggagtgataccgttattcaaaccgaagacaggcatgaagaaaaagctctgcagtttgaaatacactccgaatacggcggttgcagtagatgaaaatgtgatcaggatacggttcatggagtatgtcataacagaaccaatcgactgcatgataatagatggaataccgattgcataaattgttctgataattcttccgtccggccggaaaccacggaactgaagccttacatccgggttgaatttatgattacatgtaaatgaaacaagtgctccgacacactgtccgatgaccgtagccacggcagcacctgtaacccccatcttcgggaaaccaatcagaccaaagatcaggatcgggtcaagaatgatattcgtaaccgcaccgcataactgagaagtcatactgaaaatggttcttcctgtggaagtgagcagtcgttcaaagcaaatctgtgccagcagtcccatagagaagatcataacagtgctcagataatcgattcccatttccatgatctcaacatctgcatttccaatctggcttgcatagaaaggttttacaactgtaaagccaaggataagaaatacaatataacttatgatataaagaaatgttccgttagacgcaatcttatttgcttcgtcagttttttttgctccgagtgctctggaaagaagtgcattcataccaacgccggtaccggttgcaactacaatgagcagcatctgtaacgggaaggcaagagaaactgcggtaagagcattttctgacagttttgctacaaagatactgtctacaatattataaagtgcctgcactagcatggaaaccatcatcggtaaggacatgttgaacaagagtctgccgatcggcatggttcccattttgttttctgctgcaggggcagaagctgttttttggttcatatattctcctgttattactaaaaattcatttaaagtgccaattattaatgatagcattatatggtgtacgtttcaatagttgaagacttgaaaatgtcttaaaggtcagtttggcattcttgaattattgtgttaataggtaaagtcagtagaagtaatagtaacaacttgacagtttgcgtactgtatgatattttctaagtagtaagtagtaagtagtaagtaaaaataaaaatggtgatcaggaaataagaggaaagagaggaaagcaggtatgaaagatcttacattatctcagcaatatgcattacttgcgttggacggacaggagagtattcatccaagcgtggcaaaaagtgctgtattgagagctgtttcggctgcgcaggtgttggagacagaattaggaaaagcagatgcggattcattttcagaattttcttcagcactgcagaaagcggtacagacggcaaagacgttgaagaaaaaagaggagactcagatcgagcaaaaagtggttaatattctggaagcagaagaacttctaaaggaagtaccggatattttgggctgtgatatgaattatgatacatcaggtgttgaactaaaggcataccttagtgatgagacaagttatatcagaataaaagaaggacttcgtgcagagattctagaggatggtccaattagtctggaagatgcggttctcttatggcttctccgtgaaagtggctgtatccatgacttattttctgtatcagagcagaaccgtgtagaagagcgtatgacagaagctgccgttcaggatgagaagtaccgtgcattatgggaagcagaatttcataatgtttttgaaggatttatgaatcggtttgtgaagactaagagcaaactgcttaagaatccatatttagagggtgttaatcttgtattcccgtatcttgacagaagaaaatctgtatttattgatacggttatttttggaactaacgtggcagacagaagagctgcggctgtagaatatctgaagaaaaaaggctttgcggtagaggagatcagagtaggcagtgagactttactaaaaataggcaatatatattaccgtatcttcccaatgacgaaaacagcatataaagtaccgattcagggagtcaacctggtaccggcatactggcagtaggaagaaagtactgaaatactaattatgtagacagtagaaaaggtgagcagatgtcaagacagagaagcatggaagtaatagagcaggcagaatatgtgacaatcggagagcttgtgcggcttacggcagtgcgttacagtactttgaaattttatacagaggaaggaatgctgccgttcgagcaggcagaagagaatctgaccagaagataccgcagagttgagagcttagaaaggattgcgcagattcgtcggttaagagaacagaagaagacaattccggagattaaagagattctggatgtggtatagaaaaaatgaaaaggggagtcggaaaatagcaatgaaccgacaccccttttcatataacttgtttttggaatttaagaatatgtacaaagcaatattggaaaattatgcatccagtatgctttctgcaacttctggaagaatctcactgactgctccatggaaagcagcagttgctttttcatccagataatgtgattccttatggattacgatcaaatctttgcctgtgaaatgtggaagcatatctttgcacagactggaattcaggttcatcccgagaacgagaatcgtatcagctttagcaacttcttccacagcatggctaatgacagtattactgagcatttcaccatgtaaataaactccaggatgaatcacagtcgatttacacacatcacaaagaggaactttatcactgtttttgatatattcaatcgggaaaatctttccgcaacgtggacacgcattattttcataaatatttccatacatattgatcacatttttacagccggctttctgaggcatattatagatgccttttgtaatgattgtctttaaatatcctgccttttctaatcttgcaagtgcttcatttccctttcctgcctccagatgtttggaaagaatttcatttctataatattcatagaataattctgcatgtgtgttaaacatacgggcactgaataattcttccggagagtagccatacttttcttcaatccgataggattcgtcgctgtctcgatgatatgcgacattttgctctctcataaattccattccggcgagacaaacaagatatttagatgttctaattgtttcttcaagatagtttaaattcataatcatccctgcctttacaaaatgctgctgttaacgagttactataatgctagtatagcataaataaaaagaattgtctgaaaattcaaataaaaacaggataaaatttaaagaaaaactggacaaaataaaatttacagttgacaatagcgagataataagctatattaaaaatataataatagtaattattattaaaataaaaaaggaggttatcacatggagaaaaaagcactttataatttgtcttatggagtatttatgttatccacacgttccggtgagaaagtaaatggctgtattaccaatacatgtatgcaggtagcgaatgacccagttcgaattgcgatctctgttttgaacagtaattatacctgtgatctgatcaaagaaagcggaatttttgtactgagtctgttggatgtagaatgttcctttgagacaattaagcatttcggattccagtcaggaagagatgtggataagatgaaagatcttacgttaccggtagatcagaataatattccatatatgggatatcaggcatgcgccgtgatcagtggtaaggttctggaacagcaggatctcggtacacacactctgttcattgcagaagtaacagatgcaaaactgctgaatgagaatgcaccgcttacttacgccgactatcagaatcgcgtaaaaccaaagaagaaagagatacctcaggataagaagatcgttggatggagatgtaagatctgtaattatgtatatgaaggcagtgaacttccggcagattatatctgtccaatctgcggacatgatgtcagcgattttgaaccgatttttgaaaattagtggtaatgattcattgatcttgtcgtgtagtgaatggatgcaaggtcaggaataattataaaaacaaagatgaaaagaaaaggagatatggaattatgaaatatgtatgtgatttatgtggatgggaatatgatgaagagcagggatacccggaaggcggtatcgcacctggaacaaagtgggaagatgtaccggaagattttgaatgtcctctgtgtttagcaggaaaggatcagttctctgaggagtaaagaaaaaattactctataattgaattttatgtagaaaatgcaagagtccaatataatgtacaaaacagaacaacaaaatagacagaaaatttattttataaaaagttgttgacagacaataatgaacgtgatattgtatgtttgtacaaaataatagacaaaaacaaagagcaaaggtgcttacatttcgtagtagctttgctctttttgtttttgtttattataaaaatttttcagcgcgcgatgtatttgacaattagttgagattaaggcaactgtgaaacagctgcagattcaggaggatttgacaatgagattaaaagacacaggattaacagcacaggatatcaaagacaaagtaagcaaatacatgatcgagacttatgagcgtttcgattttcttgcagagacagccgaggggatgtatctctatgatgagaatggaacaccatatcttgacttttatgcaggaatcgcagtaaacaatgcgggaaacagaaacccgaaggttgtagcagcagtcaaagaccaggtggacgatataatgcacacatttaactatccatacaccattccacaggcgctgcttgctgaaaaagtatgtaagacacttggaatggacaagatattttatcagaactcaggaacagaggccaacgaggcaatgatcaagatggcgcgtaaatatggcattgagaaatatggtccgaacagataccacatcgttacagcaaaggatggtttccatggaagaacatttggagcaatgtcagcaacaggtcagccgggaaatggatgtcaggttggattcggacctatgacttacggattctcttatgcaccatacaatgacctgaaagcattcaaggatgcatgcacagagaatacgatcgcaattatgatcgagcctgtacagggcgaaggcggagttcatccggcaacacaggaatttatgaaaggacttcgtgaattctgtgatgagaagggaatgcttttacttctggatgaggtacagacaggatggtgtagaaccggagcagttatgtcttatatgaactacggagtaaaaccagatatcgtatctatggcgaaaggtcttggtggaggaatgccaatcggagcaatctgtgcaacagaggaagtatccaaagcatttacagccggatcacatggaacaacatttggaggacatccgattagctgtgcagcagcacttgcagaggttggagagcttcttgacagagaccttgcaggaaatgcaaagaaggtcggagattattttgcagcgaaattagagaagttgccacatgtaaaagaggtaagacatcagggacttctggttggtgttgagtttgatgatacaatctcaggagttgatgtaaaacatggatgctttgacagaaaacttcttatcacagcaatcggagcacatattatccgtatggttccaccactgattgtcagtgaagaagagtgtgataaggcagttgagattatcgaagaggcggtaaaagcattatcataaatagagaagaagtatagaagacaagggcgtcacgagaatgatcgtgcgccctttttcttcgtggtttctggaatcgttgagacgataatgaaatgctgttcactctcgtgtaaatcagaaaaatcattcagatgatttgtatgggagtaagcagcagaaatagaagagagggtgaatgatatggcacatctagttattacaatcggatgcgaatacggtgcaaagggaaaccagattggccggaaagtcgcagaagatctaggaattaaattttatgatcgagacacagtagaccagatcataaaagaagtcggaataccgaaagagattatggagaaagttgaggaaggtgttacaatcgcaggaaaaggagcggaaggagatgttcgtggttctttttcaaaatatgcagatctgacagatcgtgcgatgcatgttcagaaaacgattatacgaaaactttcggacagagaatcttgtgtgattatcgggcgatcagcagattacattttgaaggaacatcagccgattctcagagtatttatttattctccaaatgaagtgaggattcataacgtaatgaagagtcacaatctttcagcagacgatgcaaagcttcttatcatagaaaaggataagaggtaccataaacgtcacctggcactgaccggaagcaaccgtggtgaccgtcataaccgtgacatgctgattgatagtagtcttctgggagtagatggaaccgcagagttgattgaagatgtagcaaaaaagataatgaacaagtaggagggaacaggttatgacacagaaaaaatcagagtttaacaaagtattgaatgcctgggacatccttgtaatcgcctttggcgccatgattggatggggctgggttgtatcaacaggtggttggattgaaaaaggcggagttatcggagctgcacttggttttgcaatcggtggtatcatgatctttttcgtgggtatgacatacgcagagctgacagcagcaatgccacagtgtggtggagagcatgtatttagttaccgggcaatggggtcaacgggatcttttatctgtacatggatgatcgtacttggatatgtcagtgtagcatgttttgaagcttgtgcatttccaacgatcattacttatctttggcctggatttttaaaaggctatatgtatacagttgcaggatttgatatctacgcaacctggctgatcacagcaatcgtaattgcatttttgatcatgatgatcaacattatcggagcaaagacagcggctatccttcagacggtactgacttgtatcatcggtggcgcaggaatcttgctgatcgttgcgtcagtgatcaatggaacagttgacaatctggatggacagatgtttgcaggaactacggcaggtgtgaatatcaaggcaattatcggagttgcagcaatgtcaccgttctactttattggatttgatgttattccgcaggccgcagaggaaatcaatgtccctccgaaaaaaatcggaaatatcctgatcttatctgttgttcttgcagttgtattttatgcatttgttattattgcagttggacttgttatgaatccaggagacattatcgcgtcacaggaagcaacagggcttgtgacagcagatgcgatggcagcggcttttaacacgaaaattatggcaaaggttattattgtcggtggaatgtgtggaatcgttacatcctggaactcctttttacttggtggttcccgtgcaatgtattccatggcagagtcttacatgattccaaaattctttgcaaagttacatccgaagcacaaaactcctgtaaatgccttgattctgatcggtattctgacaatgcttgctccgttcgcaggaagaaagatgcttgtatggatcagtgatgccggtaactttggatgttgtttcgcttactgcatggttgctctgtcttttatgatcctgagaaagaaagagccggatatgccgagaccgtataaggttccatgttataaattcttcggaactatggcagttatcatgtcaggatttatggttgcaatgtactgtattccgggaagcggtggaaacctgatccttcaagagtggctgatggtacttggatggtcagcacttggtgttgtgttctatgttgtatgtaaagtgaaatacaaagagtcctttggtacacttgttgagatcatctctgatgaggatgcagcaactctgatgccggaggcagatgaagaagagcttgataaagtgatcgatgcagcaattgatcgtgtactgatgcagaaaagtgatttgattggaggcacagtttaataatgaatggatttagtttttcagttccacagaatattacagtaggaaagggaagccttacaaagcttcccgagattgctaagaagtcaggcagttctcatgcatttcttatgtccggaccgcatctggcgaagatggggctcgtggagaaggcagcagagtctctgaaagtggcaggaattgctgttgatacatttacagagatagaaggaaatccatctgttgagacagtggataaggcaacagtggcattcaaagaatcaggtgcagattttatcgtggcattcggcggcggttctccgatggatgtggcaaaagcagtcggtgttactgcgaaatatggcggaagcattacagaatacgaaggtgcccacaaagttccgggaccgatcattccgttgatcgcaattccgacgacagcaggaacaggttctgaggtaactgcattttcagttattacagatcacagcagagattataagctgacagttttcagttatgagattcttccggcatatgcaattctggacgcagaacttctgacaacagctccggcaagcgttgcagcggcctgtggaattgatgcatttatccatgcagaagaagcatatatttctactgcagcatcaccgttttcagatgcgatggcagagaaagccatgagtctgatcggtaaaaacattcgtcgtttcgttgcaaaccgcggcgatatcgaagcagcagaagcaatgcttgtcggttcactttttgcaggaatcgcattttcctttgcaagacttggaaatgtacatgcaatgagtcatccggtcagcgcattctttgatgtaccgcatggagtggccaatgcagtattacttccggtaatcgcagagtataatgcactggcagatcatggaagatatctgacgatctataatgacatcagttcggttccggcttatgaggaagagtttgaaccaatgatgctggtggatgcgatttgtgaattatgtggggagattggaattccggcaaatctgacagaagcaattaataatgccagcaagacaggcccggtgagtgcagaagagattgagaacaagattgaagcaatggcagtggatgccatgaagagtggaaacattgcagtgaatccgaggtcttccagacagtgtgacattgaaatgttgtacagaaaagcgttgtaaggatgaagtagatggactatttatcacataatgtatcagaaaatttgaagaaaattcgtaaagcaaagggaatgagtctggaatttgagacagaccagccacatgtgtaccggaaccagggaacagaaaaggtatgttgtgtgtgcttcttcctagattatatgagaataatataaaaaagagattttaaatataaaaagcaggtggtagaataaacacagaactattctatcacttgttttacgttacgaaagagaggaagagaaacatgtatcaggcagcaaatgacagatatgagaaaatggcttatgtacgttgtggaaagagcggattaaaactcccggcaatttcacttggattgtggcacaactttggagataccggtgtttatgagaatatgaaggaaatccttttcacagcatttgataatggaatcgtacactttgatctggcaaataattacgggccggcttatggaagtgcagagaagaattttggtaagattctgaaagaagaacttggcgtgtacagagatgagcttctgatcagcacaaaggctggttttgatatgtgggaaggcccttatggaaactggggaagtagaaaatatcttctttccagtctggatcagagcctgaagcgtatggggctggattatgtagatatcttctaccatcaccggatggatccggagactccgttggaagagacgatgggagcacttgcaagtgcagtgcagtcaggaaaagcactttatgtgggactttcaaattatgacggtccaaccctagaaaaggcagaggcaatcttaagagacttgaagtgtccatttgtgatcaatcagaacagatattctatctttgacagaacaattgagaaaaatggattgaaagacaccgcgaagaagctggagaagggaattattgcattcagtccgctggcgcagggacttcttaccgaccgttatctgaaaggaatcccggaagacagcagaattatgacagacggacgattcctgaagaaatctgctctgacagaagaaaaacttgtgaaaatcagagaactgaacggactggcagccggaagaggtcagacattggcagagatggcattgagttggattttgaaggatggtattgtaacaagcgttcttgtaggcgcatcaaaaccggaacaggtattggataatatcaaggcaatacagaatacagaatttacagaagaagaactccgcaagattgatgaactgtcactggactaaacagtaagttggttcatcatatacttgttttagctattgacatgtgctagaggtgagatggctaaaaaggatatagtaccatgagtacacaaaaatgcccccagtagtggctgctactgggggcattttgtgtataataacactattttttgtacaagattccaatatattaaaaaggtattgacatacaccatgaatatagttataatcctaaatgtttgaattataactattaatgtaataaaagaaggagatgaataataaatggatgattcctttcactacctgtctatgataaaccatatgactgtccagaaaaaactaatggaacagctgaaagatacaggccttaccttgggacagcccaaagtattggattacctgaaagatcacgacggtgtcagccagaaagagattgcggcaggatgcctcatcgaggcaggttctttaacgtctattttgaaccgtatggaagaaaaaggcctgatcgaaagaaaaatgctcaatggaaaccgtcgtacttttcatatttttatgacagaatccggaaagaaaaatcagaagcttgtggaggaggcttttaagaaaatagaaaaaattgcattaaatggtatttccgaagaagagcagaagctgtttatggatattttttgccggatctaccgaaatcttgcagatatgaaatgatccgacgataaaaaatatgaaatgaggaggaaaaaatggagaaactaaaacgatatttaatatttctggtgggattgtttgtaaactccctgggagtcagcctgatcacaaaggcaaacctgggaacatctccgatttcatcaattccttacgtattgagtcttaattttccatttacacttggaaactttaccatctttttcagtatctttctgattgcacttcagttgatcatcctgagaaggaactttaaattggagcacatccttcagattccggtatccatcatatttggatattttatcgatcttaccatgattcttttttcctgggtcaatccggaagcgtacatcatgaagattgtatatcttcttatcggatgtctgatccttggcgtaggtgtatatatggaggttttggcagacgttgtcatgcttccaggagaatcttttgtccgtgctattgttcttacatggaaaacaaatttcggaacaaccaagatctgttttgatgtatccatgtcagtgatcgctgctgtactttctttcgtatttgcaggaagtctggctggtgtaagagaaggtaccgttattgctgcccttctggtaggcttcatcgccagactcatcggtaagaaacttgcattcttgaaagatatgattttcccggaaagcgtatctgcagaaaacgagaacgaagcaaaagaacagaagacaggaatctgtggaaaaaatgttatcgccataggaagacaatttggaagtggcggccacgatattggcaaggctcttgcagaaaagttgggatatgatttttatgatgcggagattatccagatgacagcaggaaccaccggatacacaccagaattcgttaagaaaaacgaggagatcatgacaaatagtcttctctatgatctggtcaatcagatgtacctgaatacagacaggcaggatgaagcgccgaaggataaaatttttgaggcagaatgccaggttgtatgcaatcttgcgaaaaaaggcaactgcgtgatagtaggccgttgtgcagactatgttctcagaaattccgaaaactgcctgaaagtatttttttcagcgcctcttacgagcagaattagaagagtggcacagagacagaatatctccgagagagaagccaaagctacggttcagaaaaatgaaaaactccgtgcagataactaccgctattacacacgccgtatgtggggggcagccggaaactttgatctcagcctgaatacagatttgggagaagaatatattgagaactgcatttgcagtgctatgaaactgtaaaaatattattttttcttcttttttcctgctgggtttggtacgatcatatcacgtttgagtgtctgtttagactagttgtcattgttaatctgtgttatactgattaaaaatgaaaaaggagaatttaccatggatagaatcgcaagctttacaatcaatcacctggatctgatgccggggctttatgtttcaagaagagatgcgaaaggagattgtgtcacaacaacatttgatctgagaatcacagcaccgaacagagaaccggttgtggatactccggcacttcatacgatcgagcatctggcagcgacttatctccgcaacagtgagaagaaggatgacgtgatctactttagaccaatgggatgtagaacaggatgctatcttgttatgttcggaaatctggattcagaggatgtgctggatcttgttcttgaaatgtgtgatttcattatcggatttgaaggagagattccgggagctgcaccggagcagtgtggcaactatcaggagcagaaccttgatatggcgaagtattatattaagaaatacaaagatgcattggtgaatgaccgtcatcttgtatatccggaataatgaaaagtgggaattgtctgacgagttgttttcagacaattcccactttggttatacagatcagatcttggattttcaaaagtttttaatttccaagaattttaattattcatcctgaacatctaacgtatttgtattcaggtcgtatgttacaacatcatcccagtttcgccgaaggacaacctcagcagtcagatcagtattgttataattgatggaccactgtgtattactggttatttcgactggatttggatcttgagaggcagctttcaatgcattccaggaagttgtgtttgtgtgttctttttctgtttcaaaaacgttaagaaccgcatcgtaacgttctcttccatgtccgtaaatcccatttctctggtttggggcaaccttgtctttatatagaatgaaaaagttggtaattgcttcagatttcgtatctacaagttcgcgggtattactgttgcagtcatactcaatgacgcgtccatctccgttggcatctgtgatatagaaatgataatctctgccggaggatgcaaacatatcgtaactctttagtaaggtaacggcctcttctgttgaagcagcgcggtcaagtacaagacgaattgcaagagtggtggaaatcgtaggttttcctgtatcctgatgaacagggtcactgtccagcgtcagtactgcaatagaaacacctttttcattcataccgtcgagacagatgaatggagaagttaatgaagcaagttttttctttacattctcatcaggaatgttggcagatacattatcaagtgctgcgaatgcaacagatttatatccatttttcggtgtacagtacacgagcattgcggaagtatcttttttaaaatcgtaattacgacccatatgaatatcaccgtctgtatcagtcattgtaaatgcagtacagccaaatttcggggctttgatcttgaccagaagaagagggagtgcttccttcagaattgcatcgatcatactctgatcatctgtgatcccgtagttgattacatcatctaagttataatcatatttcacatccattcgatacaggttatagccatcgtcataagaacttatcttttgaatggaagacattgtgcgaaaacgtgtgaaataaattcctgtaaagattccgatacaaagcagaagaaatacaagaagaacaagaaggattcgtgttacatattttttcatagaggttccccctttcatgatgtgtacccagggtgtgcttatttcagcatataagattttaattgcccacgggtttcaatccccaatttgttaaaaatgctggtcatgtgctgttttactgtccgtacattcatatgcatataatcagcaatctcattgtttgtccagcctctgttagcaagcattgcaattgaaaattcagtggttgtcagattgtcggcaacatcgtcctgtgttgctggattatggattcttctccaaccataactgaactgataggtgatgtttatgatacgtttatagtcatcgggataatctgttttcagacaggtttcaatcaatccttgcagcagaccgtgatgttcgccgattccctcaatcagtccgtcaggacgggcgagagtccaggcgttcataaaatgttgtctggcaagctcctgtttcctcagattcatcgcatccattgcgcccataagattcaggtagatcatagcaatcggatagacatccgtgcttaacatcagacaggcatggacaatcccaagtgacttttcatattcctgggaaagataggaattatgagccaggatataacctccccacaatctcattccaacaggcagttcagagagatagtctgacagaggaggaacatctccgactggaagatgaaggagcgtttgtgcggcaacggttgtaaaaattgcgaatgcggtagtcttccgattatcttcctttttcagaatctgatctaagttctctttcagacttttcaaccctccggttgcagagttgattctattgagagaaagattggcaaatgtatagatcaggcaggcagaaagccggagcatgggatcaggatgactcaaatataattctgcaagatcaacggctttgtcatgttcgccagtgaaataatagtactcgcagtaggccattttctgcatgtcctgacttttcaggttttggataaaattcagacactctcccggccggaaagcagtgctcataagcagcataggcagatatccggtgccttgaggttctttatgaagtccaagaatataatcagtggatacatggaattcccgtgctaattttattaaaagatcactgttgatcgatttggtgtcgccatttaaaatccggctgatctgtgaaggagcaacgccaagatgcagcgcaagctccttgcgggtcagctgatgtgtatcgcataactgctggatgcgttcaccaggagataccgtagttccgttcttgttttcaaccatggtcatcaccttctttccaatcatccagatatttaccaggctctcttaagtgactttattgtagcacgggaaatagattgtgacatcgttcatttatgaaaaagattggttgcgtttttgcaaataataagggattttcaatgagataaattgcaaaaatgcaaatttagttcttaagcaattccgcattcttatgaattgtctcattaacaatattctctacataacttccgatatgttttttgacatccttatccagttcatttggatagatcggagtaccgtattcgagaacaacatgtgttttcttgatctttggaaaatgattttcgaaaatttcagcagtattattcatagaaatcggtacgatcggacagccggtcttcgtggcaatcttgaaagcaccttctttgaaaggaagaagacttaattcttcacctttatttcttgtaccttcagggaagatacagatagagataccgttctttacataatcgattgcctgcaggattgtctttaaaccttccttcggattctcacgatcaaggaaaagacaatagacaaaacgcatccaggtagaaagaagcggaatcttttccatctctttctttgctacataacctgtaagattcctgcatctgctgtaagtgagcagaatgtcaaagaagctgcggtggtttccgataaagagaacaggttcattcggtacattctcttcaccgatcacggtaactttcacaccggtcattttcaaaatcactttaaatccccactggacaatacgcagagaactgatgtcacgcgcatgtgggttgaatttaccgatcagccattccacaaagaaaacaggaatagaaagaatcaggtaaagaattagaaaaattgcaacaaaaataaatcgaaacatataatatcctttctttatcttaagaataatagagtcgccataatataaaataactactggcgcatgtagctttattataccgtagcagcataaaaaatacaactgatgcatagattgaagggaaataaaaaatccggatggcgttactgtttacagtatctggaatattgtaatgaaaaataaaaaacaaaagggcattttagctgtgtttctactgtgtgtctgtttttttataagcggatgtattaccaggattgagaaagagcaaaaacaaaaagatctggaatatattctgatcgaccaggagcatcttccggaggaaatgacagaagtgctcagtcagttaaaaaagaaagcatttcattttgtttattcggatcagggaaagacgtatcttgcagaaggatacggtgcatgtccgacaacaggatatactattgaggtgaagaaactttatgaaacggagcatgcagtttgtttgaatacaagtctgatgggaccggcaactggtgaagagacgaaagaaatcacgacatttccatacatagtcgtggaaatcagtgaaacagaaaaagaggttatgtttgattgaggaggagcaggatggaaattgtgaagagagcgatacgcctgatgcatgaaggaaaatgtatttacgatcagtttcagctggacgaagactataacgttccggatgcaaaggaggatgtgggaaatgtaattgaagggacagtctgtgtgaagacggaagatatgaagcttgtagagaattatctgaaaatcagtggaaaagctctatttaagattttgtacatgacagcttctctggatccgcaaccggcagttttagaaggaaagcttccatttgaagaaatggtatatgtagaacaaccgggagaggaagaatatttcctgaaaaatctcagaacagagttcagtgtatcaatggtgcattccagaaagctgagcctgcatctactgacagaacttgaaattggaaggactcagatgataagtgaagaagtcacggaagatgtggaaagtgaacatgctgtttataaaaaaatgaaaaagtttcgtctgcttggattgtcagacacaaaaaaagacacttatagaataaaagaagagattacattaccgggaacgaaggagagtatcagccagattctgttgtccgaagtgagcggtagaaagttagaactgcgtccgggaacagatgaggtaacagtcagaggagaactacaggtgttctgtctctatttgtcagaagaatcgaaggcagactgggtcagccaggtgattccatatgaaggaaaacttctttgcaatggcttgacagaaggaatgttttattctgtggaacatacgctggaggatacactggttgatatccgtatggatgaggacggtgagatgcggatccttgggattgaagggacattactgctgcggatgaacttttacgaagagcaggagatggagttgttagaagatatttactctttgcaagagcagtgtattccggagaaacaagagacggtttttgaagagcttttaatgcagaaccaatccagatataaactaacggaacggctttcacttccagaattaaaagatgatgtacttcaagtactctgcagcagaggggaaatccagatagaacatacggagtatagagaagaaggaatccaaatagaaggaatcctgcatcttaactttctctacctgagaggggatgatgcaagaccatatggaagctggcaggggatgataccattccaacatctgatcgaatgttccaatcttccggaaaatgtacggtgtacgatgagtcatcatgtggatcagatccaggtgtctatggcaggcagtgaggctgtagaagtgagagcaattcttgcatttgatgcattcttacggcgggaggtagaacttcagacaatcgtgtctgtcatggagaaaccgctggatcttgaacagatagataagaggccgggaatcgttggtcatattgtgcaggagaaagaagatctctgggagttggcgaaacagtatatgactacagttgaggggattatgaatgtaaacgaattggaaaatgaaaatgtgaaaataggggataaattgttgatttttaaagaaaatatgagtatactgtaagtactatgtatacaagatacatttgtgtaaattttcacatctggttctttagaaaacagcgatggaggtacacaggatgaatcaaattgaattaaaagcacttgccaagattaatttaggcctggatgtgcttggaagacgcgagaatggataccatgatgtcagaatggtcatgcagtctatctatctgtatgatgaagtgaagattgcgaagaagaaagaacctggaattacattgacaacaaatctgaagtttcttccaaccggggatggcaatatcgcttataaagcagcgcagcttctgatggatgaatttgatctgaaagaaggggttcagatcacgctgaataagcacattccggtagctgccggtcttgcaggaggaagctcgaatgcagctgcggttctgtttggaatgaaccggctcttcggactgcgtctgacccagcaggaattgatggatcggggagtgaagcttggagcagatgttccatattgtatcatgagaggaaccgttcttgcagaagggataggagaagaattaagtgtccttcctgccatgccgaaatgtacggtactgatcgccaagcctccgatcagtgtttcgacgaagatggtgtatgaagcactggactccaaagagattgtcgagcatccggatattgacgggattctggaaggacttcggaagggagatcttcacaaggttgcagattctatggggaatgtgttagaggatgtgacaataccgatgcatccggtgatcgcggatatcaagcaggtgatgcaggattgcggagcaatcggggcaatgatgagcggaagtggaccgactgtgtttggtctgtttgaaaaccgggcatcagcaagagaagcacagaagatgattcgggacaaaggtctgacaagacaggcatatgtgacgaatatacacaacgttaggaggaagtaaagatgggaactgattttgaagtaacaatgaatgaatatctgcctctgagagatgtggtatttaatacattgagacaggcgatcctgcgcggagaattgaaaccgggagagcgtctgatggagattcagctggcgaataaactcggagtgagcagaaccccgatccgtgaagcaatccgtaaacttgaactggaaggtcttgtccttatgattccgagaaaaggtgcggaagttgcagagatcacagagaagaatctaagagatgtcctggaagtgcgctgtgcgttagaagagcttgcagtacagcttgcatgtgacagaatggatgaagaaggagtgcgtgagcttcgtgcagcagcggagacgtttgagtctattctcaacagtgatgatattacacagatcgcacaggcagacgttgcatttcatgatattatctatgctgcaacagataaccgcagactgattcagcttctgaataatctgcgcgaacagatgtacagatacagaattgaatatctgaagaagaaagaatgctacccacagttgttgaatgagcatcagacaattattgatgcgattgccggacatgataaagagctggctacaaagtttacaagccagcatattaagaaccaggcagaaacggttgttggcactatccgtgagaaagaagaaaatgcttaaaaaataaagaatgtgcctcggcacattctttattctatatgtatggaattcatttttgtggaaagactccatgtatgaacaaaattaatttatcatagatggaggatgatattatgaagaaacggtttgcactgctcagaagaaagctgaagtctgtccgagaagaaaaactgccgggaagagcagtgattttttcagtggcagcgggacttctgatcgctgctttcttcacaggaatgatatatacaaaacaggaattatatgcacaggaagaaacgcagaagcatctggcgcaggaagtgtttcgcttccatgtgttagcgaatagtgacagcgaaaaggaccagaatctgaaattgcaggtaagagatgcagtattggattatatgaaagaagaattgtcagaagaaccggaagagaaacagtgtcttaagcagacagtgcagtgggcacgtacacatacagatgagattcgtgcaatcggagaaaagacagttgcgatggcaggagaagatcagagtgtgaatgtggctgtaacaacctgttactttcctgacaggacttacggtgatgtgacatttcctgcgggaaattatcaggcactgcgggtagaactgggaaatgcagagggacataactggtggtgcgtgctttatccgaatctctgctttctggatacaacgaatgcggtggttcctgacaaaggaaagaaacaattaaaacaggtactgacggaagaagaatattccaaagtgacagcgaatacaaagtttaagattggctggtatttttggaaataagaaataaaagaggttaagaaaatgtatgaatttgacagcagagtacgttacagcgaggtagatcaccacggtacgatgacagttccggcgttgatcaattattttcaggactgcagtaccttccagtcggaggatcttggaattggtacaacggttttgaaggaagagaaaagagcgtggcttttatcttactggcaggtgatcctgaatcggaaaccggagcttggtgagaagatcacaatcggaacatttgcaacagaattcaagggattgtttggaaacagaaacttttatatgaaagatgcagatggaaaatatctcgcctgtgcgaattcagtctgggcatttattgatacagagacaggaagaccaaccaggccgcagccaaaggatgttcagttgtatggagtagaagaaccacttgatataccatatgagggaagaaaaatccgacttccggaagagacggatgatctggaagcatttccggtcagaaagtatcatattgacacaaatgagcatgtgaacaactgtcagtatgtgcagatggcattggaatttctcccagatgatcttcagattgcacagttgcgtgtagagtataaaaaggcagctgtactgggggatatgatctacccgaagctgagtaaagaagcagacagaatcgttgtggaactctgtgacgaacaggcaaaaccatatgcagttctggaatttaaagaagaaatataaaagaagagatagaatagaaaaactcccggatgttcctacagaaatttctgtgaacattcgggagttttttgttgcgaacaagtaacgtttgcaggagatatttacttatcaagacttgccaggacatcttccagaacatcctcaacagaatcagttacttcatccgcatagtaggatacaccaggtgcactgtttgacattgcgtagctgtgaccgaccagttcaagcatttccagatcattatactgatctccgaatgccatacattcttccggctttacatggaataatttcatcaggttagaaagagcagcacctttatttgttcccggagcaatgaagtcaatccagatatttccggaagtaacaaccttaatctctgcaccgaacatttcctgtaagtgttctaaatattgcatgattacttttgtgtcatcaatcatattacagattgcaatcttgagaaatggaccttcgattttgcttaggtcgtctacaatttttgttgtgttctgcatgacatttacaatatgatttacaaaagcttcatgattatcttcaatcagacaagcatcttctctggagatgagaatatcaaaattcggtgattttttcacttcatctataatgcggcaggcaaggtcatctgcaattattccgcgagagattacctttccctgatgaatacagatggaaccattttctccaatataggaaatctcgtccttaatctcagaaaacagtctacgctcattatcatactggcgtccgcttgcagcaacaaagtgaatgcctttttgtgtcagttcatgaatcagctctatggcacgaggagtcagtttctgtgctccgttatgaagaagcgtaccatcaaggtcgcttgcgattaatttgatcatatgtaaaatcctcctgatttttcaaactctgtttacgcaaaaaagtttaacatcatctttcgaaagaatcaagaaagttattctgcaatcacttcttcagcacgtttcagtgcggcactgatattcggctggaagttctcttttccaaccagctctgtgaatccggctttctccataactttcattggctgttcgttgacgtgggagaagacaaccgtaattccctttgactcacagacttctaccagatcaaccaaagcattcatagcagtactgtccagcgcaggaacgcttcgcatacgaagaacgaggcaggtagtaaaatcttttacgacaatgtgttcaatcgcacttgctgctccgaagaacagaggtcctgagatctcgtagacacggatctgaagtggaagtttctgaaggtgttcatcgacatccggggtatcatcatccacataagtccagctgttgacgtgtgtttcttcgctcatacgcttgataaagagcaggcaggcaagaaccatgccaatctcgatcgctacgaccaggtcgaagaggactgtcaggataaaggaagcaaaaagtacaatgatatcactctttggagcagtcttaaccagttttacaaaggtacgccactggcacatattatatgcaacgataaacaggattgctgcgattgttggcattggaatcattccggcatatggcatcagtacgacaagtacaatgaccagtgtaatggaatgaacgattccggcaatcggagtacgtccgccgtttttaatatttgcagcagttcttgcaatagctcctgtcgcagggattccgccgaaaagggcagaagcaatgttgccggctccctgggctacaagttccatgtcggaacggtgtttaccgttgatcattccgtctgcgacaacacaggaaagcagagactcaatcgctgcgagaacagcaattgtaaatgcgttcggaagtgcattttgaacaacttcaaatgatacagccggaagatggaaggatgggagtgagttgttgatcgtataaagatttccaattgtagaaacttttaacggcaggaactgaaccatcaggattccaatgataactgcgatcaaagatccaggaattcttttgaagatgtatggagcaatgatcagaacagcaagacttactgcaccgacaatcagtgcatcaatattaattgtagagaagttttcaacaacagcacggaatttctctgttgtctcgatcggttttaccccatccggataggtgagtccgaagaaatctttcagctgtccgattacaattgtaacagcaattccggaagtgaatccggttgtgatcgtaaatgggatgaatttgatcagacttccgaaatggcacagtcccatcagaaccagaaagataccggcgaggattgttgcaatgacaagtccatccattccgtctttggcaacaatgccggcgacgattgttgcgaatgcagccgttggtccggcaatctgtacactgcttccgccaagtgcagagatgacaaatccggcaacgatcgcagtgaagataccagcttccggtcctacaccggatgcaagtgccagtgcgattgacagcggcaatgcaataattgctacaatgattccggcagttacatctttgatgaactgagaacgattgtagctctttaatgatgtaagtaacattggcttcaatgaattcatttgatagatcaatcccttcttttgtgataactataaaacataacctttcaagtatagcatagaaaaagggacactgagaagaggaaaccttgtatgtttttaaggacataaagaggttattgttcactcccgtgtcaatcacttcgctgattgacacggaggatgcatgttttggtacgccacaccgacgaaatgcgtagcattttggaggttggctctgaacagttactttaatttctttcaaatttatttcttcttaaattttagtttgatggactgttttaccatgttcggaagaacaaatttcagacgatcctcgtaaggaaccattctgctacattccggaagttctctatgtaacttgattgcatcaaattcacattttgttgtacaaagtccgcagccgatacatttattcggatcaacaacagatgctccacatccaagacagcgcgctgtctccgctttcacctgctcttctgtaaataaaagctttgcatcacggaaggaatgttttgtatcaattgcatcattatgtcctggaatctgacggctggaattatcataattctccaccttgatgtcattcttatctaattcgatgaaatcatttctgttacgtccgattgtaagactggactttggctgtacaaaacgatggattgagattgctccctgctttcctgctgcgatcgcatcgattgcaaacttcggtcctgtataaacatctccaccaacgaaaatatccggttctgctgtctggtaagtaagctcgtctgcaactgctccattgccgcgtccaagttctaccttgcttccctttaacagatcaccccatacgattgactgaccaacagagaagaatacatgcttacattctactgtcataagctcactctcatcatatgtcggattgaatcttccttctgcatcaaatacagaaagacatttctttaatacaacaccgcgaacctcaccattctcgtctacgagaacttccttcggtccccagcccggatttacaacgattccttctgactcagcttcttctatctcttctacggaagccggcattgtctctctggactccagacagaacatatttacctttgtatcgtcacttgcacatctcttagagtctcttgctacgtcgattgctacgttaccaccaccgatgacaactacgtcacccttgatgtcgtatttctcatttgcattcacctcttttaagagatcaaccgcagatgcacatccctttgctgtatcattcggaattcccggaagacgtccgccctgacatccgatcgcaatgtaaaatgctttgtatccctgtgcacgaagttcatctaatgtgatgtcttttccaacttctacaccagtcttgatctctacccccatctctttgataatatcgatttctgcctgtacgacatccttctctaatttgaatgatgggattccgtatacgagcataccgccggcgcgctcatttttctcgaaaatagttggtttataacctttttcggcaaggtaaaatgcacaggataatcccgccggtccaccaccgatgattgcaatcttctcatcgaaatatccttttgttgccggaactactttctctggaataaaacgtgtctcagcattcagatcctgagccgcaataaacttcttaacttcatcgattgcaattgcctgatcgattgttccacgtgtacatgcgtcctcacagcgacggttacagatatgtccgcagactgccggaagtgggttgttcttcttgatcagtgcaagggcatctctgtatcttccctgcgctgccatcttgatataaccctgaacagcgatatgtgccggacaggctgtcttacacggagctgtacctgtatcataacagttaatgcggttcttatcacgatagtcttcgtcccacatctccggtccccatttcttctctgtaggaagaacatgcttcggatactctacttgagaaccatccttcttacaaagcttctgaccaagcttaacagcacctgccgggcagtactctacacaacgtccgcaagccacacagttctctgtctcaacttttgcaacatatgcagatctgtccatattcggtgtattaaataactgtgaagtacgaagcgcataacagacatttacattacagttacaaatggcgaaaatcttattctcaccgtcaatatttgtaatctgatgtacgaaaccattgtcctctgcctgtttcagaatctctaacgcacgttcctttgtaatatagtgtccacctttatttgtctcaacgatataatctgccatatcgcccaccgcaatacaccattcttccggatcatccgcacatccctcatcgaatgttttacgagatcttctacaagaacatggactcgctgcatattttccctcatacttttcaagccaatgtgaaatgtgctcgattggcagagactgattctccgttgaaatcgccttctctaccggaataacatgcattccaacaccgccctctggcataaatggtgcaagtccttccagtgcaatacggctcattctctcaaagaaaagtcccagctccggatgcttctctaacatcttcgcattcatacaagagaactctgcacttccaggtacgaagatcggcagtacatactgcttctcatgctgtggattttcccagttatactccaccagcgcaacctgtgccatctcctctaactgcttctccagataatctctgtccttgcctgtcaccttcaccatctgatctaaagttttcggctggcgcacccccatcttcaatgcgatctcagcctgctcatctgtacacaaaagtgccagtccccaatactccggatcgtactttgtcatcttctctaatccgagctttttctttgcacgccctgtcatcatcttggcaagttttaagattggttcacgttctttttcgttctcaatatagtccggataccagcctttaaatttgtctgtcatattccctctcctttttcataaaatcttttcccaaatcctcttaataacagatttctataagtccaacataacacttgttatgtactttgtcaaacaaatatcgatgttacatttatctttttttatgctataatcttttcaaggttggtgagcctgtcacaatatgtatactgtgcacaataacacaattcattttgaggtgaagaaacacatgaatgaacaaaaaaacacaaccaaaacacagattaaacaagctgcgatccggcagattgaaaagtttggaattgataagacaagtatgcgttcgattgctgccgaagccaatatgacaaccggcgcgatttattattactataagaataaacaggatttatttgatgagattgtcactgattcgattcattttgcacatcgtatttttcatgaaaatgagaacgagaaaatcaccgtagattctctcttttctgatgtagaaaaagaagctcggattcgtttcaaacgccttcaggaagaaaaactatacttacttctattatcagatgcaatgaaatgtgattcagaattttcccagaaatatacctccggattgaagtcgatcctggatcaggctgctacgctttttgcttctgcatttgcacttgatgatcgtaagcttgcagaacaattcgcttctatctttatggctacacttgatggattcgcgattcaacaggtacttcatgcgattccaaaagatgatacttcttatgcagatacgattcttgatttcttcacaacctgcgttccgtattatattgagaaacatagggagtcttgataggagcagtaaagccgatacaggaaatgaatcctgcaccggctttattttcttctatccctttcttttataactttcgagagcatatacatcatccagcatgtcgccaataccagataagtgcccactatcagtattgctaaaagagttccctgtaaataaacagaatcctccactgttacggcaacaatataactatcgtcccgtctcgtcatacatctacagtgtttcccatctattttaacatgcttaacaactacttgattcttgtctacctgttcagacgatatcccgattgcatcaagtttctctcgtatttccatcaacacggttcatttccaaatagatgaaaaacggttgagaatttgtaggttctatgataagatattaactgtgtctggaatacagatacaattgttcccttagttaaatggatataacgaggtcctcctaaggaaggccgaggcattccccaaagggaaaaatcctagaaacccagtaaaatcaagggtttgcgtcatgtgtctctgtagctcagctggatagagcaccgccctcctaaggcgggtttttgcgggggttcgaatccccccagggacggttcaaagcgttcgaaaatgttagctgaattagctgacaacgaacgcttttgttattttctaatcacattcgtgacataaaattccattcaaaatgatcaatttccagctaacgcaatccgatttttgttagctgacagctaatcaaaattaccggtttgcaaacatgggttttaagaagtccagctaacattttggttccgctctgttgtcaccccttattgggagatgtaaatttgatcttctggtgtctctgctgcgaccgccgtagaacatgctacagaaattatcattgcaagagaaagaaaaaaaccaatcgttcgctttaaaattgttttcataaacatttacctcctttacttcctttatttcccacacttcctgttacctatatatacaatggaacattaaaaaagttgcataattttaaaaaaatttgaagtttcctataacaaaaaaatgagagagagtgcgatcacctaacctggtaatcgcactctctctcataaccgttttttactatttaataactatttttccttcctttaaagatataggatctgagcttacacctaaaagacagatataatattctccggatttttctgcagttaattcaaaggtttgatttaattctttacgaggctctgattttccatctaatatttcaccgtcacagatataaaaatacatgattccctggccatttccaccgtttgtttccgcttcatattccgttgcctgaatcattaaggtttctccctcatttaatttccagcctgatccgtcttcctgctcaaaaatgactaaatcattgttgccaaatataatttccggagtaatatattgtccggcgtcaccggatacagcaaattctgttatactgtttggactaatgcttacgtttttgtatgatttaatacgagctgttgtttcccaaattccatctgaaggttcatccggaacctctatctcttcatcagctcctattatctgtccttctccatgaagtccttttccaactaaatgccggttgctgtcatcaattaatgctgcaccgtagttgtgagcaatagcaagaatagacgacattgcagcaagagctgcaaccagtaaaacactcttgatagcaaaatgcctttttctcacgattttctgatcatggatcatatctgttacatctttacaagttctatctgaagaaaacatatcatcggtttcatcattaaacatatcattttcttctaatatttcataagcaacatctgaaatgttagtaaacatatcgttatacgaaattttcatactgatttcctccttcttccaaaaattttttcatcttctctttgcagcgtttgagtttgctttttactgtggatgccggaatacctgtaatgcgggaaatatcggctattttctcattttgaaaataaaacagaactaatattaactgctcatccttattcagtttcctcagagcattcgccagcagtaatctcaattcaacctggttaaaatcatcggaaatatctgctatgacctcatcatttatctggtaatctggtatgcattttttcttttcatttatagctgtatttctggccaatgtgcctaaataaccttttattgtaacgcttttcgatggatcaattttattagctttatgccacaaggtaaaaaagatctgattaaccacaccctgaagatcaattttatgagagtaactgcctaagatactgtatacaatttttccgacataagcatgatattccgaaattattattgctaacgctgattcatctcctttttggattcgtctaattagttcattctcatcataataattactcaatacgttccacctcccaccttcttttcatctctttaccttatatacaaaagtcatatgaaaaaagttgcagccatccattatatttttacaagtttccctgtatacggctcgagccttgatgactactaatccttttatacataagtaggattagcagcggcaactcgattctttgctatttttctttttctcctgatgaattcttttcgtttctcaaaatattctatgttcctatagggattcattccttgttttagcttaggataccggttggtgaatcattccttgtgttattatacacaaaggagctgagtacatacaattgtaaccagctcctttgtcttttccattctaataatacttacaagagtaatacagaatctaatcttatcctatctgtggctcaagaatcagaagatgataagatcagatgtgatgagatggaacagtattctatcttggaagagacagtcaaacaaaatatcgattatgatgttcttttgcagagttacccaaacgaagtacaactcgtacagggaatctatgagttgattgttgagactgtagcatacactggaaaaaagttagtgattgccagtaatgaactaccaacagaatttgttaaaaatcgattcatgaaactaaacttcatgcatatccagtatgtaatttccagcatgaagaaaaatacaaccgaaatcaagaacattaagaaatatttactcgctgcattgtataatgctccggcaaccatgcagggatattaccaggcagaggtgaaccatgatatgcaggactggtaagataggaggtacacatgtttattttaaaacttgctgggaagatattattactgccagtatggctgatcctttttgtgatcggcctagcagtgaagatgacagtacagacttatgcggttgtcaggggaatccttgggtttctattcactttgctgattatagcgactgcatactgttatcatgactgggtacaggttgcatttctattttcgctgagtgtaattctgtatctgatcctgtttgcaggagtattcgtggacactgtactggacatgacaagagaacgtattattgattttattatatcgtgaggaggatatgaaaatgagcgaaaacaatgattatattcagttaccaccactaaaaaaagacacaccagccgatgtggtagcatttatgtgggagtacatgaaagtaccggaggattcaagagaaaaagttaagaatctgcttaaagatgcaaatgaaaatggagtaaaaataagtcatcaggcaccaacactgtatgatgttgttccgaaagaagaaattgctgaatttgaagagcttatgcgcaaaaccatagctggcattgtatcagaagccagtagcgttgcctgttgggtgtatgtgcagaaatatgtgaagcacaaaaccctaaacgaaatgctgcaagaattgccagacgtaggtcaattcatcctagctatgaatacctggtttgaaaaactgatggagaaataatctaggaaaatagtttaaagtttacatgttatgatcatgtatgaagttggaacaaaataaaagaattgtgctataatatcgttcaagaaaaaactcattgacatatttcaatctatttaggaggataaacgatcatgtgtacagcagcaacttataaaacaaaagatttttactttggacgaaccctcgattatgaattctcttatggtgatcagatagtaattacaccacgtaattatgcgtttaattttcgccatgttggcgatatgaaaaatcattatgcaattattggaatggctcatgttgcagaggattatcctttgtattatgatgctatgaatgaaaaaggagtggcaatggcaggactgaattttgtcggaaatgctgtttatgctgcgcttaagccagatgtggaaaatattgcacagtttgaatttattccgtggattttaagtcagtgttcttctttagttgaagttcgcgagcttcttgaacgaattaatattgttaatactcctttcagcgagcaattaccattagcacaattacactggatcatttctgatgagaatgagtcaattacggtagaatctatgtcagatggtttgcatatttatgacaatccagtaggagtgcttacgaataatccgccatttccacagcagatgtttcaactaaataattatatgtatttatctcctaaacagcccagaaatactttctgcgaaaatttggctcttgatgcatatagtagaggtatgggaggattaggtcttccgggagatctctcatcttcctcacgctttgtacgtgtagcttttacaaaggtaaatgcaatttcaggtgaatcagaggaagaaagcgttagccaattcttccacattctcggatctgtggatcagcaacgaggatgttgcgaagtaacggatggaaaatatgaaatcacattgtatacgtcgtgttgtaatgttacaaaaggtatttattattacaatacttatgaaaaccatcagatcagtgcagtagatatgcatgtagaaaatctggatagtgataaaatgatttgttatccagtaattcaaggagaacgaatcaactatcaaaataaataatgttttgaaatcagggatgaggtagaaaggaaagttccatgataaaagatgaagtaaaaaaactcaggatgaacagtccggaatcactacagtttttaaataatgctacaaaattttataatttaatgatgatgtatcgttgtgctattcgggagatacaaactaaacttgaggttttggatgatgaattttcagttgagaacaatcgaaatcctatttcttttataaaaacaagaattaagcagcccaatagtatttacgataaattgcagaagatgggatatgaatttacaacagaaaatatacagacatatctcaatgatgtagcaggcgttcgaatagtttgtgcgtttattgacgatatttatatgatatcagatttgattacccaacagaatgatattaaagttattgaaataaaagattatataaaaaatccaaaatcgaatggttatcgaagctatcatatgattgttgaaataccagtattttttgctaagggtaaaacacctatgcgtgtagaattacagattcgaaccaatggtatggatttctgggcaacattggaacatcaacttcgctataaaaaaggaattgaagaaatgcctggctatgatgagataagtgaagaattacttcattctgcaagagctatcattgaagcagataatgaaatgcagagaataaaagacaaaattggtaagttccacgaaatttagggagaaaactgagcaagtaggaaggtggaatatatgaaacaagatactttagagggcaaagcaaaaacaaaaaatggggtaaaacggctgtgtttttccataatctgcattcttctggaagtgatttttattattactatcgtaacacgcttgaatgaatatgcagaaatcataaatttatttacaaggattttgagtgggatcttggttttgggattgtacgcatcaaataagacatcctctatgaaaatgccttgggtcatcttaattctaatttttccaattatgggtgtaggcttgtatttgttgattggtttgaatggtggcacacataaaatgcgtgagcgatatgcagaaattgatagcaaattgttaccaatgcttccggacagtcaggagtgtttgagcagaataaaagaaacaattccgaaagcaggaaatatagcaagttacatacaaagaaattcgcagtatccaatctatcagaatacggatattgtgtattttgatgaagcagtgaagggattagaggcacagattaaggatttggagaaagcacagaagtttatctttatggaatatcatgcgatagaagacgctgaagcatggcataagattcaagatgttctggaagagcgagtaaaagcaggtgtggaagttagagtattctacgatgatatgggttctataggctttattaacacagattttgtgaaaaagatggaggcaataggaattcattgccgtgtattcaatccgtttatgccaggtttaaatctgtttttgaacaatcgtgatcatagaaaaataacagttattgatggaaaagtcggatttacaggtggatataatctagcaaacgaatattttaattacacacacccgtatggacagtggaaagatacaggtattcgtttagaaggagatgctgttcagtcgcttacggtgacatttttggaaatgtggaatgcagtaagtgataaggatgctaatgattctgattttagtaaataccttttccactatgattatgcggcacagcaaactgggtttgttcaaccttatgcagacagccctatggataatgagcaagtaggagaagaagtttatatcagtatgataaataaagctgaaaaatattgttggtttatgactccatatctaatcataacagatgaaatgacgcatgcgttatgtctggctgctaagcgaggggtagacgtaagaattatcacacctggtatccctgataaaaaattcatttataatataactcgttctttttatcatggattagttaaacatggtgttcgtgtttatgagtggactcctggtttctgccatgcaaaaatgagtgtggcagatgactgtatggcaacttgtggaacaattaatctggattatcgaagtttatatcaccattttgaaaacggctgttttatggcagattgtcaggcagttgtggaaataaaaaatgatctgataagaacgatgggagaatgtcgtgatgtgacagaccaatatcaaaccggacgaagtgcatatttgcgactgggacaattatttatgagattatttgctggattgctataagaatctgatgaaacgacctttcaaaaaacagttgatttagaagttaactgtttttgaaaggccgtttttgctatatctaacagtctgttgtacaaagaagattttgcatggatagtgattaatacaacggagtaagaaaagctccttcatatattagaataaaaatatgactgtttcattaaaaagaaaccggtcatattttttatgaaaaataaattttgttgaggttaaattgagattgactttgtattgtataagtatgaaataaaaaggaatcaggtgatgtacaatgaaaaagcataaaatatgtaaaatccttcttgttatactggcaatttttttatgtgtggctttttatgaattgctcggaatctgcgttgcatataaaaagcagccggaagtgtccaatacaaccaaaaaagaaacaaaaaatgggtcatggaacgaatgcagtgaaaatacagaacgggcagtaatcatagaaaagaatccagaagcgcttttacaaagagtgcgtttgattaagaatgcaaaaaaggaaattattctttctacttttgcatttcaatccgatgaaagtggaaaattgatcttaggagcactgcatgatgcggcagacagaggtgtacatattcgtctgttagtagatggaatggagagctggattgatatggaaggaaatccgtatttctatggattatcttcccatgagaatgttgaaattaaactatataataaggccaatccgttgaaaccgtggaaaatgatgggtagaatgcatgataaatatttgattgcagatggaaagagatatattcttgggggaagaaatacatacaattatttcctgggggattttccgggacataagaactatgacagagacgtgttagtggtttgcgatgaacctgagaaagaaaattcagttaaccagttgttagagtattttgaaacgatatgggaacaagaagacagtggttattttcatgacaataaaaaactggcaaatagaaaatctgtaaagaacgcagttttagagctgcagaacggctatcagaaatattttgaagagaataaggaaagaatctgcgataccgattacacggacgaaacttttgagacagaaaagattgcattagtgtcaaatcctattcacacaggttccaaagaaccagtagtgtggtatcagttgggagaattgatgaaaaatgcaaaaaatcgtgtgaagatccacacgccatatattatctgtaatgatatgatgtataatacatgggaggagattgcagagaacgtttcagatttttctatcatgacaaattcagttgcgaataatgggaatccatttggggctgccgattatgcgaaaaacagaaatagaatcttaagtacaggaattaatatctgggaatatgaaggcggttattcataccacggaaaaagtattctgattgacgatgatctgtctgtaatcggttcctttaatatggacatgagaagtgcatatctggatacggaactgatgcttgtaattcgcagtaaagatattaataaacagttggaagagggcatgatggaatatgaaagagtgtcccgccaggtattggaaaatggaacctatcgtgatccatatcatgtagagccgatcgaattaacaaagaaacgtcagagaaaaatatttttggtacagcatctgcttggatgggcaaggtatctgttttaataaggaggaaggaaaacgtgtttcaaatattaattgtagaagatgataaagaattaagccagctattccaaaaagtgcttgagaagaatggatatcaagtcaaaagtgcatcggatggagcacaggcattagaagtattggataaggaatatattgatctgatcatttctgatattatgatgccggttatggatggctatgaactggtgtcagaacttcgctcagcaggatatcagataccagtgcttatgatcactgcgaaaggttcctttgatgatatgcgccagggatttctttcgggaagtgacgattatatggtaaaaccggtaaatgtgaatgaaatggttttaagagtcggagcactgcttcgccgtgcacagatactgaatgaacacaaaattgtgatcggttcaacagagtttgattatgatgcaatgacggttacaactgataaggaaagtcttgttttgcctaaaaaagaattcctgcttttatataagcttgcagcttcgccaggcagaacatttacaaaacaacagttgatggatgaagtatggggatacgagacggaggcagacccacatacgatagaggtacatataggaagaatcagagagcgttttaaagataaccctgattttgaaatcgtaacaatgcgtggaattggatacaaggtggtgaaaaaataatggaacaaaagaaagaaaaaggattgcggatccgatcctgtctgactggtgcaatctggctggcacttgtattttcaacagtcatatctgctttattatttgcttttttgaatcatttttttaatctgccgggcagcatacctgtgcttggctggcttttgattttcaatacattgattgcagggctgatcacttcctttatcaatgcaaagttactggaaccaattaccagacttggtaaagcaatgaaggaagtttctcagggagattttgaacagcatttggaaacgaacagccgtatagcagaagttggagaatcttatcaaagttttaacgttatgacaaaagaacttcgtgcaacagaggtgctgcagatggattttgtatctaatgtttctcatgagttcaagaccccgattaatgccattgaaggatatacaatgctgcttcagggagaagaactgtctccggatcaagaggaatatgtagaaaaaatcttatttaacacccaaagactttccggattggttggtaatattttgctgttatccaagttagagaatcagaatataccaatgaaaaaaacagaatatcgtctggatgaacagatccgccaggcatttctttcattggaaacaaaatggacagaaaaagaaattggttttcaggtagaattggaggaagttaaatatactgggaatgaaggactttttatgcatatctggataaatcttttggataatgcgattaagttcagcccttcaaaggggacaattacgatgtttctgaaacaagaacaggattctgttaagttcattctggaagatgaaggaccaggaatagaggatgatgtaaaatccagaatatttgacaagttctatcaggtagatggatctcataaagcagaaggaaatggcctaggtcttgcacttgtaaaacggattgtagatagtgccggaggaacaatcaaagcagaaaaccgtgaatatggtggatgcagatttgttgtagagcttccaatacagaaagatgaggccatataagtttaagaaaaacagatagaggaggaattacatgacattttatcaggaattgcagttaaatcaggcaggttctaaaaatctgttgaaaaagagtgaaacagtgaaagaaaaatcatatcatatactgctatatttggtaaagatagctgttacaatggcattttgtttttcatttgttactattttcagtatcttatttggaaatgagaatagtattgtgggtgtagtagttttattatgccttatggtatttcggaatgcggatctggggatccacaccggacaatctacgatgcttttggctttgttctttgtaattatgactgtatgtccgcatttagcaaatcagttttcaccggtattgggaatgctgttaaatattgcggcactggctgtgttgattctgttcggatgccataatccattcatgtttaatcaatctacattggttcttgggtatctgctgctatatggttatgatgttacgggaaaaagctatcagatgcgattagtcggaatggctttaggtgcagcacttacctgcttcgtattttatcgaaatcataaaaacagaacttataaaagaaatctgaaagatctgatacaagaatttgatatcacttcttccagaacaaaatggcagatatgtcagattttatgcgtaccgattgtcctttgcattgcagaactttgtaatatgccacgtgcaatgtgggctggtattgcggccatgtccgcgattttgccgtttatggaagatatgcactacagagtccgtaaaaggattgtcggaaatattgcaggtgttatatgttttacagtattatattttctgcttccttcgtcaatctatgcatatataggaattcttggtggaatcggtgtaggactttcagcacaatatggctggcaggcagtatttaacacatttggtgctttagccattgctgcagagacttatggactacaaggagcggttagtcttagagtgattcaaaatgtttttggtgttgtgtttgctttagcattttgtgttatattttattggtttatgtctaaaaaaaaggaaagtgaggtgaccgtacatgcagagtgaagtgaatcaggaagaaaatttgaatagaattattacggttcctaatcttctttctttttttcggctttgtctgattccggtaattatatggagttattgtgtaaagaaaaatcctctgttagctggtgaaatcttattgctgtctggtcttacggatcttgctgatggatatatcgcaagaagattccataggattagtaatttaggaaaaatacttgatccagtggctgataagctgacacaggcagcgatgttaatctgtctgtttactcgttttccgcatgtgcttcttttaatcgtaataatggcaggtaaggagctgtatatggtagtcagtggatgtcttgtgatacaaaagacaggaaaagtacatggtgcagactggcatggaaagatagtaacctttttattatatggaactgcagcggtgcatattatatggttccacattacaccgatggtatcagatctgttgattggtttgtgcgctataatgatggtcatatcggtcgctctgtatattatccagaataccaggactcttaagggagagactgtataagcaattttatattgcaatgactagaaaaatatttaggagaagatagatataaacagtaagtcaaacacacaaactatggagtctttagtcggtttaataaaattttaaatagaaaataaaaaaacgaaaaagaactgttgtagaagcctataccaaagcatgtaaaaaagctgatgcgatccttccttactcttctattcataacttcttttaacttaaattattatcaaagattactactaaatagctgcattcctttttggggaagcagctatttgtagttaaaagcagtaattttctaataaaaataaaaaagttgagtcaaatggttgtataagcctcctaaaacgtttctacatatgtagacaataacaaatcagaaagtgaggtaaatcatatgagtcagaaaagatgttacacagtaaaggaaatccaagaaatattaggaatcagtcgtccagccgtttatgcattactcaaaagaaaggaatttcattggatccaattagaaggaagtcgatatcgcatttccaaaaagagttttgatctatggttggatggacaatctgaaacggatagtttttgacatcctacccatttttacttaagacaggtatattactgatgaggtgacgaaaatgaatgtaaatgatcaagaagaacttgttcaggctctgattaatgatattaaccgtagcagcccatacaaaaagaagcctgccgtaaagaaaaaatggatgacagttcccgaaatgggaaacttattagggcttaagaagacagaccgctattggctgttacataaagatttatttctgcatgaagaatattacggaaaaatacggattaatattgatagttttgaaaagtggtatgccaaccagataaaatatcataaagtcacgggagaagaacccggactagagctgaagaataaaacatattctgttaaagacatttcaaagctattgggcatttgtgaaagctgcgtatatgatttaatgaaaaaggatatttttgaagttattatcgtagattactggaaacgaattcctaagaaatccttttggagctggtatgaaggacaatctcattacagaacccagcaagataaagaaaaagatgccaaaattgaagcggaatccataacaatgcctgagatggcaagattacttggaataaaaagaaacaatgtctattccttgctaagaaataagcaatattgttcctatttcgaaattgtagtaattggagataaaaaacgaataaccaaagatagtttccaaagattcttgaaagctcagagcacatatcaattgagtccaattaccgaatataaagaagtaaaacaagaaaagaatccgacgctttctaattatcgtacttcaaaattattaacttctaataatcgtgcggtgaatggaaacttgaagtatttaacgatggatgaagctgctctattagctaagatcagccgtggcatgatatcaaaatggatgtcagaaaaaaagttttcatttatcaagataggaagtcgagtccgtattgatcgcaaggaatttgaagaatggttaaaaatccgagaaatggaaggaaggactaaataatatggcgtctataagaaagagaaatgataaatacagtgtaatttactcctatatcgatgaaaatggaaacaggaaacagaaatgggaaacttatccaacccgtgctgaagcattgagacgtaaaaaggaaattgaattcaaacagaatcttggaaactttgttgttcgtaactgcaagactgtcgaagaactgattggtgaatatattaccttatatggaaaagaaaactggacctactcgacttatgagggaaatatgggtgtaatcaacaattatatacttccaattattggtaatgtaaaacttgaagatattaatacaagatttattgaacagtattataaaaaacttctaataaccccatctgtcataaattcggcaactggaaagaaaaagcatgaatatgtatcgccaagtacaataaaagacattcacaaaatactccgaagctgtttcaaacaagcaatgaaatgggaattaatagaaaaaaatccttgtacgcttgcttctgtaccaaaacacaaaactcagcaccgtgaaatatggaatgcagaaaccattttctatgcaatagatgtatgtgaagatgaacggttgaagcttgctattaatttggccttttcctgtactttacgtatgggggaactgcttggtttaacctgggattgtgtagatatttccaccgaagcaatcgaagaaaacagatcctatatatttgtaaataaagaagtacaacgaatcaagaaaagttctttggataccttggatgcaaaagacattctgtatgtttttccttcaagtcatacaaagaatactactcttcttgttctgaaaataccgaaaacagaaagtagtgtacgtaaagtttttctaccaagaagtgttgccgaaatgctgcaaaaatggaaacggaaacaacttaatacaaaagcaatccttggagaggaatataatgattacaacttagtgatgacaagtgaatttggctctccattagaatccggaacaattcgagtatccttcaataaactaattgaagaacatcatctccccaaagttgtatttcacagtttgcgtcatagcagtgtcacctataaattaaagctcaataaaggtgatataaaagctgtgcagggcgattctggccattcccagacagatatggttacagatgtgtattcccatattattgatgaagacagaaaaaagaacgctgaattatttgaagatgcattttacaagaaaaataatcttgagccaaatatggtttctgaagaagtcgatatggaattattgatgaaagctctggcgaatccggaaatgcgggcgttgcttaattcgctggctaagacaatgaagtaatgaaaagtagtgagtctatctccatcatgcctatagaaattattcaataaaagcgagcaaaacatcaatacaattgtattgaatcagcaatgaaatggcattataatgaagaaaaaaggaggtttctaaaatggcaagtacaattcagatcagggtagacgatgacttaaaaaataaatcagatcagctttttaaagatcttggaactgatacgacatcagcaataaggatgtttttaacgcaggcggttgcatataatggatttccatttgaaataaaacgaactgtgcataatccttatacatctatgacagaagaagagatgcttcaaagactggaacaatccagagaatcttcaaaaaagggaaattaccgaaatgcagatgatgtgatttcagatatgagaggaaaatatggattataaagtagttgtaacagctgaagcagaagaagacttgaaccattttatacagtatctgctttttgccaagaaaaataagcaggcagccaaaaatgtgcttgatgattttgaggatactattaaaaagttgaagtatatagcgagtagtttgaaagtatgcgacaatccacgtttacagagccttggatatcgtcgaataaattttcaacagcaccgatactttatgttgtacagaatagaaaatgatgttgtatatgtggatgatattttccatgagttacaagattatgaaaaccgaatgatataaattgaatattggcagtaaaaagagtatttaccgtaaaaccgcaaatgctctttttttgcacctatttggaaagaataaataatatagcgtctataaggaagcgttggttttaatggaaatgcactattggaaaatcctctaatttcaaaaataaaaagtagtcgaaatttccatagacaaatacacgctcacgttgtatattataaatataaatctagtcaattaaatatagatatcatttccacctctaagggaatggtagtcataggattgatgtagttagtatcattacatacttccccaaatattagctgtagctaaaaagttgctaacaagctgtacttatctaaggtttatagctgattacagtaattgactggataaaaattggaaagccgtttttcataagaaaaatcaggctttattatacagaacataccaaaaattgacagcaccctgtataactcctaagcgaggggtcggaggttcaaatcctcttggcgacggacttcaaagcgttcgaaaatgttagctggattagctgacaacgaacgcttttgttattttctaaacacgttcgtgacacaaaattccattcaaaaggatcaatttccagctaacattttagttttgctctgtatatgtacccctctatataacgaaacgctcagagcctattttacagtgggggaaaagaaaaaatatcaaaaaaataatgattaatggtaagcttgtgatagaatgaaaaaaagagaaaagcataaaggatatagttggggagaatattggttatgattagaaaattgctgaacggagatatcgatagagttgctgacatatggttaaagacaaatctgaaaacacattattttatttccaatcaatactggaaaagtaattatgaactaataaaagaaatgatgtcacaatccgaagtctatgtgtttgaagcggataaaatgatacaaggatttgtaggactaaatgatgattatatcgaaggtatttttgtctctgatgaaatgcagtcatgtggcataggtaaacttttattggattatattaaggataaaaaagttagcttacgattaaatgtataccagaagaatgccagagcaatttctttttaccaaagagaagggttcattattcaatgtgaagatttggatgaagctactggtgaaaaagagtacaccatgctatggaaacaaaaatagaaatcgggattgaccgaactgaaggtgaagaatgcttcttgtctaaagggcaagaagatggggattagaaagtgttttttacaaggagatgattaggtgaatgatcaattcatacaaggagtaatatttgattgggataaaattgataaggatagttatctgaaggaaatcagggcttttaagggagttgaaaaacttgattttaacaaaccaattactttttttgtaggggaaaatggcagcggtaaatcaactttattggaagcacttgccgtagcacatggttttaatcctgagggtggaacgaagaattatgttttttctacgcatgatacacattcagagttgtgtgatgcgataagaattgccaaaggctatcggaaggaaaagtggggatattttcttagggcagaaagcttttataatgttgcaacgcaggaagaagaatatgcagatattacacatccttccgctaaatatcatgaaaaatcacatggagagagttttctcgcattagcacagaataatatgaatccaaatggcttgtatctttttgacgagccggaagctgcattatcgccgcagagacagcttacattgttgatgcaaatatacagatgtgcaaaagagggagcacagtttattatagttacgcattcgccaattttgttaggaataccagatgcagatatctattgttttgataatggacgcatacatctgtgcgaatatgaggatacagagagttaccaggtaacagaaatgtttataaataataggcagatgctgttggatagattactaacagattagataataaagaaatcgataaattcaagtttatctattcaatcctctaaaaacgctgtattttcaaggcttttcgcctacttaatgttcaaaccttatgtattttcccttgtttttgcccttatgagccaaaacaagggaaacttttttattctccaccgactactttatccatcagccttgcggaattacgcttcgcttcccttgtagcgtgagcgtagatgttcattgtggtacttacatcggcgtgtccgagaagctcctgcacatctttcggtgctgctccgtttgcaagcaggttgcttgtgtaggtatgtctgagcatatgaaagtggaagtcctccagtccctcgacttttttccttgccgtcctgcacataatccccaccgtactcggtgcttcatacgctccatcaggtcttaagcatacaaaggatatttctttgtaaccatcgggaacttcctccattctcggtaagctgtaaacctcataataagtacggtctttttctttgacttccaagtagtagttgaggttgtaaagctctccgtagcggaaacggtttttgtgctgttcggtttttgccgctttcaggattgccgccagcgtgtcacagaagtccacggtacggattttctttcgcttcgttgctcctatctcggttttgtgcctgtccccgttataacggatactgcggcgtactgtaaggtactgctcgtcaaggttgatgtcccgccaagttaaggcacatacctctccaatacgaagtcctgtgtagtacgctatctgaatggggagcaatgcaggattatccttagctttcagaaattcttccagcttgcagtattgctcataatcaagagtaggtttggaaactgtatcactgtcctcgtcagagaacaggtaatattcctcttttttgcccctcatcacaacatattgcatcggattaaaggttatcagccttttcgggaataccgcaaagcggaacgccccctgcaggactgccgagaacaatctcagataccctttgctgagtgcttttgctgttgtaccgtcgggatttgtaccgccaaaactgagcaagtccatatacgcctgtaaatgatcggcggttacggttttcagctttctttctccgatagggtgctgcttgatacggttgactactccctgatacgacattaccgtaccattactgagattgcctggtttcagttcttcctccacccacatatccaacagcttaccaagcgttgcattctcggattttgctacgaatttcttttcctcgtagtcctccattgcttttcggagcagtgcttccgtttcggatttactttctgtgccgacatactctttttgtacctgcttaccgctttcatcttctacatagaagcggtagtaccactttttgcctttctttcttacagaaccttttgccatagataaaaaactcctttcctatccgtggcaaccggaactgtgacgtatggtgtgcgtaaagtaatagtgtcactcatcgactcttatgaagccgattttttaatgtcaaggtgccacgttattgtttctgtcagcaagtctttcttctgctgacatcttaatctgcgacatcttcccaaaaatgtttttggaattcaaatcgtagatatgtaagaaacaatccaccatctgtttcatatcttcgactggctcactcagttcgttgtggtaagccttttcggtaatctctccagcacctatggcatatttcatcagggactgctttaacccctcatcttctgcgatacggtctgcttctgccattgctcttgcaaagtgtccgcagaggacagcgtacatatccatatactgtccgagtatgttggtcagcatttcctgtctcggctctccctgtaccgttgatgtaagaacatcaaggaatttctttgtgtgttcctccatcgtcttttcacagacagtacgggtagagtattccttttcttcggaaagtcctgtcagccattcgggtgttgtgagcagcgcttctgcaagaccgttgataatcatagttcttgtcgggtcaactccgcctgcttcatatctttggattgtggatttgttcacgccgatacgcttgcccagctcaggcattgtgagatttaactctgttcggcgttccttcactcgttcaccgacctgttttgcggtgaatgtaatttcattcttcaaggttttcacctcctgacgagtattagtatagcatagagaaatgcaatttgcaacccttatccctgataaatattaaaaataattaataacaggttgcagaatgggttgacagtaggtagcagaataagtataattaacattgcagagttgcaaaatgagcattttgcaaaggaggaagatagtatgagtacagttaaaatgggattaaccatcgaagaagccgccgaatgtacgggtatcggcagaaacacaatgcgaaagctggtcgaatggggtaagctgcctgtccttaaagttggacgaaaagcgattatccgcagcgatacgctggagcattttatgacggtcaatcagggcagaaaccttcttgtcagagaagatgtacgcaaggttgactaaccgttctctcaagccctcggcgtttgagagcgaaatacacccctcgcacaaatctggcgatttgtactctgggtatttcgcccttgcagggagctaagtatcatcgcagcactcccatttctgcattgatacttatagaaaattgcactgcaattttcttcgctgtcccgccgacaataaccgccgaaacagcggcaaccgttctaacggttgcaaaacgagaacgcccgtcaagggagaaaggatactatggcaagacacagcttcatacagatgacgaagctgccaaatgtcaaaggacgcatttcgtatatcacaagcaaatcaaggcaggagaacctttacgccacctaccgtaccgctgataatgccttttggagcaaccttgcaagggaaagccagcaggaatttaagcgaagcggaacaaagggaaagtgtatcgaagcaagggaactggttatcgctctgcctgaaacgttcacacagtacgagccacaggagctgctggaacggttcacggacgagttccgtaaaaggtatggcgtagaatgtgtatcggcactgcaccacaacaaacgcaagaccaattaccatattcatctgatattcagtgaaaggacattacttcccgaagctgacatcaagattgccagccgaagcgtattttatgatgaaacaggtaaaagggtacgcaccaagaaagagataaccggcgaagacggaaaaatccgtcaaggctgtaccgtcatcaagaaaggcgaggtttatgaaagtcatctgttttcggtaaaagatgaccgctacaaaagcgaagcatttcttgagggagaaaaggagttttacaccgcccttatcaacagctatatttccgatcccgaacagcacctgaaagtatttgataacaacagcgtgtatctgcctaccaagaaaatcggcaagaacaatccgaaagaagcggaaatcaaagccgataatgaagcaagacaggaatggaacagaacagcggatatggctcttgttacgggaattgcagaagcaaagattatggaaatcaagcagaccgagatacaggacaaggcaagcaagtccattcgcacaagcggttggctgcccgatatgttccgcagtatcatcggcaaagcgaaagattttctgcaaaatcttatccatgaacaggatatgccgccgaaacctacgctcaatatcaatatgacggagttccgcattatgcagcagcttatgatacgagtgcaggacagtgcaaaggaaatcaagcatttgcagaaccgagtattgccgaagctgaaacaggagctgaaagacaccgcagggcttttcaagggcaaggaacgaaaggcacttgccgagaagatacagcagacagaggacgaaatctccgtaaagttggacaagctccccgatattctgaaagaggacggttatcccgatgttcaggcatttatggcaacctaccgtgaaatggagggtgttgtggaacgctatgagcgtgaggtatgggaatacaatctgaaactcaagcagaaagagaagccagccaagaaaccgcccgaaaagcagagcgtcagagaacatctccgacagcttcaggaacagggcaaacaacagtctcacaagaaaaaatcctttgacagagaaaggtaactttggcaaagaaaaaccgccgctatggctttacccatacacggcggagtacatagtgacatcggtctattttagtatgcaaacaagattattctgcttattatttgtattttttgaatatatgtttgaaaattatatgaccacttataatttgaaacatcatatatgcacacagataaaaaacaaatatttttccgttctccagaatttctaacatgtcaagtatagcaaacaaaacaatcgatgcagatataatgcaaagtccaaaaacatatacatatcgtgctgtcatgccacgaacttcgttctttagctcatcgtgcaattcaatgttttcggcttctaatttttctttatagcgttctacattgtttggagagttccagtaaaaatatttataaatcattaccatcccaggaataattccggctccggcaaagccgaacattaaactgtctaatttagtatcagtaaatatcccgataagtaaaaatataatgcctgcaactacatacgctatcccgcataaccaattactctttttcattcttgttacccctttcgtggataaaaatttcatcaattctctttccaaaaaaatcagcgatttcaaatgccaaatccaaagatgggttatattttcccgtttcaatggagcttacagtttgtctcgaaacccttattgcttttgcaaaatcttcttggttcaatcctaagtgttttcttaattcttcaactctgttttccaaatagcaccgcctccgttgacaaggttcctttacatttatataatagcatcgtttcgaaaagttgtcaagtttcctttacaaaaaaatctgatgttcaagataaaaaacgacagagaatcaattccctgccgcttttacttatgcgtaaataatttcgctgtttatgacttcctctgcacgattgtgaatgttattcattaactgtacccataacataggttgctcagcattgagctgtttcgtcacattctctttcgcagtcatttccttaaccagtcgataaagcatactctcagcttgttcgttgatgtcagcaagatagctgttaagtttaccgcttattagaagcgttttgtaagttgcgttcttatactctttcagatagcatttgtgtcgctgcccccaaatgccaataggtctttcttcttcggctgataagataagacaagggatataataatctccttgcagttcgtaccaaagcccgttgctttcatcatagatatacttgtccattcaataaatcctccagtataatatattcgtacatacatcacagttctccgattgccacactttgttatatcttgttatcagattttcttgcccttgcgttttcccttatgagggaacaggacaagggtaaaacagtatgaaatcatataaagggataaggtgaacacattgcgataaatcctttgttttcaaggcttttggaggattttattaaagctctgtgagcttcaataaccacttataaaatcgtggttttcaaattcaagtttatgaaagcatagagtgtatggattcaaattcccatatactctgtcataatccatatactgtctgctaatagtatatgcaagatgccgctttcaaaaacaaaattttttttattttttgaaagtggaaattatgtaaagacaacctgattctttacttaatttcaggaaaaatgcagtaaagaaatgtcaccattttattatatccatatttacattctgcaatctgcctatttcgggaactactccctgtgcacaccattcatatgtattgtctgtgccatgcctttctttacaatcttcgaaaatatatatcctgtcagaaccgatatgtcttccgaaaaagcggataaattcattaatctgctcgtcaggtgtatggtaattaagtgcggatctaagtgcttcatttatgaccagttcatactttatgattgtcttcatgttgttttcctcctgaatgtctttcttatcttacttttttacattcaagccagacggaaagtccttcttttattttctgctcttccacaggtttcataaaaaaatattctatccgcagtctgaacgcatgaagcgaaaaatcaaggtcactgcaccagatgattccacatttcggatacagggaacgaagatgttctgctacattcagaccggacacccccgataatgcgagaagcaccactgtcggtactgttttcaatgtccatgcaaaaaattgttcttgattctgataaatttcaatcagcggaaaaatatgcttctctttgaagtaatttctaatatattccgcactgtcttgtccttcctgttcctggtcggtcaatatagcaatacaatacacaacacccctccctttccgtttaatgtactttcatttattattttcattataaaaaagtcagaaactatttcaacaatcctgtcacgaaatgacagaaaatgacacgaattacaactccgtggtattgttttgtgatatactgttaccagaacgttttcgaaataactacaccacttgcttgtctgcggattcgattgcacagatgaaaaaatgtcactgtaaacgaagtgtgcagtaacaaaaaagtctcagcaagcggaattttataaatatatataaggaagatttagtgtgaaaattgcaattgttgatgatatttcagaagaacggacactgctgcgaaacagactggaatctcagttttccagacgcaatgtccttgcagatatatttgaatatgaaaatggagaaactttcctcacttcagcgaaggaatgtcctttcactgtagtgtttctggatatttatatgaatggatttaacggaattgatacagcaaaagaacttcgaaaatcagacactgactgtctgctgatctttacaacgacttccactgaccacgcattagagggatttcaggtccgggctctgcattatcttgtaaaaccctacagtgaaaatgatatttccgcactggcagatgaaatcctttcccgcatcccggattccgggaaatacatagatgtaaaggtaaacggcagtaatattcagattcctttccgggaaataatctacgctgaacatttttcccacatgatccacatccacactgccggtgaaagggaactggtcacccgccagtcctttgattccttcacaacctccctgaaaatggactcacgtttctatcaatgtaaccggggcgttgtgatcaatctggagcatgccgttgattttgacggatcatgctttcgccttgataacggaagtaatgtccccgtcagccggaagctgctcaaaaatgccagacaaacatttatggaatttctgttccaaaggaggtgcctgtgactttgactattctaccggctatgtccgtatttaatataatgtctccgtcattaaaactactatatgataattagggagactgtccgccccggataatctccccaatttctaccccctcttctcttagtcatttactgttttttctttgacttcttccctttattattcggttcttcgttcttccctttgtctcgtttttctaatattcttccaactgtcatagctaccagaataaatatacaaagcacagcgcctatagtagctataagaatctcgattggactgtctattggttctattttatatttaccttttgaagttcgataaacagttatagtgtcttcatctcctattttaactctatgataaacggtgcctcttcctttataagtttccccttcaacttcatatgaataattaacatcatattttatcatcctagactcttcatcttcttttgcttgagtaataactgcactcacccttcgaatatcagtagaattttcaaactctttttgtttattaatttcattgaatatgcagaagatgcatccaaccactccaataataaataacagatatacgcctacaatttcccatttttcattcttttttttatccataatttttcgcctccccggtaagaatattctattcattatgttatattcataatacccgattattcatatggtgccactatcacttgtgttagtaatcgaattaatttgtttactccagcgtaattgaaaagataaaaagtaattggaaaggcgaaaccatagtagaacgactcaaagcatttcgcaagcatccattccaagtaaaactcaagaaggtgatataaaatctgtgccgggcgattctggttattccctgacagatatggtttctgaagaagtcgatatggaattaatcatcaattccgtatttattttccagtgcttcttctgctaattccagttcatcttccagtttttcaatcgtgcgttctctcgctttgtatgtctcgaaactaatctctttcatctggtaagcatactcaaattcatcgtcaagcttatccagttcgtcatcgactgcgtctacctgttttttcaaagcgtagaattgttcgtgattctcagatgtatttgtaaatgtttttgcattgtttacactttttgttatattacggatatcgttttcataagaagagaaatcataatccttttcgttcgcattctctactgcattttctgtgttactgatattatcatcattgtcatctgtatttgatgtcacaacttcctgtgtcttaatttctatatcttctgctgctccattattggatgaagtgcatcctgtaaaagcaaatattaatgtgagagataataaaactactaatatttttttcataatgtgttctccttccgtctcttggatgttttgtttttgctgttatatgtatcatatagggggaagattaaaaaaaaattaaaacaaatagtaatttcaaaaaatgaaaaaaaaggactctagcacacgaaaatgattggtattataataattacattatgagattactgattgtagaagacgagaatgatttaagaaacattgtcaaaaaaaggcttgtcaaggaacattacagtgtagatgcctgtggggatggtctggaagcgatggcttatatcgatatgacttcctacgatggtattattcttgatatcatgttgccgggaaaggacggatatgaaatcttaagagaattaaggcaacgagaagatgatacaccggttctgttactgacagcaaaagacagcattgaagaccgtgtcaaaggactggatcttggtgccgatgattacctgatcaaaccatttgcatttgaagaactacttgcaagaatccgtgtcatgatgcgtagaaagccacaatttacatccaatcaactaaaaatagcagatcttattctggatcgtgacacaagaaaggttacaagagccggaaatgaaattgatctttctgcaaaagaatttatggttctggaatgtcttatgcgcaacaaaaatatcgtaatgacaagacagcagattgaacagaatgcgtgggactttgattttgaaggtggttccaatgtgatcgacgtatacattcgctatttacgaaaaaaaatcgatgcacaatatgaacaaaaactcatccacactgttcgcggtgtcggatatgtaatgagggaaaacgaatgaaacagctgacgatcaagaaaaaaattacgctatggtacaccggaatcattgccgtagttcttgggactattttagttctcgtccttctttttgtggatagggttggaatttctgcgacagaagaagaaatcagtgccgcagtgactggtttctcttcaaatattaattttcaggatgattccttttatcttgacggcgataccgaattttacgatgacggtattatgttttgtatttatgacaaaaacggacgcttactttatggaacgattccaacccaatttccagaagaaactatcctcaagtcgaatacaccgcgaatgataaccggatcaaatcgaaaatggatgatatatgacagcgtttacacttacggtgatgatgaggaaatgtgggtacgaggaattacctccgtacattctatagaacttttcatgcagacatccgagaaaatgctgttgattgtattcccattactcattattctgatcggggccatcggatattttatgatcaagcgggcattgagacaggtggatcttatctgcgatgaagttgaaaacatcagcaatggaaaagatctttccaaacgattgtctctgccaaaagcaaaagatgaattatacgaattgtcggagaaatttaacgaaatgttcgagcgcttggaattttcgtttgagaaggaacgtcaattcacatcagacgtatcccatgaactgcggacccccgttgctgttatcatttcccaatgtgagtacttattggaaaatgaaaacttatctgcggaagataaggaagagattacagtcatcttaaggcaggcaaaacgaatgtcaaagctgacaagcgaaatgttaatgatcgccagaaacgaacagggtgagcagcatctgatggaaagactggattttggattattaagcgaacttgtaatagaagaactgcagacaaaagcacaggaaaaaaatattgaaatcaccctgcaaaagcaggacgacttatttatgaacggcgaccagacattgattttgcgtatgatgatgaatttaataaccaatgccatcaattacggaaaaacaaatggacatattcatgttatcctgaaggtcgaaaatgaccagattgtcggtgaagtgaaagatgatggtattggaataagtgaggaacacctggacaaaatctgggagcgtttctatcgcatagacaaaagccgttccagagaaaatggcggtaccggtctcggtctttctatggtgcgctggattgtaaacctccacaatggaaccattcacgtcgaaagtatcgaagatatcggaacgagttttattttccgatttccgaaaatataaggggctatcgctatatatccaattttttttaccaaagagaagggttcattattcaatatgaaggtttggatgaagctactggtgaaaaagaaaggcccgtatccgttctggatatgagccttgcaagaattggagaattgtaatccttagattttacaagtaaaatctctccagttttgttttaaaaaattgaatcaatggaccgttgaagcaggcatttataattgtaccaatccctactaccgaccagatacccgccccagatgcagtggcaaatatgattccgataatcacaacaacaacatccgaaagaatccttgctttatggaatgggattttttgatgtgtcagtttctcgattataattgcgacgctgtcatatggagcgattcccatatctgcgaccatatatagtgccactcccatagatgccatcagctgagcaagcagcagtgcaaggatacgcagtggcagattcatctgaatctgcactacatcattcgctacataacaaataaaatctgcaatatatccgacaaataccatattgataatggtccccaaaccaatacaggatcttgcctgaaagaatacaactacaagaatgattgcattgacaagcaactgccacgttccaaagctccatccgataaatccgctgattccaagattcattgcactgaatggatccacgccaaattgtgaaagtcgtaagaaagatacacataatccaataaacaatattcccagtaccattccgctgattctttttgtcttcgtcatgctctatcttccctcctgaacttttttgcctttcagcatatatattctagattcaaaatcggtacaaggagtcacattcccaggcacttcaccagctgtcacatcggatgtgatcaatccataattcattaattcatctccgtaattttctgtatggttccatacattttcataaaccatatccgggttcaatccctgtaatctgacacggctatacggctgattcactccatttaaaacacgatagtatcctacgattgcaagcgtgcggtcttcatttgtcaccatccataccgtctcatttccttcgaatggacttttcagacgataaaatgttccaaactgtaacacttctcggtattctttcataaatgtgatctgttcttttacttctttgatctcttcttctgtcagtttgttgagatccagttcatatccaaaagttccaaagtatgctacattcgctcttgtatgtaatggagtattgcgaaatacctggtgattcgggacaacagacacatggcttcccatactgctgagcggataacacatagaagttccatactgaatcttcagacgctcaattgcatccgaatcatcacttgtccatccctgtggtgcataatacagcattcccgggtcaaatcttccgccaccgctggcgcaggattcaaataatacttctggaaactcatttgtcaaacgttcatacagatcatatacacctaaaatataacgatggaacacttctccctgtctgtctgaaggaagtttgctgctgtagcattctgtaatgcttcggttcatatcccatttaatatatgagattttcgactccgataataactttgccatcattccgtaaatatgatctactacttcttttcttgcaaaatcgagtacatactggtatctgccgtgtgatgtatttcttcccggtgtctgtaagatccagtccggatgtgctcgataaagatcagagtctttatttaccatctccggctcaaaccaaagaccgaattttaatcctagtgcttcaattctttctgacaggcctttaatgccatttggcagaagctcttcatttgccacccaatcaccaagaccagctctgtcatttcttcttgcgccaaaccatccgtcatctaaaacaaacagttctactccacattcttttgctttccttgcaatctctacaaggcgatcttctgtaaagtcaaaataagttgcttcccagttgttatttaaaatcggtcttgccttatcacgccagtaccctcttgcgagtctcttagcatacaacttctggaacgtctgactcatgccatttaatccattttcactgtaaaccagaactgcttccggtgtctgaaagctttctcccggttctaatttccaatcgaatccttccggattgatcccggctgtaattcgtgtcacatcatgtgtatctacttctgcctgcatacggaaatttccactgtatacaaggcttattccaattgcttctcctgcattttcatctgtgttgtgacgttttaaagcaaggaacggattatgttcgtgagaagaatttccgcgcatgctgtcgatagctgttatgccctgctccaatgttcgattctttatatagcgctctctggaccacgcaccggacaactgcatccattcataatccttatccggaagatccaggcttaaactcatcatatttaatacatgcagatttttctcaccggcattttcaatataagcacttcttgcaattgcactatattcatcaaaaatcgtatataaaagcgccagttttgcaccagtcaaagcgtctttcagaaagatgcgcaatgtctgcgcttcctcctcggactctgtgtaagttgccggcaatccggagagtttcggttttccggcaataatctcatagctttcatattggaactcactgattctgctgccattttcctgcaacaattcaattgccggatgtctgtaatctgtcgtaccgtaaaccggatattcctgtcggatatgttccaatgaaaaagtacgatcccattcatatatatatgatgtcattgggcgtccacatttttcaaccagataagaaaaatctgctttatcatgaagtcgttttccaaaatataattgtcccagatgtccattttctaatacacataagatataactgattttttcattgtataaatggaaagttttcgtttcctcgtgaaaaataatctgtctcatatactaccccttttataattgaattgttgactcttaagctgtctgctttttcgcatgcatttcatttacttttcttgtgatttcttccatcttctcaccttttaaagtgtagtattttttgtaaataccaaaactagcaaatgcaagaatgattggaattacaatcattaacacgcgaatacccattactgttgctgcgctctgcgttaccgcttttgcgttgtatcctacaatctgaagaccaattcctgttaatccacctgctgctgccatagctgccttcataaggaatgtctgtgcagagcatgttacactttcatttcgtacaccaaatttcacttctccatagtcgataacatctgccatacagcatgttgttactccaagtgaaagacctgatccaaagaaaagaagcgcacaacatacaataactaacactttgctctgtggtgctacatatcctgctacaccgagcagtacaaatccaacaatcggaagtccgcatgcaaatgcgtatactttttcacggctaattttttctgcgattttcgggaagcataaaagtcctgccatctcagcaataatcgcaagtccaaaaatagaatacagatattcatcatggcatacacatttgaaataatatacagcaaagctttttgcaatctgtgtacaaaggttaaatgtcaaaagtaatccgataaatgcaagcagctgatcattttttacaattacctgaaatgcctgtttcagacttgtcttttctgctgatgtacctaatgttgattcctcttttacattaaatacagtaatgccgattgtaacgatgaaaataactgcgataatgattgcgaaaagtgtatatcctttttctgcgtagagattgctctcgcctgcaactttgttcaggtagttgataatataaagcccaaatgttgctactgaaaatcctgcaagacttgcgaaaaatcttggaattacggatactttctcacgttcgtgaggatcatttgtcaagttcggaagccatgaccagtaagggacatccatgatcgtataagtcattccatataagatatacataacggatacatatacgtacaatgctgttcctgacagattaaaactgtggaataacaaaacaaatacaactgaatttaccaatgttccgattacaagccagattctgaatttaccaaaacgtgtatgtgtattgtcaacaatcattcccatcatcgggtcattgatcgcatcccatattcttgccacaaaaaacagtacgccgacaaaggctggtgccagatacaatgtatctgtaaaataaagcattaaaaatgctcctactaaattgcaaattgcatctttaccgattgccccaattccaaaacataatttttctcttgtagacgcatatttatattgcggatttttctgagtttctttttgatttcccatgattctcctcctctaacactcatttgtttatttgttgtttaagtgaagaaacctgtgcacttgttccttatgtttgttgatacaagtatagcgtacaaaaaaaagcatccgttatacctttttgttaagagttatatctcaaatgttaggtatcagatgctttttttaacattttatctattctttttcgatgtttcctacataaattgttttatgcttcttatattctttcagttcattttgtgcacggatcaatcgttctcgggcatcctttctgttgtcattacgatattgggtcggcgttattcctactttctgcttgaatattttaccgaaagcaagggaattacgatagccacaggaaactgcaatctcctccacagacagatctgtaagtgcgagctgctcctttcctctggaaattcgaaattccgtcaaaaaatctttcggagagattccaatactgttcataaatattgtatataaatagcttcgatttagtgccaaataatttgctatatcttccactgtgattttctgtgaatagtaattctttatataggcaattgcttcctgcacatgtatgctttcttttgtatcattcgaatattgctgaatttcaatcccacgagccagtactgagaaaaactgatagagctttccctggagataataaagattttctgcagttgaactcgtatgatgaagcatttcaaatacaatttctttcagttcttctccatattcacactcgcatgtaagctgacgactgttcagtccgagatctctgacaaatctctgtgcctccgtaccaccaaatcctacccaaaggtaagaccatgggtccgttttatctgcctgataaaaggtaaggctttccggctcgatcagaaaggcctgcccttctttcagctgatacttcgtttcaccaacctgatagatacctttgcccttcattacataatgcaaaatataattgggtcttgcggccggtccatagctatgtaatggcttacattctgcaaatccgcagaaacacaaatgaaaatctttaaactttggttttaatagttgtaatacgtaagaatcttccataatctgtatcctctcttaatccctaagatcacaagcactttccagtcatgcttacttttgctgttactcactcaacaatagttcgtttaaccatttttcttattctatcacagtatcgtgttattcttccatcagttttcaagccaagtactaaaatgtaaaaaaacttgcaaatccatcttctttccgttaatatattgacagcaaacagggaaaggaaagaaggtatgtttcaaacaattattggtacaatcagttcttttatgtacagcaaactgctggtcattctactgattggtgcgggagtctattttacaatctgcacaagatttccgcaagtaagattatttaagaatgcttgtggatccgtgatggaaaagccggaggataaaggggcaatttcctcttttcaggcacttatggtttcaacagcatcccgtgtgggaacgggaaatattgtcggggtttcatcggcgatttgtataggtggatttggttctgtattctggatgtgggtgattgcgatcatcggaagtgcatctgtgatacggtcaaaaatatttatttctgattgcgtggtattctttgatacaatcgcaactttcacacagaccattgctggctgggttgtactggcaggaaagaacgtggcacagattagtgatggaatatccaatcctgtcgttgctggaattataaactggctgataagaatattgatttgcggtggatgtctggtgggtgtgggaatacttttggcattcatcgaaataaagattgcagggctatataagaaatactgttgggatatgattaccataatggtgatactcgtaagtatggcaatagcaatctatttcgcagattggataaggacaatattaccagtcaatctactgtttctattgttattggtacaggtaatatatgtcgtgataagatggtatgtgaaaggctggcgggaaacaaggggatattactaaaacatactataccatgcctaaaactgttaaacaataaatcggcataattggtcatttcatgatgcaagataaaaagactgattatgtcgatatacagattctgtgaatgaatgaaagtggataacttgttttgtccgagcaagggaactataatgttttggtagaagtaaaaaagacaaccatttggttgagaaaaaaagatgcagaaaaacctattgacggaagaataaaaaatcaaggagtaatcatgatagaaaacaagataatattgattgaagatgataaagaaataagaggaatgataaacgattatttatcaggagaatttgaagtgacagcttttaatgatggtatgtcagctatccagaaaattacaagctatgatgaatatgcgcttgcgcttattgatcttatgttaccggatataagcgggatggagattattaagataattcgtaaagtcagcaagataccaattattattattactgctaaagacaatgatatagacaaatcattaggattgaatttgggtgctgatgattatgtggtaaaacctttttcactcattgagcttactgctagaataaaggctaacatcagacgagcaagaacctaccaggcgttaccgaatagttctattatcaaaattaaagatatagaaatcgaccctcatagtcacatggttcagcgcaaaggagtaaccatagatttaacgccaattgaatttcaaattttatacattttagcaagccatccggggcaggcttattcaaaggaaaggctatatgaactgatttggaaagaaccatattttggaaatgaaaatgtgttgaatacacacatcaatcgtcttcgcttgaaattgaagagcaatgcagaagacagtacagcctatgttaaaactttatggggcattggatataagatggaggagaaatagatgatgattttatttgtggttctttcatttgttatggtttttatattgatctggcaacagatacagcataaaaaattagtacgagaaattgattatattacaagtaggcttgatactatttctgtcatttctgaaaatggctttgtacttatacctacagataatgatagtatcaagaaattaagcgctgcacttaataagctgcttcaggatttttatacaaaaaagtcacaatttgagcagagtaaacaggcaatggcgaaagtccttacaaacatctctcacgacatccgaactccactcactgttctaaaaggaaatagtgaaatgctttccaatataacaaacacttactctgcatctgaaaatgttcatgctatggctgttaaaatagaccaaaaggctgatgatttaatctcaacaattaacgactattttacaatgtctaaaataacttctggagatttttctattaaaatgaaaaaggaaaatatatcaaggatttgccaagatacaattttggactactatgaccttcttgaacagaaacaatttgaagtcaatattcagataccggatacaccgatttttgcctatacagataacgaggcgttacaacgcattttaaaaaatctgatagacaatgccatccgacatggtggtgatggtaagtatatttctttaaggctcaccacatcaaatggaaaaaacattattgaaatagaagatcgaggagatgggatatcaccacagcagcaaaaacagatctttgaaaggaattatacaacagcccgaaaaacttccggcagtggtttggggctttcaatttcaaaatgtcttgctgaacaaattggggcagacttagaagtttatagtgtacaaaatgagcaaactattttctcaatcatcttgaaaaagttagaaaatcgttagatttatgacagagaaaagagaagtccattttgtataatggcagctataaaggaggcacacaaaatggattatattatggaaaccgtaggtttgcgaaaagcctacaaagataatattgttgtagacgatgtaaatatgcatatatctaaaggggcaatatatggctttgttggtccaaacggcgcaggaaaaagcacggttatgaaaatgattttgagtcttatccagccagatgctggagaggttcagcttttaggcgaaaaagttaccagtcacagttatgaaatattcaaaaaggttggttctattattgagaatccatacttttacgataaaatgactgccagacaaaacttagagttgcactgtgagtatatgggatttcccaacaaggaacgaatcgatgaggttttgcatttggtggacttgcagaatgtcgagaaaaaacaagtttgtcattactcgttgggtatgaaacaacgacttgctattgcaagagctattctggcaaagccagaatttttgattttagacgaaccgatcaatgctttagaccctgagggtattcgtgaaatgcgaaccctttttcaacggctaaatcaagaagatggaacaactatttttatatccagccacattctatccgaagtggatcttcttgctgatacgattggaattattcaacacggaaaactcttaacagaattacctatcgaagaaatccataagcatcaaacagattatatcagcttgcaggttgacgatgtgactcgtgttgctgcactgcttgaaaacatgagaatcacgaattttagtgtattagataaagaatttatccacatttatgattctgatatttcaggtaaagctctgtcaaaagccatcattgagaacgggattggtttggagagcatgggacgcaagcaagacacactggaagatttctttttccagcttacagaggaggaaaaatgagatgacacatttgatcaaactggaactgaaaaaatttggtattgcacaaaatattatctttatgtttgccgcaattcttttcagcatccttttcattacaatatctttatgggatagcatgacagaccccaaacaggtcaaagacacatttgaaagcacataccttgtcattggcttattgatgtcattcatttttcttgtgtactcgtcggtcttaacggcaaagctggttattggagaatataatcatcgaacaattacgattatgttttcttatcctttaaacagaataaaattgattgccagcaaattaactataatcatggtttatacagcgatttcaatgacgattggatatatctgttgtagcagttatattatatttgcggataaatcctttaatatgctggagggaacatttcaaccatcaatgctccgaacatggataccaatggcaataaccactgtgattatatgtatggtgctgtctctgtggtcatttattattggcatgatcagaaaatctgttcctgcaacaatcgttacttctttgattgttattgtgttacggcaagttattatcaccaaaaacacaaccaatcaggagtccataatgcaagttatcttatttgctattgttaccgtcattgctacactacttatctttaaaagaaaagtgcctgaactatattgattatttctatttttacaaatggtaaaagaaaaagccgtcgcaaagcagattcaatttcatgtatttatataacggcggctttgatttttaaagtcaatgtttttagtgattacacaaacagatgacaacttacatgtatgtggtagctgacgtaagtttggattattttaaaagatttccaatgaatcttccgcatctacccacatctgcatattcccatccagatataatcgtacatattcaagcggttcatcaattgcaagtgcatttaatgcacaatctgagccaggcgtagtttttaaattcttttctgcttcccaacagtcaatgcggagcatatagctcgcagaggtataaacatcaacactattacgttgtggattgtattctgcaaatattgttctcattgtatcaaatctccttatcattcaatcaatcatttcttacaaaaatcagaagcgtttcaatcagttcaccatgtcattttcattttgtgctataatgtgttatcagttttttgcccttgtatttgcccttatcagagttcgtaaacactggtgggacgatataacacaagggaaacaatatgatacggtcaaaaatatttatttctgattgcgtggtattctttgatacaatcgccacttttgtacagaccattgccggctgggttgtactgataggaaagaacgtggcacagattagtaatggaatatccaatcctgtcgttgccggaattatatactggctgataagaatactgatttgcggtggctgtctggtgggtgcaggaatacttttagcattcatcgggataaagattgccgggctatataagaaatactgctgggatatgattacaatactggtaacacttataagcatggcaacagctatctactttgggaagtggataaagacaacattgccaatcaatctgctatttctcttattattcgtgcaactggtatatgttggaatcaggtggtatgtaaagggatggcgagaaacaaggggatatcattaaaacaaaaataccgatattttattggtactatatgtctttactttcgtgctaatatatattatcatattagcacgaaaggagaaaacatatgactcagtttgaaaaattagatttgttgttgcgtgaatgtggagggacaattcagacatttcaagttctaaataatggaattagtaagtctgtgttttatgcatatgtgaaggaacgaggattagaacaagctgctcatggtgtgtatgtatcgccggatacgtggacagatgcaatgtaccttttgcatttacgttgtggtcaagctgtattttctcatgaaactgcattgttttttcatgatttaacggacagagagcctttgaaatacaccataacagtaagaactggatataatccaagtcgtttgcaggaagacggttttcaagtgtacacagtaaaaaaggatttacatgaaataggaatcatagctatgcagacatcattcggacattccgttcccgtttatgacatggagagaacaatttgtgatctgcttcgtagcagaaaaaatgttgaaatgcaagtctttcaagacgcattgaaacaatatgcaaaacgtaaggataaaaacttacggatgcttatgaaatacgcagctatgtttcatgttgaaaacatacttagaccatatttggaggtgttactttagatgataacaacggcaagacaattaaaggatttaattcgtaatatgtcaaagaaaaaatccgcagatgcacagattttgatgcggaattatatgatggaacgttttttagaacgaatttctttatcagagtataaaaaccagtttatattaaaaggtggaatgcttgtggcggcaatggttggtctggatgccagagctactatggatctggatgctaccataaaaggcactaatgttagtgtggaggatgtagaaatgattatatcccaaattatatcaattccactggacgatggtgtttcatttcgggtcaaacggatatcggaaatcatggaagaagcagattatcctggtgttcgtgtaagcatggaaacgaaatttgatggtgtaatcacaccattaaagattgatatttctacaggggatgtaattacaccaagagaaatcaagtacaaatttaatcttatgcttgaagaccgcactattgaggtatgggcatataatctggaaacggtattggctgaaaaattggaaactgttgttagtcgaaacgttacaaatacacgaatgagagatttttatgatatttatattttacaaaagttgtatggagaacaactccaaaaacaagttttatggactgcacttgtggctacagccaaaaaaaggggaacattagacctgatagaagctgaggatataagagaaatatttgatgaaattgaatcaagtccggttatggagaccttatggaaaacatatcaaaaaaattattcttatgctgctgatatttcatggcatgcaattgtgaagtcaatctgtgcattatatggaagtatattggagaatatgtatgacacataaaaaaatgatatgtaatttacgttagcattttgagttgcctaaattcgaaagttaggaaaatcttaataatttctcaggcaatccattgtgaatttagatgttgtatttgctatacttaattggaaatatgagcaaaggagttgaaaatatgtctgaaaagatattgattatagatgacgagcaagatatagcggatctgttggaggtctacttgaaaaacgaaaattacatcgttcataaattttactgcgcaacggatgccatgtcgtgtattgaaagcggcaacattgatcttgccattctggatattatgctcccggatatgaacggcttttcactttgccagcttatccgaaagaaatacacttatccaatcataatgctaacggctaaaattgaggaaacggataaaataacggggctaacattgggagcggacgattatgtgacaaaaccttttcgcccacttgaagtagttgccagagtgaaagcacagttaagacgttacaagaaatattcgcccggtatcatcatagagaaagttccatcggaactttcctataacaaattgtgtttgaatgtgcagacccatgaatgtttgttaaacggtgagccggtttctctgacaccgacagaattttctatccttcaggttcttttggaaagtgctgggaatgttgtaagtattgaggaactgtttcatgcagtttggaaagatgaatactactctaaaaacagtagcacaattactgtacatatccggcatctgcgtgagaaactgaaagatacttccgatactccgcagtatattaaaacgatttggggtgtcggctacaaaatttaagcgaaaggagaacgctatgaagagaaaaccaaattgtttggcaactattttattcttaatttatctggcacttctggtttggatcatactgttcaaactacagttttcaatcagtgatctggataaagtaaggagtataaaccttattccttttcactatgacaaggaaattggagcagcatttcacttaacagaggtgctcgaaaatttcttgatttttgtgcctatgggtatttatcttcaaatgattctgccaagaacaaaattatatgtgaagttcatgctgattgctggaacaagttttttattggaaactatgcagtatatcttagcagtcggacgttctgatattactgatgtacttacaaatacggcaggtggtcttttgggacttgctgtatattcgatggcagcccggttaatcggaaatagaataaaagcaaacagactgttttccattctggcaggcatagtaagtgttgtcgtgattggcctacttggccttcttctgtttgctaatcggtaggaggtgtattctcatgtcgaagaaagaaatgacaacagaaaagcgccttaaagtgcgcttatacctatcattgctggtttataccgttgttggatatggtttgacccttatcttggactacatcttttcaaaatttgacaacggtatttttgcatggctctacaggcggctcgatctgctttttattttgtatctgatgatcggctttgtatgtattttcaattactattggaaaaagccgtggggctatctggatgaagtaattgatgcgacccaaacggtctatgagcagaacaatcataccgtatcattgtctgacccactgaaagaattggaggcacaactcaatcaaatcaaaatgtctgttctgttgagcaaacaggctgcaaagcaggcagaagaaaagaaaaatgaaattgtcatgtacctggcacatgatatacgcacacctttaacaacagtgatcggctatttgagcctactccatgaagcccctgacatgcctgaacagcaaaaggaaaagtatgtaaaagttgcgttgaataaggcagagcgccttgaaaagcttatcaatgaactttttgaaattactaaatacaatgcacatacggttattatcaaaaaagaaactgtggatttacattgtttgattgcgcaggtaatagatgaaatatacccgacactctccgcaaatggcaatacagcggtatttactgcggaggataacttatccgtgaacgctgaccctgaaaaactggcgagagttttcagtaaccttttgcggaacgccgcgtcatacagctacccacagacagagattactatatcggccaaacggttagaacatgatattcagattacttttgaaaatcgtggaaaaacaattccacaggaacagcttaacagtatatttgaaaaattcaatcgcttggatgatgctcggctttctaatacaggtggtgcgggacttggcctttctattgcggaagaaattatacatttacatggtggaaagattactgcatccagtcaaaacgaaaccatagactttgtgattacattacccctttccgcttaggaaaataagactgtgatcttaggaattacttaggaatttaagcgtgtgatttttgagattgaaaagcctttgtttggtacaatgattatcgaacaagggctttttattgttcagctgaagcaaaagaaaggagtgtaagcatggaactgaaaatagagcatttaagcaagcagttcaaagacaaaacagcagtaaatgatgtcaatctgacattgactcccggcatttggggactattgggggcgaatggtgcagggaaaaccacgctcatgcgcatgattgctgatattatgacaccaaccagcggagcagtttactatgacggaaaaaacattcgagagttaggtgaagtctaccgaagcaagtttggctttctgccgcaggattttgggtatcaccgggattttacggtcaaagattatttggagtatatggctgcgctgaaagatattcccacaagggcaactaccaaaaagatcaatcatttgttggacattctttcgctctccgatgtgaaaaagaaaaaaatctccaatctgtcaggtggcatgaagcgtcgtgttggtattgcgcaggctatgttgaacgacccggagatacttgtcatggacgaaccgacagcaggactcgatcccggagagcgcgtgcgtctgaggaatttcatttccgagttttcgcatgatcgaatcgtgttgatttccacccatatcgtatctgacatagaatatatttctacgcgcaacgcaattatgaaagccggagaaattgttgatgtcggaactaccgcagaacttgtcaagcagattgagggcaaggtttggaattgcacaattccggcctcaaagctgccggaatgtgaaatgcggctgcacattatcaatcagcgaggcgaagatcacaatcaggtttctattcgttatctgtccgaacactcggaaattgatggatctgttacaacggaaccacgattggaagatctgtatctgtggttgtttccgcagacagacttggaaaaggaggagagataatatgcgactctttagacttgaaataaaacgtattttgaagtcacggcgcaccctgattatacttgcaatcgcacttttgctttccgtagccatggcatacctgcctatttcatttgagggtattaaccgtccaaacgaagatggcacggttacagaattagacggcttggcagcgatcaagtacaaacaagatttatataaaacatccgctggtgaagtgaccccggataggatcaaatcggctttggaaacttatcaaagctgcgttcgagaatatgggccagtcgaggaagagggctttcctctggctgtatatattgaaaaaatcgtcccgttccgtcacttgctgatgggtctgtccgaagcgtttgctgatccattaacaggcattggtgctgatttaatggatattgacccgaatgacattgacggagcctattatgaaaagtgcgcagaacatttacaggatgtcatgcggaatgagcaaagagaaaacgaaaccgcacaacagaaagctcttgaaaaatattcagaacttgatacgccattttatcttcattctggaatttctaaagatgcatttgattatattgagttttatattttgttccttgctattttgtgtgtggcaatcgcagcacctacttttgccggagaatatcaaacgggtggtgacagcatcctgcgaaccaccaaatacgggcgtaaacaattagcaattaccaaaattctggcggcatttacacttttcgttgttactttccttgtcgggatcacggtacaaattctgattttaaatgcagcgttcgggacggattgcttaaaaacatcgtttcagatgcgatactctatcattaatctgccaaacatcaatctggggcagttgcagataattctcgcagcagcgggcttactttctgtattagcaacggttagctgtacgttgttcctgtctgcaaaatgtaaagacacattgatagttttgctgatctctattgtagttcttctcatgccgctttttgtttatgtggcgatgggagcaacatggctctctaccatacttccatctgccggaattggtatgcagaacaatttcctttctcagcttgcagatttcaattatctgaatatcggtggaatgagtttctggacaccgcagattattttgctttcagcaggaattgaattatttgtgtttacatttttggcgattcattcctattgcagacatcaggtagcataaaagaagttcaaaatagaatgaattgattatctgccgcacgacggcaaaagaaaaaagccgtcgtacagcagacacattttcacgcgcctatgaaacggcgactttgattttcagagccgccgcttctttgcatttgcacaaacctatgatgaattttccggaaatattgtggttaatagcgatttaaactgttgtatttgtttaaaaattaaaaaatatctaatgagtcttccgcatctacccacatctgcaaatttccatcaagatataattttgcatattcaagaggttcatcaatggcgagtgcgtttaatgcacagtctgatccgcagagcagagcagagcagagcagagcagagcagagcagagcagagcagagcagataatattgacattctgaaagcaacttgtgcttttctgattgtttgtattcatgtaccgtttccgggagtaattggaaaatattttacagcattgactagaattgctgtaccagtattctttatgataaccggatacttctactttgatgtcgaggaaaaaaacggcgagactcggcagataaaaaagatttttaaattggtacttgaagcaaatgtactttatctgctgtgggattctttttatgccgtattaagccgaaacatgagcttcttgcttgatacatttacgattgaaaatgtgctgaaatttatagctttcaatgagtctccgctgaaggggcatctttggtacttgggagcaatcctgtatgtgctgattattatgcacatctttgataagctgaaaatcgaaaaatgccttgtttttgcggcaccgtttttactgatgggagatttaattctaggaaaatattctgttctgttgcttggaagagaatttccttatatccttgtccgcaatttcttgttcgttggtattccttatttctgtatagggcggttgattagaaatggatttgggcaaaaagaaagtcttggctattttcttgattgtgttttctgcgacatcattgcttgaacgatttgctctggttagccttaatgttaattcagcaagagatcattatatcagtacgaccttattggctattacggtattcttatttaccttgcaatgtcatgggagtaataaaacactagcattgattggaagaaaatattccacatggctttacattttgcatccgatatttattacctgtattggcatggttgcccataaagtgggtgtgtacggcatctataagttcattgcgccaatcgtggtttacattacaacattgatttttttgatgatagttgacaagataaaaatggcggcagtaatagaccgctgaaagaaggtggcagtttgataacagaagtgaaaacgaaagtttatgctggaagattgaaagatagggcttctctgttacgcagttcatccggtggagcttttgtagctctttcggattgttttctggataacggtgatgccgtggtttgcgctgtgtacaattatgaagatcacgccactgagtttcaactaatcgaaaacagagaagaacgtgacaagtctattggctctaaatatatgcagagcaagccaggaaaaatctataagatcgcagaggactggctgattaatcatccggaaaaacgattgctttttgtcggcatgggatgtcaggccgatggctttcgtaagtttgcggaaatgaagggattccgtgaacgagtatggatagttgatattatctgtcatggatcgccgagtccaaggctctggaaagaatatgctgagtctgctgagaaaaagtatgggaagattacatatttgacatttaaggataagcggaatggttggaaagctccgacggcatatgtaacagctggcggtcaggagcatctgataaaggattatgttaaagtcttttataaccaatgtgcattacgtctgtcctgctatgaatgtccgtatgcgacaactgaacgaaagacggatatgacaatcggagatttctggcatattgaggaaacaattccggacttctatgatgaaaaaggcaactcaatcttcctgatccacacagaccgaggagagcagctctttgagacagtcaaagtgaagttggagtatagactaagcgatacaaaacaatgctggcaggcgaacttggaagctcctactaaaagatcagagcagagagatgaattttggaatgattatcaaaggaaaggagtggatttcgttatgaaaaaatatggaacaactcccttaaaaacgaaaatcaaaaacaagcttgttaagctaatatcaatcgggggggcaaaccctaaatcctgatttgatttattatgttgactactccgaaaggagggcggcataatgaattggtcgcagcctaaggtatatgctgtaaagcataaagacgaagaaatcagggcagcttcacgttctggtggtattttcacagcattgtcagacttggttttggatgatggtggtactgtttatggatgcgttttaactgatgattttcatgctgttcatgtgagaactgatagcagagatggacgaaatcaaatgcgtggttcaaagtatatccaaagtaaaatgggagatacatataagaaagtacaggaagatttgaatgcaaaaagagaggtgctattctctggaacttcttgtcaagtcgctggattaaagcattttcttggtaaagattatgacaaccttatatgcatagatattgtctgtcatggagttccgagtcctgttgtttgggataagtaccttagatggcaggaacataagaatcatggaaaagttgttaaggttgactttagaaacaagaaggatttcggatggaaagatcatgttgaaaccatttggtttgataatggaaaaaatgtaagtagcccgatttttaagaatctcttctatggtcacatggttcttagaccgagttgttatgaatgtccatataagtccatcatgcatccaggagatattacgatagcagattattggggaatcgaaaaggctgctccggaattcgatgataataaaggagtgtcattggtcctagttaataatgaaaaggctgatagcatctttgaaaatgtgaagattgaattgaagtggaagagcacaagaattgaagatagtatgcaaccacctttgaaagccccatttccaaaaccagagggaagagaacagttttggaacgatgtgaatgataaatctttttcgtatattgccagagcatatggggacaatggaactgcaaattatataaagaaggttctgagaagagcaaaacgaaaaatacagcacttaataagtaaaacttgaggaaaggagtatttatgagtggaaaagcattaaacaagcaggaaatggatagtatcgatctggctaaatttgttttcgcttttgcggttattcatattcatgcgggggggggacggtcgtacatccgattttagcaagtattgttaattcttttgatagcttagcggttccgttttttttatagtggcaggttatttcttttttaacagaattgaaaaactagaaaacgaagctcagaaaaaagaatatgcgataagttatctgttgaaaacattgaaaatatattttgtctggtcagttgtgcttttaccgagcaggttgatactgagtaaaagtagtatgcttggcgtacttttgaagtggttcagaaccgtattttttattggtgatgcgcagctatggtatttgaatgcattactgattggattgattctgattttgatattgaagaaatcgaaaattaacgatacttggatcatgttgataggagttgtattctttattgccggtatctttgttcaaaaacagttggatgtggcatctgtcaatggatatgcaggattttggaaattgtattatatgatttggggaaagacaataaaaaatggtgtgtttatggggatgttttattgtatgcttgggacgctaatccagaaaatccctcaaacaaaaacagtattcatttgcacaatctcagcttttatactttatgttgtgggagtgtactttcagtacgaatggagaaaactgttgctacctgttgtgtcggtgcttgtagttgagtcagttattatgctacctttgcatattggatctttgggaaaatggttccgatctatgagcacgttactgtttctgtgccattatatttttgtcagagcgtttgaatgttttccaacattagcagtttgtttcccagaaggaatacataaatttatgtttgttggtgtgtctgcatttttattgtctgcattgctcgtctgggctggaaataaaaataaaagaattaggtggttatggcaatagtgaaatgaataggaaggttgttgtgaatggtggaaaaagaagtaccagtattatataaaagaaaggaagaatgctgtggatgtacagcttgttatgccatctgtccgaaagaggctatttctatggtcgaggacgaagaaggctttgagtatcctcagattgatgaaagtaagtgtgtgcgttgctatcaatgcatcaaggtgtgtccgataaaagcagcacgagcacagtaaggagagattatgaaaacgacattacttatcatggcagccggaatcggcagccgatttggaacaggaataaaacagttggaaccggtcgatgatgctaaccacattattatggactactcgatccatgatgcaattgaggctggattcaaccatgtagtatttattatccgtaaggaaatcgagaaggagttcaaagaagtcatcggtgatcgtattgcctccatttgctcttcttataatgtaagtgtggactacgctttccaggatatcaacgatattccgggagaacttccggcaggccgtacaaagccgtgggtgaatacactttgttctgaatgttagaaaaagcccaaacagaaatcactcacgatacctgtttgggctttttcgttacattcattcaaagggatgaagaggagcgggccggtgtccgatgcaataaagtatccacatcacgcccttatccaacaaaagtttttgcttcattactcagaattcaaacgtctaaatacaaatttaaacttctgctctcgccattgcttccttataatccttctgatctgtaaagatctcattcttgtaaggattcttcttctgctgttttgctctcttaataattgcagccagacagatcacatttgctgcaagtgcaattaccgcgatcacaccctgcatggttggattagcacttgtcggtcttactgctgcatccatgaatccgtcagaatacagagccggaattactgagaaacggcttgcatcctggaataatgggaatacctgagcaaacatacaccacagtgccagtgtattcgcgcggttctggatccagccacccttgttccagaacatatttgcaaatgtcggagcaagaagtaatgcaacaccacagtagaatgcatgtgttgtcaggttattgtatgtgtactcaaaattccacagatcatatgcaataatgaagcaccatgtcatatccggccaaagcatatcatcatgtttcttggatgtgtagattccccaccatcctgtcatacagaagatattcaggattccggcaattccgttcacccagttccaccatcctccgtagagccatacattttctgaagacagccaccagcggtcaccgaattctttcattgccatgaatccacggatacctgattcaaaatcacttactactgcaatcagaatattgattgcaacaattgcaaacgggaatactttgaaccattctgtcttaccaattccccatttgtatttcagcatcataaaaccaatacaccctgctgttgcagcatacaattttgcataatggaaccagcttgtcatatgtacataagtatcgttattcagtgcccattctgcaccatttgctgcacagatatagattgcgatgaaatacactgtaagtatagccggaatagctccaaaacagatcagtccaccgatttttgtacgtcttgcgaattcatttgcaagaacaagtccggcaaacaccagtacccaccctaacagctgccagccggcaccatcgccataaatttggaataacataattatctccctccttcttttaattggttataccaacctattgttatctttttaacattatactcttcttattattatgcgtcaataaatgcacctgtttctcctatttttcagcactttataataaaatatctctccatatttttgtatttttacaatagatttgcgctttggcatctggtatgaccacagccacattattttctttctgacgattcagaaaattcatttaagcattcttatttttgagttatctaacaattcaatattcattttattctgttttatgcgtacttttcttgatttttttcatgtttttgcaagaatacatatatatttcttgcaaattttacctcaactgtttataattacagtaaaatgcattatcaagacaccagaaaacatatatgtattgtgaggatgaaaactatgaattcaaatgatatattaattgcaaacactgacgatctgcgcagtgatatggactatttagagaaaacacttttgaaaggacaccgcattgatccgaatctttatgaagaatatgatgtaaagcgcggacttcgtgattcaaccggccgaggagttcttaccggactgactgaagtatccgatgtctgtggatttgatgttataaacggacgtaaaattcctgctgaaggtggactttactatcagggaatcaatgtcaatgaccttatcaacggtctgaaaggcaaacgttttggatttgaggagacaactttcctgctccttttcggacgtcttccaaaaaaagatgaattagagcattttctgaaagttttatctgaattagaagatctaagcggacgttttgttcgtgacgttgtcatgaaggcctcaagctctaacatcatgaacgcactccagcgctgtgttcttactttatatacatatgatgagaacccggaagatatttctgttgaaaatgcactgcgtcaggctcttgaacttattgcaaagcttccactgatcgcagtatattcttatcatgcatacagacatttccgtaaagatgagacacttctgatccgtaatccggagaaaggccgctctcttgccgaaaatattttgtacatgcttcgtccggatggacagtatacagaactagaagccaaagttcttgatgttgcactgattcttcatgcagaacacggcggtggtaacaactccactttcactacacatgttgttacttcttcaggaacagatacatattcagcaattgctgcttccatcggttctctgaaaggacctcgtcatggtggtgcaaacctgaaagcgcaggggatgtttgatgatattaagaagtctgtcaaagactggactaacgaagatgagattcgtgagtatctccgcctgattcttgataaaaaagcctttgataagacgggactgatctatggaatgggacacgcagtctacacaatctccgacccaagagaaaaaatcctgaagagctatgcacagaagcttgcttctgaaaagggatttgacgatgaattcgcactttatgaccgcgtagaaagaatcgccggtgaagagatcatgacacacagaaagatgctgaaacctgtctgtgctaacgttgacttctacagcggatttgtttatacaatgctgaatattccggaagagcttttcacaccactcttcgcgattgcacgtatcaccgggtggagtgcacatcgtctggaagaactgttaaatgccggtaagatcatccgtccggcatacaaatatgttgggcagcatacagaattccatgaccgtaatgacagaaattaattatttgatacctgattattattctaagttcacctgcatcgccgaccgctgtccgatcacctgctgccaggaatggaagattggcgtcgatgcagatacgaaccgtaaatggaagaaactccaggctccggaaaccgtacctgaacaaaagaaaaatttaagcgcttatacgattaaaaaagatggacagcgtgtgataggcctggacagtgatcatcgctgtccattccttaactctgagaagctctgccgccttgttgttgcttacggcgacaaagtcctatcagaaacatgcactacatttccacgagaggaacatcgctttccgacacataacgagaaaatgctgatgccttgctgccctgcagtgattgacctgtggaacaaacagaagtccctgcatttcccaaatgtatcagacactttgtccgatactggcgatacagatacttctgtccttttcctcttgcgtgaaaaactactcaatcttttagatgattcttccagaacaatcgaagaagaacttttggaaagcttctatattcttcaggaattgtaccagcatcagccattaacaaaagaactgttagaagattatttttctgatagcacagtgagagaacttggaaatgcgatctcagatatagaccttccacctttggatctgatcagtgaatgcaacgaactgctacaagatctttccgtaaactatcaaaaagaagggctctatcaggatactctgaatccaattcttgctttggctgaagaaatattggaagccctttcggacaatactggaaatcctgatgatactaaagcttacgaatccactttactggaacaatgggaacaattcacacaatacttgagcccttacggaccactgcttcgcaatttcctgcgcaacgagattttctccgatctcctgcttcctgacagtgacctggaaaatgtactggtacagatgcaatggattgcccttgaatatgcatcaatccgccacagcattttcttaagatggatgctggatggcacagacgcaaacgtttctgaaatttcttacgaaacgctgagacaatatcttgtgatcattacacgaatgaccggatatgaaacagcggatatttatgaatatctggaaaacagtttcgaatccctcttatgggactggggctactttgcattaattataggaaactaaaaaaggattatgtgattggcacaagtactttttgcccttcacataatccttttttcagagttatcacaaactatctcatacaaatgtacacaacatacactgcataaagaagtaacatgataataccttcttttctattaagttctcttttcgtccatgccatgatccatccaataacactgaacacgatcagcactgcaatatcaatgatattttctgtcaaaaatgcgaccggtgaaattgctgccgcaataccaagcaccatgagaatattaaagatattggaaccgattacatttccaagtgccatatccacctcacctttttttgctgctacaatcgatgtaaccagctccggaaggcttgttccaaatgcaactacagtaagaccgatcagagtctgactgattccaattgccgccgcaactgtacaggcaccgtctactacccagtcacttccgaccgcaatcgctactgcgccgagaataatgtaaatcacactctttcccatagacatttcctgaatctcctccgcttccagaagatactcttcctcttccactcccggctccacatttttctcacgagatgtctgtgctgagcggatcatgtagaggataaacgccaggaataagataataaatacaactccatctatatgtcccagtgacattccggctgcaccaagaatcagaagcaataccgcacacagaatagatatcggaaaatcaatctttaacgtattaatctgaactgccacggaagtaaaaagcgtgcaggctccgactacaaccatgagattgaaaatattagatcctaccgcattactaactgcaagtgcattgtttcccgtaactgctgctgtcacactgaccgcagtctccggaaggctcgtccccatcgccacaatcgtcattccgatgatcagtgacggaacatgataccgtcttgcgatactgctacacccctcaacaaatgcatctgcaccttttacaagaaacacaaatccaataattaaaagtaccactgcaaatggcacactttgaaacaaatcactcatcttttatttcctttctgctatactatattcaacctcattttatgctaatccagacagatgctggatcaaaatcctaacacctaaaagcaccaggatgattccaccaaccagttctgccttatgtttatatttcccaccaaaataatttccaatcactacaccaacaatagaaataatcattgtcgtaattccgatgatcgtaattgcctcaagaatcggtgtgtccagaaatgcaaatgtgattccgactgccagcgcatcgatactcgtcgcaacggcaagtacaaacatatttctatgatccaacggctgatcttttacttcaacaatatcttcttcgttccattcttttactgcctccagaatcattttcccaccgataaagccaagcagaataaatgcgatccagtgatcaatacttgtaatatacttttggaactgaattccaagaatccatcccacaagcggcattaatgcctggaaccctccaaaatacaatccgatcactaccgcctgtttcttattcagcttcttcattccaaggcctttacagacggacactgcgaatgcatccatcgcaagcccgacccccatcaacaaaagctcgataaatagtgccatatttctcctcttttcttttttcttctgtatctgttccgctacaattgcagtacgcatcctgagcggagcgttttttatatattaggaaagaactttcctaatatataaaaacaaagagacccacgtatgttctatgataagagaactgcctgcttgacataacaaactcgtcctcttatttaaaacatacatgagtctcattctttaagatttgccaggtgatcttttaaaactcattctcaccggtatgttgacaaatcacattttcatgcgaactactccctcacggaatatatttaatttttctttcggctcggttcgtctcatgaacaactgcctcactgacacatcgtttcttactataacgaatgaattctgttttgtcaataaattttatcatttattccgagacatttcgttactgtcacagtaacagctttccccattagaaaagcagcattccgattcctcttgtgatgatcgcaacaatccatgcgatcaagcactgccaaaacaccattccgacagcccattttgcaccaagttcgcgctttactgatgcaactgctgcaacacatggtgtgtagagtagactgaatacaagcaggacaccggctgacagaggagtcagtacagaagcaattcctccaccaaacaatacctcaagtgttgatactacactttctttcgccataaatccactgatcagtgctgtacagattctccagtctcccagtccaagcggacgaaggattggaacaagtgcacctgcaatcatagcaagaatactatctgctgaatcctccacaaggttcagatgcaagtcgaaactctgcaagaaccatacgacgatcgttgccatcagaataactgtaaatgctttctgtaagaaatctttcgctttctcccaaagaagctgtgccacattcttcgcacccggcagacgataattcggaagttccataacaaatggtaccggttctcctttaaacagagttcctcgataaaggaatgcgattaaaattccaactacaattccaagcacgtacagccccgacatgatcagtccgcccttccccgggaaaaatgtacttacaaagaatgcataaatcggaagttttgctgtacagctcataaacggtgtcagaaggatcgtcatcttacggtctctttcactggtcaatgttcttgttgccataactgccggaactgtacatccgaatccgatcaacatcggcacaatgcttcgaccggaaagaccgatcttacgaagcagtttatccattacaaatgccactcgcgcgatatatccactgtcttccatcatagagaggaagaagaacaaagtaacgataatcggaagaaaactaagcacgcttcctactcctgtaaagattccgtcgatcacaagacttcggattgcatcatttacattgagtgcgagcagtcccgcctcagccattcttgacaactgatcaattcccatttccagaattccttgcagaaatgcaccgattacattaaatgtcaaataaaatacaagcaccatgattccgataaagcatgggatcgctgtatattttcctgtcaagattttgtctatcttctcacttctgacacgttctttactctctttcggttttacaaccgtctgctcacagagacgttcaataaaatcgaatcgcatatctgcgattgccgcacttcggtcaacctcacgttccgtctccatctgctgtacaatatgctcaagcatatccaactcattctgatcaagctttaactgttctaagatcagcggatccccctcgattgccttcgtcgcggcaaaacgtaccggaagctttgcttcttctgcatggtcttcaatcagatgaatcactgcatggatacatctgtggaccgcaccgtcatgatcacttttatcacagaaatcctgacgcagcggacgctcctggtattttgccacatgaagtgcatgacgtattacttcatccacaccttcgttcttcgctgccgaaatcggaataaccggaactccaagcagtgcttccattgtattcacatcaatagatccatgatttccaatcacctcgtccatcatattcaaagctactaccatcgggatatccatttcaagaagttgcattgtcagatagagatttcgctcaatattcgttgcatccacaatattgatgattgctttcggatgttcatccaacacaaaatttcttgaaacaatctcctcactgctgtatggagacattgaataaattcccggaaggtctgtcacattcgtattcggataacctttgattgttccatccttacggtctactgttactcctgggaagtttcctacatgctgatttgctcctgtgagctgattaaacaacgttgtctttccacagttctgatttcctaccagggcataagtaagcactgttccatccggtaacggattagcatcttcttcagaatgatactttccttcttctccaagtcccggatgatctaccggtttcaaacgttctccacggaaatggctgtttgttctctcgctgatttcctcaacttcaatctgttctgcctctgcaagacgaagtgtcagttcatatccatgtacctgcaattccatcgggtctcccatcggtgcaaactttaccaccgtaacttccgcacccggaatcatacccatatccaaaaaatgctgtcgtaacgcaccggaagccccaactgtcctgatcacagcactctttccaatcgctaattcttttaatgtcatttttttatcatcctctttagcttattgcgattttttatcaattagttatacaaaactagcttattccaggatgttggatttgtcaataattatcatttacaaaatgctgtaataaaaaaagaaatgctttattccctcttatatttggggaaataaagcatttcttttttcattatatagcagcctctcgttttttcagtggcgcataaacgattcttctgacaaaaataaagcaaatcacctgcaggatgatcgtaatgatccaggataccggataggaaataaacaaaatcttcaatgatctgaatcttggaaatattccaaagatccagacgattctcgttccgactgttccgattacggaaagtatcatcggcacaattgattttcccattccacgaagagatcccgggaacagatccatccatccgcacagaaaataagtaactgttgtatatagaagaatctccataccacagctgataacctgaggatcatcggtataaatcttcaaaagttccggtccaaagagatacgcacctccaccaagaattaatgcaatcgttgtggaaagaatcaggcagtcaactaagactctgtccattcgtttccattttccgactccgtaattctggcttgtaaaactcatacatgcctgtgtcactgcattgatcgatgcatataaaaatccaaaaatgttattcgctgccgtatatcctgccatcgccacggatccgaaagaattgaccgatgactgcaaaagtacatttgagaaattgatcacagtactctgaattcctgccggaattccaacctgaaagatctgtcctaaatatactttttttatcattagcttcgagaagcgaagctgataactgctgtctgatttatacaggcaacgcaataccaatacacacgatacaaactgtgctgttaccgttgcaattgcaacgcccgctactcctaaatgaaaagcaattacaagtaaaagatttaaacatgcgttaatcacacctgctacaatcaaaaacaaaagtggtcgtttcgtatctccaaccgctcttaagattgctgctccgtaattatataacataaaaaacggcattcccaggaaataaatcttcatatatagtgtcgaaagattgatcacattatccggtgttcccatcaactcaagtgctcctctggaaaagaacaatccaactaatgccatcacaactccgcttataatcgcaaatgtaatcgctgtgtgcaccgtctccgacatctctttctcgcgccctgccgcatagaacctggctgcaagcacatttgctccaagagatattcctataaataggttcgtaaatacattgatcagtgctgtggttgatccgactgctgccagtgactcacttccactgaatcttcctaccacaacaatatccactgcgttaaatgcaagctgcagaattccagatatcatcagcggaattgaaaaagaaatcagcttattcatgatcgagccattgcacatatcaatttcaaatctgtttttcttcttttctgaatgcataatttttcctcattctataaattattgtaactgttcaaacactctcttaatgctgtcataatgaaggaagattccctccttggcaaagttttcaatctcctccttagttgcgaacatatatccatctgtttcctctgtctgaagtttcagatcattctcatcaatatcaagcacaaagcgatatacatcaacaaaataattatcaccatcgcccggattttctcgcttataagtaaatagatatccgccttctgcattagaaatatctaatcctgtctcttctctcacttcacggcataccgcttcctcagaagactctcctgcctgcgctgcaccgccggatacttcccaccaacccggtgcccacgcttttgtcattacacgtttcgtgatcagatatgttccatccggtcttgccacaactccaagcactgtcagatggtattccccatcctttaagcaccagtcatttcgcttcattgttcttccggtcggccgtttctctgcatcataaatatcccaatattccatgatattttctcctgtctcacctatctcatgtttttcattttccgtaactgttcagagccaacctccaaaatgctacgcatttcgtcggtgtggcgtattgaatacactttgttctgaatgttagaaaaagcccaaacagaaatcactcacgatgcctgtttgggctttttcgttacattcattcaaagggatgaagaggagcaggccggtgtccgatgcaataaagtatccatatcacgcccttatccaacaaaagtttttgcttcatcactcagaattcaaacatctaaatacaaatttataccacaaaattcatcttctgatcatcgtactgcacggaaaatccttttccttcgaggtactcttctaccacctgatacatctcatcatatcgtccttcgcaggcacaattaccaagtggttcgatccagaaggattgccttccacaagtgtccctgagatgaattcggaaattcagacctttatctttaagaattccatttaattctatcacatcattaaaagatacataactcattttaattctcctcttctttacctaataaaatgtgttgcaattcgttcttctttctccggaagtccaaactgttctttacccaaggcaatactcttcataagaaatgtcatgtttctggcgaggactctcatagtctgctttccttctccatcctgctctgcttctcctgatattcttccatgaatactattccaatactgactggaagcaactggcattccagaaattgtaaagtatttgtttaactcgtcaaatgttgctgaacatccaccgcgccttgcacagacaacacttgctcctactttcatagtcttatcaaatggtgtgctgtagaacaggcggtcaagacaggcgatcaatgttgcatttgcggatgcataatagactggacttgcgataaccagtccgtctgctttctcgaatttcaaagccagttcgttaactacatcatcataaacacatttttgcttggaagcacatcctccacaggcaacacatccacggacaggtttatttccaacaactactgtctctacttctactccattttcctgaaaaatcttttccatttcttttagtcctacactagtatttccgtttgctcttggacttccattaatcataagtactcttaatttttctgccattatttctcctcctacaaacattattgtcttatcttcaaagttctcagatactctttttgttccggcgtgatccgatagctttcgattgccttctggattgtcttattatgtgtccatacgtccatcttctgttcttctagaaatggaagaacctgatcatactttttggcaagtgctgttgcgaaataccatgccctggccatatttacataatactcttctgaacggattgcggcaaccttccccggatattctaacttaaattcttcctccaaataatagcgcatcagcatattgattccaaatcggatcgtatatatatgctctgattccagccatcgatctatctttttgatataagaattcagatgattcttcactgttctgactgccagaagatcacaggttgcccagttatctatatggggcagaaagcgctccagttcttctatacagagttcataatctttaatctgctcgatcagaagcccatgcagattattctcttcataatattgatgtggcaggatcttaagaaactgcttcgcctcttctgtcttcccgaatttctttgcataagttcgaagtacagggactctcactcctatcactgattctttctctactgttggcatcagttttgcgtgaaaatcccgatattttagatcctgcattgtaaaaaggtcctgctgcacttttggtattacttcttttggagtcatctttattcacctgctttctgttaatttgcagtataacacacactttatgccactgcaagtatatatagaacaaacgttcttctgtattttatttcttttttttgctatacttatctacgtataaagttgctgctcacacccactatgaacagtaactaaaaattctctgactcttttgctgttactgctcacactatatattaccagcaacacagattcgtcagagaatataagggagataaaaatatgctgacagtaatgaaatttggcggaagctccgtggccgatttggagcacatccgcaacgtagcaaaccgctgtatcgcaaagcagcgcgaaggcagccaggttgttgttgtcctgtctgctatgggaaagactacagataatctgatcgcaacagcaaaacagatcacagagcagccttcccgcagggaattagatatgcttcttacaaccggtgaacaggtttctgtatccttaatggcaatgactctgatttccatgggcgtcagtgcagtgtcactgaatgcatggcaggttccaatgcatacaacttcaaattatcaaaatgcgcgattcaagagaattgattccgagcgtatccgtaaagagcttgatgcgaacaagatcgtcatcgtaaccggattccagggaatcaataagtatgaagatatcacaactcttggccgcggcggctctgacacaacagcggttgctcttgctgctgaactccatgccgatgtctgtgaaatttacacagatgtagacggagtatataccgccgatccacgcgttgttccaaacgctcataaaatgacggagatcacttatgatgagatgcttgagatggcctctcttggtgcgaaagtccttcacagcagatgtgtagaaattgcgaaaaaatacggtgtagaacttctggtatgttctagcttaaaccacaattcaggaacaattgtaagggagaaaacgaaaatggaaaaaatgttaatcagtggtgtggcagccgataaaaatgtagccaaaatccgtgttgccggtctcgggaacgagcctagtagcacattccgtcttttaaatcttttagataagaataaactgaacattgacgtcatgatccagtctcttggtaaagacggtacaaaatctgtatccttcactgttgcaaaatcggacatgctccgtgctttggatctgttaaatgaaagcaaagactatcttggcattaagaaactggattctgatgaaaatgttgccaaagtttctgtcattggtgccggtattcgttctcattcaggtgttgctgcaaagatgttcggtgcactcgcaagtattgatgtcaacacagagatggttactacatctgagattcgcatcactgctctgatcgatgaagcctatgcagatcttgcagtacgtaaactgcatgaaactttctttgattaaaagtaaagcagaatcaagcgacagtaaggattaataattccctgctgccgcttgatttttatcttatttttattctgaataattacatttgttttttatttttcactgcacattatacttcttcctttaacggcgtttttccgcgcaaacgtctgtaatagaatcttccttttccaagaagaatcgtaagataacgaagtaccggctctgttgcgatcgcaaatacaacaaaaagcatgatacactttgttgtcattccgctaatcgcaaacagctgattcaaataaatactacagaataataatcctgcgatacatccgccaagaatccctgcacgaagcttattcatcggtgcactgatcttatagaggatcataaatcctacaattgccaaaagcatcgttgctgctgttgagatatcctgctctcctactccaaatgtctttccaaagacaaccagtgccccaaccgccaatgcatctgtaagtgctgccgggagtgctttcaggaatacattcgtcaggaaatgtcctttgatgatattcttgttcggctcaagtgcaaggaagaacgccggaatgccgattgtaaacatactgatcagtgatacctgtgatggttccagtggataagtaaacataaatactaccgagaaaagactcagcaggaaagagaatatattcttaaccaggaacagactcgccgaacgctggatattattgactactcttcttccttctaatacaacctgcggcatacaagagaaatctgactccagaagtacaatctgagaagcctgtgctgccgcatcacttccggatgccattgcaatactacaatctgcatctttcagcgcaagcacatcattcactccatctccagtcatagcgactgttttcccagcctctttaagtgcctgaacaaactgtctcttctgatttggagttacacgtccaaacactgtcttctcaagaatcgctttcttaatatcttcttctgtttcaagacttgatgcatccacataattctcggcatttttgattcctgctgtttttgcaactttggaaactgtaaccggattatctccagaaataactttcacttcaactccctgctctgcaaagtactggaatgtttcttttgccgcctcacggattggattcgcaagtaagatatagcccaacggtgttactggttctgtcagtgcttttccatcaatctccgctgcataagtaccaaatacaagaacacgggcacctgtagatgcaagctctgtgattctttccttatgttgctcgtaatcatccagaagtacaaattccggcgctccaagaacatatgtcttatcttcaaatgtagcactgctgtactttgtcgcagatgaaaatcctgtcttggaaattgcttttgctcctgaagaatgtgtaaaatattctttcattgcagccattgtgatattatcgtttgtcatagctgaaacaaaatctccgaccataagacgaagagatcccatcttttccgtatcgtactgctccgtcggaataagttcctgtactttcatcgtattttctgtgattgtaccagtcttatctacacaaagtacatcaacacgcgcaagtgtctcaatacatttcatatcatgaagcaatactttctgctgtgcaagccggattgaactgacagcaagtgcaacgcttgcaagaaggtaaagtccctctggaatcattccgatcacagccgctaccattgacgtaatacttgaatggaatgatgcattctggaataccagagactgtgcaacgagtatgattccaatcggaatgattgccacaccgacgcatttaaccaatttatccagcgagcggatcatctctgactgctcaccattctgcatttcttttgcttccagtgtaagctttgaaatataagaatcttcaccgactttatcaagtcttgcatgacattgaccggaaataataaaacttcctgacatcagctgatctccggcatgttttgtaatctcatcagactcgcctgtcagcagagattcatttacctgtacttcacctgcacaaacctgtgcatccgcacatacctgcgcgccggctttaaatatgacaatatcatcaactaccaactcttctgcatcaatcaacgatcttttaccatctcgcactacagtcgctttcggtgcatttagcatggtcagattatccagcacttttttggcacgcacttcctgtataataccgatcaacgtatttgcaacaataaccggaagaaaggtcagatcccggaaggatccaaccagacataacaaaatagccagaacaagaaagattaagttaaagtaagtaaatacattctcatgtacaatctctttcgttgtcttcgatggaggatcaactgccctgtttacccagccatgaagtctgtgctcctgcacctgctgtgctgtcaatccgactttataatccggattgtaacgggttgtcggtatccgcttctctatttcttcttcaatctctgttttcttgtttctgcttcttgccatctgttacttcccttctgcttcttccaacgtctccgttctcgtcaaaatctgcataaattcttctcctgtaattgtttctttctcatacaggtattttgcaagctcatgaagtttcttctggtttttctccaaaagttccatcgctgtatcatatccgtgttttacggtatctacaaccatctgatcaatatctgctgctgtctgtggtgaacaacttaaactgctgtctcctcccagatatggattgttctgcgtctcaagagcaaccataccaaaccggtcactcattccataacgcgtgatcattgctcttgcaagctttgttgcctgctcgatatcattcgatgcgcctgttgtaatagaattaaaaatcagtttttctgcgcatcttcctccggtcagtgtcgcgatcttgttgatcagctcttcctgtgtcatcagattccgttcttctgattcaacctgcattgtatatcccaaggcacctgatgtacgcggaatgatcgtgatctttgtaaccggtgccgaattcgtctgtaatgctgctaccaacgcatgaccgatttcatgataagaaacaattaatttttccttggaagaaagtacctgattcttcttctgatatccggcgataacagtttcaatactttcttcaagatctgcctgcgttacatatttacgattctctctgactgcgcgtagtgccgcttcatttaccatatttgcaagctctgctcctgatgctcctgatgcagctcttgcgattgcattaaagtcaatgtcatctccaagtcttactttcttcgcgtgaactttcagaatctcttcacgccctttaagatccggaagttccaccggaatacggcggtcaaatcttcccggacggagaagtgccggatcaaggctgtccggtcggttcgtcgcagcaaggatcacaacacccttagatgcatcgaatccatccatctctgtcagcaactggttcaatgtctgctcacgctcatcatttccaccatatcctgcattatctctctttttaccgattgtatcaatctcatcaataaatacaatacaaggtgctttttcattcgcctgtttgaaaagatcacgtactttagaagctcccatgccaacaaacatctctacaaattctgaaccagagattgagaaaaatggtacatttgcctctcctgcaactgcttttgcaagcaaagttttaccggttcccggaggtcctacaagaagtgctcctttcggacatactgcaccgatctccgtatatttctgcgggttatgaagaaaatccacaatctctgtcagcagttccttcgcttcatcttctccggctacatcctggaaagtgattcctgttgtagattccacataaatcttcgcattgctctttccgaactgcatgaacggatttcctgctgcacctccacccatcttggccatcatcttctttgcaagccactgtcctaatgcccagaagatcaaaagtggtaaaatccatacaaggaaaaagctaagaagcggattcatctcctgctgtgcgactcttccgaattcacatcccgcatcttccagacgatttaccagatttggatcatcaaacgttgttgtctcataatatttcggttcctcgctattatctgtaaaataaatagtgtctccattcaactctacttttgatacttcttttccctcgaccatagtaagaaaggttccataatcgacttctttcaccttattctttcctagaatattcggaaaaagaaatgtgttaagaagcacgagaataatcaaagcaatcaaatagtaaaagattaatggcttctttggtttctcaactttcttcatactgttgttcctcctattttctaaattttgcacgaactgcctttatcatctgtataatcggaagattcaatgctgcaagaccatacacagtaagtaactgcgataatgtcagtgtctgcactttaaagatgttatgcagtccaggaacagtcacgacaagcgtgatcagaatcattccaattacaaaagcaccgatcaggtaaatgttattaaagactctttttgtaaatacaaccggacgatttgatttacagttaaacccatggaacaatcttgaacagcaaagtgttgcaaatgccattgtacttgcaagtagtgcattaccgtctttgtatccaattgtaaatgcaatcatgaccatggtacagattgataatccttccagtccgatattgatcaaaaagtctttcgttaaaatggattcatttatcggtcgtggcttttctttcatcacatttttcgaatgtggttccaatccaagagcaattgccggaagactgtctgtcagcagattaatgaacaacagatgaaccggtgcgaacggtaccggaagtgccatcagtgaagcataaagcactgccaggattgctccaaaatttcccgaaagcagaaactgaatggatgctttaatattgcgatatatatttcttccattctctactgctttaataatagtcgcaaaattgtcatctgtcaaaaccattgctgcagcgtcttttgacacttcgcttccggtaattcccatcgccactcctatgtctgcctgtttcagtgccggagcgtcattcacaccatctcctgtcatggatacaatgtttcctttttcctgccatgcacgcacaatacggatcttgtgttcaggagaaactctggcgtaaacagaaatcccttccacaaagtctttcagttcttcatcggacattttgtcaatctctgcaccctcacaggcttcggattcattttcaagaattccaattctctttgcaatggcagcagctgtcaccttatgatctcctgtaatcataatcggacggattcctgcacatttacactcttctacagcagcttttgactcttctctcggcggatccatcattgcgatcagccccaggaatatcagatgatcttcatcctccagcgtaagttccgtctcatctgatacttctttataagcaaatgcaagaactcgtaatccctctcttgagtatttctgattctgctcttcgattactcttcttgtctcttctgtgatctcatgagtctccccgttcatctcaacccagtctgtccggttcaaaagaacatcaactgctcctttgacaatcatcgttggcactccgtttaatgaatgctttgttgccatcatcttacggtcgctatcgaatggattctcactttctcttggatactttactctgacttcttccgggtcaagaccaagactgcttcctaaattaatcagtgctgtctctgtcgggtctccgatctctacaccatcaatattcgtagagtcattacaaagaatactgctgataaggagtctgctctgagacggatcccggagatcgatcttgtctgcggaaatgctctggccatctacataataatgctctactgtcatcttattctgtgtcagggttcctgttttatctgaacagataatggatacacttcccagtccttctactgcctgtagttttcgaacaattgcatgctctttcgccattttctgcgttccaaaagaaagaacaatcgtaacgattgaacttaacgcctccggaattgctgcaacggcaagagcaactgcaaaaagaaatgcatttccaatattctcaccacggaaaacactgattccaaacaaaatcgcacagaatacaagaattaaaatggataatttctgtccaaactgatccaggttcacctgcaatggagtcttcttctcagatgtcgtcttcagaagacttgcaattttaccaacttctgtattcattccaatctctgtaactacaaaagaacctcttccatacgtgagaaagcttccggaatataccatattaatacggtctccaagaggaacttcgtcctgttcaatcacatctgtcgtcttctcgacaccaagactctctcccgtcaatgcactttcgtcaaccttcatgcttgcacattccagaatacgtccatctgcaggaatatagtctcccgcctctaacataataatgtctccaacagtaacttctgaagacggaatcgggacaaccactccatcacgaagaacttttgcttccggaccggataatttcttcagacttgccagagatgactctgcctttaccgtctgcacagttcccagaattgcattcattgtgatcacgataacaataacagctgcgctctcaatatctcccataaatcctgatgcgatcgctgctataataaggatgatcaccagaaaatccttatattgctccaaaaaaatctgaaatgttgtcttcttttttccttccgtcagttcattcgggccgtatttcctttgattttcactgatctgttcttttgttaatggttcttccgagccattcacttctcttaaaacttcttctcccgataattgataatatgctttcactgccattcctcctaactggttattgttcactcttcttttgtgacccataatcctgattaatctgcagtgcgaataaaaaaagagacaattattgcaccgcttcttacatgcaataaaagtctcactatttcatcacgatccggatggacttcttccatcgtattgacggctcgcgaacgctactcaaagcgccagttactcccttttattaaaataaactatactcatttttcctgataatgtcaataaactttattttctttttaggaaatattttcaggattttaacattaaaagaatttcttgtaaatacggatatatcctgctattcaccttttatctcttttctttgccatattgttatttatgccttcatccttcttgaccagctctttatagcgaatggcatacatagaataccaatcaagacaggaattgtaataagtagatatggtgaccagataagcttccccaaaatacgaaaagtattggttctgaaaatatctgttgaacttcctaccaatggtattatatctaatgctttttgcattccataaggaagatattctgcaatcatcattggtccatatacaacagccagactaagcagtaaggtaagtacattattttttacagccgctgatataaacatgacaattccggcaaaacctattgctccaagcaatacaaaaacatattcataaatttctgcctgcagcatattcataggtgcaacagcaatcagcttgatattctgaatcggcatatcccatccggcagttcccataaaaaacaactgtgatataacacttgaaacagcaagtaatgcaaataactccactgtaaacgctaaaccagtaagaattttggcaagagcgattttcccccaaccatttcgagtcgtcaatactaatgcgcttgtattatcatgccattcgccagcaaataaagaggataaaacaataccgagaaacaaagccatcacaactcccagatccgcaatcgtactaccaagaagcgttgaccatccttctacccactcataatgaaatggtttttctacctttctctctatctgatgtaaaaactctttttcagctcctacctgaccactgacctccaaaaactcatcaagtacctgctgtcttctttcatagaagcctgttaacttatccggatcaacatagcttatcatcgttttataattactggtatctcgaagctccggatacaatgttccgagccaactattaactatctgccagtctgtcttttccagttcttcctccataccgccagcttccatttgctgataatcacttactatttgctgcaaggtttcatccgtcaattctccaccaaatgaaagtgcatattcctgactatcctttattactgtatatccatcaaaattattgccaaaagcacttgtatagtcacctgaactgccaaaacagaaccattgaaacgaaagtatgcttccaaaaattacataataaacaaaacacaacaacacacatattttaacaattttctttcgccataactttttatgctctaaccaaaataattccattctatttcactccttcctctgtaggaaaataaaataaataaagatcttccaatgtagcttcacaaggaaccgctcgctcactaggcatattgtctgaaataatacgcaatataatttcttttccttcatgccgtaaattagcaaccgttgtttttgtctgccattgtctagcttcttgtggagaaacagaaagttcccaaaccttaccatttgccttgtgaatcaactctggaaccgtaccctgcaatacaacttttccttttttcatcaatagcacttcatctgctattgcttctatatccgatacaatatgtgtggaaagaattacaattttatcgcctgcatactctgagagcagattacgaaaacggacacgctctttcggatcaagtcctgcagtcggctcatccaaaatcaagattttcggattattaagtaacgcctgtgcaattcctactctttgtttcataccaccagaaaaagtttttacttttttgtttgccacatggcttaaatcaactacctccaacaattcagtcacacgtttttttgcaacattcttcggtattcctttcagtgctgcaatatacattaaaaactccaccgcagtataatttggataatatccaaaatcctgtggtaaataacccaacacattccggtaatctgcccccatcgaagttacttcttttccatccagcaatacctcccctgaggttgactccaaaacagcacatagcatacgcatcaatgttgttttacctgcaccgttagcccccaaaagaccatatactcccggctttaaggtcgcactaacacaatctaccgctattttcctgccatactgttttgttaaacgatcaagcgacaattccatacatttttccttcctttctcatctctgcaatataatgaatttcatttataaagaacatagcaaaaatcaaaaatgtaacaatccacacccccactgctgatgtttcatataaccatggcaatatccttgctgacataccccaacaaatgcaggaacccaacattacaatcgcacatatctgtaaactctgtttcttttgcaagcggatcaaacgtagcaacgcaaccatacacactaagtacggaaccaggcagtataggactatctgtccaatctctttataagaattttgcaaataaacttccatgcacaaaagaattgttatacacaccaaattagccgccccagccagaaccagctttgctaacgtgatttgggcaccagaagctcttgttaccgcttcaatctcgctcattccataatactggcttttaaaaattgctggtatgatagccaatacaaacagcggcataaaaattggtatattctttggcacgtctgcaatgctggcaattgttaaacaaactataaataacgttactgcctgcaaaccaaatattggaataccttcaaaacgaaatacatctgaaagatagtgaaagaaacctgtcctcggttctgccctagtcacttcctgttctcgcacaatttcagtgcaaagcttaatcgtttcctctaatcttttaggctgtacttcctctcctaaagattgctgtaaatagcccttcaaatttttatctttcattttcctgctcctttctcataatttttaaagcattacgaaccctgctttgtgctgttcgcatattgcatcccatcacttttgcaatctctccaaaactaagttgttctccaaagcgtagaatgactgcttccctttgttctgatgataaaaaattcaaaaaatagcttatctgtgccctatcctctagccgaactatgtcgttatactcatgcactatattttcttcatcttctaatggataaaactcaaccttcctactttcatcaatacataaatgatttgcaatcgtgtatagataagccttaaatttctttttccctttatatccggataaattcttaaacaacttcaaaaatgtttcctgagtcaggtcttctgctttttccagattagagcaatgccacctacagtaacgcaaaatagatgtataatagcgttttatcaattcttctgctgcattttcatttccaagtagaatctgttccactaattcgtcatcactcaacacgcatcagactcctttccattgaatatctgtatatatatattaacgggttatgcacttaaaatgattaaaagattcctcatttttttcatttcaatgcataaagaaaagtcccataaacattgagtttacaggacttaaccatatcatatcttatcttatattatcttatcttagaatttcttaattagcaaataccctgagctgtcatagcatctacaaccttctcaaatccggcaatgttagcacctacaacgtagttgcccttgaatccgtatctctcagctgcatcaaccatgttgtggcagatgttaaccatgatgtttttcagttttgcatcaacttcttcgaatgtccagctcagacgctcgctgttctgggacatctcaagtgcagatgttgcaactccaccggcgttagctgctttaccaggtgcaaagataacaccattctcctgcagatactctgtagcttcgagagttgtaggcatgttagcaccttcacatactgcaatacatccgtttgcaacaagtgcctttgcatcttcaaggtgaagctcattctgtgtagcacatggaagagcgatgtcaactttaacattccatactcctcttccttcgtgatactctgaattcggacggtagttcttgtactctgtcagtcttgcacgttttacttctttgatctctttaagagctgctacatcgattccgtccggatcatatacccatcctgtagaatcacttgctgtaacaaccttagcaccaagctgctgtgctttctggattgcgtagattgcaacgttaccagcaccggaaacagcaactgtcttacctgcaagttcgataccattgagtttcagaagctcatctgtcagatacagaagtccatatcctgtagcttctgtacgagcaagagatccaccataggaaagtccttttcctgtaagaactccttcatataatccacggattctcttgtactgtccgaacatatatccgatctctcttgcgcctgtaccgatatctcctgctggaacatcagtatcagcaccaatatatttgcaaagctctgtcataaagctctggcagaatgccataacttctctgtcagattttcccttaggatcgaaatcagatccccctttacctccaccgattggaagtcctgtaagggagtttttgaaaatctgctcgaaaccgaggaatttgataataccaaggtttacagatggatgaagacgaagacctcccttgtacggtccaattgcactgttgaactgtacacggtatcctgtgttaacctgtacctgacccttgtcatctacccacggtacacggaacttaaactgtctctcaggctctaccagtctctcaagaagagcatctttacggaatttttcttcatttgcttcaatcacaacgcgaagagactccagtacctcttttactgcctgatggaattccggctctgcaggattcttctttacaactaaatcaatcacttcatcaacgtatgacatcttaattacctcctagaataaatagattgggattcctatctccctgatactattgtatctttcgtcaacggatgtcttttctaaaagaaaaaacagactgacaagcaatctgttacctcagacaccgttgtctactcgtttattttataagctaaatgaaagattgtcaatcattaattgcattattttaaagttttatcactttaagttgataaaactgcatgaactaatgtatcaaattgcaattttcagcatatttaaggttatatgtcgagtaaacagatcggaaaatggtggtttttatatgttaggaaagaactttcctaacatataaaaaacagagtactgtttccagtactctgtccatttgcacatattagttatatttacgttttctagcagcttcagatttctttttacgtctaacgcttggtttctcgtagtgctctctcttacgaatctcctgctgaataccagcctttgcacagtttctcttgaatctgcgtaaggcgctatctaacgtttcgttttctttaacgattacatttgacatagtctcacacctaacctcccctccagccttgtattgtgcatcatacgactgttcgggtatatttattgcactggatattattataacatattttttcaaaacgtcaactgctttttatgattttttatacttttttctcgcttctaccaaaaagagaatctgccacagacagattctctttacaatgactttatttaatagctttatttaatctgatcagccagtgcttcttctgcttttgcaagtgcatccgggattcctgctgggttctttccacctgcctgagccatgttcggacgaccaccgccgcctccgccaacaagacctgcgattgctttcacaagatttccggcatgtgctccctgcttcattgctccgtctgttgctgtagccatcaggcttacttttccgtcatttcctgatgcaagtacaaccacaccttcgccaagcttctctttgagctggtctccaaggtcacgaagtccattcatatcaacaccgtcaagctgtgctgcaagaagcttcacaccttttacttctttcacctggtcaaggatgtctcctgctgcgctctgagccatcttgctcttaagactctcaacttctcccttcagagacttgttctctgcctgaagatgtgtgatcttctctgcaagattctccggagttgcttttacaagctgtgctgcttctttgagaagacgctccatctcagcatagtagttcataagtccttcagatgtcagggcttcaatacgacgaacacctgctgctacaccactctcagaaataatcttcagtgctgtaatctctgatgtattcttaacatgtgtaccaccacagaattcaacggagaatccactcatatctacgacacgtacaacatcaccgtatttctcaccaaacagagcctgtgctcctgtctttcttgcttcctcgattggaaggttctttgtcacaactgcgagggcatttgtgatctgctcattcacaatttcttcaaccttcttcagttcctcaggtgttactgctgagaaatgtgtaaagtcgaaacgaagtctgtctgcatttacaaaagatcctgcctgttctacatggcttccaagtactgtacgaagtgctttctgaagcagatgtgttgcactgtggtttctttctgtaagtgcacggttctttgcgtcaacttcaagagttaccgcatcaccaatcttgatcattccttttacaacatgtcctacatgtccaacctttgttcctgcaaggtgaatacaatcttctacaacaaactctccatcggctgtacgaatcacacctttatcagcttcctgtccacccattgttgcatagaatggagtctgctcaacgatgattgttcccttttctccatcagaaagtgcatcaacaacttctgtctctgttgtaagagctgtaaccttagaatcaaatgtcagattgtcatatccgacaaattctgtctcaagtgctgcatccagctgatcgtatacagaaacttcttttcctgtataagaatgagttccgaatgttccttctgatttcgcacgctgttcttcctgtgctttcttgaatccttcctcgtcataagtcagccccttttcttccaggatctcacttgtcaggtcgattgggaatccataagtatcataaagcttaaatgcattctctccggaaagaactttctctccattcttctccatctcagcttccatatctgcaaggattgcaagtccctgatcgattgtcttattgaagtttgcttcttctttcgcaattacattaaagataaactctttcttctcttccagctccggatatccatccttggaaccttcaattacagtcgttgcaagctttacaaggaatgctccgtcaattccgagcagctttccgtgacggcatgcacgtcttaacagacggcggagaacatatccacgaccgctgttagaaggtaagataccatcagaaaccataaatgttacggaacgaatatggtctgtaacaacacgcagagaaacatctgtctcatgatctattccgtactgcttgccggagaggttacatacatgatctctcagtgctttcattgtatcaatatcaaacatggaatctacatcctgtacgatacaggcaagacgctcaagtcccatacctgtatcaatgttcttctggatcaggtctgtatagttgccgtgtccgtcattgttgaactggctgaatacgttattccagatctccatgtaacggtcgcactcacatcctactgtacatcccggttttccacatccgtatttttctccacggtcatagtaaatctcagaacacggaccacatggacctgaaccgtgctcccagaagttatcttccttaccaaaacggaagatacgttctgccggaattcccatcttcttattccagatttcgaacgcttcatcatcatcttcgtatactgaaggatataatctgttcggatcaagtcccacaacttctgtaaggaactcccaggaccactcgattgcttcattcttgaaataatctccaaaagagaagtttccaagcatctcaaagaatgtaccgtgacgtgctgtcttaccgacattctcgatatctcctgtacgaatacatttctgacatgttgtcactcttcttctcggcgggatctcctgtcctgtgaaatatggtttcagcggagccattcctgaattgatcaggagaagactcttatcattatgtggtactaaagaaaagctcttcattgcaagatgtcccttgctctcaaagaactccaaaaacatttttcttaattggtttactccgtatggctgcatacatccatcctcctctttcgctcataaaaagcctattctgtaatataccacaacagcctccgtttgtaaagcggaggccggttattatccttatatttacttatttcagttcaatttcttccagttctttcggtggaagtgctctgcttgagtttttgacataagctgcgacatccttcttcgcagtcgggattggaatattcgttccagctcctgcaatacatccgccaggacatcccataccctcgatcagacatccattcattcttccggctttggcaagtgtcaggatcttcttacattctgccagaccttccgcatgctcaatattaacctgcgttccagggtaatactcgttaatacattcttcgattgcctttgcaactcctcctgcacaggcgtatccacgtccggctcctgtcgcatcatggaaagaagactctgcctcataagctgtcagatcaattcccttcgcatcaaacattgcctgcaattcttcaaatgtaacaacgaaatccacatcacttctcacagtacgtctggaagcttccagcttctttgctgcacaaggtccgataaatacaacctttgcattcggatgttcctgtttgattgttcgtgctgttgcaaccatcggagtcagttcctgtgagatctgatcgatcagatccgggaagaacttcttcgcaagcattgcccaagatggacaacaggatgtcagaagaaatggaagttctccggttgtcactttattcacataatgatgtgcttccgcaattgctccgatatccgctccaagagcaacctcatatgtctctgaaaatccgagttcttcaagagctgctttgaagtttcttacattaatattcggtccaaactgaccaacaaatgccggtgctacctcagccacaatctcttctccttctgaaagtgcacgagccagctggaagatctgagacttgtcagagatcgcaccaaacgggcagcttaccatacacattccgcaggaaacacatttgtcagcatcaatataagcacgtcctaatttatccgatgtaattgcattcactccacaagctttcttgcaaggacgctccttcttggcaatcgcatcgtatggacagacagacttgcactttccacacttgatacatttatcctgatcgataaaggattttccattcaccatggaaatagcgcccctcggacagacttcctgacaaggatgtgcaaggcagcccttacatacattgctgacctcgtatttattctcctcacagctctcgcagcctgacggaatcacctgcatcagcggcggctcataatatttttcagaaatattactggcctcaactcccgctgtcaaatggaccggcttattctccggacgaagggaaagtcccatcgcaagacggagtctttctcttacgactgctcttgcacgataaatgctctcacggtattttacttctgaatcttctcctacgatttcatatggaattgcttccatatctgctaccaatgtctctgcatttgctttaaatccaagcttggcaacttctgtaaatacctgtcttcgaattgcacgaaccggtgtctgtaatcctctcatttttgatctcctcctattcttcagttccaaaaactctctgtgcataatgaaccgactgcatggcatctttgccatagaaatcagctcctatcatatctgcgtagtcctgattcagtacagcgcctcctaccatcacaagacaatgcggagctttctctctaagctgtctgatcgtctcttccatacttacgacagttgttgtcatcaaagcacttaatcctaccagatgaatatcttgttcaagtactgtgtcaacaattgtctccggcggaacatcctttccaagatcgatcacatcaaagctatagttttcaagcagaaccttcacgatatttttaccgatatcatggatatccccttttactgtagcaagaatgatctttcctttcttctcctgaacttctccgctgctatccattttctctttaagcaccgcaaatgctgtcttggccgcttcagcactcatcagtagctgaggcaaaaagactgttcccttctcaaatccttcacctaccgtattcagtgccgggatcagctcttcgttaatgatctccagaccatctttctcctgaatcatctcagatgtaatgctgttcgcctcttcacgaagccctctttcaattgcacttttcagtgtcatcttgtgagctgaacctgttgcggaaaccggagctgttcccggctgctgtgcatatttattaatataattctcacagttgctgtccagattcattaacgcatggtatgcataccatgccttcatcatatcctccgagttcggattgataattccaacgctcaaaccattctgcattgccatcgtataaaagatggagtttacaatcggtctgcttgggagaccgaaagaaatatttgatacaccaagcacagtacacacaccaacttcgtcacgaagtctgcgaagtgtctcaagtgtcacctttgctccttccggttctgaactgatcgtcattgccagggcatcaattacaatatctttcttctcgataccgtattttgctgcctctgcgataatcttcttcgcaatctgtacacgtccctcggctgttgccgggattccgtcttcatcaagtgccaggccgatcacaacaccgccatacttccggatcagtgggaatactgcatccattgactcctgctttccactgactgaattgaccatcgccttaccattgtaaatgcgaagtgcattctccatcgcaaccgtatcaaccgtatcaatctgaagcggaagattcgtcacactctgaagttcctgaacaacttccttcatcaatgtcggctcgtcaatatccggaagtcctacgttaacatccagaatatgtgcaccgttatcctgctgtgcaattccttcttttaaaatataatcaagatcatgttccttaagcgcctgtttaaagcgtttctttccggttggattaatacgctcaccaataatctttgatccggttccaaggaacacactctgtccataagaagatactacagtataacttttcttctcaatcggcttcaccggaatgtctttacactgcttcaccatctctgcaatatgtgcaggagttgttccgcagcatcccccgatcacaactgccccaagatcaacaacatgacgcataacagaagcaaattcttccggagaaacatcgtaataagtttctccgtctttctgcttaggaagacctgcattcggtttgacgatcacaggcacagaggagtacttcatgatctgctccaggatcggcagcatctgctccggtcccattccacagttgattccaagagcatcaatccttaatccttcaagcattgccacaacagacggaacatctgctccggtcagaagctttccacgctcgtcaaaaatcgtcgtagcgaaaaccggaagagatgtattctctttcgccgcaagtactgctgccttcagttcataagtgtcactcatggtctcaatatggatcagatccgcaccggctttctctccgaggatcataacttctttgaatgtctcatatgctgtctcgaagtccagatcacccatcggttttaaaagctttcctgtcggtccgacatccagtgctgtgtagattcttcttccaccacttgcctcttcagccgcatccttcacatgcctgatcgcaagacggataatttcttccaatggaaaatcatcgcaatggaatttcaatgcattcgctccaaatgtgtttgcaagtacaatatcacttcctgctgaaatatattgtttgtgaatgtttttgatctcatccgcatgtgtaacgttccacgtctccggtaactctcccggctgaagtccctttgcctgaagcaaggttcccattccgccgtcaaaatataataactcttttcccaggcgttctcgtatcatcttcttgtatcaatccttcctctcttatctcttgcttatcgtcggtattcacaatctttttttgtacagacctcacatcctgagattggacatctgtccttctgtgtactgattccaattactgctgttaccgactttgttggtgtcatcataaagctgtctgtcaaagtcaacccgattgtctttgcacaattcaacattcgtacgactggttcctgataacagatatcaaaatctccatatccgggactgaatctcggtcttaaatacaaatgttcttcttcaagctctgccgcaatcttcttctgacactcatcacaatattcttctaacattgctgctgcacaagactgcaaaataactgctcttgccatatctgtcaaagaaattctgcgcatcagccggtcaactccggcgccaagtgttgctccaaaaagaacaacctgacggcatcctttcagatttctactcaggctcttactttgaatcttcatctgtccaataaccagtcttccgtcatctgtatgattcagatcaaaaatttggcagatggacttaggccctgcttcctgttccaggtctttgaaagactgttggatcagttccaaggttcgctcatctgcctcatttcttccaaatcccagataacgaactgcttcacgtactctcttctctgtctctatcatctggtcattcactttcttaacacttgataatctcggaaagattattcataattgctactgcaatttccggcttattcatagaataaatatgaatattgttcacaccgttcgcaagaagatcaataatctgatctgttgcataggcaattcctgcctgcttcatcgcctccggagaacttccgaagcgatctaatattgcaagaaatcttctcggaaatactgttccggaaagttcctgacttcgcttcatctgagcagcactggtaatcggcatgattcccggcagaaccggaactgtgatccctgcttctctgattctgtacaggaaattataatggatatcattatcaaagaacatctgtgttgtaaggaaatcaactccactgtctaccttctgtttcagataacggatatcatcctctttatgttcctgctccacatgtccttccggataacatgctgcaccaatacagaaatccccatgtttcttgatttcctgtaccagttcataagcataatggaatcgatctccatcagggaatgtcatgccttccggaatatctcctcgtaaagcgagaatattctcgattccatgagccttcaggttttcaattacctctccaacttcttcttttgtggatgaagcacatgtcagatgtgcaagactcatcactccgagatcatccttaatatgggatgcgatcttcgctgtgttcttgcttgttccgccaccggctccataggttacgctgatataagatgggttcagtttggcaatctcatctgttgctgataatactttgtcaaatcctgcatctgtcttcggcggaaacacctcaaaagaaatgtggatgcctttctggttcagtttgtcaataattttcatcgggtctgttactccttgctcttgtgttactcttgtattacttctttgttacttcttataattcttattctccgatcagacttctgtacagatcttcatactgtcttgcagaattcatccatgagaaatcctgagtcatcgcgcgctcgatcatcttgttccagtcacgtttcttatcataatagattctttctgcataacgtacggtgttcagcatctcatgtgcattataattggagaaactgaatcctgtacctgtcttctcaaactcattgtacggttctacagtatctttcaatcctcctgtctcacgaacgatcggaagtgttccgtatctcagactcatcagctggctgagtccgcatggttcgaataaggatggcataaggaatgcatcacatccggcataaagtctgtgagaaagatcatcggaatagaaaatattcgctgaaacctttcctgcatacttccatgcaaagtgacggaacatattctcatatttcggatctcctgttccaagtactgcaatctgtactgcatcctgacacatctcatccatcatataatcgatcagatcaaatcctttctggtctgtcagacgggaaacgattccgatcaacattacatgattgtctttatccagtccaagttcttcctgaagagcagccttattcaccggtttgtttttccggaaattctcaacgttaaatgtctttgcgattctataatctgtatccggattccagtcattgtaatccagaccattcacaataccgcaaagatcatttgatcttgctgccatcagtccgtcaagaccttctccatagaacggtgtcttgatctcttctgcatagctgtgacttactgttgtcaccttatctgcataaacaataccgcctttgagcatattagcatctttatatgcctcaagcttatccggaacgaaataataatccggaagtcctgtgattccctgtacagtctttgtatcccataccccctggaacttcaggttatgtattgtcataactgtcttgattcctctgtaatattctccaaagaaacggaaattatccagatataccggaatcagacctgtctgccagtcatgacagtgaatcaaatctggacggaacccaataaccggaagaatacttaaaactgccttacagaagaaagagaatttttcaatattccacttcggatctccatcatatggagcaaatcctgaaaaataaaattcattatcaataaaataaaatgtaactccatttaattctgtcttaaagattccgacatagcgattctctcctgcaaaatccatgtagaagtttgtgatatactccaggcgctctacccactcctgtttcatacacatgtacttaggtaaaactacacggcagtcatatttctctttatcaaaatcttttggaagtgaacctacaacgtcagcaagacccccggtctttataaatggtacacattctgatgaagcgaacaaaatgtttttcatacttagatcctccactttcacttgccctctttcggcaattacttataaaatattataccgcatttttatcataatgcaaaggatttctcattgtattttacttcttatttcccatgcctgtattccaattgtattgtatctgcgatcagagcaataaattcagaatttgtcggtttcccttttccattgcttactgtatacccaaaaagttcatccagagtgtccagctttcctctgctccatgccacttcaatcgcatgtcggatcgcacgttctactctgcttgatgttgtctgatacttctttgcaacggttggatacaggatctttgtgatcgcattgagcacatccatatcatctaccgccatcataatcgcatctctcagataatgataccccttaatatgagccggtattccgatctcatgcagcatatttgtcactcgtgtctccagactttctcctctgttatcagatgccgcctcagagcttcttgtttccataccgtgtgacatccgccccgcacttcggattcgttctaacaacatctcattttgaaacggtttcatcatatagtaatttgcacctttattaaaagcatcttctgtaatcttttcttgcccaactgctgtgattacgataaaatacggatgcttgctgacagttttgtcatgattgatccgatccatgaccgtcaatccatccattttcggcataatcaggtcgagaagaacaacatccggctgtttatctttgatgatctgacacatctcttcaccatttttcgcctttccgaccagattcatgtctttttccatcccgatcacacgatccaaaagatccaaaattttctggttatcatcagcaatggctattttcaaatgttccatcttcttctctcctttttctgagaacgtttgtcttgttacaccactcgtgtattatattccagcttttttgtcgtattcaagaaaatcttgcagtagtatttcgacatccttttcgacccttttcacgattcttcctctttcaacatattttcaataaaaataccgtatccttttgtcgaatcctgtacaaacacatgcgtcacagctccgatcagttttccattctgaatgatgggactcccgctcatcccctgaatgatgcctcctgtctttttcaataattctgtatctgtcacctggattatcattcctttgttcacctggtcggattctttgtcaatttgtgttatacagattgtatattctttcacctcaccatcaatgtagcagcgaatccttgcctcccccgtctttatttcctctttttttgctacctgtatcggaacttcctctcctatccagcttctgtctgaatttaattctccataaatacctgcatccgtatttttctcaatcactccaagctgatgaaaccgattataaacaataatcccttccattgttccaggattccctttgcttcccttttgcactttctgaatactggttctataaagcgttcctcttttgatcgtaagaagtgtacttgtatcaatatcatgaataccatgtcccagtgctgcgaacctgttattttttgtcaaaaatgtgattgtcccaagcccctgtacattatctctcacccagattccaagtcgataatttccttttgaaatctgcacaggagtcaatttcttttctaatatcgtattttcacgtctgactgtcagaaggaccttctctccatccagatgttccaccagatccatcaactgttttttcccctcaatcttctggtgattcacttccataatataatcaccagaactcactacgccctgtgcaggtgtatattcctttccatccacccccgtcattttctccgtgtctaaaaccagtacaccatccgtttccatataaattccaaccggcattcctccaagtagaaccgtatcgtcttccttttccgcagccagactttccacttcccggccactgacttccgtattttccataaatcctgtaatctgtgcacagccacataacatcaacagacagaacaaaaacaacagacctgtcctgctcatattccttttcctgcgttctttcatgatccacactcctctcttgcaaatattaaaagcagatgctgtttgcatctgctcttagtatgtgtggatcttcttcttttcacactggtattatttttctctttttgccagttctttcatttctctggcactgtctataattccatctgtcacatttgctcccccaagaagtcttgcaagctctgcaacagagtcttcctgatcaagtctctcgatctgtgttctcacagaattatcttctgcctctttatgaatgcaaaaatgaatatctgctgccgctgcgatctgtgaaagatgtgtaatacaaattacctgacggctctttccgatcaactgcagtctctctccgacacgacctgctgtgattcctgatattccactatcaatctcatcaaatatcaaagtcggtgtatcttcttcatctgcaagtacggtcttgattgcaagcataatacgggatagttctcctccggatgcgacatcccccagtggacgcacaggttctcccggattaaccgacagataaaactctgcatcatcttttccttgtgcagaataactttttgcttctgtcaaacgaatttcaaaacgtgcatccaggaaattcagttccgacatctgatgaacaatttcctcggcaaatttaactgcgttttgttcacgcactccatgcagttccatcgcagccttttccatctgcttttctgcttttttctgtttctccaaaagttcctgcataaaagaatcgtaatcttccagttccgatagtctctgtcttttttcctcacaatatgcaaggatatcactgacagtgtttccatattttgcctttaaatgattcacttcattcaggcgggactcaacttctgaaaactcttcttccgagtattcaaaactctttgcatattctaccagatcccggttgaaatcattcagcagactatcgatctccacgatctgatcataaagctggcttcccttttcatcaaaagatgctgcttcctgaaggcttcggattgcacggcttaagtaatcacttgcatttccacgttcgtcctctgcagtatactgatacgcttctgcaactccttctgtgagttttctgctatctgtcatcttgcgatactgttcttctaaaagttcatcttcaccttctttaagagctgcttcttcaatctcattcacttcaaattcagcaagagaaagttctcttcttcggctctcttcatccagcgaagattgttccaccttcttacatactgccttccattcctgatagcaggaagccattttttcttttaacggatccgtctgttctttcccataaagatcaagcagtgttaaatgattctttcgatgaagcaatgtctgattatcatgctgtccatgaatatcgatcaaaagactggctacatctttaaggacgctcatattcactgtctcaccgttaatcttactgacacttcggccttctaaaaggcggcggctcaatgtcagatatccgtcttccggataaatgtccaatgcctccagcttctttaaaatcttttcttctttgatgtgaaaagtaagttctaccaatccgctttttgccccgtttcgaagcatctgtgcattgtattttccacccagtgcaagcgtaacagagccaagaaggattgactttcctgctccggtttcaccggtcagaatattcaatccttccccaaactctacctctgtttcatcaatcaaagcaagatttttcacatacagattctgtaacatatatcacctatgctttccttgaaaccaatttccttatattctccattactacagctgtatcttcaactgtacgaattgcgcacatgattgtgtcatctcccgcaatacatccgaccacttcattccatttcattgcatctactgcagcagcaaccgccattgccattccggcaactgttttgatcacaaggatattctgtgccatatccatggaaacaaatccgtcacaaagcacacggatatatttttcgttcattccgtcatcttcctgtctatggacaatatacttctgacgcccaccgtttacagacaactttgtcagcttcagatctctgatatctctggagacagttgcctgtgtgaccttgaagccggcattattcagatattctgccagttcctcctgcgtctctatgtcatactgactgatcaattcaattatctttgcatgtcggctcactttcatagtatcaatttcctttcatcttctcgcgcattgttatcataaaactttcttcacttaattttacaagatgcgctttggcatctgattttctgatcttcactctgtctccgctaaccaattgtctctgtacagcgccgtcataacataaagctactttctcctgccttccataacggccctcgcaaatctcaacttcaacatcatcctctactgaaagcaccacactgcttgtgttaagtgcatgggaacagattggagtgataactatcagacttgctgttggctctaccaccggtccacctgcggaaagattatatcctgtacttcccgtcggtgtacagatgatcacaccgtctgcctgatatgtgttcaacaatgtcccattcacatatacattaaactgaacaatacgaagattcccttctcttgtcaggacgatatcattcaccgcaagatctttttcaccggatgacatcactccttccagcatcatacgtttctcaatattaggatcttcctcacagagtctatcaatcgctgatttataatctttcagttcgacatctgtcaaataccccaatgtcccaatattaattccaagaagtggaagtctgcttccttcaagatcacgtatcgcacgaatcaaagttccatctccacccaggaccagaccacaatccgcatcttccggaacagtccccggaacaataaatccttcctcatccttttgagcaagaataacatgtttgccttttctctcaatataatcttttatctcaatcgtaacagaataatctctgtcttttaattgatttgttatgatataaaaagattccataccatcacctttttactttgccagagcagcgaatgcttcatccactacctgatccagttcctttgtctcaatctttgcttcctcttccggacatttcttcaaatgtacaaggtattcgatatttccttctggtcccttgattggagagaatgtgatctcaagtacagaaaatccgattgataccgcaaattctgtcactttctcgattacttcatgatgtgtactcttttctcgcacaacacctttctttccaaccttctcacgtcctgcttcaaactgtggtttgatcaatgctacgatctctccatcatctgtcagatacgctctgattgcaccaagcacttttgtgagagagataaacgaaacatcaatcgacgaaaaatcaacaggttctccaagatcttccggagtcacataacggatattcgtcttctccatacataccactctcggatcctgacgcagcttccaatccagctgtcctcttcccacatcgatggcaaatactttctttgctccattctgaagcatacagtctgtgaatccgccagtggaagatccaacatctgtacagacctttccatctactgtcacatggaattctttcattgctttctcaagcttaagacctccacggctcacataggggagaacatgtccgcgtacctcaatatttacctcctctggaaatgttgttccggccttatcttctctctgaccttctacaaatacatttcctgacataataattgcttttgctttttctctggaatccgccagatttctctttacaagcaatacatccaaacgttctttcatgttacttttcttcctttattctctgatcatctgcaatgaccttttttacaatactctctctgtcgagaccaacttcttttcttaagacatctacatttccatgttcaacataatcatctgaaataccgattgtgcaaactttcaatgggataccctcgcgcatcacaaaatcttctacctgctcaccaaatccacctgtaagcacattttcctcaattgtcacaaggatcctgtgattttctgaaatcttccggattctctctgtatccagaggtttcacaaatcttgcattgatcagactacactgataccctgctgccttaagatcctcacgcacctgttctgcaaggaaagacatatgtccgacaaacattaccgcgatctcactctcttcatatagaagttcgctctttccatattcgatcggagcacggaattccttcagtccttcatatgcttctcctcttggataacgaagtgcaatcggatactggaaacctactgcaaagcgcaccatatccgccatctcccaacggttctttggtgacaggattgaaagattcgggatcaatgataaaaatgataaatcaaagactccctgatgtgtctctccgtcacttccaacaagacctgcgcggtctactgcgatcacaaccggcagattctgaagacagacatcatgaattgtctggtcaaacgctctctgtaagaaagatgaatacaccgcaaaaacaggcttcattcccccagcagcaagtcctgctgcaaatgtcatcgcatgctcttctgcaattcctacatcaaagaatctttccggaaatagctttgcgaatctggaaagtccggttccgtctgccatcgctgcagtaatagctacaaccttcttgtccttctttccgatatctgcaagcactttggaaaaaatatctgtataagaatccttccccgaccctccgatcgtttctcctgttgtcacatcaaaaggtcccgttccatggaattttgacggattcgtctctgccggaagataaccttttcccttcttcgtcacaacatgtacaagaactgcatgatttacccgttttgcttcattcaatgtctttattaatgtcttcagatcatgtccgtctacaggacccagatatgtgattcccatatcctcaaaaaacattcccggaacaaataattgtttgatcccgctcttcgtcttcttcacctgatggacgatccgttctcccctgccgggaatcctcttgatcgtatcttcgacacctctcttcaggtctgagtatacctgtgtcgtccgaagcccattcaggtaatttgacataccaccaacattcttggaaatggacatcgtattatcattgagtacaatgataaaattacttttcaatctggaagcgttattcaatgcttcatatgccataccgccggtcatagaaccatctccgatcacagatacaacgttataatgctcctgttgaagctctcttgcggccacataaccaagccctgctgagattgaagttgaactgtgtcctgtatcaaacgcatcacatttgctttcttttctcttagggaatccactcattcctccgtattttctaagatcatcaaatccttcttttcttcctgtcagaagcttgtgtgtataagactgatgtcccacatcccagatcagtttatcctctggaaaatgaagtactttatgcaatgccatcgtaagttcaacaactccgagattggatgccagatgtcctccggtcacactgatcttttcaatcagaaactgccggatctcatccgataattctttcagctcttcctctgtcagttcttttatatcgttggccttttgaatcttttcaagtgccataagttcctcctcaccgacaatcttatttttctctatatacaagagatttcaaaagctgctcaaggaaattatccccggcagggaactttttcagttcatcgattgcttcttctgtcatacgttccacatctttatgagcctgttcgattcctttaagtgttacatatgttgtcttttcattcttctcatcactatgtaccggcttgcccagctgctctgtcgtgcttgtcacatccagaatatcgtcctggatctggaatgccattccgatctttcctgcgattttctgcatactctttacatcttcttttgatgctcccgcaaggattgctccaatcatcatagcagactcgatcagtgcacctgtcttcagtctgaaaataaaatcaagaacttcctcatcaatctgatgtccggattctttcacatctacaacctgtccaccgatcatgccatagattccggcctttcttgccagaactctcatcgcttgtccgattctaaggctttcctccggaaattgctcaaacgccttgcatgctgtctcaaatgcatagtttaaaagtgcatcacccgcaaggattcccatatcctctccataaacgatatgtgtcgtctttcttcctctacggtactcatcattatccattgccgggagatcatcatgaaccagtgaataggtatggatcatctccattgctgccataaacggataaatcacttctgtctctccaccaaacagacggtatgtttccatcatcagcattgggcgaaggcgcttacctcctgccatcagactgtattccattgcttccatgatcacactctgatatccgtttgcttccggaagatattctctgagtatcgcttcaattttttctactttttctttctgttcttctttaaaattcatgactctctccattctcatccaaggcaagaactttcttttccacatcgctaattgtacgattacaacacttcacaagttccatgccttcctgatataaattaaaagaatcttcaagagaaagctcctctccttccagtccgccaatgacgcgatccagtctctcaaataactcctcaagacttgcagcctgttctatcttcttcgtgtctttcatcatttcctcccggttactgtttatgggaactttgtcctctttccccttctagttttacagtgtctgtaacgtaagtctcaatctgtccatccgttacataaatctgcaacaaatctccttctcttacctgatctgttttctttatattctgtccttgtgcattgcagacataagaatatccctgacttaatttctcaagaggagacaatcccttcatccgttctgcacaaagtgcgagtctgtgcttttcttttgtcagatgccgctccataagcgagcgcagtgtattctcagcgtcaaccgttctttgtctcttctcattgagtttctgtcttggatggagtgtctgaagtttcaatctgctgtgttccaaatgcatacgctcgtttagcagcttctgatttattgctcttcgaagtaaactctcacaattaagaatctgttccttcacttcggaatattcatacactgcaagctctgccgctgcagatggtgtcggtgctcttaagtctgccacataatcggcaatcgttgtatctgtctcatgtccgactgcagagatcaccggaacgcgacagtcaaaaatcgcacgcgcaacagcctcctcattgaatgcccacagatcttcaatgcttcctccgcctcttccgacgatcatgacatccacctgcttctcttccagcatatggattcctttcacgatgctgctcacggcaccatcaccctgtaccagtgcaggataaagcaggatctggacaaatggattccttctctttgccacattgatgatatctctgatcgctgctcctgtcggtgcggtcacaaccccgatcgtacgtgcatagcgtggaaccggctgtttgtactctgctgcaaacattcccatctcttcgagttctttcttcagtgcctcgaatctttcatacaaaagtcccgcaccgtccagaatgatctctcttgcgtacagctgatactttccatcccgctcatagacactgaccgcccccagcactactacctgctgtccttcctccatatgaaaagaaagcccagaccttgagcctgcgaacatcacgcaggctatcgtgccggactcgtctttcaatgaaaaatatatatgccctgatgtgtggtactttaaattagacacctcaccctttacatagattcggttcagcatgaagtcctgggtgaacatattcttaatataagaattaacctgcttcaccgtatagacatttttcattctttcgtctcttccagtgaacgcgcaatcttgccaagtactccgttgataaatgacggagcctcatctgaactgaacgtctttgccagttctactgcctcgttaatcgcaactcctaccggtacctcgtcatcccacttcatctcatataccgcaagtctcagaatggacagatctactttgttcattcttgtcgtcttccatccctttgcattggcattgatcagttcatcaatctcttctgtcttctcaagtactgccgcatattttctcttaatatattctttatccttatccgctgcatcttccaatgtagaaaaatagtattcaatctgctccggcatctcctgcggatcattaaattctatctgaaacaacatcttgaaaatgtgctcgcgaagttcttttctaaccatgttggctgattcctttcctgttcgcttttattcctgactctccatctcgactcctgcaaccttaatgttcacatcagccacttcaagtcctgtcatattctcaattgcattcttaactttctcctgcactcttgcagacacctcaacgatgctgtaattgtacttcaggttcaatgccaaggatacagtcacaataccttccagtacatcaaccttcacacctttggaaagattcttcattccgagctttccgatcagttcattcgtgatgtttccggccatagaagcaacaccttccacttctgtggcagcaagcgctgcaatgatcgctacaacttcatctgcaatcttaatctcacctttgcttgcgtcgttctgtattgtataaatatttctttcgtcctttgccataatcaaaacctcctgttttgtctgattctttctacattatatcaaaaatctttctatttgaaaagatttttatgaacgtccgaattctgacaaaataagtccttcatttctctcttctgtcatacggatactccactcatgcgcaaagagaagaagcggacgtcccttcagatccatgatcttcttcatatcagatgttccgctcaagcgatccatatcgatctcttcattctcaatccaacggatgtactcatatggcagattctccagacggatctctacattatattcattctgaagacgatacttcaatacatcaaactgaagtacacctacaacacctacgataatctcttccatccccgtgttgaattcctggaaaatctggatcgcaccttcctgtgcaatctgattgattccctttacaaactgctttctcttcatcgtatcaacctgacggacacgtgcaaagtgctccggtgcaaaggtcgggattccttcgtaagcaaatttctcttttgatgttgtcaatgtatctccgattgaaaagatacccgggtcaaatactccgatgatatctccgccgtaagccttatcgatcatctttctttcacttgccatcatctgctgcggctgggaaagacgcacatcctttcctccctgcacatgataaacactcataccggcctcaaattctccggaacagattctcatgaatgcgattctgtctctgtgggctttgttcatatttgcctggatcttaaatacaaatgctgagaagtctttctcagtcattggatcgatctcgccatgatctgattttctcggaagcggagaggttgtcatcttcaggaaatgcttcaggaaagtctctacaccaaagttggtaagagcggatccgaaaaataccggtgaaagctgtcccttatcaaccagttcctgatcaaactcagcggctgctccgtccagaagttcaatctcatctgcaagaatgtcttttgcatctgctccgatcagttcttctgtctccggtgcgtcgatcggtatcatcttcacttcacccatcgcagtaccttttttcgtatctgagaacagctcaacttcacgttttgctctgtcgtaaactcccttgaattccttaccggaaccgattggccagttgatcggacaagttgcgattccaagctctttctctatatcatctagcaattcaaatgtatccttcgcctcacggtcgagcttattgataaatgtaaagatcgggatgtgacgcatcacacagactttaaacagctttcttgtctgcgcctcaacacccttggatgcatcgataaccataactgcggaatccgctgccatcaaagtacggtatgtatcctctgagaagtcctgatgtcccggtgtatccagaatattaatacagtatccaccatatttgaactgaagtacagaagaagttacagaaatacctctctccttctcaatctccatccagtcggaaaccgcatgcttcgcagttgcttttcccttaacagatcctgcctggttgatggctcctccgtacagaaggaatttctctgtcaatgttgtcttaccggcatccggatgggatataatggcaaatgttcttcttttctttatctcattcgtaatttctgacatttctaatctcctatcattttcacgcaatagataactgtccgcaggcatcccgtagacagttacataataaaccagtaaatagtgtatcacaagtcctctctgacagcaaatcttttattaaaaagtttttccaaaaatatactttctattcatgaattggtgtaattacaatcttctccggctttacatccgactttcttgtcacaatatcctcaatctgggcacggtttgcatccgtaagctcctctgcatttacaacaacatctgcactatcttcccccagacttactactgcctctgaaaatccttttgttgccatcaatgtctcaatttccatctccgtctctgattgttttgtaagctccaccatctgtgcaactgcatctgacttttcctcttcactgagctccgtattgtctatgattgactgcagtgtttctttattctgggcacgcacctgttctcttgtaacttttgcctgggctaccgtagtctgggctgaaccatttgttagaaccgcctctccaggtgttccttctgtttcagaatcattactttcaatttcttcgcttcctgcttctgtatcttcctgtgaaatatccaaaagttcctgatttgtaagatctgcattagcttcttttgttcctttcgcattctcgccaaacagacgtcccgtgtagttcagatatcctgctgccgcgatcataaccgcaagtgccacaatgatcaactggtttttcttcactttccctttcattaagataaacctccttttatgtaggcgcacgtttcattatttttatcttatgcgcttctacaccaaataatgcctgcaccgcttctgtcagattcttcgcgacaactgcattcccacctccatctgctattacaagaattccctccacttccggtgcattttctttacttacatatgggatctgcgttccgtctgtcccctgactgtacacggtcgttttatccaaagatttctcttcactttctcttgtctctccctggttgcctgcttccttcgtcgtctgatgtgtactttgctgatctttttcaaccaccttctgtcctgtagactttaatgtgatcatcaccgtcacctttcccgccccatctacgacaccaagtgtctgcgctgtcttctgttccagatatttttcatagtctgccatggaatctgtctcatacgtctctcctttcccggattccccgttaatctttgtatccttatccacctcccctgtcttcggaaccggaaccgcaactacaagaagcagcagtccacacaggaataaaatggctaatcttgttcttttctgaccacgatccgcctgttttatcttccttgtgtatcccacgatcctttctttccactcctgccaattattgtccaattccgatttcctcccgttttatagaatccgacatccgctctatttctttctcatattgctgatacacttccctttgataaaactgctctgctttcagtcctttcaacgccgcaacaggggatagtgcaagcaggatcaggacaagtccacagaaaaaacgaatatatttttcataatcctttcccggaatcacctgcagaactgcactcataacgagaagcattgaaatgattttttgtatccattgtgtaagcatccggcagattcctcctctctcctctgaaaccttaagatgttacagccaccacaagtgcaatgcttaagacaaacaacagtgttgtggatgctattaccttcaccataagctgataaccagaactaactccagatatgcatgttgtaattctccggtcagaaaccggttggactaatgccgccacaagttggtacaaaaatgccaatatcagaaattccaccagtggaataagtgccaggacagctataaaaatcattcctgctacaccgattccattcttaagcagtactgcaactcctaatgcaacatccattgtacctccggcaacatctccgatccacggaaccgcctccagtgttcgtcctgcagcagtcattttcaaagaatcaattgccggattcaaaaatccccggatcagactgatcccactcacagcggcaatcatacttttcagactccattggatacatttttccagaagttctgcaaattctgagaaaagatcttctccggtcaggcaggataagaccctcaccatcccgtagatcttcacagccggtaaaagaaagtgaagtacaagcagttccaccagatagatcaggaacagtattgtattataaaacatcaacgccgaactgctctttccggtaaatgcaaccgccagaaagaaacttgggcaaaacacctgcatcaattggacaagctctcctgttttttcttcggcatataaattcatcgattgatatgcttccagacagattgcgatcacaacaagatacaaaatataaaaacccgcttccgctgtctgtctgttttgaaagatacttgtaaaattcgagaaaaatgcagccgccactgtaatcagcagcaagcgcgccagattcttccttcctttctgaaaaacagagaacacctgtcctgaaaaaaactcaagaaatctttctcccaattccttcgtatttccgctgatcagcatctctgtaagatcacgaaaccgaactttttctcccagttctgtctctcctgataactgatcgatctgtctgaaatcaaattcatccagcagactttcttccatttgttccagctcatcctccaacatcccggaatgatcttctgtttccttttcctccgctgtaccatgctctgctgcatacacgctgccacatcctgtcacaaccgtaaataaaaacacaaaacagaagagctttttccaaaaatatttttcccttttcatatcagaaaatctccgattagttccagcagcgcaagaagtaccggcattcctatcgcaaggatcgtcaactttgtaaaaatctcaatctgtacagcaatattctgataccctgcatctttacagattccggatgcaaattcagccacataagtcacaccggccattttcaacagaatactcatctgtccggcatccagttttatataatctgcaattttctttactgtctgcacaaagatttcaagtcgtgaaagcatacaaagaaataaaaacaggctgactgcaagacttacataaatgccatattcacttttaaactgcaaagcaagtaatgttcccacgacacccaaaagtgcgatttgtatactgttcaattctgttccgccctccttaaagagaaaacaattgccggatcgaagaaaataagtcataaatcgccgggagaacccaggataatacaagaatcagccctgcaagacttgtcaggaatgcctgttcctctctgccgctatgcttcaaaacctgactcagaatagatacaagaattcccaccgccgcaattttaaatatcagattgatgctcacattctccctcctctcccttttgttcccgcccttttaaagcagaaggatcacaagaaaaatccctcctgctgcccccagccagctaccgagctttttcttctcagacgtttccgcagttctcttttcaatttccatatccagcctttttaaatgatactccagcagacgaactacaccttctctgtctcctatttcaagcagttccccaggttcgcagatcagaggattcattttccctctccatttcagttccggaagatcttttcctatcgtatctgtccacaagtcagcaaaccgcttttcctgtgtgccctgacattgaaatgccagatccatcagccagttttcataaggttccttctctcttgatgcaatattataaaaaatttccgaaagcggaagtcctgcatacagtaattcgccttttatttgttctataattctgcgaaaatgactcaattcttccagataattccgaagttcttttccatacatccatcctgctccggtcgtcgccaacaagatcagaaaacatccgactaatttctgcacagcacacgcccccgctcatcatagatttcccggatcttgccaggaccgtgatcctgtccaagcacaacataacgctgaaacattcttctgcggatcaggtcacccaggatcggctttttagaagcctcatccatatcaaggctgtgtacactcgcgatcagccggcagccgcactgcatggcatattcaatggcatggatatcctcacttgtaccgatctcatccactgcgatcacacgcggcgccatagaacggatcaacatgatcatcccctccgctttcggacaacagtctaaaatatcagtccttgtacccagatgattctgcgcgattccaagataacacccaccaagctccgatctttcatctaccacaccgacagaacacccttttatgtattcatttccatccgatatctgacggatcagatcacggatcaaagtagtctttccgcaacacggcggagaaatgatcaatgtatggcaaatctgtttattttccgtaatatatggaatcaatgcgtcagcacacccaagtacttcgtgagaaattcttacatttagcgaagaaatatactgtatattttttactttttcattttctataattacttttcctgccaccccgaccctgtgacctccttccactgtaataaatccctgtttcaactcattctcatatgcatagagcgaataatgacaaatatatcccattgtctcaccaatatcttctttcgtaaccagatacgggtgtaccgggtccggaagaacccgttcctgccctttcatctgaatcagcagcggctgacctgtacgtatcctgatctcctgcagttcctccggattactgacggattcttctacaagcttacggattttttctgccagcagattccagacctgcatcttcttgttctgtctttccatttccatcttgtccacctctccagttgttgtccgtacccctcctctctacacaatatatggataagattcttaaagtattccttgcgcatacaagaaaagaggaacaaaacccagtttcctgaattctgttcctcttttcttattctttctgattcttattctgcaacatctttcatgctgaagctgaatcttcccatcttatctttaccaaggcatacaaccttcacaacatcaccgatgcttacaacgtcttctaccttgtcaactctctgcttggaaagcttggaaatgtgtaccattccttctttacccggtgcaaactcaacgaatgctccgaattctttgatgctgataacctttccttcaaaaagctgtcctgcttcgtaatctgtaacgattgtctggatgtacttcgcagctttctccatgttctctttctctgtaccgcaaatagatacatttccttcatcatcgatgtcgatcttaacacctgtctcgtcgatgattgcattgattgtcttaccacgctgtccgacaacatcaccgatcttctgtggatcgatctgcatctgaataatcttcggtgcaaactctccaacttcttttctaggctcagcgattgctttattcataacttcatccatgatgtaagttcttgctttctttgtagcagcgattgcttcttcgatgatcggtcttgtcagtccgtggatcttgatatccatctggattgctgtgataccttcgtgagtacctgccaccttgaagtccatatctccgaagaagtcctcgagtccctggatatctgtcagtacaaggtaatcatcatctgtctcacctgttacaagtcctgcagagatacctgctacagcagacttgatcggcacacctgctgccatcagtgacatactggatgcgcagacacttgcctgtgatgtagatccgttagactcaaatgtctcagatactgtacggatcgcatatgggaactcagactcgcttggaagtaccggaagaagtgctctctcagccagtgctccatgtccgatctcacgacgtcccggtcctctggaaggtcttgtctctcctacagagtaggacgggaagttgtagtggtgcatatatctctttgtcttctctgcttcatcaaggccgtcaagcttctgtgcttcagaaagcggagcaagtgttgtcattgtacagatctgtgtctgtcctcttgtgaacatagcggaaccatgaactctcggaatcaggtctacttctgctgcaagcggtctgatctgatcgatcgcacgaccatccggacgcttgtgatctttgaggatcatctttcttactgtcttcttctgatactggtaaacagcctcaccaagctttgcaagatactcttcgttgtctgcaaatgcttcctcgagtctctctgtgatcacacggatattctcttctcttgtctgcttgtcatctgtaaatacagcctcttccatctcagcagccggaacgatctcctggatcgcatcaaagagttcctgcggaacagcaaagctctgatactcatgtttcggctttccacactctgcaacgatcgtgtcaaagaaagcgatcactttctggttcagatcatgtgccgcaaagattgcttcaatcatcttcgcttccggaacttccttcgcaccggcctcgatcatgataaccttttcctttgtagaagcaactgtcagtgcaagctcggaaacttccttctgtgctgctgtcgggttgaatacgaactctccgtcaacaagtccaacctgtgttgtagagattggtccgtcaaacggaatatcagaaatacttgttgcaagtgcagcaccaagcatagctgtaagttccgggctgcagtcctgatctacagaaagaacaagattctcaagtgttacgtcatttctataatctttcgggaacagaggacgcatcggacggtcgatgacacggtctgtcaggattgcattctcagatgctttaccctctctcttattaaatcctcccgggatctttcctacagcgtacattctctcattatactctacgctgagtgggaagaaatcaattccttctctcggcttgtcagatgctgttgctgtacacagtacagttgtgtcaccataatgcatcagcactgcaccattcgcctgttttgccacacggtcaacatccacgcgcagtgttctgccggccagttccatttcaaactttttatacatggttttctcctttttatcttatcttcgttttatatgagcagaacaattcgctccgaaactactgaaaaatgtactattccatagcaattgaagcccactgtaatcgattgataatacacttttcagtggtctcggttcttctctgcccacaagcttttaaattatatcatattccataataagaagtaaatagttttccaaaaaaagaacaaaaagtaccaaaaattcagacaaaaagaaacagaccagaaaccacatcatcagatgcagcttctgatctgtcaattgatcttcttttttggaaaatcttattattttctcagaccaagtttctcgatcagagcacggtatctctcgatatctactttcttgaggtatgcaagaagtcctcttctctgtccaaccatcttaagaagtcctcttcttgagtggtgatccttcgggttagctttgaagtgatctgtcagctcgttgattcttgctgtaaggatagcaacctgtacttccggtgatcctgtatctccctctgttcttccaaattctttgatgatagcctgtttcttctcttttgcgatcattgtaatatcctccttaaaattcttagttaaaccgcctggcattaagcaatggtcggagtgatccgattaccgaacaccggctgatttgatacctcggatagtatagcacagagatatctgcttgtaaagcacaaatttaaaatcttttatctttcatcgaatggatgatttttcagatattcttctccgtaccgcatatctttcatcacgcggtctttgagttcttcaaccgaatgaaatttcgtttccggacgttcgaactccagaatctgcactgtagcagtcttcccgtaagcatcgccttcatatccgtaaacataaacttcgaacaaccgtcttttctcttgcgcaacggtcggtttcaccccggcatttcccacaccgccataccatacaccatccacaaggacgcgacaggcatagacaccgtactttggcaggattttcttttcctgcggtgcaagattcattgtcggaaatccaagtgttcttccaagctgctgtccatgttccacaacactggtgatctcatacggataccccagaagcttatttgcaagaggaatatttccatcgaggagaagttccctgatataagtgctgctgatctcccggtctttgtaatatgctttctcgaccacatcaactgtatagccatatttcgctgcatatttctccagcatctgatgattgcctcttttttcatgaccaaaattaaaatccgttccaacaacaatgtatgatgcgtgcagcttcttatgcaggatttcatcgataaatttttctgcttccatctccatcatttctctcgtaaatggaatctcgatcagataatctaccttgtcctcaagaaatgcccttcgctcttcatttgtcatcagacagtctctgtccatatcaaaggcacaaacgacactgtcgcagtcttccttctgcgcatatttcattattctgttgagcagcttctgatgtcctctgtgcaatccatcaaactttccaagcgttaccgctgtgtgatttcttccgtcaaaggcatctaatccttttatatattgcatgtctgtcttattcgtcctttatttctcaattttctctgcttcaggatccagaaacattttcttaatatggaacagcttcttcggtgcacgatactgataaaggccgataaaattctttctggaatcatatactctgacttcctgtccatctgtccacgcttctttttctaacagaaaacgttccggaagatcatttccgttataagacatccacgccttcgcatccgtcacagtaacggccggcagttccgcgaagatctgatccagaggagtgaaaagttctgcaccttctccctgttccatcttctgtcgcacttcatccagtgttaccgcatcttctttcaggaaacggccgactttcgtacgctcaagttcttccatacagccgcccacctgaagcttctctccaatgtcatggcacaaagtacggatatatgttcctttagaacagtccacctccatacgcacatgcggaagattcatctccagaatgcgaattccatggatctggacttttctgctcttacgctccacggtctttccttcacgggcaagctcataaagcttctttccattcactttcaacgcagaatacatcggcggaatctgatcatattctccgataaatgattcgatacaggaacgtacttcctcttccgtcagattgcccggatccctctcctccagaacctctccggaaatgtcctgcgtatctgtcgtctttcctaaaagcagcagagcctcatatgtcttatcatgatctgtcagaagctcacaaacctttgttgctcttccaagacacaccggaaggactcccgttgcatccggatcaagcgtacctgtatggccgatcttcttctgtccgacaacttttcgaagaaccgcaaccacatcatgggaagtgtatcctttttctttgtaaatattaactattccgtttatcatttttcctcgtttttctcttctgccgctctaagctgtctttcaattaaaagtgtcagattgttgatcacatcatacggggaacctttcattgtaacaccggctgctctcacatgaccgccaccaccataatatttcgcaactgcacttacatcaacgatttcttttgatctaagacttactttaaatgtctgcggttcgagctcgtaaagaaggattgcaacctccacacctcttgtctgacgcaatacgctgacaattccatccagatcagacggttttgcctggaagaactccatttctttcaaacgtatcactgagacaaccgctttcttattcaggatcatcatactctcaagaagtgccttcccaagcatctgattctgaacataggatttttcaaaatatgttccgtcaatgatcgcgcttccattgatcccttttcttaaaagtgcagcaccgacttccattgtctccggtgaagtacaggaatactggaacactccggtatcatgcacaatccccatataaaggaaagatgcgatttcttccgtaatcttctcctcatccagcagacggaaaacaagttccgaagtagaacttgcatccggcacgatataattcgtgtctgcaaaagactcgttactgatgtggtgatccacacataaagtttcctttgccttttggaacaccggctcggaaaaaccaagacgtctttcgtccccgcaatccagactgatgaaaaggtcataaactttgccttctacaatctcatgcttcggcacatctctgtgtcccatcatctgaaatgcttccggaatctcctccagatacagatctgtctcaatctccggataataagtggtcagataaagatataatccaagtgtagaaccaacgcagtccccatccggacgaatgtgtccgccaatggctacactgtgtttcccttttaatacatcgtttaatacgatcatctattcctcagctccatccttcaaatctcttgtcacttcgtcaattttcttgctgatatttactccatattcaatggactggtctacgataaatgtaatctgtggtgtgttgcgcatattcactgtacgtgcaagttctctgcggatatatccctctgcactctgaagacctttgatcgtatcttcctgtgctttcttgtctccgagaacactgatatatgccttgcatgtcttaagatccggtgctacttcaacagcaacaacagatgtcagcggtgcaacacgtggatctttgatcccgccacgcaggatattactcagctcacgctgtacttctgcattgactcttgtattcttaatactgttctttctcatgttataactccttttttatacagaaaagttactcctgcaatgtatgacccctgcacgagtaacaattctgtcacctgctgacaattacaacactctgcaaatgtcggcatcttttattcttacttgcgttctgtctctaccatcttgtaggcttcaacctgatcgccttctttaatgtcattgtagttctcgaatacgagaccacactcatatcctgttctaacttccttcacgtcatctttgaaacgcttcagagatgccagcggtccgtcgaatacaacgattccgtcacggatcagacgaacagaacagtttctctcgaagataccgtcaagcacatacgcaccggcaattgttccaactcctgatgccttgaatgtctgacgtacttccgcatgaccgagaaccttctcctcaaagacaggatcaagcatacccttcatggctgcctctacatcttcgatggcattgtagataactctgtaaagtcttaagtcaacaccctcgcgctcagcgatatctttcgctgttgcatccggacgaacgttaaatccaatgatgatcgcatttgatgcagatgcaaggataacgtcagattcattgattgcaccaacaccgccatggatgatcttaacaacaacttcatcgttactcagcttcagaagactctgcttgattgcctctacagatccctgaacatcagccttaacaacaatatcaagttctttgaggttaccttcctggatctggttgaacagatcatccagagacatcttggacttcgtctcttccagaagttttaccttgttctgggaaataaatgtctctgcaaacgctcttgcttctttatcagactcacatcctacgaatacttctcccgcattcggaacatcattcagaccaaggatctcaaccggctgggacggacctgcttctttcacacgtcttcccttgtcatccatcatcgctcttacacgaccatgagcgcttcctgctgcgatcgcatctcctacgtggagtgtacctttctgtacaagaacagttgcaacagatcccttacctttatcaagctcagcctcgatcacaagaccacgtgcggcacggttcgggttcgctttcagttccataacctctgctgtcagaaggatcatctcaagaagatcctggattccttcatgtgtatgcgctgataccggaacaaagattgtgcttccgccccagtcttccggaatcagttcgtattctgtcagttcctgttttacacgttcaacattcgcacttggcttatcgatcttgttgattgcaacaataatctcaattcctgctgctttcgcatggttgatcgcctcaattgtctgtggcataacaccgtcatccgcagcaactacaaggattgcgatatctgtagagtttgctccacgcatacgcattgcagtaaatgcctcatgtcccggtgtgtcgaggaatgtgatcttttctccgttaatctcaacaacagatgcaccgatgtgctgtgtgataccaccggcctcacgacctgttacattactgttacggattgcatccagaagagatgtcttaccatggtcaacatgacccataacacatacaaccggtgggcgttttaccataaggctttcgtcttcttcatcctctttcagaagttcttcgattacatctacaacttcttctttctcacagagaacatcgaattccatcgcgatctcttctgctgtctcataatcaacttcctgatttacagttacgatcttgccctgcatgaaaagcttcttaacaataacagaaggaacgatcttcatcttatcagcaagctctttaattgtaagaacttctggaatcacgatctgtttgatctgctcttcctgcttctcttccttcacctgtggcttcttcacttccactgccggtttctgcttcttgccttttcttccttttccttcgaaagcttcatctctgtattctttcttcttattatctctttctttgtctttcgctttgtttctctgtgtcttctgctgttctacgatcggtgtagcgtcacttctgtcgtttctgcgattgtcatttcttctgtcagagcgctgtccctgtccgcgtccgtctcttccgtcacggttctctcttccatcacggttgtcgcgtccctggaatccgtcacgtcctcctctgtcagaacgctgtccgcgtccgtctctgtcctgacgtggtcctctgttttcgcctctgttctcgccattagaacgtctgtctccaaatggtttctgtcccggtctgtcagagcgtacctgtcttccctcaccactcggacgtcctgttctttctgttcttgatccctgcggtctctcagaacgtgctccgttctgtgccggacgtgcctgtctgtcctctgctgcacgaaccggtctttcgctttttgctgccggtttctctgtacgagccggttttccttcaccattcgaacggctctgtcctgctgccgggcgttttccatcaccgtttggacgaccctggttctgtccctgacgtccctgtcccggacgttttccctgcagtctgctgctgttctttgaattctgtgggcgaactacaaatgcaagatttttcttctttggagcaccctctttttctgttgttttatctgcagccatctcagcatctttgccagctgcttctcttctaatatcttctgccacgttatcctccctggtgtttaaactctttttattttcattctgcatcttctcatctgccatataaatctacctccttcaagcaatcaacggggaacctttgtcttctactcccattcatcaggtacgggatttcagttcttttaatattccttttgcaaatccttcgtctaatatcgccagagatgcacggaattgttttcccatcgcatgccccaaggtatctttatctccgtaaactatcattggaactttataaaatttacacatatcacggaattttttctttgtattatctgaagcgtcttctgcaacaactacaaggcttgctcttccggacttcgtctgtccttctgtcataaattcaccgcttgcgcagcgccccgctttcgttgccagactgatcagagacagtactttatctctagccaatctcatccatctccttttccagccgttcatatacttcctgcggtattgcctgcttaaaggaacgctccagtcctctgttcttcacagcctgctcaaaacatgccttctgcggacagagatacgctccacgtccgtttttctttccggttgtgtcaatgacaaattcttcttcctctgttctgaggatccgaatcagttccttctttggtttcatctcgccgcagcctacacatttacgcataggtactttcttctttactgccaaacaattcactccctcagatcttactcttcgtctgtctcaacgaattcaatctcatctgctccgtcttcatcagctgcatctgccggaacatcatcgtactcttcttcctcttctccgactgtatagccttcttctccgaccatacccatctgctccatgtagttctccggaagatctccacactcaattgcctgtgtctcactcttgatatcgatcttgtatcctgtcagacgggctgcaagtcttgcattctgtccttctttaccgattgcaagtgaaagctgataatcaggaacaataactcctgcaatcttctcatccggatcagccataacagaaataacctttgcagggctgagtgcattctcaatcagaagtgccggattctcatcccagttaatgatatcaatcttctcaccacgaagctcttttacgactgcatttactcttgcaccgttcataccaacacaagctccgaccggatcaacattcggatcgttagaccatacagccatctttgtacgggaaccagcctcacgggcaatgctcttgatctcaactgttccgtcctttacctctgcaacctctgattcaaacagacgttttacaagttccggatgtgtacgggatacaaggatctttggtccctttggtgtgttcttaacttctacgatataaagcttaatacgctctgtcggctcgaaatgctctcctttcacctgttcgttctctgtaaggattgcatctgcttttccaagattcacactgatattcttgccaatataacgctgtacgatacctgttacgatatccttctctttctcgaaatactgatcaaatactgccttgcgctcttcttctctgatcttctgaagaatcaggttctttgcattctgtgttgcaatacgtccgaattccttggaatgaagctcaacctgtgcgatatctccgatatgaagtgccggattgatcttctctgcatcctcaagactgatctcgattgcaggatcaaatacttcttcaacaacttctctctctgcgtatacagaatagtcacatgtcttgcggtccataacgatcttaatattatcggatgttccgaagtggttcttacatgcacttaaaagtgaattctcaatggcctccaacatgacatccttgctgatgttcttctctttttcaagaatatccaatgcttcgagtaattctgtgttcatttttctttcctcctaaattaaaaatccaaagcctgacggatcaaagcgatttcttttctgtcaaatgtctgctctgtctcatcttcgtatgtgatggtcactgtattctcatcataactctttaaaattccgacgaactctttctgtctgtcgattgcacggtatgtgcggatctctacttcttctccaagatttctcttaaaatccttctctttcttaagtggtcttccaagtcccggagaacttacttcaaagatataggagtcttcaatataatccttctcatcaaggatatcggagaatctcctgctgactgcctcacagtcatccacggcaattccgcctggtttgtcaatatacgcgcgaaggtaccaggtacctccttctttcacatattctacatctaccagctcaaacccgagttcctctacgataggctcgagaagtgcttctgtctgctgttcataatcttctcttctggacacgctgcgtcaaactccttttcttctataatatagtttgtgatctgattcataaagaattttccatatcaccaaagaagagtgaactttcgtccactcttctgccaattccttatgtaactatatttactctagcacttttccgtgaggaaatcaaggggttttgcacattttcttacaatgcctcaaaaaattccatgactttctcccgcattactgcctctgctgccagcaatgcttctagcggcttttggttcctgttccatcccgtttcgccagtttcaggcggttcagtgaaactgtcttttctccataagtaatcttcgtctctgttccttcttcaaaaagataaacttcttctaattcatccttcttctgaagcttaattcctctgacaccgacagctgcttttttcttctccggaacatccgcagataaaaacctcaggaaatatccgttcttcgtctgaaggacaacattctgatactccgtcacaaccttcactgcgacaagcctgtcttcttcctgcagctttgttgccgcgatcgtgcgcttggatacctgaaattcacttccatccacacgcttgatcattccctgtgctgttgcaaacaataattttgaacaacgcatctgctcttcttcacagatcataacaatctgttcttcactgcttgaataattacttacattatcaatcggaatccctttgtctctgaactttccatgtggaagatcaagcaccttcacctgatgcatcttgccttcatctgtaaacagacagagttttccaatgttcatacaatgcacaatgtatttattctctttgtctgcagcttctttattcctctcatagactccggtatccactgtcttcgcgtaaccaaagcgatccatcagaaagacgacctgctgctcttcaatcttcttctcttcaaaaacagcttcttctgcattctccacaacggtacgacgctttcttccgaattcttttttataactgtcaagctcttccatgatcacgcctgccatagaatcatagttatttaaaatatcttcataacgggcaatattttctaatgtcttctcatgctctttctgaagtgcttcaatctccagaccgatcagacgataaagacgcatctccagaattgccgttgcctgacgttctgtaaaacggagcattgccgccatctttttggaaatcgcagacttgaacttaatgttttccgtctcaccgtttaccagacaggcacgcgcatcttttacagatttacttcctcgtaaaatctcaatgatcaggtcgatcacatcacatgctttgatcagaccttcctgaacttcactcttctcccgctctttgccaagcaaagttgtatatttcctcgttgcaagttcaaactggaaatccacatgatgttctatgatctgtttcaggcttaaagtctccggtctgccattcgcaaccgccagcatatttacgccaaatgtatcttccagacgtgtcttcttataaagcatgttcttcaagttctcaacatccgcaccacgcttcaattcgatcacgatacggattccttcttttgaagactggtttgaaatatcaacgatatctgtcgtcttcttggattccacaagattgcagacatcgtttaagaactttccgattccggctccgatcatcgtgtatgggatctctgtgatcacaagctgcttcttgccgcctttgagctcttccacttccacttttccacgcagcttgatcttcccctgtccgctctcatagattgccggaagatcatccttattgaccacaattcctccggtcgggaaatccggtcctttgatatatttcatcagctgctttgtagtgatcttgtcattcttcatatatgccttgaccgcatcgaccacttcgcagagattatgtgtcgggatacttgtcgccataccgactgcaattccttccgcaccattgatcagaaggttcggcacacgcatcggaagcacaagcggttccttctccgtctcatcaaagtttggaccaaaatcaataacattcttatccagatcggccagacatacttcctgcgtgaacttcgtaaggcgcgcctctgtataacgcatcgcagcagctccgtctccctcaatggatccaaagttaccgtgcccgtcaacaagaacctgtcccttcttgaagtcctgcgccattactacaagagaatcgtagatggaactgtctccatgcggatggtatttacccatcgtatctccgacgatacgtgcgctcttacgataaggcttatcataacggataccaagctcgtacatatcataaagtgtacgacgctgaaccggcttgagaccatcacggacatccggaagtgctctggcgataataacactcatcgcataatcaatataagatttcttcataagatcagaatattctgtccttatgatctgtgattcattactcattcttcttctccttagatatccagttctgcctctgtcgcattttcatagataaaattacgacgcggcggtacttcagttcccatcagcatctccgttacactcgaagccattcgggcatcctcaatctctactcgtttcaacatacgtctctccggatccagtgttgtctcccagagctgctccgcatccatctctccaagacctttgtaacgctgaagtgtaaacggacctgtatgtgtctttctataacgttccagtgccttatcatcatacagatactcttcttctccactctttggcattgccttataaagtggcggcatcgcaatatacacatgtccttcaaaaataagctccggcataaagcgatagaataaggtgagcaataaggtagaaatatgtgcaccatcgacatcggcatcggccatgatgatgatcttatcatatctcaactttgtaatatcaaagtcatttccgtatccttcagaaaatccgcagccaaatgcattgatcatcgtcttgatctctgcatgggcaagcaccttatcaatacttgctttctcaacatttaagatcttaccacggatcggaaggattgcctgataatttctgtttctcgctgtcttcgcagaaccgccggcggaatctccctcgacgataaagatctcacacttcttcggatctctgctctcacagtttgctagctttccgttactgtcaaaagaatacttctgctttgtcaggagattggtctttgccttctcttctgtcttgcggatcttcgcagctttctccgcactggaaagaactgtcttaagtgtatccagatttcgatcgaagaaacgaacaatctcttctcctgttaccttgctgactgctttcgccgcatccgggttatccaactttgtcttcgtctgcccctcaaatctcggatccgggtgcttaatggatacaattgctgtcattccgttacggatatctgcaccggtaaaattcgcatccttttctttcaggattcctatctctctcgcatactggttcatgacagttgtaaaggttgtcttaaatcctgtcagatgtgttccgccctctgcattataaatattattacaaaatccaagtacattctcatgaaactcattcacatactgtagtgttacctctacttcaatcccgtctgcttcccctttaaaataaaccgggtcatgaagtacttctttcttacggttcagatcctggataaatccaatgattccttccggttcatgataaacgatgtgctcaacacttccatctctcttatcatcaaacacgatcgtcagattcggattcagatacgcggtctcatgcagacggctcttaacctcttccgctttgaacttcgtcttctcaaagatcgtatcatccggcagaaaatttaccgttgttcccgtctttctcgtctttccgatcttaggaagaagtccatcttccagttcgatcaccgggattcctctctcgtaccggtcatgatgaacaaatccatccctgctgatcttcacatccatataagtagaaagagcatttacaacagaggaacctactccgtgaagtccaccacttgtcttatatgcagaatcatcaaacttaccacctgcatggagtgtcgtataaaccagacgagccgcagatacacccttctgatgcatatcaaccggaactccacgaccgttatctgaaacggttgcagatccgtctttttccaatgtcacctggatctcactgcagaatcctgccaggtgctcatctactgcattgtccacgatctcatagatcagatgattcagtccttttgtagaaacacttcctatgtacattcccgggcgtttccgtactgcctcaagaccttccaataccgcgatactccctgcatcgtatgtattatttcccgccattactctttctccttctttctcgaactcaaactgttctatacagtcaatcaacaaatatgatatcatttaaccatctgattttcaacttctttttcgctcatatgttctgtcaaccttcttctgacaggagaggactgtaactgtccggcaaccgtttattctgtaactacccgctttaatgtccgttccagtacctccattgcattcttcatctcttccaccgtatttgtctgcgcccctgcttcgatcaacagagactttggcagcagatgaagattataacggtaagctttcagataaatatgccttgcaaatcccgggtaatactgttccgatgcaatctgcatctgcaaggagaacgccagattatcctggatatatggattatacagataggcaatatcgccatttgtccgtgtcctgctcaatccattaaaatacataatcttcgcagtcggttttccattcacttccgttaccagatgtgtgtccgcatttacaccgtctctgtgaagatcgattgcaacttcaatcgtcggattcgcttccaaaatcggccgtactgcactttctgcattctcatatgccctgctgcggtcaagtttcccattaataatatcatacactccgctgtcatgaagcgtctcaatcccatccgcatttaataactgcgtcagatattccccaatcccaacgatgcttgtagatggatcacccggtatggagtcagcaaattcttcctgtgaatgcgtatgaaagatcaaaattttcggacctcctgtactttgatctatcttcatactccggtttaaaagatcatccacattaagctgctccggtccgatcattgtagaactgtctattgtataaagattgcttgtcagatattcaaaatcacgcagccgctcaatagaaagatccattcccggaaccggctgttctacagcactttcctgagtttccggctctgctcctaccagtttcccctcttcatctaccgcgtgttcatcatttgcctgacactgaagaatccatgcgatcgtctcctcatcttccaatacttccgccgattcttcctttccccttttttctgtctgatcttccagatatcctgccaacggcatccacacatgaagtggaagtctgaagatctcttccctttctgattcctgttctttctgataagaaaaaagcggaaggtacaatttctgcgcataaatctgactttcttctaataaaaatgttctcccctcttccaatgaccggcccatcccaattcctaacggaatacctgacagaaccagaatcaccccataccatttcatacgtcggattgtttttttcttatacacacgcattgcagagtccttccgctcatttctatcattctattcactttctcctgcatttatatcagaaaaaagaagattcaaagacgctgctatcgtatgactgatctgatgaaccatttcatccacatcctttggtgtcacaaacattccatttaaatgtggggagatcaattcttttacaaactcatatttttccgccgcactataagagcgcaaaatctctcctgtactccttaatgcctgcgactgctccagtgcagtgatgaaattctccatcgtatcattgacgatcgttgccgcatcaacaaccgtaggcactccgattccaatcacaggaacccccagagattcttccgtcattgcattcctgtaatttccaacaccggaacccggatgaattcctgtatcggcaatctggatcgtccggttcaatcgtctgctgtttcgcgcagcaagtgcatccactgcaaggatcagatccggcttcgtctcatggacaattccacggacaatctccgccgtttccatccccgtctgtcccatcacgccgggaacaattgcactaagaacaatcaattgctccgtacgcatcgcatattttccgtattcttttactatatgccggtttacctccagatgatctgcaacataagggccaagcgcatccggtgtcaccgctctgttaccgagcccgacaaaaagaatctttaattcttttccatcttcacaggaaattttatgaaaaatcaattcccggatgcaatcacagatccgttcctgtaataccctgctattttcttccacctccaatgccagatccggagattccagtgtcagataaatgcctgtcggttttcccatgatcttcgctccattctccgtctcgatcaccacacgggtcagccggatctcattctcctcgtcatactcttcctccagaacaactccctgcacttctacattgtcagatgcaaaacgttccttctcctcaagtgcaagatccgtacgcacactgtaatttttcatcatagcctcccttttctccgtgtcaatcagcggagtgattgacacgggagtgaacagtaaccataatttttcttattacagcctatttttagcatttttttgtaaaatatgtattgacagaacacgtttgttggactagaataaatgagtatgtttcgatagaacgtccgtgtccgagtctattgaacacatgaatcacatttgaaaatcatatgatagaatattttggaggtgcacacattggctaatattaaatctgcaaagaaaagaattttagtaacagagacaaaagctgctagaaacaaagcaatcaaatctaaggttaaaacagctgtaaagaaagtagagacagctgtagctgagaagaatgtagaggctgctaaggctgctcttcacacagcaatcgttgagatttccaaagctggaagcaagggtgtttatcacaagaaaacagtttccagaaagatcgctcgtctttccaaagctgttgactctatcgcttaattataaatagagaatagaattttcagtcgcatctgctaccgtcatggcagatgcgacttttgttatacgttcagagccaggcagttctaaagatacagatacgagccatgctcgcatgagcgagaaaaagaccggcacttccaagtcttaacctgaaagtaccggtcttctattatcttattctataatctcagacaactgattagttgttgatcagtttgtcctcatcactccagctgtaaagctttctgatctcagctccaaccttctctgactggtgctcagcagcaagttttctcatagccttgaagtgaacctgtccacctgcatcagacatatcaagcaggaagtcttttgcaaatgtaccatcctggatatcggaaagaattttcttcatagctttctttgtctcagctgtaacgatcttaggtcctgtgatataatcaccgtactcagctgtgttagagatagaatatctcattccagcgaatcctgactggtaaatcaggtcaacgatcagcttcatctcatggatacactcaaagtatgcatttctcggatcatatccagcctcacaaagagtctcgaatccagcctgcataagtgcacatacaccaccacaaagtacagcctgctctccgaagaggtctgtctctgtctctgttctgaatgttgtctcaagaactccggctcttgctccaccgattccaagaccataagcaagtgctctgtcaagagcctttcctgtgtaatcctgctctacagctaccagacaaggtgttccttttccagcctgatactcgcttcttactgtatgtcctggtgccttaggtgcgatcattgtaacatcaacattctttggcggtacgattgttccgaaatggatgttgaatccgtgagcgaacataagcatgttaccctcttcaaggtttggctcgatgtcttctttgtaaagtttagcctgtttctcatcgttgatcagaatcatgatgatgtcagcctgctttgcagcttctgctgctgtatatactttgaatccctgctcttctgctttcttccaagaacggcttccctcgtacagaccgatgataacatcacatcctgactctcttaagttcagtgcatgtgcatgtccctggcttccgtatccaatgatagcgatcttctgtccttcgagaagagaaaggttacaatcttcctgataataaatttttgctgccattttgcattcctcctaattgaatttaaaatatagagtagaatgctcccgatctcttcgggggtatcctatatagtgaaaggtcttgccctttactagctttatctgttccacaagttctccctgcggttctccgatcctgaccggatcagaaaaatgcaacatccttgctgcctctggaaagtccggtaattccggttcttgccagttcgagtatctcataatccttcagaagattcaggaaagcttccagcttattctgtgtacctgtcaattcaatgatcagacaatcttcttccacatctacgatcttcgctctgaaaatatctgcaaccgagatgatctcaccacgctgtgcggcattcgcacgaagcttcaccatgatcaactctctgcaaacggattcttctgctttcaaagccttgatatccacaacatcctccaacttacgaagttgcttctcaatctgtgataggatctgctcatcaccggatgaaacaattgtaatccttgtaaatctaggatctgctgtcatacctgccgtaatactgtcaatgctgtatccacgacggctgaagagtcctgaaattctgctcaaaacacctgaattgttatctacgagcagtgaaaatacctgacttctcatatgtatcctctctttctcacttcaggaagcgaaaatattatgactgactaagatgactggttcgctccttccatgatttgtataaaacagagtgcgttctgttttttacttacttaatattaacaactagaaccggctttgtcaaccctctttttgagatttttcatcacaaaccaaattcctctgccagttcattcaaatacatccaacgctcttccttctcttcgagctgttctcttactttctcctgctcttccatcagctcacgcagtttcactgaattcgttgcatttgcggcaatctgacggtcaagagacgcaattttttcttccagctttgcaatctcctcatcaattgtctcatattcacgctgctccttgaaagaaaacttcaccttctggcgctgtccatccttccagttctttcccgtcttcttctcctgcgtctcctcttctgtggacttctctgccggtttcatttcagactttcctgtgataactttgctttcctctccgaatctgcgtttcttcgcctctacataatccgtgtatcctccctcaaactgtcggatcccgccgtttccatccaattcaaagatacggtcaactacattatcaaggaaatatctgtcatgcgatacggtgatcacaatacctgtaaatgaattcagatagtcctcaagaatcgtaagtgtcggaatatccagattatttccggcctcgtcaaacaacagaacattcgcattctccgcaagaacaccaagaagataaagccttctcttctcccctccggatagcttaccgatcggtgcatactgcatatccggtgtaaataagaacctctccaacaattgactcgcactgatctgtccgtcctttgtcgtcacatactccgcaatatccttcacataatcgatcacacgctgggaatcatccatatgctgttcttcctgtgcaaaatatccgatcttgatcgtctcgccgatctcaatctcccctgcatccggcttgagtacacctgcaatcatcttaagaatcgtagattttccacagccgttcggtccgataattccaagccgctgattgcgaagcacaatataactgaaatcatccagaatcttcttctccccaaaacgtttgctgacatgatgaagttcgatcgtcttcttgcccattcttgtctctatagaatcaagctccaccgtctgatccgtcacaggtgcttttcctgctttcaacgcttccagacgttccagccttgccttctgctttgtcgttctcgcacggcatccacgcttcgcccattccagttccatccgaagaatactctgacgctttctctgacttgcaagctccatctcttccctctgcgccttcaattcaaggaatccagaataatccgcatcatatccatacatctttccatggctcagctccaggatacggttcgtcacacgatcaaggaaatagcggtcatgtgttaccataagaacagttccacggtaagatctcagataatcttccagccaggaaatcatctcctgatccagatgattcgtcggctcgtccagaagaagtacgtcaaagtctcctgcaagtatcttcgcaagaaccacacgtctcttctgtcccccggataaagtgtcgatcttctgatcccactgcgtgatcccaagctccgtcagattactttccacctgccagctctccgcatctgcatcctgaagtgcgtaggaacggatatccatcccctccggaaatgtcggattctgcggaacaaaagcaatcttcagaccattctgacgaacaacctgcccctcatccggtatttcctctcccgcaaccaccttcaaaaaagttgactttccggttccgttaatcccaacaatcccgatcttatccccctgctgaacaccaaacgatgcatcatcaaaaatcactttctccccatatattttagaaatatgttctatattaattaagttcattcttttccctgctttctgtttttcttgcatttttatcaatcacatcgccattccagtataacagatatttcagacactgaaaatcttaaaaatttttaaattcatatttaaaagggttgagaaaacacggaaaacgttataacatagtgagatacatgcaatgacatggtttcaaatggaaagtgaggtaaatgatatgagcccgaagaatgatttctcagacattttcgatgacgattttgaagttacatatgaagaagatccggaaatcaattttcatacttctgaagatacaaaacaaataaacagacctgattctaacacagagacaatcgttatgaacgcagacgattaccgagataactttaacgattccgatgacagccagttcgaagaagtacttcctgaatatgacgatgattatgaagatgatgatgcagattatgaggatgattattatgaggacgattataacacttccaacagaagatcaaatcgcaacaatccttataatgattcatataataatccatataatgatcgtgactacgacagacgctcctccggcaggaaacgttccggtggcggagtaaaacttgccgcaccgatcaaaaaaggcggaaaggcattatcaaggctcacaagcacattgcttcagcagctttctattgtgttaatcctggccacaacagcatttgtactctacaacttttaccgtgcaagcacaccgtacggagatatccaggaggcaatccagacacagaagatttcccagactctggccgcttacttatgtgtagctgccctcttcctgttcttcgaattcatctcccttctctggtcaatgacacgcgtccgcgtacgtgacggagtctccagctggagagaagataccggaagaggcctgtggtcttttatccttgtattcgcggtttcctatgctgcgttcctcttcagcccgttgctccctgattcaccggaagtgatctacggagtgaaaggagctcttgatgtatacggttccctccacaatgtattgtttggactgtgtgcagccggagtcatctcctgcctgatcagaaaatacaaaagttccaattagaacacaatatgccctttacaaaaagtgcacccggcaatgaaatcgatcacgaaatcattgccggatgcacttttaaaatttacgggccagtctcaaaaaatgcgatgcattaatccaaaatgatcagcgccataaatacaagatctgtatcccctgtattcgtcagtccgtgtcccattccatccggtgtaaatgtcacatctcctgctttcaccgggcggatacgtccattgtcatcataatttccttccccacgaagaatataatatgtctcactctcgttgtgatgctcatgatatccaagagaacatcccggttccagtgtgacttctgcatacatcttgcactttccgtttaattctttctcttccagaatgtgcttgatgataacgtgtccctttccaccagccatgttttcttttctctcaactcttaattcactcatcttcaattcctcctaaaacatttttattgtaaagcttatttgctacaatacgtcttttatctgacatttatttcatatagatcaattcatactctcttgttccaagaccaatcttctctgcatgtgccagacaagtcttgtactcagaattcggtgttgtattctcaaaatgatcatgatgatcgcagaaattctcttcttccatacgatctgcaagctggctgtgcggcaacggtgtcgcgctaagacagacatctgcacatgcctgatccagtgccagcggatcaaaagaggcaaacataccgatattcggaaggatcggtgcatcattctccggatgacagtcacagttcggtgatacatcaacgatcagtgaaatatggaagttcggtcttccatccacaaccgcctttgtatactctgccatcttgcagttcaataccttggtcgccgcactgtccataaatgaaattgcatcaaagttacatgctccgatacatcttccacaaccaacacaatgttcaagatcaatagacatctttcttgcatcagcatcataaatcaggccgtcattcgcacactctctcagacagctcttacatcctctgcaagcttcctgattgatcgtcggcttaccaacagaatgctgatccttcttaccggctctggaaccacatcccattccgatattcttgatcgtaccgccgaaacctgtcgtctcatgccctttgaaatgcgtcagactgataaatacatccgcatccatcacggcacgtccgatcttcgctttctctatgtactctcctccctgtaccggaacttcaatatcatccgttcccttcaggccgtctccgataatcaccggacatccgacactcaacggtgtaaatccattctcccatgcacagtaaagatgctccagtgcgttctttctactgcccggatatagtgtattacaatctgtaagaaatggctttcctccaagctccttcacgacatcaacaaccgccttggcataattcggacggagataactgatattccccatctctccaaaatgcatcttgatcgccacaaatttattctccatgtcaatctcactgattcctgctttcttcatcagacgtttcagcttcgttggaagaccttctccaagcttcgcccggaaatcagtataatacacccttgctttttccatgatgtaaacctcctgttgtaaattctgacagcttaaccctgcattcttatcatacactataaatctgactcttccaatcatttttagaaaaataataaagtggacatccccttgacgatacggtatactcaaattatcaattccgaactcagcaacagttcgatcactctgaaggagatgtaatgatacaatgaatcatctggctgttacctcaatactcactgttgtagcacatatcatctggtttgcttctatgacagaacgaaaatatccgatcaaaaaaacggttctgctctatggactttacgctatattcttcactgtatgggccatacttgcatattccctgcttggcaaagactctccgtatgtgattccattttcatttgtcggaaccatcctgccagcaattctacttttcctatatacttcatctgatagtttcagcaaaaaaatatttttgatccttacttatgcaaatttgttctgcatcatcatttgcctttctattttgatctgtgatggattatttccggatttatccattgtaaaacagatgtatatacgaagtttggtacgaatactgttgaatgttcctgcagtcctgctgtatctgtggtttgcgcgtccttatatgcgtacagtgcccggagacagaaaacggacctggtactctatttccctcgtgtcctttctgtttttaaccgtgtttgcaacgcttatcaacttcctcatgcgtgatggtcataccgtcgaacagatgatcctgtttatcacaaccatgatgatttattgtgcagtactgtggattgtatttggcacgatccaacacatgaatgccgaagtgaagatggaactgatcactcaaaatgtacaatatctgcaaggacagcttaccatggccaaagaacatgcatcaaccgccaaagccatgcgtcatgattttcgacatcacatgcaaaacattgacctgcttctgaaacaacagaagccacaagaagcgatacattatatagaagaatttatccaaagcctggatgtggcaagtcagattgatttttgcccacatattacagccaacgccattttaaacaacttttataatcaagcacagaaagaaggaattccgatctctataactgcagacacaccggagcatataacaattgcagatatggattttgttgcgatcctttcaaatcttctggaaaatgcagtaaacggatgtatcgaatgcggttcccgggatgagatcacagtaaatctccgtatgaaaaaggagaaacttgtgatcgtgtgcagtaacccttgtaaaacggaccttgtgatcgaaaatgatatcatcaagccaaaaggaaccgggatagaaagtatcctgatggctattgataaatacgatggaaatatccgttatcagatggaagacggtattctgacagcatgcgtcatccttaactgctgatctttgcagaaaatcagatcactatttcacgcagaaaaaacatggtttcacgaaaggaacacgttttttctgcatttttcttttatacttacacataataaaacattctttggatcgttaatcattgtgacccaaatttatgaagaaaggatctgatttaaatgatgaactcaaatgtacaggctgctatgccaaaattcgccggattatcccatgtatgtattttcgtggacgatatgatggaggcggttgactattaccagaaactgttgggcgttgtaccggatcattacctgtcccactggagaaacgaaggtttctttaaagccggcggatttgtcaaagaagctgccgacggcgatgtctctatcgcttttgtaaatgtaccgggcacaaaactgacactggaactcatgcagtaccattcaccggaaggacgaaaagaacctgtcttcttcgctgccaacgatgtcagcggcgcacgtcatgtagcactgaaaatcacgaacatcgacgaagcatttttacatattaaatccatgccggatacacgactgatcaatgagactgacgattatcaagtattccagatcagcgagacctatccagatgaggttcatttcttcgatcaggatatgaaggaaatggatgaaaggaaacagcagacagctaaaatcctcagtgaagtgcgctatttctactttattgacaaatacggtctccaatgggagttcgagcagggacatactgatattggtgattaagtgaaaaaatgaaacaggagtcggtttgcgttacccgtgctgtacgcagcgactcctgttttttgtttatcttattattttttctttaccaggcaacgctttttatagaatgcaatgccatagcaatgaatatgatcactgtcatactcgtcctcaaaatcccttgcatacattctttcatcaatttgccgcaatgctttctcgcactcggattccagttcatctaccgaccttgcacgtttagcctcgaaaatagccacgtgaccattgatggtatcacagacaacaacatcacttctgccttctccatgttctttatttgaatccacctgatatccggctcctgcaaaaataccacttaagaatgcatgataaaagtcttccccataatcatggtaacttatagttcgccttaataatgcactcacttcttttgtgattttatcgcaatcttcactccatacagatgaaaacaattccgttctattccattttttagaactatcctcaaaccacttagaaacttctgtctcgaaaatttgcttgatttccaaatttggaattttcaatgccaccatgttgtcttgccagccatcatcaatcttataatctctaacctgcgttaaatatcccgtcaaatacattaagctccacagattttcctcagaagaatgtaaatagtcgtaagttagattctcatccactctctgaataatatatccaccattcatcagtgtttcaagcttcttcgtaatgcttgcacccgcataatcaataaatgaacgaataattgcattatcacttgtatctttccagtattcatctggttttgcattaggattcttctgcaggtcatcaacataacacatcacatcccaggggcaataaacatcgacatctccgaaatgatatccatcataccacttcttcataatatctcccttacccttgatttctgcatcttcaagaattctatcaacttcgttttgaacaaatccatagtactcattcaatcgagaggatgtaatcgtgtttgagacaaaattatttgtacctgtgaaaatgctttcctttgcaattttcagacaccctgtaataactgcaagtttaatgcactgattatcttttaatgcctgcataaatcccttcattatttcaagcatttctttataataaccattgcttgttgctctcgccataggaacgtcatactcgtcaataagaagtattacactcttattgtaatacttgctcaaaaactctgagagaatttgaagcgaacgcattacttcgatcttccccgctcgtccataccgaatgtcatcaaacttctttttttcttctgcattcagcacagggctttccatgagatattcatgcttcttaaaaagctctccgacttcataaacaagctgcatatacgcagttgaaaaatcattcccctcaaccgccttaaggctcaagctcatcacaggccactgattcatccattcctcacaaatatctctttgttttgaaatttccaaaccttcgaacaaaactttgctatctttttgaatatccagaaagcattcaagtgtactcattcccaatgtctttccaaagcgacggggacgagttattaatgtaacctgagtgccggatgacttcaggatttcaccaatcaatcctgtcttatcgacatagtaaaatccatctctacgaattgtctcgaaatccgatcttcctttcggaatatttaaaaaagtcatgtcatccactcctctccgacattttaccgctgcaactgcaaagatgcatcttgtcaaaaaatatcacgcgctccaatgtattttgattctaccatcttactggataaatgacaagttgggtaaggtaaatagtaggattgtttaatgtaaaccaaactctttcaatagttttctctgatattctttgtcagccgccgcttttgtaatgtcttctgtacgtccaagttttgacagttcgagaattaattgattgatttctgctcttccttcttctatcccaatcttacgtccattctcaattcctcgtctttctgcggttaacattcctatattgtaatctctaatcgctctttgtcttgtctcgtattctaacctcttcttttcatctgcgcttaatttatccaacacgtcatatgcttcttccaattcagaatttttctttgccattttttcaaaatcctttcacgagcaggagcagccagatggcagattcctgaagcacataaagttccgttttccggtgtatttcggagacagggagacacaggaactttgttgggacaacgaaagtaccgttgagacatgtgttttattgtccaaactaggacaatagttggatgattcgatgactggaaagtgaagaattattatataagtcaatacatgcttgacatttgttgactagatcttagaatagtacaatcaaagtcaaagtgtagccagtaaattgatgacttagacaagaaattttgcaataatgggtcagagcggtaaatggtattcgtaatatggcagaagagattgtgttaaatgaattgatttacaggtaaacaaagagctgaacaggtaggaaaaaaatcctatttgttcagctttggtgtttataaggggtcaaagaagaagcatattacaattctactgctagtcgattgatttatgcatactcccattataatatgtgtgcaggaggtgaatatatgtatcaaattagtaatgaaaaattcggtttatttgtaaccgaattaagaaaggaaaagaatttaactcaaaaggatttggctgaaaaattatatgtatcagataaaacagttagcaaatgggaacgtggtcttagtatgcccaatgtcgtattactcataccaatagctgatatattagatgttaccgttacagaattgttacgtggagaaaaaatagatagacagaaaaatattgatagaaaagaaatcgaggaattggtagtaggttctctcgatatggctgttagggattctattcatcaacatagaaaaaactggatattagcatatttgttatgcctttttatatctattacagaaattattatcttagttgtatctggaagttcattagctgagatgaaagggggtatattgctggttaccggggtaatgcttttatttggtgcatggttttgtttctttgcaaaagacatattaccaacatattatgatgccaacaagataaattatgtttcacaaggaatttttagaatacatctagttggtttatcttttaataatggaaattggatatacatctgcacaactttaaaaatatggacacttgcaacggttgttttatatcctcttgcaggtattataataatcaattgcttcaatatagctttatggaatattttgaataaaattttcttaattatgatattaggtggtatagtagtttcgatttacattatcgggaaaaaatacgaataattaaattacctgttatcgttgtgaatagtactaatttacaacattcttcatgggaaatatggaatgcagcagaagagattgtattaagagaattaccgcatatttaaagcatggggggctgttgcaaaatagattgattactcatctattttgcaacagccccttaaatttatggttaagaataaagtggttttaaaagaaagagatgttcggagtgatctggcaaattttatcggagagaagaaatacaaaaatatctgttgaaagaaaagttgttgcatgatattataaccgtaaatacggaattaaaatatgaaaatacggataaatgaaatgcgggtggagaaaaagatgattatcagtgaaagaattttttatgtgatggagcagaagaatataacacagttggaactctcaagaagaactggaattgcaacgagtaacatcagtgactggaaaaagaaaaagacaaatccaaaagcggattgtttgctttcaatatgtgatgcattagaaattactcctgatcaacttttaacgggaaaagaaattgatccggaatataaagatgcagatatggattatgaagttactaaagcggatattagaattttgaaacagattcacagccttggagatgagcagtataaaagattgatggcgtatatgaaagcattgcagaagctggagcagatggagcgtatagtggaggactaacctgtgaaatcacaaattgtgacttcacgataaaggaacgacataagaagcttatagaaattgtaaccgatttgtttggaggaagaatggaagaaacaaaagaattgattactacagatgatattcgtagtaaagtgtatataattcgtggacagcaggtaatgctagataaagatttggcagaaatttatggctatgaagtaaaaaagttaaatcaacaagtaaaaagaaatatagaaagatttccagaagattttatgtttcggctatctaatagtgaaattgattccgtgaggtcacaatttgtgacctcacggaaaaaggatttttttgctgggcaggaaggcggacgtagatatttaccatacgcatttacagagcaaggaatttatatgcttgcaacagttcttcgtggagaattggcggaacaacagagtatatttattatgcgtactttcagggagatgcgtcactatattaggcagaatcagcagtttgttactagaaatgaaatggatcttttaacagcaaaggttggaacgataactgagagacaggatcgaatggagaataaggtagattcaattcaaaaagatgtgactatcttagcagataattttattactgataaagacaagaagaattttgtgatttataaaggccaaaagttagaggctgacattgcttacatagaaatctatcagcaagcaaagaaatcaatctatgttgtggatgattatatgaatgcaaagtcattacaacatctttctcagaaggctgatggtgtggaggttgttttgttcacagaaaatggaaaaggtgggaagggatttcttacaaaatctttagtgacagattttcaaaatgaatatccggctcttcggattaagcctaatcccgattgtcatgacaggttaattgtacttgattatggtgaggagacagaactggtttatcactgcggagcatctagtaaagatgcagggaagaaactttgtgcaattaatcaaattacagaaacttcaattattcatccggtgatagatagattacttttgttgccggataaaccaatataacttatatccgattggtacaatagaagattatacagtataaaaatttgtaagaataaaaacagaataaagaagaaaaaacagcatagaatacttctgagcagatatggctaagaatgttttagcgtgttgacgggacatttaaaatgacgtatattaagttcagtgatcgttctgtagaaacttgcgaagcctacaggcgggggagagcttgcgggtctctccctcttttgttttaaggaaaaatgatatgcagacaccgaaaaatcctctttttttagcgaccaggtttccaggatgaaaatttgaaccgttgaatcagcagaagatggagcagtttctatctgttctcactaagtatagaaatgtatgtgtacatggagaacgactgtttacatacttattacttggaaaagtattatcagataccatttaaagtaaagaaatatcctctaagagatagtgaaatacctattgctttagaggattttttgttgaagaattttaatattcaagagtttgttttttcctctttgacattaaagctaagatttcttgtgggtttgtcaactgacgtccgggaagtgtctgctttggtgtgcggtcacggtcggcttcgtcaagaatatagacaggaatgagaagcagtgcgaaagcgctgtttttttcttgcaaaaactaaaagtgctacattgcacttctataaaaatacaaatactcaacaggcgttactattacgtaaactgtgaatagtttacgctattactatgaaataatccagaattaattgataaaagagaaaatttatcagttgattctgggttattttttggggataaaacacgtaacttcttgaaattgtgttataaatcttgaaattgtgttataaatcttgaaattttgttataaatcatgaaaatttaatattcattaaattggaaagttatgttaatatagcgtatgaaacaaagacaagagaatgccgatagacagcagaggagagacagaagtatattatcggtttatagaaaagggatggagttcgaaaaatgagaggaaaggcaaaacagagagttagtctgatacttgtagtgacaatggtactcggaacagcattaacaggaaatactgtatttgcaacaggagagagcagtgacgaacaagatcggataaaaattaatatttctaaagattctgaacaaactgtggaacagaatgttacacagacaattcatgtgactgcgcaggggcagtgctcgcaatcagtctgtctggatgtatatctaaaaaacgaggacggatctgcggcaacagatatagatgcagtcaatcttctgacaagcgatcagcttacagataaaaacacacagaaaacaatcgatgagacattgaaagattcagtgactcttaataatggaacaaaggcaagtccaacagcagagtggaagaacgacaaggacgataatggaacagttacttctaaatatctgcagatcacaatgccggcagatgcaacagcaataaactttgatatgcagcttcagtatcgtacagatgaagcaagctatacaaagaaagtgctggttgaggcaaaggcattcgaagaggagcaggatatcacagaagcagctaagagagcagacgagagcaaagagaatgaagcgacagttgcctgggaaggccaggcagtaagtcaaccagaaagcgaagctgcggatgaggatgcggacggagaaaatgaatcacaagtaatggctgcaagtgcagagaccggagtgacaatttactttgcagcaccgaaggagtggacggataagaaatatacaatagaagcaaatggatgcgaatcaaatgacgagaatatatggatccgccaagagatggtaaatactggaaagacatacaataatcttcaggtatataaagtagttatgccgcatccaaaatatgatagatatgatagatttcaatttctagctaagtcaggaggtcaacaaccagattataaagaagttttttcaagtaggaaaacagtagctgaaattgatggaagaattttttattctgatgggaaatcagaagtttacaatcccttcaatcctaacaaccacacctatttcgctggaaaaaacatccttttctataataaaggatcagaagatctttccggtggcgtaacagcagtattctatgagaaagataattcaggaactctgacagaagtaaaacgaatcgagatgacagcaggtactggaaacaaaaaattttcagtaacaattccagataaggcgtgttcctacattcgttttgtaaaaacattagatggaatgatattaggtgattcctactcaaatttctatggacagggaaatggagaaaaagatgtcactgaaagctttgtatacagtgactcaatgtattgttataactacagcggttcagcaaagaaatcttcttggggaacggcaggtgcagtaacagtttattacgacgctacattatccaaactgtcctataaagatacaaatgatgtgaaaaatgaaggaaaaggaattccatatctagatacggcgaaggtttattattatgccacaggcggaacgaaaacaaaagctggggaaatggaattagataaaaaagaaggttatacggatgtatataaggttgagcttccggatggatacaataaagtaagatttgcagcttatgatgtccagaacgcggaggcatcacaaaatggtgatgcaacagatctggtaacaatcccaggtggtttgatgaatccgtgttattacggtgattccagtgatgatgttatttacaaaggtggaaatcgtggtggatattgggatgaggcttatactgtaagagatcctgaaaaagaagcaaaacaacataatagtaaagctgttgtagacattaatgaaggcaaatttacaagaaatgcgagcactttatatgtaaattcaacattttatgactattatacagattatgaattgaacggaaaaaacagagatgattatgatcaaaataatccggcggctggttcgcaaagaagttatgttacattccgtcagtttaatcaagcactcagtgcttactatgataatgcaaatgtaaagataccaatttataccggtcattttcagccggattataaagattggggtaatcgtttttctgcaatcgccggtacattagaactttatggatatgataaaaagaatcaaaacggttttatgtctacaaacaactcaacattgaatgcgaatggagttggagaagacaaatactatgatgctgcagcacaaggattggtggcaaaggaattaaataaaaacaatctaatgacttcagaaaacgaagtattagaaccacattttaatgaggaatttcttacagaagataatagtaagcatacagcgcttgcaaagatatataagaatgtttcgtttccttttacaaaacaaaaactgaacgataaaggagaaaaagatgataacggcgttgaatactggtactttgatagtgcagatacaacattggcaatgcgtactgacaaagaatcaggaaattattatttggaggatgtagaaaaaaaggattggtcaaaaaatgtaaatagttccagtaagactgataacgtttccaatacttacggtttcttcccatttaatgaaacagcgaaggaatgtagtgccagcaattacaattatggatttggtacgaagttggaatttaaattccgcctgacagacaagggaactgtagtaggaacagatggaaaagaacatccgattaaattcaacttctccggtgacgatgatgtctgggtgtatgtagatggaaagcttgcactggatgtcggtggagcacatggaaaagtaacaggtcagattgattttagtggagaagatataaataaaacagcaacagttagcgagacaaaggtaagtcaaggatcttcaacagaaagtaaggacaccaagagtagttttaatattgaaggttcgaattcagatgagcatacactcaccatgttttatatggagcgtggtatgtgggaatcaaacatgaaagtatccttcaatttcccggatgaaaatgaattcgctgtggaaaagaaagttgatacaacagatgtgaatacagagttattcccgacaccattgtttgaagatgctaacgtattcccattcacgattcaaaatcaggcaacacattatggaacaaaagaagcacaatctgcggatgcaagacaacctaaaacttataatgatagtttttcagcagaaaagttatcaagtgcatctccacagaatacatttgaatttgtagacagcaaggatggtaaatcgaatgtagttcactggaaggcaaaacttgatgatgcggaaggggcatattttgacaaaagatttggaatcatacaaccagcaaaaggtgatacatttgatgcttctgatacaaatgcattcttgcaattcaagatgtactatgactatccggacattccgggacttgcaagtacttatctggaattggaagattccttgggacaaaaaataggaggttatctttcaggaaagacatatggaaacagtagtcttgtacagaaaaaatggaatacgattcaggttgacttgagcaaattaaaaggaaacaacgaatttgattattccaagatcacagcaatcaaatttaattataatttcgagagagatatttacttggatgattttatattcattccttccgttgtagcagcagccaaaactggatttgtaacacaacaacaggatattccggattatggttctgcgacaagtggaacgttgcaatatccggaaggagcacagtatacattatctaaaaatgatggctcatcaaaactgtacagaatcagcagtgacggaatgttcgccttggcagatggagagacagcaacatttagcgatcagtttagacgaggaagttatattgctgtatcggaagatgtgaatccatcagtatttgatacgacatggacactttatgaaaatggacaggctgtgtcaacaatgggaacaggagaaacggtgaaaaatgaagatcctattccatcagttaaaaatgttacaagtgatacgattcgagatggtcgtaaagaagaatataagaaagaccaaaataatagtgtagaaatatctaacagcggatatacttctacaggatatgcgaagaatcaagatggtaaggaaaataaaaacacaattgtattcagatcatatgtagctcctgataatcagacaactatgacaaagctgaaagcaacatttgtcaataaagtaaaaaccggaaaaatagagattcgtaaaagagcagcagaaggatcaaatacattgaatggtgactatacattccgtgtagagttcagtaatgttgcagagctctcgttggaatctaagaagattgtaaaggaatatacaatcaaagctggagagtcaaagaccatagaaggaattccggctggaacagattatagaatcagcgagattaatagttcagatggttccacactggaaagtgtaattgtgaataataataattcattcgatgcagggtatgatccagtcacgaaagttgttgccggtaaggtaattgcttccagtgatatgaaaggggatggaataaaaaatcgagatacatcatcggatgctacaattattactttcaagaatacgttaaaacctacaatcaatcttaatcttacgaaagtgtgggaaaatacagaggatatcacacttccagattcaattaagatccggcttcagagaagcagcgataatggtcgaaactgggaaacagttaaatacgctggaacaaacgaaacaataacactttttcaaggatatgacgaaaagtggagttatccattcaaagatctggatcaatatgtggattatacagcaaatccaaaagttccatatatctatcgagttgtagaggtgtcaggagacgatggaagtgagacagtgattgaaagtggcggatatctgaatgataagtacaaagtagcttacagtaataatgtagattgttcaaatatttccacagagactccggaaagtaaaacaaaatcctttacaataacaaatacttatagtcctaagacaaatattaagatcacaaaacaggatgcatcaactaaggaaccactggatggtgctgagtttaaactggaaaagatgaagaaagatacatcgacaggaaagctagtagttgataatagtttcaaagccaggacagtaacaacagagggaaaagacgcaagttctaatccattaggaattgcagaattcaaggatctgacggatggaacttatcgcctgatcgagacgaaggcagcagagaaccatagtttgttgaaagatccggttatcatagtgattaacaggagtgataagtgtctgattgataatgaagtgtgtgaggtagtagataataccatttctattacgatttccaatcaggcaagattcgatcttccagccacgggaggatatggaaggtacattgtgatacttggggggattgcccttgcaggggtaggactcttcatgtatagattacaaaaacgcagaaaggagggtaacatctcctagacgcaacaataaaaagaaataataacacgataaagtgaaagagaggaaggaaagtatgggaaaatttagaaaaatgctggcaggcgtgttaagtgcagcaatggtgttgtcaactatgacagtgacagcatttgcagcagatactaaaatgccgacaattaatgacacaacaaaaacagggtctattacaattcataaatatgaatataatgaaaattcagaaaatcatgcaactggagaagaagataggccacagctgcctgaaggtgcaacacctcttcaaggagcagggtttacgatttataaggtagcggatgtaaatgatttaacaaagtattataaagctaatccggaaagtcttccgtcagtggatgaatatctgatagatggaaaaattaatgattcaaaagttttagaaaaaataccagaagctaaaacagataaagacggtattgcaaagtttaacaatcttgctcttggtttctatgtagttgttgagacaacaacaccggataaggttacaacaccagttgaaccatttatcgtatccgtaccaatgacaacaaaagacggagataattggttatacgatgttcatgtatatcctaaaaataagacaacttatggtggagtaacattagagaaaaagggaaacaatacagaaccgttgtcaggtgttaaatttgttcttcaaaaatggaacgcaacagcatcaacatgggaaaatgcaaagaatgaaacgggagtagaaggagtaccgtttggagaactcactactgacgataatggaaaaattactgtagacggtctttcacagggaaaatacagatttatcgagattaaccgtggagataacaacagtggttatatcatggacggtgctactacatatgtgtttacagtaacagcagagggaaagattgattatgatggtaaggaagagaataacattacaattactgtaaataatgaaaagccagatatgaaaaaagaggtgcaggacagaacatccaacgcctggaaacatgatacagattataatgtgggagacatgattccatataagatcactattgatgttccatccaatattacaaagttaaaagaatttacattaacagatacaccgacacatctgaaagatgatgtaacaagtattaaagtacagtataaagataaaggtgaaagcgctggactgcaagaggtaataaatgctaataattcagtttatactgtaacacaaggtaaaaatgaaaacggatttacagttgcattccatccagacaaaatggatacttatgcaggaaagcagattgtagttacatataatgcaaaacttcttgacagtgcagatacaacaacagttggaaacccgaatacagcaaaacttgagtattctaaccagattcttccggatacagaggatgtaagtaacccgaataatccgggagaaccaggaaaagatgcaattaaagatacagcaacagtttatacattcaaacttcagattcagaaaaaggcagcagatacaaatgaaggattggatggtgttacatttgatctctataaaaaagttccagtaggtacagaaggtgcattatcaactgaggaagcaaataaatttggtttcgaatcggctagtacatggacatggaagaaagtagaaacattaacaacaagagacggtggtaaagttgaaaaaaccggtcttgcaaatggaacatattatcttgtagagacaaaaacaaacaaggactataatctgttaaaagcaccagtagaagttaaattaaatattgtttacacaacaactacagaggaagagcatgtgcgtgatgaagcgggtgttaagactcttgtaaaacatgagatcaagacaacaacatttaccgaaaattctgtagattcagagggtattcatacagaaactatcattaacaagaaaggttttgaactcccaacaacaggtggtatgggaacagttctcttctccatcgcaggttttgcactgatggcaggagcagcatttgtacttctgaaaggtagaagaaaagacgcgtaagaaatcagaacaattactataaacttttaatttcataatgctatataaataggagaggacagaagaatctgttctctcctaaagtaaattttacgctgctgtgaacagtaacgtgtcgggcagtgatttatttttggggaagagtcagatgaaaaagattcgggttatattttgtgttattatattcataacgggattgggaatcgcatcgtatccatttatcagtaacatggttgcgcagcggcatgccagtcaggttgtgaaagattatgagacaaatgtagaagaaatggatgaagagaagattgatgcaatgaaagaagcagcaaagaaatataatgagcagcttagcaatgttgtatcagtggatgatgaaaatgaaaataatgagcagggagagagttatgcagatcttctgaatatcggtgaatcgttagggtatattacgattccgaagattaatgtgaatcttccaatctataacggaacgagtcaggatgtcctttccaagggtgtcggtcatatggagcagtcttcatatccgcttggcggagagagtacgcactgtgtgttgacaggacacaggggacttccgagtgcggtattatttacagacttggacaagttagagatcggggatgaattttatcttcatgtattagacgagattcttgcatataaggtggatcagatcaaggtagtagagccaaatgaatccggtgacctggagatcattgatggaaaagattattgtacgcttgtgacatgtacaccatatgcgatcaactctcatcggcttttagtccgtggagaacggacggaatataaaggagaacaggataaacagacaaagaatcagatgcagacaggtgctttgacaaagcgtattgttgatgtatggccgtggcttctgggtgcatttcttgtcgcagtgctgattgaaagcggtatctttttctcgattttaaaacataagaaacaggacatggaggagtaagcaatggagtattatgagaagctgcagaaagcgattgatgccgtagagcatgtgattattggaaaagatgaatgtgtggagaagatcatggaagcaattcttgcaggaggccatgttctggtggaagatattccgggagtcggaaagacgagccttgcacttgcatttgcgaaagtacttgatctggaacagaaccgtgtccagtttactccggatgttcttccggcagatattacaggattctctctttataggaaggaacttggaagttttgagtatcaggaaggtgcagttatgtgtaatctgtttctggcagatgagattaaccgtacttccccaaagacacagtcggcgcttctggaggcgatggaagagcgaaatgtaacagtagatggaattacacatgtgctcccggaaccatttcatgtgattgcgacagagaacccgatcggatctgccggaacacagatgcttccggagtctcagctcgaccgttttatgatcagtctgcagatcggatatccggagaagcaggatgaattaaagattcttatgagcagagaccggacgaatccgatggatgcgcttcagccggtaatcttccgggatgagttgaaagagatgcagaagctgaccgaagaggttcgaatccatcaggtgatctatgaatatatcattaaccttgtggatgcaacaagaaagaatgaaatgatcgagcttggagtcagtcctcgaggtgcactggcacttgcgaagatggctaaggcatctgcatttctctcaggaagaagctatgtgattccgaacgatgtttcagatgtatttcttaatgttgcggagcatagaatccgtctgagttcgaaagggcgtctgaatcacctgaccgcagagaaagtgcttggtgaagtgttagatactgtgaaaaaaccggtgccgcagagacgataaaatctatagaatgaagtaggacaggcatatgagaaataaaaaaatatatggcggaatcttatttgtgacgcttgtgattgcgcttttctgggaatccgctttgatccggacacttttcgcatatgaagtgttgatgcttccacttctctttcttcaggctgagtattttgcgagaaatctcgaatcccggttgcacgttccggtccggtatgtacagaaaggacaggaatttgcggtggaagttgaactggaaaatcattctttcatgccgatggaatcaattcctgtggaaatcagctgtgagaatgaatttacaaaaagcagattcagcgcaaaggatacggcgatggccgaggcaaggaaaaaagtgcggttacagtttttccttgaagcgaaatattgtggcagagtgaaagtgtctgttgagaaggtgaaggcacaggattatctgcggttgttttcgagagggagcgagaagaaagatcaatccgaagaagtgatggtacttccgatgattcataaaataccggtgcagcaatcatttcaactggaagaaaatctggaaggacagctgttttcaaaaaatagaatcggtgaggatacttcagaagtatttgacatcagagaatatcgttcgggagatacttctcacaggattcactggaaattatctgcgaagacagatgattttatggtgaaggaatatagtctgccaatggaacgcacagtattgctttttcttgatctgcatattggaaaagaagaaaagtttacacagcagaagctggatcattttcttgaaatcctggcttcactgtcatggtctatgcaggagcagaactggcatcacaaggtgatctggtgggatgaacagaatcagatgttaaaggaagcggatgtttcttcggaggaagaaacctttcgtatgttagaacagatttgttcctccagagtatattcgaaagcatatgagattcaggaattatatttccggcagtttggcgagcggacagaagagctcggaatgcagcttgatatttcagggaaactttatcatggtggaagatgtataaaagtattccgacaagagaaactggaagaggatttaatggaatgggaactggaactgtaaagaagaaaaaaacaaatcatacagaagagacaggaatccgtgtggtacgcagacgaattcttcaggaagatccgcagggagacagactttcttctgcatctttctggtggatgacgggactgtgctttctaagtacagtggctctttgtatgctgtttacaaaagcattttctattacatttgcaaaatggctcgtttatccggcgatgcttgtgtactgtgttctctttacattatattatgaacaaagacagttgaaaaaatattgcgtgtttctctttttaggagttgtttttgtgctttgtctggtcatgtttctgatacagagggagttgatggcaagcatttcttatgtgtggatgcagatggcagagcagttgaaccggtcttatcagggagatttgagtgtgccatcaggagccggaaattctgcgacactgtttttcctttttttgttccttggtgttgtgtggattcttgcacagggaatgatcaagagacacgagaaaggatattttctgttgattacatttccagtgttactggttgttctgttaagtgggggaaatgtatcgaaagcagccctttttctattactccttagtttcttgtgcatcacggcagcatccggaatccgtgtgagaaagaagttctggggcggagaagagagcgaggtatttcgtcagaatctccgggcggttcgaagaattcagagcagagcctctgtcgtgtgtatcgcagcaggaacgattctgcttctgacttccttttacctgcttggaccggttctttcaaagccaatcgtgacgttatcagatgtatcagcgcctgtgaaagttcatggaatgcagttcctttatgatttccttccgaaaatatcaggtggtaagttgaatctttcgcttgaaggggtcggaggtggtgtctcggacggagaattgggagatgtcgaaggatcttcctatgatggaatcgaatccatccgtgtgacgacatctgcacagccgaaagaggttctgtatttaaaaggatttgtcggatcagaatataccggagacagctggaaaccgggagatgaagatgcgctgcaggatacggctctcaactggaaaacagaaggaaattcccttctctatctgcagaatcttccgtttttgcgaatgatgtatacgcagacacagcagccggagcagatgacggtagagagattgaatgcaaatacaaagtatacctatgttccatatcaggcttatctgaacgactattatgagatgatcggcggagatggttcagttgcagggcagacagcgcaggatgacagttatgcatggtttccggttacagatttccagaaggaaatgacagagtgggcaaagcaggatgatcagcaaagtgtacttgacgaagtggagacttcttatgaggtatatgtagaaaataattatgaagatgttccttcagatctgaaacagctgaagaaaatgtgcaaggagaaaaaagcagagtggaaaaagaaaatgagcggagatatcacacaagagcagaaggatgatcttgtcagtgagcggatcacggatgtgaagcagttcataagacagacgctctggaaacaatgctccttttcagaatctgtaaaaaagctgccgaagggagaagattatgtagaatattttctgtttgacaggaagaaaggagattctacagcattcgcttccgcagcggcgttgatgttccgtgagtgtggagttccggcaagatatgtagtcggttatgcggcaccggcgaacttatttacggaaaacagtgaggggaattactcggcagttctccaagatgacaatgcacatgcatgggtggaaatctatgtgccgggtgccggatggatgccggtggagacaacacctggatttgacggaacgattgagaatgttgaaagtaccgatgttcagacggagtcagtgaaggatcagaaggacaaaaaggaagagaagaaaaactggaaagaggaagcgggagatctttttaaagatacaaagaaagctttcagtggcaaaacagtagaaatcgtgagcggaattcttcttttcttattattagtcgaggcaaggagacgttggatttccggaagaagacggggcaacggaagaaaattgtcgaaggaacagaaggtaaaagaaatcttttgcagcttctatgaagtgcttttgtttggcggatttccacaagatgtggatacaacagaagaagaatttgaaagagaagttgcactgcgttatccggaatttacggagaaggagttggaaaagttcaggactcttgttcttcaggtgcattatggatatgaggaaatctcagatcaggatgtacagtttgcacgagacgagtatgagaagcttgtaaaggcaacagtaagacagatgaagttcagaaagaagagcgtattttatatatggaaaggattctgatgagagaaaggagcgtgggaaaatgaggaggctggcagcggttctctgtgtgttgatctatcttggcggtataattgtatttgcgtggccggatcttaacagtttaaaaacaggatatgagaataagaaagtgatggagcagttccaggatcagacagaagcagaacaaagtgtatcgaatcagacagactctacctctgccgattccaatcagatcccagagaacgcccagctctaccaggagatgcaggcatataatcagcagatcttttctgatggtcagtcaggactgactgatccgtggtcttatgagcaggagacattggatctgtccgagtatgggattgatgacgggatgatcgggattcttgatattccgaagatggatgtgacattaccgttatatctcggcgcgacgcaggagaagatggcgaaaggtgcggtcatgcttggacagacatcatttccggtgcagggtacagacagtaattgcgtgatcgcagcgcaccgaggatggaaggggattccgatgtttcgcgagatcgagcggttggagatcggagatgaactgacgatacaaaactgtcaggaaacattgacgtaccgtgtgtctgagattgagattatcctgccggatgagagtgacaagatcatgattcagccggggcggaatatggtgactttgatgacatgtcatccttatacgcagaattccagaagatatgttgtgtattgtgatgaggttggaacacagccggaggcagcagttgatgcagcagaagaggcggacagtagccaacaagagattatcaccacttccgagcagaacagaacggaagcgatagaggaagatcagcgtctgatcgagagagatactttatggaggaaagccggttatgttggaatcgggctaatcggagtattaattatttttggatttatccctaggaaaaagcactgatctgcgttatactaagaaagatgtgaatgaaaacatggtacaaaggagatggagcaatgattcgttttacatggtatgaactgctttggctgtttttcatctattctttcttaggatgggtgctggagacagcggccgcaacagtaaaacagaagaagtttgcgaacagaggtttggtgaatggaccgttctgtgtgatctacggtatcgccgctctgttcatgacatttggattacaggagctaagaggagtctggctttttttatttgcgacgatttatgctacagtgattgaatgggttgctgggcatttgatcgagaaggcatttaaagccagatggtgggattactccaagatcaaatggaatctggatggatatatctgtatcccggcttctcttatctggggtgctcttggatatctcggaatccgctggggaaacagatttgcgatcatagtatttaaaatgttgcctctgttcctgatgaagatccttgtcttggttcttcttggcgtattggttgtggatatcctcggatcttatctgctacttcgtggaaaaggaaagaacctcgcgcggtgggaagctacgaatgaaggtctggataaagtcagcaataagcttggaagtgcgatttccggatgggttgggaaacgtatccaaaaagcgtatccaaaggcaatggaactgatccgcaaggaagaggaagcggagaaggggaaagtatttgccgcaggctgtgggttctataagattgtgctgttgttctttgtcggagcatttcttggagatattacagagacgattttctgcaggattacggcaggtgtgtggatgagtcgctccagtgtggtctggggaccattcagtattgtctggggactggcgatcgcacttgtgacagcaatgctttacaaatataaagataagagtgacagcttcttatttatcatcggtacattgctcggtggagcgtatgaatatctttgtagtgtgtttaccgaaattgtattcgggaaagtattttgggactatagcgagattccatttaacttaggaggccgaatcaatttattatactgcttcttctggggaattgcggcagttgtctggtttaagaagatctatccgtacatttccgcatggattgagaaaatcccgatgttggcagggaaggtgctcacctggtttttgatcattttcatggtctgcaatgtggctgtgtcatgtattgcacttgttcgttatgacgaacgtggaaagggcgttgtagcggaaaacagcattcagaaatgggcagatgagcattacgatgatgcgaagatggagaagatttatccgaacgcaaaagcgacagaatagaaaataagatgtaaacgagagggaaatggtatgatggagaataaaaagatgcgggcagagcatccgaagaaagagcttgcagtggatattttgtatgatattataggaagtattttgtttgctgccggaatctatacatttgcagaagggggaaattttgcgcctggaggaatttcaggtattgcattgatcatgaacaagttatggaatcttccggtcggtacaatgacattgatactgaatattccactggtcatcatcagttacaagacagtaggaaagcggtttttgataaagactgcgaggacaatgattatttcaaccatttttgtcgatcttgtatttccgatgttcccatactatacagggcagcgtctgcttgcagcgatttactcgggagcattgcttggacttggaatggttcttttctatatgagaggttcttcttcgggcggagcagatttcctgacgatgacgatcaaaaagaagagaccacatatgtctcttggtcgactgacgttgttgatcgatttgatcattatcttgatcggatggccggtattcggtgatgttgactcagttctttatggattgatcgcagtatttgtctgttctatggtgattgacaagattctttacggaatcggtgcaggaacacttgcaatcattgttacatcgaagggagaggaaacagcggaagagattggaagaatcaccgaccgtggtgtaacatctttggaaggaatgggtacttatacaaagagtaaaagaaatgttctgctctgtgcatgttccaagtcagaagcgtatcttgtgaaaaatgcagtttaccaggtagatgactctgcgtttgtaatgttcactgagacgagtgaggtgcttggagagggattcaaggaaagtcttgatgagttgtaaataaaagagaagaatatgaaatagaaaaagctgctgtctgaactgttgcttgcgggactcgtgaacaacagacggacagcagtttttctatatgctctttatgaagagattcgttttcaaagatataaaaatgttaatcttctttcgcccagtcgaaggaatatttgacagccttgtgccagcctttcagtttcttttcgcggacttccggatcaatcgaaggttcaaagacctgatcgatcgcccagttctctttgatttcttcaagactgttccagtagccgactgcaagaccagccagataagcagctcccatagcagtcgtctcaacgcagaccggacggtggacaggtgcgttgatcagatcagcctgtgtctgcatcaggaagttatttgcgcttgcgccgccgtctactttcagggaggcaagattaatgtcggaatctgccttcatggcagtcaggacgtcatatgcctgataagcgagagactcgagggttgcacggatgatatggtatttatttactccgcgtgtcaggcccacgatcgttccgcgggcatactgatcccaatatggagcaccgagtccggtgaaagcaggtacaacataacagccgtttgtatttttcactttctttgccatgtattcgcagtcgtctgcggagtcaatcaggcgtagttcatcacgcagccactggattgccgcaccggcaacaaagatagaaccttccagagcatatgtaacctttccgtcaagtccccaggcaatcgtggtgaccagcccattgttggaaaagacaggtttctctccggtgttcatcagaaggaagcatccggttccgtaagtattcttcgcatcgcccggtttaaagcaggtctgaccgaaaagtgcagactgctgatctccggcagcaccggcaatcgggatcgctccgccgaggacggatggatctgtctctccgtaaatgcagctggaaggctttggtgtcggaagcatacagcgtggaatctgaagttcttcgagaatctcgtcatcccagtctaatgtattgatgttgaaaagcatggttcgtgatgcgttggagtagtctgtaacatgtactgcgcctttcgtcagtttccagatcagccaggtctctactgtaccaaagagcagttctccgcgctcggcacgttctcttgctttcggaacgttgtcgagaatccagcggatctttgttccggagaaataagcatcaagtacaaggccggttttctgacggaacttttctgtcagtcctttttccttcaaagaatcgcagaattcagcagtacgacgacactgccagacgattgcgtggcagataggatcgccggtatttttatcccacacgatcgttgtctcgcgctggttcgtgataccgattgcagcgatatcagaaggttctgcgccgatgatgttcatagcctccacagcaactccgagcatgcttgcccagatctcgtccgcatcgtgctcaacccagcccggtttcggaaaatgttgtgtgaattctctctgtgtgacgctgcagatttccccttttttattaaataaaatgcagcggttacttgtggttccggcatctaatgccataacgtattttgacataatatgtgcctcctcattctagtattactcagaacagtaaccatttctgttctatattctaataagataagaatatcataatcggaatggaggttcaatggacgaaaggtgctgtaataactaaattttcgcattttactgtattttactgtatgcatgcttgcaaatctttttatgataccgtaaaataaattttgaattgcttttcagcagttcgccttatgcaactaataacgatacagagacattagaaagttttattttcttatgcattttcataataagaaaggcggtatattccatgggaatgatacgtgctgaaaagcttgtatttgaatatgataaacgagacgaagaaggtaatgtgatcggatcccatcgcgccattgacggagttgacattgatgtcccgcaggggtcttttgtggcgattcttggacataacggttcaggaaagtctaccctggcgaagcatatgaatgcgattcttgtcccgacaggtggaacgatgtgggtggacggaagagatacgaaagatccgaatgagctttggaacatcaggcagagcgccggaatggtatttcagaatccggataaccaaattatcggaactgttgtggaagaggaagtaggattcggtccggagaacttaggagttcctacagatgaaatctggaaacgggtagaaaacagtctgcgcgcggtcggtatgctggagcgaagaaaggattctccgaataaattgtccggaggtcagaagcagagagtggcgatcgcaggagtgatcgcaatggagccgaagtgtatcgtgctcgatgagccgacagcgatgcttgatccgaatggacgaaaagaagtgattgaagcggtagagcagcttcgaaaagagaagaatgttacggtgatcctgatcacacattatatggaagaagtgatcgatgcggatcaggtatttgtaatggatgaagggcatgtggtgatgcatggtacaccgaaagaaatcttcagccgggtggatgaactcaagaagtaccgtatggatgtaccacaggtgacaatgctggcagacgcattggttcaaaaaggagttccgctgccgaaaggaattcttagaagggaagaattggtggatgccttatgtcaattaagttagaaaatatcagttatgtatatagcccgggaactgcatatgagcatcatgcgctgaaggatgtcagtctagagatcccgcagggacagttcgtcggaatcattggacacacgggttcgggaaaatcaaccttgatccagcatttgaacggtctgatgaaagcaacctcagggaaattactttatgaggggcagaacatttacgaggacggatatgatatgaagaaactgcgtacacaggtaggacttgtgttccagtatccagagtatcagttgtttgaagttgatgtgttaagtgatgtgtgttttggaccgaagaaccagggtctttccaaggaagagtgcgagaagcaggcaagagaagccttggagcttgtaggatttccggagaaatattataagcagtctccatttgaattatccggaggtcagaagcgtcgtgtggcaatcgcgggaattcttgcaatgcatccgaaggtacttgttctggatgagccgacagccggactggatccgaagggacgagatgagatcttagatcaggtgaaattgcttcatgagaagaccggaatgacagtaattcttgtttcccatagcatggaagatgttgcgaaatacgtggagcgcctgatcgtgatgaatgatggagaaaagatgcttgacggtacaccggaagaagtgttccgccattataaagagcttgaggctgttggactggcagcaccacaggtaacatatgtaatgcatgatctgaaagaaaaaggatttgatgtatcagcagatgcgacaactgtggaagaggctgcggacgagatctacaacttcctgaagaagagacaggaggtgcagtcatgatcagagatattacgataggacagtattatccggtacagagtccgattcacagactggatccgcgtgtgaagattgtctgcacactgatctttttggtttctttatttgtgcagaacagtgtgcttggatatgcattggcatttgtatttcttgcgtgcatgattcacgtttctaaagtcccggcaaagtttatcggaaaaggacttaagccgattgtgatcttgttattgtttacagtggctatgaacttgttccttacaagaggcggtgcagtgttattccattggggaatcattacgatcacagagacaggacttcgtacttctgtgttcatggcagttcgtcttgtactgcttgttgcaggatcttctttgatgacatttacaacgactccgaacggactgacggatggactggagaagctgcttcatccactgaaccgaatccatgtaccggtacacgaaatttcgatgatgatgtctattgcactgcgttttattccgattctgctggaagagacagacaagatcatgaaggcgcagatcgcaagaggagctgattttgaatcaggaaatattatccagagagcaaaggcaatgattccgatccttgttccgcttttcgtgtctgcgttccgaagagcgaatgatctggcgatggcaatggaagcccgctgttatcatggtggcgaggggcgtacaaagatgaagcctttgaaatatcattatcaggacagacttgcttatgcaatcacattgggatatctgattgcgattgtagtgatcggaagatttgtgccgtttaaattgtggattttttagaataaaataaatagagaagagggacggagatttctgtcccttttatttacgcgagcaacgagccaaagtccgtgcttgcacgagaccttggcgactgccgcgataacttgagaaactcgcggagcgtgtttctcatagtataggagaaagaacagatatgagaagaatcagattgagagtggcgtatgacgggacagcatactgtggctggcaggtacagccggaagtgccgacgattgaaggtgaattgaatcaggcaatctccagacttacgaaggaagagattatcgtgatcggggcaagccgcacagatgctggagtccatgcgaagggaaacgttgctgtatttgacacagagtctacaatcccggcagaccggtttgcttatgcattgaatccactgcttccggaagatatcgtggttgtggcatcagatgaggtggaagcagactggcatccaagacattgtgatacggagaaaacgtatgaatacaagatcttaaatagcaagttcccggatccgatgagaagaagagacacgtatcatgtttcttttgacctggatcttgagaagatgagagaagcagcaggatatctgaaaggggaacatgattttaagagcttctgtaatgttcatactcaggtggaagatacggttcgcacgatttatgatctggaagtagagaaagaggaagagcttattacaattcgtgtccgtggaaatggattcctctacaatatggtccggatccttgcaggtacgttgatcggagttggaagaggagcaattgccccggaacagattccggccattcttgaggcaaaggatcgccaggtagcaggaatgacagttccaccacagggactaacacttgttaaaattgactaccttgatgaaaaaagcaaataattttttgtaaaggttgacaatgaaccgtttcgctgttagactagacagtgtggtgattgtcagtagacagaaccaaatttcaggcagagacgaattttaagcgtatgcctggaatttgtttttgtaaagaataacgaaaaaaatcgcgtattatgtaaaagtataaaaaaaatataaatattattaacaaattataaaatatttgattgacttttatgtgcaggtttgttatactgaatcacgtagaaaagagataacattgacgaattgttatcattaaagaaggattgttactgttaggcaggcaaaaccagattttatgagcgtcaccgaaggaatcaagggggatgccttaaagtttggcttttttattatgagggagtttttcccaaagttagagaaaggccaatcggatggttatagacaaaataattaataacaatattgtatctgcatttgacgaaaaaggcttagaagttgttatcatgggccgcggaatcggattccagatgaagcggggacaggaagttcctgcagagaagatagagaaggttttccgtatcaagagtcagagcatagcagaacagctcaaggaattgctggcgaagatgccgcttgagcaggttcagatctcgaacgagatcatttcctatgcaaagaagacaatgaagctgaagttaaatcagagcatctatgttacattgacagatcatatcagttttgcaatcagccgctgtaaaaaggggattcatcttgagaatgcgttactgtgggagattaaaagattttatccacaggaatttgaactcggaagatatgcggtagaacttgtgaaaaagagactgaatgtagagatgcctgaggacgaagcaggatttattgcattacattttgtcaacgcagagtatgggactgatattcgggatgcagtacggtttccgaatcagatgaaagagattcttggaatcgtagcagaagaacttgggattgagatggatgaaggctcattgcattatgaaagatttctgacacacgtgaagttccttcttcagaggatttaccgcaaggagttacttgaagaggaagagaacgagattacagagatgatgcagagaaagtatccgagagagtattcttgcagcagaaaagttgcagattacatagaaaagacggcagactgcaagctgtcaggagaggaagttttgtatctgacactccatatccgccgtgttgcgatggcggattcggaggacgaatagagggttgctttgaacggtaacgaaagaaatggctgtattagggaacagctactgtaaaattggactttagcgcaaggcgcttttgtcatagatggttctctggtttgtggaagacccggaggatcagagttgattttgaccggaggactcatttgccggttaaaataaaaagggattaaaaatgagagattattaaggagggaattctatgaaattcgtacagaaattaggaaaagctcttatgcttcctgttgcttgtcttccgatttgtggtatcctgatgggattaggatacgcaatgtgtccatctactatgcagggtggagatgtaactggtattgttcagcagatcggatttttccttgtaaaagctggtggtgccttgatcgatcatatggcactcctctttgcaatcggtgttggtgttggtatgtctgatgaccatgatggtacagcaggtcttgctgcacttgcatcctggctgatgatcacaaaccttctttctactggagcagtatctgttcttagaacactggaagaaggaacaacagcatttatcgcattcagcaaaatcgaaaacccatttatcggtatcatcgccggtatcatcggtgcactttgctacaacagattcaaatcaactaagcttcctgactggctgtcattcttcagtggtaagcgttgtgtagcaatcgttgcaggtgttgtttctattattgtatctgcagttctgctctttgtatggccggtactctttgcaggactggttgcacttggaaaaggaatcgcaggaatgggagctcttggagctggtatctatgcattctttaacagattacttatcccgttcggtctgcaccacgcactgaacaatgtattctggtttgatacaatcggacttggagacctgtcacacttctgggctggagaaacatctgcagacgtttcctggagtcttggaatgtacatgtcaggattcttcccatgtatgatgtttggtatccctggagcagctcttgctatgattcagtctgcaaagagcaataagaagaaagttgcaatcggacttatcgcatctgcagcaatttccgcattcgtttgtggtgttacagagccattcgagttcgcattcatgttcctcgctccggcactttacgttgtatacgcattactgtatggtatctttacagtaatcacagtagctcttggattccgtgcaggattcagcttctcagcaggacttacagaccttatcttctctgcttcccttccggcagcagctaagacatggcttatcattcctcttggaattgcagctttcatcgtattctacgttgtattccgtttcgcaatcgttaaattcgatctgaagacaccaggtcgtgaagatgacgatgatgatgaaacaaaagttgttcttgcaaacgatgacttcacaacagtagctaagatcgttcttgagggtgttggtggaaaagataacgttgagtctatcgacaactgtatcacaagacttcgtcttgtaatcaaagattacacaaaggttgatgagaagaagatcaaatctgcaggtgttgcaggtgttgttcgtccatctcagaaagacgttcaggtaatcattggaacaaaagttcagtttgtagctgacgagttcaagaaactttgcaaataagtttaaatgataattaggttatccgggataatgatgtgaaagaatacggataacacacacattaataatcccttttcaaaagcggaagtggaatcggcgaagagccggggacacttccgttttttatatattaggaaagttctttcctaatatataaaaacgctccgctagggatgcgcactgcggcgtacaaggtaggtgtcgcaagcgaccgccgcaggcgccagaatgtgccaaggcacattctttgttatatatacaagaccacttgacaaaaggattacaatagtctatcatcaagactacgagagtttattctgactcttatatagaagttgtatatggaaggctgtgaagggaacaagtaacagacagaacagacacacagaaagctgccggctgatgagaggcgcgtagatgactgactgcgaatacatcccggagcttcacactgaaatccgatgatgaaagttcaatgattgatatggggaacagatcagacagagagtaggctgtgacggagttgtgctcgttattgcacgaatgagactgacagacataaaggtaagaattttatacttacatccgaaaaaatgttgtcggtgaattaaggtggtaccacggtgatagatcgtccttattgcgttatgcagtaaggtctttttttatatgttaggaaagttcttttcggatatataaaaaggacaagctgaatgatgcgttataatgctactggtcacagtttttgtgccaagagacatgttatgaatattctgtagaagttacagaaaaataaaacgaaaagagaaggagaagaaagatgggaatttatgaagaacttcaggcaagaggcctgatcgcccaggtaacagatgaggagagaatcaaagaacttgtaaataatggaaaggctacattctatatcggattcgacccaacagcggacagtcttcatgtaggacatttcatggcactgtgcctgatgaaacgtctgcaggaagcaggaaacaagccaatcgcactgatcggtggtggtacaggatatatcggagatccatccggaagaactgatatgagaagcatgatgacaccggagcagatccagcataactgtgactgcttcaaagagcagatgagccgtttcatcgatttctctgatggaaaagcgcttatggtaaataatgcagactggttgcttgatctgaactacatcgatgtacttcgtgaggtaggacctcatttctcagtaaacagaatgctgacagcggagtgttacaagcagagaatggaaaaaggactcagtttccttgagttcaactacatgatcatgcaggcatatgacttctacgagctgttccagaattatggatgtaaccttgagttcggtggagatgatcagtggagcaatatgctcgcaggtacagagctgattcgtcgtaaacttggtaaagatgcaagcgctatgacaatcacactgcttctgaactccgaaggtaagaagatggggaagacacagtcaggtgctgtatggcttgacccgaacaagacatccccattcgatttctaccagtactggagaaatgtcggagatgctgatgttctgaaatgtatccgtatgctgacattccttccacttgaagagatcgacaagatggatacttgggaaggtgcacagcttaatacagcaaaagaaatccttgcatatgagctgacaaaacttgttcacggtgaggaagaagcgaagaaagcacaggagagtgcacgtgcactgttcagccagggaaatgctgataacatgccgacaacagaactggaagaggcggatttccaggatggaaagattgatatccttgcagttctcgtaaagagcggacaggcatcttccagatctgacgcaagacgtgccgtaacacagggtggtgtttctgtagacggagagaaagtaacagacattacaacaacatatgctccggcagacttcgacggagaaggtaagatcgtgaaaaaaggaaagaaaaacttccgcagagttgttgcaaaataattgaaatgaaggaactattcagtagccactgtgaaggcgctgaatagtaatgaaatgaattaaaaatagtggctgttactgtagcattaagttggatacagtaacggccgcttcttataaggaggaaacaaaaatggcatttaaagaagtaaagattgaggaactttcatttaacccttttacaaaaatcagcaaggaatggatgctgatcacagcaggagatgaagagaagcataatacaatgacagccagctggggcggtgttggaattatgtgggggatgaatgtggctacagcatatattcgtccacagagatatacgaaggaattcgtagatgcagaagagatgtttacactttctttctttaaggaagattatagaaaagtattaaatctttgtggttctaagtcaggtcgcgaatgtgataaagataaagaagcaggtctgacaccgtattacacagacggaacaacagcgtatgaagaagcagatctgatctttgtctgcagaaagctttatgcacaggagatgaaaccggagtgctttacagtagacggaccggatgaaaaatggtatccgggcaaagattaccatacaatgtatatgggtgagatcgtgaaggtgcttgtgagagaataagtaaaagatttcagctggtcagattatgaagtcgaagagccggaacaattaaaataaagagtagttacactgcttgcaaataataggagaactcctttcagttgtgataagatgcagtctgagaggagttttttgtagaatagagtaaataaaaatgctgtacaacttgaaaattttgataaaatatggtaaaaatagatatagaaaataccaggaaagcgggcagtagaatggaagaagtaaaaacaataatactgaaggatgtattgccttttgtggatccggtggcaagatcccatgcaagaagagttctgaaagatgtagaaggatacaaggagcttgtgattgattttcggggaattgaattcatggggcgcggttttgcggatgaagtgttccgtgtgtttcaggaagagcatccggagataaagattacaccgcttcatgcgagtacatctatgttagcgatgattcgccatctcggaggaaaacaacaataaatgatatttacagattccttgtaaaccgttacaataggaagtcggggcatttgtctctgatatcttattatatagaagaaaaggaacaagggaaatggggatttatctgattgtatgtccgctggtgtttctggcgggctttgttgattcaattgcaggaggcggcggacttatctcgcttccggcatatatgtttgccgggattccggtgcataatgcaatcgcgacgaacaagctgtcatcttcaacaggaacggtagtatcgacagcgagactgattaagaataagaaagtagactggggatttgtaccaggaacggtgatcggagcgttgattggttctgttgcaggggcgaatctggcgttgatcatcagcgaccatattttgaaaatggtattggttgtgatcctgccgattgtagccttctgtgtgttgagagataagaacatggatgtggaagttccggtcggaatgacaaagaataagcagtatctgatcgcaattgtatgctctttggtgattggttgttatgacggattctacggtccgggaacaggaaccttcttgctgcttgtatttaccaagtttgcgaagataccattggagaaagcgacaggaaatgtgaagattgtgaatctttcttccaatatttcagcattaattacgtttatcctggcagggaaaattatgtggggactgggactggcagcatcctgtttcagtatcgcagggcattatgtaggtgccggaatggttgtgaataatggggtgaaagtgattaagccgattattttgatcgtgctggtgctgttattggttaaggttgtgtctggaatataagtaactgttcagagccaagcaaaatttcaaaaaacaggtatgaaatgcttgcatttttaagactgtttttgaaattttatttggcggatacgccacaccgacgaaatgcgtagcattttggaggttggctctgaacagttacgaatataataaggaaataaaagaagcagaatcatgagggaaaatgattctgcttctttgtgcataggcttaacttttatacaaaataacataaatttgtcaatttttataaacattataatataatacttacatcactaatctcagcactctggtcttatccaatataaaaatagaacataccataaacagatgcgccagcagcgtgctgacgatcacaccgttagacgtaagcaggaatccggtatagaatccaaaccagcagacgaatccggagtaacttgccatcaggataagcagtggtaattcttcccagaagccgtgaagtgtgcttaaaaagtcatccattgtaaaatcgaagtagataaaccggccaacagcaagtgtgatgaagtacatcatcagtgaatcgtagttattatcattgtaaatgaacttgatataaagaagtatcagtataatataaaaggaagataccagtcgaatggacgccttttggttggaatctatttcttccaatggtacaaatacaatatcaagccatccatttaagataacggagaagcaaaggaagagtaaaaggataatatcctgatacttctgccaatagatggacacgcctggaatcctctcgtcaatcacatagtaaagagacagaaagatcagcacggaggtgctggcgaagaccatctcaaagaaactttcaataatgcttctttttcgctcctgatggtggcggttgatacgacggattgctttgtgagacagggagtcatcctgcagtcgctggcgtgttttcaatttggctacgccaagaacaataccgatcacaacggccagcccgatcagcgagacgagcaggtagattccgatgtattcaaagttaaaatagtgtgtaacataagttttcattaaaatgccttctttcaaaatccttagcaggttataaatagttgtatagctttcattatcaattatagcacggtgatgcaaggggaaaatactggtaactgttcagagccaatactggataaaattcaacctagtcaaaagaaataaactatgttagactatcaatagattgataaaaagataacaagcatggtatctgtcagaatggattgccagtcgtatgtagtgcgagtagtaaccaaaatagtttaccagggagtgggaaaaggacaggatgagaataatgaaagcaattgtattcgatgtagacgacacattatatgatttatcaactccatttaaggaaacatgcagggaggttttcccggaagataaagatctggatctggaaggcgcatttttggcaagcagaagatacagtgattccgtgtatgcacgctgtttaagtggtgagatgtcgatggaagagatgtatatctatcgattcaaaaatgcatttcttgattatgggaagaagattgatgcactcaaggcattggaattccaagcaatttatgaagaaaaacagcatgaaatcaagatgacagatgcaatgagacagttgatgcagaacttgaaagagaaggtgactctgggaattgttacaaatggtccggcgcagcatcagtgggataaagtgaatgcgcttggtgtaacagaatggattccagtaggtcatgtatttatatcaggagcactcggggtagcaaaaccggacaagaggattttcagtcgtgcggcggaaagaatggggattttgccgcaagagatctgctatgtaggagattcttttgaaaatgatattgttggggcaaaagctgcaggatggaatgcagtctggtataatcatcgcggacatcaggcagcaggtgatgtaaagccggatgcagtggtaagaagtgaggcagaattgattgcatgtctggagaagatcagcacaaaggagtgagcggaatatgcagaaggaagcccaaataatcaaggtgatggctgctccggaagctggatggtaaaagaaaaccttttaaaaaaagaaaaataacagctgtaagagaaatatttttcaattacagctgttattttcttcttattcgttattcttctactttttcacttttatctttcggcagaatcagactgagcagcagtgatactacgaacacacctgcaacagcatttccgttgaagatatctcccacagcctgtgggaaagcgctgaagaagttcgcatctgtttgtgtaagaccaacgccgacgcagaaagcgagagatacaatgatcattgtgcggtcattgaactcgcagtctttgagcatcttgattccttcgtacaggattgaaccaatcttccatattggatagttagacagcgtctgcttcttcattttttccgagtctgcgaagcattgtcttcttgactgcacggaaaatgttttcataacctgtgcagcggcacagatgaccggacatcattttacggatctcatcatctgagaattctttgccggcatttaaaagttcagttgcactcatgatgaatccaggtgtacagaagccacactgaacagctgcttcgtcaataaatgcctgctgaatatcggataactcaccatttggtccggcgagaccttcaagagtaaggatttcttttccctcagcccatacaccgagatagatacaggagttgaagcattccccatcaatgattacattgcatgctccacattctccgacttcacagcctttctttacgctggtcagacggaagtcatctcttaaaacatctgtaagtgatgcacggacatcgatcattttctcgactttcttaccgttgatcgtgcaggtaagtaatttgtactgtttagtcatcgatcacacctcctgccaatctgatagattctgtcagtgcacgctctgcaagaacagtagcgatgtgctgacggaatgccttggatgctctccagctgtcacgtggattgatatcatccagaacagcctgaccaaattcatgaacaacagcttttgtaagcggtttgccctttgcttttgcctcagcagaaggtgcacgcatcggaacaggtcctgcaactccgtaagcaattctgacatcctcgatcgtcttcttatcctcagagagttttacattgacagaacatcctgttgttgcgatatccattgcattacgcattgcgtatttaatgtaatgtccgtggtagccttcgtatgcttccttcggaatgatgatcgctgtctgaatctctgccggtttcagatcaacgactcctgctttaatatagaagtcatggatcggaattctgcgaactccgtccggtcctgtgatctcaacaattgcatcccatgcatgaagtgttgaagcggaatcagcggatgtaacaccattacatgtgtttccaccgatcgttccgatgttacggatctgtggtccaccaaccatatcaacagcttccccaagtacgttgatatgcttctggatgatcggatcctttgtaatatgagagaagctggtcagagagccaatgcggatcgcaccgtcttcttcataagatatgcctctcatttcatcaattttataaatgcttacaagttcttttcctgcgcgacgtccttcacgcatctgtacaagaacgtcacttccgccggcaatgatctgtgcttccggatgttcctgtaaaagctgtatagcatgagctacgctttcagcttcataaagtgctttaagatcatacatttgcttctcctccttcctcaaacatatgttgttccttcatactgcggaacagatggtgtggattcaccggtgcatcatttacatagacacctgttgcctgataaactgcgttacggattgcaggtgcaatggaacatgtcggtggctcaccaagagattttgttccgaatgcacttgtaggctccgcattttctacaaaataagcgcgtagtctcgggtgatccataaatgtggataacttgtaatcgagcaagttattatttaatgctcttccggtcttcggatcaaagagcaggttttcagaaagtccgaatccgattcccatactcataccaccgtgtacctgagcttcagcaagtgccgggttgataagagttccggcgtcatgtacattgacgatatcaagcagttttaccttacacatcgggatgtcaacttcaacttctgcaaatgtacatccgaaggagtaagcattggacttaatctgtgctgtactttcagctgacagatgctcactgtgtgaaaggctgtaaagtgcttctgttgaaagatctccaagagacatcagaacacggttatctgtgatacgaacaatctgtccgtcaatgatatccaggttatattcaggcattcttgtcagttcatgcgcatatttcaaaatgcgttctttcagaagcagtgctgtctggcgaattgagaatccggctgtataagtctgacgggatgcataagcacctgttccgaatggtgtgacgtctgtatcctgacaggaaacaacgtgtacagcttcaagcggaacgccaagaatatctgcagtcatctgtgaatatgcagtatcagcaccctgtccgatctctgtctcaccgagctgaacctgaagagaaccatcctgattcaataccatgcggcaggaagatgtctcaagtgagattggccatacagctgtgttgtaccagaagactgccataccgatacctctgcggatatctcctgtctggttttggtattctttgtatttacgaaggtaatcagtaacttcgattcctttgtcgaggcactggttgaatgtgtcgctgtataattcatttttagaaaatgcatccttgaatccgaccggcatcaggtttttgcggcggaattcaagcggatccatgttaagttttgcacaaatgtcttctgtatgacattctacagcccacattgcctgtggaattccgtaaccacgcatcgcaccggcaacggatttgtttgtgaatattgtataagcatcagcctctacgttatcacaaggataaagctgtgggaacgcgccgacaccttttgcacagatgctgtgaccatgggaagcgtaagcaccctgatcggaaaatgcttccagttttcttgcagcaaatgttccatctgggcgaacccatgaaatgatgtggctcttgatcgcatgacgtacacgagtagaaacaaaggtctcctctcttggtacatcaagtttaataagatgtccgtgaagctgcatggacagccatgcacaaagtggttcatacaaaacatcctgtttatttccgaaaccaccgccgatgtaaggcttaacgacacggatcttaccccattcaactccgagtgcctgaccgacaactcgacgtacgatatgaggaatctgagtagaacttacaaccttgatgcggtcgccttccatctcagcatagcagataaagttttcaatatgacagtgctgaacggttggtgtgctgtaccagccttctactttgatcagtccaggttctttgattgcttcttcgtagttacctttactgatcgttgtgtgtttgagaatattgttcggataatcctcatgaagctgaggagcatcctctttcatagcatccagaacatccaaaacaaatggatattcttcatattctactttgatcgcacgaagtgcctgtgcagcggaaacctcatcctctgctacaaccgcagcgatatcatccccataaaatctgacgcggtctgtaagtacaagacgatcggcaacatcctgatgtgattcatctgtggaccatggatgtccggcagttgggaaataatgcttctcctttaaatcaaaacaggtaaatacttttacaactccaggtatcttctcagcttcagatgtgtcaatagaaagaacacgtccgttggcaattgtagagtgtaaaatacgtgcaatataggcactcttatcacagagatcatctgtatattttgtacgtccaattactttatcgtaggcatctacacgagtaaccttttttcctacatacatgttatcccctccttaaacataagtttggatcaaccgtttacgtaaaaatcaatatcctgtttcatctgaagatattgggccttggtaatcacgatctttcctttattcagcgtcagaagattcatctcttccagctttctgatgtttctgtccagagttttaatagaaatccccacttcttcggaaatgcgcgctcgtgtctggttaagtaccagaatctccggtgccgggatcttttgttcatatattcctgctttttaagtggtaagctattaaataaatccacgaatcttcctcctcctttttattcattatagagagaaaagctgatacattaaaaggccatgtgacattttttctccgcttttttgaattatggcgttttggacaaaaaatgactataaattaataatattataatgtttatttggtaaaaatgacaatgaaaattaaaaaatattgatttgtaaagttatccacaaattatcaacaaaaaagatgagttataaacaagaaacacattgcaattaaaagtggactgggatattctgagaacataccaattcatgaagttggtgttgggcaggtaagaggactgttttattttaaatatcgcatcaaaataaacgatgaaaaacaaattacaaaactatttcccaatgatcagaaccaaaggacaagtgcttgaagaaatccggaatagcccgaaaatgtggaagacattttgcggttgggaagaaaaataccaacaggaatatcttgacatttgcactggtgtaaaaggtgtaaaacttctctatgatacctattttaaagttattatgaatccggataccagacccgaaaggttaaatgattttctatcagaaatactgggaagaaaaattagaattttaaaagtacttccgaatgaatcagcgcgtattgcagcagagagctccttattgattatggacattgttgttcagtttgaagatggcagtatagcaaatgttgaagtacaaaaaatgggatatttatttccaggacagagaagtgcctgttattcttctgatttattgttacgacagtataaacgagtgcgcgcagaattaggaaattcatttacttataagagaattcagaaagtctatacaattgtattatttgaaaagagcagcgctgatttccgcaggttttcgaaagaaatatatattcaccattgcgaacaaaaaagtgatacaggagtagaagtgaatttactgcaagaatatacttttatatgtcttgacatttttagtgacatcattcaaaatgaaaacagaaagataaaaaacagattggaagagtggcttgtatttctcagtcaggatgatccagagatgattataaaacttttgaatcagaattcggattttcagaagatttatgaagaaatctatacactctgtcttaatatggaaggaatgatggagatgttttcgaaagaacttgagattttggatcgtaatacagtaaagttgatgattgacgagatggaagaagaattggcacaagtaaaggcaagtgttgcaaaacaggtcgaagaacaagtggcagagaaggtagccgaacaggtggctcaagcgaaggagagcattgcaagagaactagaagaagagaagcaaaagatagaagaagaaaagcaaagagcggaagaagaaaaacaaagagcagaagaagaaaaacaaagagcagaagaagaaaaacaaagagctgataaagcagaagaggaaaatatgagattaagaaagaaattgatggaattgcaaaaattgtaataaggtagatacaaaaaatttaaaaaacttagaaaaatttaaatttgtgcttgcatatctctgatgcgtatgataagatataactcgtgtcagagataacgcgagacacgcgggtgtagttcaatggtagaacaccagccttccaagctggatacgtgggttcgtttcttccttagaaaggaggtgatccagccgcaccttccgatacggctaccttgttacgacttcaccccagttatcggtcccaccttcggcagctccctccttacggttgggtcactgacttcgggcgttactgactcccatggtgtgacgggcggtgtgtacaagacccgggaacgtattcaccgcgacattctgattcgcgattactagcgattccagcttcatgtagtcgagttgcagactacaatccgaactgagacgttatttttgggatttgctcgacctcgcggttctgcctccctttgtttacgccattgtagcacgtgtgtagccctgctcataaggggcatgatgatttgacgtcatccccaccttcctccaggttatccctggcagtctctctagagtgcccggccaaaccgctggctactaaagataggggttgcgctcgttgcgggacttaacccaacatctcacgacacgagctgacgacaaccatgcaccacctgtcatccctgtcccgaaggaaaggcaacattacttgccggtcagggagatgtcaagagcaggtaaggttcttcgcgttgcttcgaattaaaccacatgctccaccgcttgtgcgggtccccgtcaattcctttgagtttcattcttgcgaacgtactccccaggtggactacttattgcgtttgctgcggcaccgaacagctttgctgcccgacacctagtagtcatcgtttacggcgtggactaccagggtatctaatcctgtttgctccccacgctttcgagcctcaacgtcagttaccgtccagtaagccgccttcgccactggtgttcctcctaatatctacgcatttcaccgctacactaggaattccgcttacctctccggtactctagattgacagtttccaatgcagtcccggggttgagccccgggttttcacatcagacttgccactccgtctacgctccctttacacccagtaaatccggataacgcttgcaccatacgtattaccgcggctgctggcacgtatttagccggtgcttcttagtcaggtaccgtcattttcttccctgctgatagagctttacataccgaaatacttcatcgctcacgcggcgtcgctgcatcagggtttcccccattgtgcaatattccccactgctgcctcccgtaggagtttgggccgtgtctcagtcccaatgtggccggtcaccctctcaggtcggctactgatcgtcggcttggtaggccgttaccccaccaactacctaatcagacgcgggtccatctcataccaccggagtttttacccctgcaccatgcggtgctgtggtcttatgcggtattagcagtcatttctaactgttatccccctgtatgaggcaggttacccacgcgttactcacccgtccgccactcagtcaccaagatcttcatccgaagaatcaaatcaaggtgcttcgttcgacttgcatgtgttaagcacgccgccagcgttcatcctgagccaggatcaaactctcgttaaaagtgtttgtatccagttcagaaccaactaactagctaattcttccctttttactgttgttttggtttgtttaaaaaccgttcttaaaaatcttctcttaaagaaattttcaagggttgttgttgtctattgttcagttatcaaggttctatctgccgccttgactttatcatttgcctttataatgattccctgctcatcaatataacctgttccacgggcttgtctactgcgccacctgcgggaagtccatgcaggtacggtatgaaaaagtcggcagaagcgggaagaaccgttttaccggtgagatgcgggaaccgattgacaaggcatactatatctgccagacctacaaccggctgagtaagaacgcctgtaccagccacaagattgaagcaagggatttgtataatctagtgctgaaggatatacaggaattggcggagcaggccatgaaagatgcggatatgttttaccagcggctcagcagccggatggagcgccggtatctgatggacgcttcccagacagagaaggaacggaaacggctggaagcccagaatcaggaaattgacgggatgtttttaagcctgtacacggataaagccaaaggcatcctgaccgaacagcgatttatgaaactgacggtggcgctggaacaggagcaggaagccaaccagaagcgcctgcatgatctggcggtgatacagagccgggcagatgcgcaggaaagcgaagtccgtacctttatcaaggaaatccggcactatgccgccattgaggaactggacgtgtccgtactgaaccggcttatcagcaaaatcctgattggcgaggttaagaaggtgaatggccagaaggtgcaggaagtcaagattgtgtataactttgttggggaaatcccggagattgcaacataagaacagcgaagccctccccatgcaggggagggccttttgttttggctaaatatgtgatattcaaattgcgagtaattgtctgagtatttaacgcacatgcaaatatctgcatttttataagtgtccgccttgtgctgcaaccaatcgctggaacaacccgttttcttctaataattctgttggcgttcccatttccacgacctgtccatgatccaaaacaacaactttatccgcatttgcaatcgtcctcatgcggtgcgcaatcaccaacacagtttttccttgcagcagttctgacaacgcctgctggacaagggtttcattttccgcatccatagaagcagtggcctcgtccaatattacaacaggagcatcctttaagattgccctagcaatcgaaatacgctgtctctcaccgccggaaagaatacacccattttctccgatattgctttgatagccttctggtagccgtgatacgaactcctcgcattgcgcggctcttgccgccgccagtacttcctcatcggtggcattctgctgccccagccggatattttccatgacggattgatcaaacaaagtaacttcctggaacacaatcgaataatttttgaacagcgtttcaggctctactgtagtaacgtccacaccgcctaataaaaccctgccggaatcagcatcccaaaatcttgccgccagccgggaaacggtagattttccgccgcctgacgggcctaccagagcagtaatctcaccctgctttgccacaaaggaaacaccattcaggacacgctcgccatgtctgccagaaacagccgtatcctccaaatctgcatgataggtaaacacaacatcctgaaattcaatatcatatccctgattattgcagacaggcagcccgctctgctccttgatagcctccatttgttttgtccgtttaatactgacaagagatgagatcatttccgccatcagcatgaacgatgaaccaaatggctcatatacacgcccggccataacaagatataaaataaacatggtaactgaaaggcttccatccgcaaccatcagaccacctgcaagcaataccgccacaatcccaaaccgtaagaaaaattgtgctaatgtcacggcgattcctgggggcagctcattttggaacgcacaagacacaacatgctctaactttttgtccacatcctcaagatatgctttttcaagtccgtccgagcgcagttctttcatcacatctaaatactcctgcacactgtcatatgcggctcgatgcgcatccagattccgttcttctgcctttatttgtttttttcgtgcggcaagcactacaagtgcagaaattggaaccggaaggataatacacaatcccatacgccagtcaatcaccagcaatccgcaggaaataatgataaacatgatgacagttccccaaaagccgggtaccgcatttgaaaacatgcgttccaattttgagcaatcccccatcatcgttgttgtcaaatcggatagatctctttgaccaaagaaagacaacggcagacggcgcattttttcagcaagggacatccggcgctcagcgctttcctcatatgccaccttataggtcaagttgtattgaacccactgagtgacaaagataagcgcagtcaaaaaagcacataataaaaggataaacggaatatttgattctgcgccgccacgaccgaccgttttatcaatcaacgccattgtcatagtcatcagcaaggaaacaggcagcatgacacagagatgcgccgccgctgtcgcagcgataccttttttcaaatcccgtgcgcccttatcactgagcgcaagcatttcttttagcatgaccgcacctcctttgtaagcttccaggaaatagactgattgtagtcctcccacatacgggcatattccccctgcagttccagtaatttttcatgtgttcctctctctacaatgcttccttctttcattactaaaatctgatccgcattttgtaccgtactcaaacgatgcgcaaccataataaccgttttccctttttgcagttccgcaagagccttctggagctgcgtctcgttttccggatcggcaaatgctgtggcctcatccaacacaagaataggcgcattttttagtatcgctctggcaattgcaatccgttgtacctcgccgccggacaggtacacgccttttttcccgaccacactgtcaaggccatccggcagcttcttcaaaatatcatcacactgtgccagatgtgccgcacgaaggatcgcattccggtctgcatcgtggcagccgccacggatattatcctcaagcgttgccttccgtaatttaggattctggaatacgaaagcaacctgcttcatcagagattccctctcaatctgctccagcggcgttcctccaatcaagatggttccctcttgcgtatcgtaaaaacgagggatcaagctggcaatagtcgtctttccggagccggagtgtcctaccaacgcagtcgtagtacctgtcggggcactaaagttaatatcggaaatcgcaggcgtttctcccgtgggataagtaaatgtcacatgttcaaaacaaatatccccgttctgcggttttacaggctgcatcggctgcttttgtggtttcgccaaaagaatggtatcgattcttcgcatagattctaccgcctgcattttataattgctcatatacataattttattgagcatggaagcgcaggccggagcgaacaccagataaaacaggaattttcctgcaaaagcaacggtatcacctgaaaacgtcattcctatcagcgctgccgggacaagtaccaaaaaggaagcgttcactattgtattaaacccgacatatcctgatttacacgccattgtaaaagcaagggcgtcgtcacggtatgcagtaattgcgtcccggaattttcttatggaccaggcggattgtccaaaaaccttgataaccgatattccccgtacaaattctactgcctcatggttcatttcttcctgtgcgtcctgataccgtttcataaagcgcatggttttttcacccattatggtcatctggcaagtaaagctggcaatcagaagcaggagcaacggtaaaccgatccgccagtcaatcgcaagcattaaaataagcccgacaaccgtcgctacttgtgcgcccacaagatcgggcatctgatgcgccagatagctttctacttgggcgctgttttcatcaataatcttccgcagttttccaccgggattttcttcaaaatagcccaacggcatttcagaaagatggcgaagcgctgccattttcaaattcttttccgtatgaaacgcccccacatgagagcagagaagtgcaatgaaattgactgctaaccccgccaactcaaacacaagcgcccatatcccccattgcatcatatgcacagtgccatatccgccgcccgacatgccgatgagcaattctcttgtggcaaaataaatacacagaaaaggtgccagtaataacagagaactgaatcctgccaaaatctgagacatgctgaaaagccctttgtattttccggagaactcaagcaaccgtgggattcctgtttttagcggtttttctgtttgtgagttttctccaaacacctttttcatatagagtatccccctttcgtctaatttaataaatttttttatctcaccagaatggatatgaagaatatgtgtggcgcagcgcaggatcagttccggatcatgggtaaccatcatactgcaaaaagcattttcgtttgcttcccggatcatttccgcagttctcatcagattatctccatcttgaccgcttgtgggttcatcatacagcataatttctcgatttgtacataacgccacactaagcgagagcctctgctgctgaccgcctgacaaagaacccggatggcggttttccaatcctgccagccccattttctccaaaatggctaccgcttcagtctctgtaacagttcctttattcagcatcagttcacctagcaccgaatcactgaacaattgatggccgggttcctgcatgaccaggtaagcctgctccggcagctttttgtttgatattcgctctccattgatccgcacagttccatgatgtttcagcaaaccgcaaagacaaagcgcaaatgttgatttccccgcaccattttctccaatgaccgctacaattgcacctttgggaatcgccagtctgtttatatccaatacttgcctcatttgacgcgaaaaccgaagcccttctatttcaagaaaagccgccttttccatgtccttttcctgcctaatcgtgcgtgtccccatattccaaagttgtttgcggcgtactgctcttaagcccgactgttcaagtttttgacgcgacagcgccagaatttcatccgatgtaaattcattttctatttgtccatctttcaacagaacgtacctgtctgcaatatcttccagataccataaacggtgttcggagatcagaatcgtctttccctcgtccttcatggttcgaatcagatcttgcagctttcggatgctttccatgtccagattcgaggacggttcatccatgacgatgacctcaggcatggaggcatacacggaaccacatgcaatttgctgcttttccccaccggataattgaaaaatatctctgtccatcaaagtctgtatatccagcttccaggcagtttcctttaagcgttccaccattttttcatgcgggatgttcaaattttccatattgaacgccatctctccggtcgtatccagatgaaaaaactgtgtcctcggattctgaaacacgctgcccgccacggcggcaacctggggaagggatgcttcctttacatggacgtttccaacagtaatgtctccctccaggcgtccctgataaaaatgaggaacaaggccattgaccatgcgcagcatcgtcgttttcccgcatccgctttttccgcataatacgatacattcgccgcgttccgcatgaaaatgaatatgccggagagccggtggttctgatccgtccggaataccgccctgataggcaaagctgacatcatcgaaggtaatcatagtcctcccccctttcaaacaatcaggttccattccaatattccggccgatacggtaatgatgcaccaatccagaatggacagttttacttctatgtagctgctgcggcgtgtatctcggtcaaatcctcttgccatcacagcggcggacatttcatccacaacaacggagcattgcatcaaaaaaggaaccatcatatactccaacatatggacaggtcgagtcaaaacattgcgccagttccatgccagccccctcaggcggagtgcctgatttaccatttgccattcctcctgaatcgtgggaacaaaacggaacattaccgccagtggtattacaacctcggacggcatgtgcattttggtaagtgcggatatatattctccaattttcgttgtctttgtaataagataaaaggacgcaaacagagggaggataaaacgcaaaacatggcagatagctgtcataatgttccttgataccccggttagatgcggcaccatatacaaatctgaaagcagcatggcaagaaaaagaacgcctgtataaaatgcccgtttccatttcctgcaaagaagcgtggtaaacacacataacgcaagcaacgatatttcctgtatgtacgacaagcctgaaaagacggagaagcaagctgtgacaaacaccgccagcttgctcctcggatctaatatgccagtcggattattccgctccatcacgcagtgattcccgctttctcaaaatgctttttcagaatgcgctttccaaggagacctcccagcagaccgccgatcagtgcaaaggcgatcagaaccgcaacaatccaatcaggtgtcagggcatccaatgctgcggcataatccgcgccataataggttgcacaattctccagaaacgcttcctttgctacaataattgcaaaaaacggtcccattgaagtcatattgaatacgacatagcttgcagccagcataccggcagatcttctctcttttctggatacgattacttccgcaaggattccccagataacggaaaacagcagcggataaaatgttgacatagaagtgattagtcccaccaacacagccaatatcaggattgcacctttcttgggaacctttgccgcatacagcatgtatactgtacccagaacgataccggcaatcaggggagttgctaaaaagagaaccggaacaatgggcagaaccatcgatgacaggacggtcagaaccacaagataaatggcgccgaaagcacctgcggcaattaaatcttttgtcgtaagttttgttttcatatagatacctaccttttcattattttggttagtttatgctaactcttatatattgtagcatttatcgatctttgcttctactctaaaaggccgacaaaacgcaaaaatgctccaaaaagccaaaaaagtgacgctatcaaaagacagcatcaccgaatctttcgttcctgttgattttactttggttataccgcagcacttgatttttgtgacttacgataggcattgggtttgcatcccatcacggcgtaaaaggcttctgaaaacttgcttggattctcatatcccatcatcaatgcaacctcactgattttatgatcggtctgacgcagtaactgcgcagcctgatgcatcttgtaattccgcaaatacgcataaggagattctccatacacctgccggaacccatcctttaactgcgtcaggcttaaatcatgttccaaagctaactccttcaaatttgttctctgcgtcatatcctgcagcaaatgctctttcacatgcttaatacgctccacagttgctcccgaaagatactcccggtattcttcaaaaactgattgttttgactgaaaatgataaagcagctccaatacctttaacctcaaaaatggtaacgatggatggggaagtgccaaatgtgcatataactcctgatatacatgctctatttccgcattacggcgatacacatggcattctgtattgagagaatacttttcaactattttctctgcactgatttgaaaagcctgtaattcgtgtccccttttcatgatttccggaaaaagcaaaatggtagagccgtaataatattttaaaggaaaagaagaagcaaccggcggatgcagttgactgttaatcgcaatatctccctctcctaaatagatatagctcttattatcgaaagcacactcatatctacccttttcgcaatgattgatttcaataacattttcttttccacttccacgaaaacagctttcgatagcaaaatcaaccaccattaactgtacgcccggaaaaatatcatatacccacatatcagcgggggcatcacccgcctgataatctacataagtaataaaaggttccttgcccggatttttcttatattgctttaaatattgaagttctgtcgtagctgatacacctccagatgacgcttttatatggttagcgttaactaatcatagtttacaatatggggacataaaagtcaatttgaacacagaaaagttccttatgaagaaggcaaaagaaaatttatctacactggaatcgacagttatttatttttctttgtggagaagatggctgtatgattattttcttaattcatcacttaacattgtggcaaagatttgcccatcctttatctttttctggcatttcggacaaatacctttaaataatatgtcatattctaaaaagtccgttccatgtgtatcatgaattttttctagcaggcccaatatttcatccatatccacatctgaaatctcaccgcagtttacacacctcacatggtaatggttctttaatgtaaggtcgaaccgattaggtccatccggaacttccacttttcttaaatcaccttcttctaccaatatgtcgagatttctatatacagtccctttgccgattgtaagacaggattcttttacaaatgcatatacttcatttgccgtaacatgtcttttcatttcacatacagcgtttcttacaagatctttttgaatggtatttcttctacttgtcatcagctctccttattaggactagttcttaataaggattatatatcacttttactctattatcaataataataattattattgtaaaagtggccagttctggaacctttaatctaaatcataattctatttcgcgttcaaaaacatattctgaatctgatgataaatcagacctaaaggaatatccaatcctgtcaaatttctgaatttccaccggattctcaatattattttctgccataaatctgaccatttctccacgagccatcttggcataggtaccttttgttacaaatttatctccggataactcacaaaatacaatcgtaatatatctgtcctgtggtgtcagatactttttcgtgtgcgccttgcggcgcacgtttctaatgggtgaaagtccctaatccaccctagtagtgggaaggatatagccaagaccaagggtgtcctattcatagagttgctatgattaacgtgaggggaatctgaaggaaggtggaggcaaatctctggtctgacgaacagaaatcacatcaggctacagttaaggataaggttgcacgacaaactaaagtccaataactactcggaattaacagtagtaaatgtggcagatatatggagagaaagaaacgtgtggtaccaagggaggtctcgtcagcggatgaaaacagagtatgaaatccgtcagtaacaacgaatggtgagaagtcagcagaagccatagtaaaccagtggttgcaaacactggcgaagggctgaactttaggagacacaagcaatgaatgtaactgaaagtagatttaagaacagacaacttcatatggaaggctatctgcaaatggtatctgcggaacagaaagagtatgcagaagtgttcgactactctaagattgctgaaaagagcggtgtcatcacagactattggacgaacaatcttttggatttgattttgcgaaaaggcaatctaaacaatgcctataaacaagtcaagaaaaacaaaggaaaaggtggaatcgatggtatgcaggtggatgaacttctgcccttccttagagaaaaccaagattccttaatccaagagataagggaaggaaagtataagcctaacccagttcgaagggtagaaatacccaaggaaacaaaaggcgaatttcgaaagttaggagttcctactgttgttgatagagttattcaacaggcaatagcacaggaattatcgctaatttatgaggagcaattctcagaaaatagtttcggtttcagaccaaagcgaggagcacacgatgctcttagacaatgccaaaagaacgtaaatgatggctatgtatatgtggtagatatggacttggaaaagttcttcgacacagtatgccagaataagctgatagaagtattgtcaagaaccatcaaagatggcagagttatatccttgatacacaaatatctgaatgcgggagtaatcgcaaaaggaatgtttgaacgtacagaggttggaatgccacaaggcggtccgcttagcccattgcttagtaatgtaatgctaaatgagttggataaggaactggagaatagaggacatagatttgtccgatacgcagacgattgtatgattttctgcaagagcagaaaaagcgcagaaagaaccttgaagaacatcattccatttattgaaaagaaactatttcttaaagtaaatcggaagaaaacagaggtggctcatatcagcacagtcaaatacctcggatatagcttttatagacataaaggtaaatgcagatttagagtacacccgaagtcagtagcaaagatgaagaatagaatcagagaacttactgacaggaacaaagggataagcaatgaagtgcgagaaaagaagtatcaagagtatgtgcgaggatgggtagaatattttagacttgcagacatgaagaaacttctccagaaaacggacgaatgggcaagacgcagaatcagagcgatctattggaaacagtggaagaaaatcaaaacaaagtgccgaatgctgaaagcactaggattagaggattggaaagccaaggaattagccaacagtagaaaaggctattggagaatggcgaaagtcttgaaccaaatcttttcgaataaaataatagccaagttaggatatacatccatgcttgactattatctagtagtctacgaaaactaaagaaccgccgtgtaccgaacggtacgcacggtggtgtgagaggtcggctaatcaactaatggttagcctgaacccgtgttaccgccgtgaaagggcgatgtcttaaccgcttgaccacggggcctcaacgatcactttctcgcgtgaccgttttatataatatcatatgtttttgtgaaatgcaagtgtttttacaaattttcttttatttttttcatcacaattcaagaatgtaacagttactcaccatttttcacttcgaacctgctgattcccatcatgcttactgttccatccgtgctgttcgtatcgatctcgcaactattataaaaacttccgtcttcataccagttatatacatttacaagctcggattctgtatgttgggatgcttctccatatgctgcctgaacgacatcaattgccgttcctaactggattcctcccgggaatattactgtcaagtcttcgtttctcagtgaatactgttccacatagattcctccgaccagacaatccttcgcttcttttacagcattccctgtattgatcagatccaccatgatcgtattcttggaagcatctttaaaccaggcattctgataatctcctgcttcaatctcatactcctgcggaaggcttttttcatccagcgtaagtccagtgctttccaggtctgcgattgtacacggaagcgtcagtcctttaccgttaatctgaacggtataagaattccagcttgctccaagttcttcactttgtggtgcggcaccttctatatccgactggattcccttagcggcttctgcttctgccgctgcttcctgattctcttcttccagcatttcatctgtattattctccgcttcgtcctcaccgttatccttcgcagattcctttacagcctttggcactttaatcttctttgtatcattataggacacaaatgtcacttccagtgtataggatgtcacctgtgcattctcttctcctgctgccttcaaataatctgtcagatcaaaggtaatctttgccggaagtatattacttctataaatatcaatcacacagtccacttttacgttgttcaatttctgctgaagctcctcgttgttttcctcatcctcggaagcctgtagattccagcctgacagatcagaggaatcttctccgagtaaagctttcagcgtatctgcaaatgtctcctggaactgtgttccactgatcgttcctgtcagctcaaagcactcttccttattcacggtcgcaagatcctgtgaaacgttgaatgctccggacagattctgaagtccatcgaacaataccgtctgctgtgaagatgtctctttctcctcaacagcgttcttctcccaggcttcatccgttccactgtagatcacagtcttcccgtcttcttccacctgataagattccatctcctgtgtctctttcgttccggccatattcgtcttctgctgaccttttctgtgtactgctgccggatcccgtgtcatctcgatatccagattgctctcctggctgattgcactgttgccattacccatctgcagttttacgatctgattctcttctgccgattctaccgatgtcatattaacctcaatatcgcggaacagattctccgatgtcgctgctttctgacagccactcagacttccaactgccgcaagaaatataattcctgctgttaacttctttatccatttacatttcatagtttgtctttcacttcccaagtcgtatattcaagaatgcctcgacattcttgctactatctcttatcgtaaccagctttgcacttcattatacaaaattattttctcaaaaacaatgcttacttcctgcctgtgacatctcactactgaacaatagttactgttcacataccactatcccgcgaggtgttttggcatgaatatgccaaaatcccgagacatacaagcccaaattccattgccgcaggcaatttggaatgaattttggctacgttactgtgaacggagtgaacagtaacgaacaataacccgagcattcccctatcgtcttctattttcctactatttttatatgtttatttggtttttctattgactttctcattgaaatgctttatcatacttttcatacctgtttaatatgttattttgtttgagtgaggaatttgcttatgaatatcttatgctttggagattcgaatacttacggataccgcccggatggaaccggacgctttgatgaaaaaacaagatggacctgcctgcttcagaagaaattcggcaacggacatcgcattatcgaagaaggattgtgcggccgcacaactattttttcggacgcttttcgcgaaggccgccgcggattagaccagattggaatcacaatagagactcacaatcctatagatcttctggttctcatgttaggaacaaatgactgtaaaacgcgctttaacgcttcttccaaaacgattgccaaaggattgattcaggttattgaaaaagcgaagaaatatagtcctcagccctttgaactcttgatcatctctccgatccatcttggcaatggagtcggagatgacggctttgatcctgaattcgatcttgcgtctgaacaggtttccagacagcttgcacaggaatatcggaaagttgccactcattatcacgccggttttctggacgcttcaaaaatcgctcttccaagtgaaattgaccgggaacatctggatgaatccggtcatgcagcacttgcggatgctgtttataaaacaattactgaaagtggattgcttgaaaaagggatggactcttctttctgtcatattgcataatattcttccctaatgctcttaccaactatgagaaacacgctccgcgagtttctcaagttatcgcggcagtcgccaaacatgcatcctccgtgtcaatcagcggagtgattgacacgggagtgaacagtaacgtatatttacacccgacaataaatttcttttattatagcctcttttactcagggaaaaaagtccctttcatcagaaaaacagaaaaatactgtgagtataacatcacagtatccccattgatcgtatatttaattgttatggtttccccatcaacgcgtatattatatctgatttatagggaaaagtaaagggggatttttgagcagtatttacataaaatgtaaatcagggattgccgtctgacaatccctttcacaaaataaacacttcatcttcattcaaattctgggttgatcgcatagaaattcttactgtcaagatgttcctgtacaattcttagactttcaccaaatctctgataatgcacaatctctctttctctcagaaaacggatcggatcacagatttcaggatctttaatcagccgcaggatattatcatacgtagtccgtgctttttgctctgctgcaagatcttcatgaagatctgtaatcggatctcccttcgattgaaaatacgttgcagtccacggagctccactggctgcctgtggccataatgccagtgtatgatcaacataatacggtgcaaaaccggaacgttcaatttcttccggtgacaaattctttgtcagctgatagataattgcacagatcatctccatatgggcaagttcttctgtaccaatatcagtcagtattcctgttacctctttatatggcatcgtatatcgctgtgaaagataacgcatagatgcagctaattcgccatccggaccaccgaactgacttataataatcttcgccagtttcggattcgtctgggttatcttcacaggatattgaagtcttttttcataattccacataaatcagcatcccccttcctgccacggccatggttcattgatccaattccagcagtcactgttttcgctgactgtatctacagttaaaggtccatatacctctgcatattctttgagtgcttcaatacgtttctctttatatttttgaaaatattcaagtgctttctgatttccaggatgtgtatctaaaaataatttaacatcatccaccgcgaaactaatctgatttatatattcaaaaagttctcttcgattcatttcatgacaattgcaactcatttacagcatcctccttttccacgaaatggtttttcaagctcttgaaaaatagttccacactgaaatccataaccgagatcgtgaagttttctccactgctgccatgggacataagccatcgcaaccggaaactcttgcaaaacatccgttttgctgtaatcaccaacacactcatcgcaacagtaatttttcgacttctgctccggaagtggaggaacaggaatattgcaatgaagctgtctttcattttcctgccttgtttgtggcctgtaatttccattctgacaataacagttcgtattcctattagaacaatatggtgccataaaataaatccttatatcttttttgttattgtatggaagataagaaaaattgtgaacaacagcaaaagggattgccacgtgacaatccctaagcataatacattcacttaaaagtagtatttatttcgcacctaaagtaacttccactgtcttctcttcatattctccattactctgtggaatctgaattgtcagtgacaccttatctcctttggcataatattgaagctgttcctgaagatcatccatgcttgatacggttgttccgtcaattgctgtgataacacttccttttgccattccggctgcctctgctccaccgccttttgtaatttctgatacataaacgccttccggcatattcagctgtttggaatattcagccggcacgctcattcctttgatgccaattgcgccctgatctttttctgcaacctttgtctttgtcgcctgattcatcagattctggatcagatcggatacatcactgattggaattgcatatccgacaccttctacagaatcaccaaccagcttggatgagttaattccaatcacttcgccacttgcatttacaagtgctccaccactgtttccaggattaatggctgcatctgtctgaatcagtttggcatcactctctgttgtctcaccggtctgctcgtttgtttcagaaacagaacgattcaaagcactgattacaccagttgttactgactgtccatagccaagtgcattaccgattgcaatcgcaggttctccaacctttagctgtgtggaatctccgagtgttgctaccgaaattgctttcatcgtatcatctgaaatagaatcaagcggaacagccacaacagcaatatcatactctgagtttgttcctttgatatttgcctcaacacttgttccatcatcaaacgtaactgttaatgtatcgcttcctgctactacatgattatttgtaacaaccagaagttctgaatcattctgggaaataatgattcctgttccagcactttcgctctgttgctgtgacacaccaccaaagaaatcctgaacctgctgcacactcatatttgtaattgatacgattgatggcattacattttccacaatacttgaaacatctgaagttacaacactggaagatttggataatgaagcattgctgctcacagatttggttgccgtagtattagtcttcgtcacaccggtcaatcccagcactttacttccaacaacatttgatgccagaaatgtaccactggaaacaactccaaacaatagtgcaaatcctgtcactgccactgctttgggaattttcttttgtggtttcttaccatgcggtacttgatgtttctgaccaccattgtcatcatgaaatggtgtttcactctgtccgtttccattcattccatccgaattataataattatattgattctccataaagattacctcttctcttgtttattctttttctttgatgtttacatagtaactccgtattgtgataaatctgtgtataatcaattaataaagattgaaaagaatgatagaaaaacaggatcagaacttccttcttaatccgttctaatcctgtctatattttttcaaccagctaaccagtatctttcatctgactctcaaacttacagatcaatgaaatctacatcataatcatctgattttcttcctttttttgattttttagctgatcttcctaaatttcttgtattttctgtcggtgcatcatattcatcgtcataatcatcatcgtaatcatcatcaaaatcataatcagcatactcatcatcaaaggcatcgtaatcatcattaaaatcatcatcataaccatcgtcataatcatcatcttttacttttttacgtccaaacgcctttctgtctgacttcttagcagcaaccggctcgtcatcttcttcatcttcatcttcaaaaggaatatcatactcgtcatataaatcatcaagttcctgatttctatgcacaagttttactgcaaacataatcataagaacaagtaatacaactacgatgagtgctcctccagccagaagaacaattggatgctcttttacaagcgactccagttttccaacaatcccttttgcttccttctttgtactgtctgttgtctgaacatctacactctgataagttccatcctgtgaatcatactgatagaaccctttttcaccggttcttgtattcaccgcatacaggagatcataacgatcattctccgggtttgcccaatatggatacgtctgatctgctactgtaagttccccttcctggtaagaattcggaagttttgctcctccattatctgttaaaagaataatagatgttgtgtcagaaatcttcaattctgtatatggaacgaatgttgaatcatcttcattgtacaggaagaactttccttctcctgaagcatctaccagatatccaagtgtaacaccagcctcattagcaacaaacttgtgttcttcaccattgaatgtctttgtagtctcactgtatcctaccgggattgcagatgttgcaaatccttctgagaaattgtaatctgttccgttcacacttactgtgatatctgtggctgtaccagttgttgctgtactgccggtttcctcaacttctgttgaaccatcatctgcctgttcaatcttaattgcggaagatccctgatctaatgtcagcgtctcatcagaatacagataagcctttgagctgtcaactgtgatcgttgtgtctcccatcttcaaggctttaaacttcattgtagtacgaagctctgtcgctgttccgtctccgcttcctgagtatgtaagcttgccatcactgtctgctgttacaccctctccgctttcaaactgaagtgcagaagtatcataactcattgtaatatctgcatcaccaacagctgaatcaccggatctcacaacaagatctacacttacttcctctccaacctttgtctgtggatcagagaacatcagagaaccatcagctgcacttacgattgtgctgaacattggcactgtaagacacagtgataatgctactgccgctaatttctttgctttcatataattaccccttcttttgttgtcttaaacttatataccatcctattgtacactgtttgaatggagttgtccacccggaagcgaaagaaatcttgtatgaatcattatttacagatttccttttttccttgaagctattccaatatactatccgaaaatccactttctgaacatttcgcagattatcttaaacgatttcaaaaaataatatgtataatggttcacaaatagcatatacggtttttcaaccaatttttttcgaattaaatcaatcatagtacaagaaacatataaaataaacacaaccaaaattgaatataatatcagaaaagtactatcctgatattgattgattttaaagatattcgtccataaataataacgaatataagaactgtcatgaattaggtataccccaaatgttgctgatgcaatcatattaatccatttatgatagttcattttcaatgttacaaatcccataaaaagtgtaatcgccatcaacaaaattggaagtctctctatttcaaaaaaatcaattgcatgtgttgaccactcctctttttttgttccaagaaaaagaaacgtcgtacttactgtatatgttataattaacaccataaaataaagagaaaaataatgtttcgattgaagtttctgattacctccatacaaatttacatatcctgcaattccatataatgttacaaaccacaataatgaattactctcaaataactgagttgtagccgtaggtatgattgaccagcacaaaaccatcatcaagatcaagtactgatattctgtcttactcaacccatgcaacagtttatttaaaaacggatgtattaaatataacataaaatatgtacttgcaaaccaccaacccggatacgtgataggaagacaaactttaatcaattgctttatctcaaaagcattcaatcgtaacattaccgataaaagatatgtcataattgaataaaaaacaacctgtccccaaaatttcaaaagttttttaggctgaaataacttttctgtattttcaatcagaaaatatccagaaatcaatacgaaaatatctacaccaactttcccacccatgagaataaaatcataccaaagatgtggaagtgtaacctcattaaaattccattcaaaatttccatgataagcaaaatggtgaaacatgatcataatcatagagatgattcgaagtaactcaattgaagtattacggttaattatctttgtggattgaacacttttttccatattttcacttcactccttccattcatatctataactaatatatttatctcattttcactttgttcttaaaatccccttcaccctaagtacaagttctttgaactcatccggttcaaccacataatttaccccaacaatagtaaatacgcttacagccaccattccgattgcatagagaaaccatgtgataaaagatgccatgttcttaggaataacatatgttccaacaatacaaagaagtgcaacgacaagtacatttctaaaaattcggaacatagatttttttgcacatccttttaccagatgccgacttgtatagaacacaatttcaaaagagcgatatccataagaacatactgtaccaagaagaactcctgccatgccgaacttccataccagcccaagagaaaccgtgatatttatcactgcttctaaaatcgcctgatatctcgtttctttataatgccctgctgcgcagataatcgtcaatcctggaatccttacattttgcataaaaacaattactgtaaataaaattccaagaaccggacgcacatactgtacatccgtcaggttaatggtatataccccgacaaaaggcaagattaagactcccatacaggcaatcacaataaacatgattacaaaatacatatactcataactagaatagctcttctttaatgtctcttcctcattcttggcgatcacttctccaaatcctgctgtcagaccattcgaaaaagaggtcatcagctgattcactgcattaaccaccatcatataaattccatacacactgacttcaagaagagattttgcccccagacaaattgtcaacactgttgtatctgtattatttacaataataccaacaacctgatgaagcagtgccgcgtttttttgctttaacgcaccttcattcggttctgcatggaaatctaatgcaggatattttcgttttgcatagattttaaccaatacaagacgaagcatatacacaccagttgcaactgcctttacaaaaagaacacctgctccaatataaatcagaaaaatagaaacaaccatattaacgatcgttcctgctgcctgaatcagtgcaaccacatatccttcctgatttgcagtcaataaaactctgtatttacccagaaaaaaataatccactaaagtacttcctgccaaaacaagtatcatccaacgcacaagactattttcaagctgtcctgaaataaaaaacggatagacacctacaagtaccagtgtcaatgccagaaataacattccggatttgttataaaattttcttgacgccgaaagaattgaatttacttcttccgtctgattcaatgcaagaggtgtatagagagcaacaactgttgccgttcctactcctgcttctgccaggcccagatatgttaaaaactgatttactgaagtgatcattccattcacactcgatccatatgcctcaagaataaaacgtggcaatatcaatccagacaaaagaacaattacctgtaaaagcagacttgccaccatgttttttaatgcctgttttcctctcatgagatttcctttcctctactttttcttttcctcactcatgaataccatcttcctgtacaagcccgtatttacgcacaatacaacagatgaaatctttctctttggctgaaaatatggatttcgcaggattgtcaggatatgcccgcgaataaagcgtttcaaatcctgatatccttctaacttcttataatcctcctgtaatagcatcttatccagaacaataaagcgagaccagatccagaggcactctgcctcctgtgttagtgatggaaatttttctttcactacttcataattctttgtatatccatctattatgtcaaatactttcggacggtatgcctttccggtaatactgtcttctcgatgaagataataatacttcggctttgttcctactgccactttcttaattcgctgcatgaggtctacagtataataaatatcttcatacagtctccccttcggaaagcgaagatcttcaatacagcttttccggatcagcttattccatatttctccacggatcgtatgccccctgaggatacagcgaaaagcctcttctcctgtgcagacaaaatccacctcttccttttgtgtctcgattctgtctttatacacttcatataagccacatgttgccatatctgctccgctatctttgatacgtgtatacatatattcaaacatatcattttcaatatagtcatcactgtctaaaaaaatgatatattctccttttgcatagggaattccagcatttctggcatcactaagtccaccattttccttatgtatcacttccactcgattgtcctgttttgcatattcatcacatatttttccacactggtcgggactcccatcgtctaccagaatcacctgaatatcagaaaatgtctgtcccaaaatggaatccacacactttcttatatatggttcaactttataaaccggtacgatcacactgattgtcggcatgatatctcctccattttattcatagtatgaaagcagagtctgcgcagcgctttcaatatcatatcctgcttttgcaaatgcctgcctgattcctgaattttcttcttcgctcctattttcacctttgtaagaaagaatcacacggctccattcctttggtgaatcctgaagtgacagaaatttcactttttcaactaacttcacttctgttgtaatcgtatctgccattacactcctgattccggatgcctgcgcttccaacgcaacaataggaagtccctcaaaaagagatgggaatacaaaaatgtccattcctttccataattttgcaacatcttttctgatccctaaaaatctgatcctatcttctattccgtattcctcagctttcttttggatcatttcctgaagttctccttctccaactaacaaaagtatagcttcttcacaggcagatgcaacctcacgaaagatttctaagagaaatttatgattcttctgttcttcaaaacgtcccacatgtccgagcacaaattttccctctactccgagttcatggcggatctcttcacgttctgacaaactgaaagcaaattttttcagatcaagagcattgtggataagatgataattgttactctttctgatcttttttgaaaagagccattctccagccaattcactgcatgcaaaatactttgtagcaaacattggaatcaacggtcggttaattctgtgcaacaaatttctcaccactcccggagtcgaagaattatgtgagtgtgcaatcactgttggaacctttccatagcttgccacaatcagcggtactatattcgctgctgacagcatatttacatgaactgcatcatatcttccgattcgaagtatctttctcatttgtctgctgaatttcaatggatgttttcttgcatcacacgtatgaaacacttttcctccaagcgatttgatttcttcttcatacgcaaggtgaggaaacatacttataaaatcaaatcttactccttgcttactcaattccctataataggtcatcacaaaactttcaatacctccgggattaaaggataatccaacttgtaatactttcatttactttccaattacttcctttccattgtcagttcatctatcagattcgtccactgtcgataaatctcttctttttcaaatttttttacacccgatatcgtatgatttgaaaacgcaattcttcgttcttcactatccatcaacaattctatacgatttgccatcttgtccaaatcataaggggggattaaatagccatcctttccctcctcaacgatttctcttggccctgttgtcacatcaaaactcaccataggaagtccacttgcctttgcctcaagcaatactaacggcaatccttccctgtaagatggtaataccaaaaatgcatattcattatacaacttatacacatcttttacattccctttctgaatcaattgagacgttaaattgtattctaccaccttttggtgtatctcgtcaaaagtatctcccgtcccgtataaatgccattcccactcaggatgagaaggcaatacttttttcgccacttctaccagaagatcatatcccttttcttcactgaatcttccaactgtgatgatttttctcgaatccgctttgtatttctttcgcatagtcaggatttctggtttgatccaattatatatacttcggattttctttggatttatatgaaattttctaatataatcctgtctgttctgctccgtcaatgtcactgtacaatgtgaaattaacgaatcccagaaacggaaaaagcggatatctttcttctcccattcattcatcaatgcaccatgatcgcaaaacacatactttgctttcgtaaaaaaacgaaccggtgaaaccgtcatagcaggataattctccataaggaaaactacatctatttgattttgtctaacaaattctctaaatggttgaaatgtcttcttaattctgtcgcgtactcgacactcttcttctagttctgctctgtatgtgattctcggatccaggtcatatggaacatgccctccttttccaaaaattgcataaatatatacttcatattctttacaaaactcattggcaagagttgttgtgacttgctcaactcctcctgttactgtcatatcataattaacaaaacatatttttttcattctgaatattctccatctgcatagtgaacaatgaatatcgttttactaagaaggcgcctattgaacttacaatagacgcccaaactattatttctttaatatgtttgcagattcttcaccattttttcaatatcaataccatatccttcacttgtagcccagccatatccatttggattttctttctgaccaagccattccacataaggagcgcttcctcttgtaaccaatgaaaatcttggatctacgcattcattctttaatgcatctttggatccatatgctttcaaatgctgaatctgagctcgtattccttcacgtactgtagtaaatgatgctccggcaacgccgccaccagttgttccaagtcctgcaaaattattctgttcaatcttaacatcaccaccaaatttaagccatgcagtctctttcattgcctgtgtaaatgcaattgccccattgattccttccgcattcgcttcttcaacgtaaatctgacagaacttttcaagtgttggcgcatccgtctcagcgtaatatgccggatatgttgcacccttagccttaaaatatttttccatctgggatgcagtcacagtagtctttccagaaatagccatcaactgatctgtagtacaagaatcatccaatgttccattggttcggaaataataccatgtattggatataaattgccatcctgtctgcatcactccgtttttatccaaataatatcttgtttttccaaaagaaatccaaccggtcatcatgtagccttccggcataaagaaatatttctttccgtcaattgtctgccagcctgtctgcataattccatccgtattaaaataatatttctttccactgattgtctgccagcctcgtaccatttttccgtctgatgcaagataatactttgtacttccaaagctgcaccatcctgtcagcatatgtccatccggcatcagataatatctcgtctgaccaaaagaaatccaaccggtcatcatataaccttccggcataaagaaatatttctttccattaattgtctgccagcctgtccgcatcactccatctgtgccaagataatatttcgtgcttccaaaagaaatccaaccggtcatcatgtaaccttccggcataaagaaatatttctttccatcgatcgtctgccagcctgttactgctactccatttttattgtaataatatttttttccatttactgttttccaaccacgtttactctctacaatcagcttaccgtcagaagcaaacgtatacgttgtcccgtcaatcacctgttttccggtcaccatcacaccattagaatccagataatatcttgtctgaccaaaagaaatccagccgcgcatcatatagccttccggcataaagaaatatctctttccatcgattgtctgccagcctgtctgcattactccgtttttatccagataatatcttgtacttccaaaagaaatccagccggtcatcatataaccttccggcatgaagaagtatttctttccattgattgtctgccagcctgtctgcatcactccatcatcattaaaataatatcgttttccatcaattgtctgccaacctcgtaccatctttccatctgatgcaagataatactttgtacttccaaagctacaccagcctgtcagcatatgtccatcgggcatcagataatatcttgtacttccaaaagaaatccaaccggtcatcatataaccttctggcatgaagaagtatttttttccaccaattgtctgccagcctgtcacccgatatccatttgcgtcaaaataatatctctttccatcaatgtctttccaggaattagttacatattttccgccttctttatatttccatccattggaatcctctacccaagttcctttttccttagatacccctaaatactttgctataccagtagcatccgcaacaccgagtttttttaacccggcttcattattcagatatgtatttacatcgcctgtattcgttacaaatgcatgttctactataattccaggaatattattttctttcgctgcaatctgaaccgaaaaataatctgattttgatccatctggatatttttcatctgccagtgttgtatctttactataaatagatcttttctgcaaaccaatcgcagtcagctcatccataatgtcattcgccagctcttttccctgctgtgcaacttctggtttccaactatcatttggtacaattacttctgcaccttttgctgaagtcgatgtagaagaattcaaatgaaagctaacaaatatacttgcccctgcttttgcagccgcatatactctgtcactgatatccccaccactgttcttattgcttggatatgggcatgctgctgtcgttcgtgtcatgtaaaccgacacattcgcatacttttccaattcttccttacaatattgtgcaatctttaaagttaaaacttcctcccttacaccattcgctcctgctcctgtgtgtgttgaatcatgtcccggatctagagcaaccacaacattctcattgacagctctcgaatcatctacagctcttgcattatcctctgcataagtctgaatatcttcatccgaatcatattcttcaacttccgctttctccaatgcatcttctatactggactcctccatcacatttccatcttcatcaatactcataacagcaacatcatactgctcctcatcagttgcggcttctgcatccggttgtccttcaatcggctgtaattctgacattccttcatatgtttcattaacaccaaattttgcttccattccaagatccgacagcaaataacttgtttccatctctgctgtctttactgtcaatttggttattgtataaattccatcctctccatctgcatatgccttctcatatagaaagacaccgtcttctgattttacagaagtccatgtttgtgtatccccattatgttctacacttaaatcaatctcttcaatattttctgttccatccccccaggaaacaacaattctctgtgttgccggagtttctacgtacggactttctatgtacaaataattcaggtgctgctctattgcattctgaacttgattttcttctatctgctcactgtctgatggctgattttcaactgtttctatatttgtatccacttttgtgtccgctgcataaaccggtactgatgtaaccacagttgctgctgctaatattgcgaccagacaagttcttatttttgatatcattttttcctcctacttattttctatgtttatcaattgctcttatttccatcagaagtgattcatgtatccatctaactctgtatcacctgtatctaatgcctgtccattctctgttaatttaagtttctcacagttatatgtatccaaataggagttcacaatacatgtaagtatttcatctttccctgtggtccccatacttctgatacgttcaccaacttctgtattcatatccagatctattgttttattattctcgtcaattttacaactgttcaatttacaaccttctgtcagaatacctttttctattaattgattccaaactgttgtatcatctatgttttctgtcttcatctcttccgaaacgatttcagcattttcattcacatagtaaattttcaacgtcttcatctcttgcttttcttctgaaatattgcttttttcttcctcctgtttttgattatttttttcagaatctatcgtttcacttgtatccttattgcctgaatcctctactgtagtattttgttctgtatccacattgtttttctcacatcccactgaaaaaagcaccatacttgtcaacattacaactactaatagctttttcatataccttaacctcctctggcttattgctccccacagatttctctatgataataacacaaaaatgcgtttaaaaaaagactgattttccaatcagtctttttctataacatggtattttaaattatttgtaatatgaacttggaagctgttctgtttttactgtttttccgtttttaacataatctctataagcaaccgctgatttgcttcctgtactccatgatcgtacattaacataatcataccagtctggttggattccccaaacttcagcatacaatgtttttccactgacatatgtcaccagtttcaccggataatcatagtcatttctgaatttcaaatctgatgatccataatctaccattgcatcctgaccgatcggcacatatgtagatggaacagaatggtttcttctctgaacaattgtaagtccggctcttattgctgctccgtaaagcgttgtactcgcctgacagatacctccgccatatccaacaccacctacaactcctgcctgcttatatccctctgcttttccacatggccctgccacgccaaaaaatgaaagggtctgtcccggctgaatgacaacctgattaaagctctttaatgctctactcatattatatgttccattttcattatttgtagacactgtagagaatactgacattctatccacataggttggagatgttatccttaagctcaatgttaaaatctgactttctgaatccagtatatctacataatatgtatgtgctccatttcctgagaacgtaaattcacatgactttttagtagaataattttgtaaaactttgttatttccaccatatacttctctgaaacgatatttgtgaacattatcataacctccactggaagttgcagtcaactgtattttttgtccgttttttgctataccatttgtattacttacaaaggaacctcttaactgattatccggatgtaccactacctgcattgtgtacgttgcacgtaccacctggccttcatcatcttttacatccacatagaaaatatgtgttccaatccccgtcgttgtaaaagaatatgtgtttttataactataactctgtcttacctttgtagttgctccatatacttcagtaaactgatactgacgttttccgtatccacccactccactgccagttaatgtaacagttctttttgcatattctctcgttgtcttattgcttctgagacctgcttttattactttatctggatgtactacaacagtcatggaatatttgagttttgtactctgattctctttatcctttatatatacataataagtatgcgttcctggccctgttgtcttaaatgaatacgtcttcttttcactatacttctgaacgacagttacttttccattataagattctacaaactgatatttaagtgaaccataaccaccttttgcatttgctgttaagcagatatttctatcgatatattcttttgtcgtcttgttacttgtcacactacctgtcaacacattatccgggtgagcaacaatatccatctcataagatgctctagatttctgtccctgttcatcaatcatgtcaacataaaacacatgatgtcccgttcctgaagttttaaaagtatacgtgtttttctcactataagcctgtcttactgccgttgttgatccatatgtctcagaaaactgatatttgatctttccatagccgcccttggctgctgctgtcagaacaactgttctttgtatatattctcgatttgtcttattcgaactaagctctgctatcaatttcttttgcggatgcagtacaactgtcatcgtataggataactgtatttcctgtccctctgcatctttaatgtaaacataatatgtatgttcgccacattcctttgttataaatgaataggtatttgtgtcaccataatcctgtaatgctgtttctacaccgtctttcttctcagtaaacctgtactgataattcccatatccatttgttgcttctgcagttaacgttatctttctgtctacatattctttttgtgttttattactggttaattttcctgaaagaactttcgatggatgtgcaaccacctcaatcttatactctgctgaccctatattgccattttcatcttttacatttactcgatatacatgttcaccaacgccagatgtcttaaatgaatagactggattttctgcgtattcctgaacaacagctgtttcccctctatattcttctgtatactggtattcaacatttccgaccgcatcctcgacatttgttgtcaattctacggttctgtccacatattctcttgctgttttattactgacaattgtagtttttaattctgtcaccacttctgttgatggtaattcttccgttgttgtatcttctgccgctctttcttccggttctgtttcgattggcgatgcttctgaattattttcatcttctgtctcttgaatcagttctgtattttcaccatcatctttctgtgtgccttgatcatccaaaaccgtttctgcctgttccacctgttctgctgacacttttaacggtattccagaaaaatctgccataaatattcccgcacataacatcaaagccatccattttcttcgcttcataccttttcctcccctgcaaataattatagagctttttttcttttcaaccggtcaaatagctttgtcttataccaaaacaacgttccaccatagcatacagcaatgcaaagccaaaattgaatatacacaataaatgttaaccatccagttgcttccgctcgtggaataaagaaaatattttgcaatgagacaagaataattgtactaagcaacgctctttttccaaaaccatataccatatatagtaaaataattcctaaaataatgctgaatataaaagctccaacatatccaaaatcgaaccatgtctccaccaaataattggatcctcgtccacgaccattcaaataatcttctttcatgctcaaataagaaagaatgtgagaaagattattgctatgaagggcattaaattcactatttgccgacgtcaagccttctgtatgaaaaattttctgtcctatacttcctctataaatatagtctataatatctccaaatgtaaaattcaaatgaggtgatagtctgattccttctcgatatccatatgctattgctgtaacgttaaaggtgactccctgaccatagaaaaaatcggcaattaatgttaaaaagtttccggttacaatctttaagccactacgtatatatgcgtatactcccataaaaataattaaagctggtgtacatatagcaaggagtcccttttcaatttttccgatccatttcttatcatctactaaataatctcgcagtaaataataagataatacaaacaagagacttaacattgccggattccgtactcctatcagcaaacttggaatcgtggaaagaacgtataagctcaatggaataaacgtttttttcttttctggtagtgtagcaagaaatacacatatactataacgtgcaaaagaggccaatgtatgaaagaaacctggcagactactggaataatttgtgtaataatccaagtaatttccagttcctattttaatcaaaggttcaaattgctcaataagataaaacaacattgttacataaaacacaatcattgaaacctttctgagattactgacaaattctgctttacaaaatatgttatctgaagaacgtgtattgttttctctgatttttatatgaaaaaactttataatgttagcaccaatataaagcgcagtctctgtaataacaatcaaagttaatgcaaaccaaatattttcctctttctgaaaactttcttcccaccattttctgcctttgcacattcctataaaaggtctgctgatttgaaatgtaaaaagtgtaagctgcatgaaaaaatataaaaaattttctttaaagttttttatactgaacaggatattcatacagaataatatcatgattgccactaatcccaggttaaagagatttcccactcttgataccaaaaataacacagatcctattacaaatagtaaaatttcacctataaatataatctgctctttctgtttccatgatatcttctctttactcatttttatccctcttaatcttccttacccaaaatggcatttctataattccaattaaggttcctactccatatgctagatgcagtgatagaaatattaatggcaacagcaaataataattgtaccacttttgcctttgaacagctaacactgacattaacaaatcgacaatcacatatagtatgcataagcaaacaagcattcctgtgtttcccaacaatgctataattcctgttaaaatcagtgcaaacacaaatgccaaaggaacaaaatgatgaatagaaaagcatcccggacaaactccaagcgtcaagccaatccaatgcccatttccatatttttgttttaacattccacaccatgaatttctaatattctgataagatataatatctggattaaaacaaattttatatcctgcttttcgaatacgataatgcatttcattatcttctgttcgtcctaaattttcattaaaaagccctgctttttcaaatacctctttgcgatatgctccatgaaaaacagacttcacatacgttttgtgatttcctttacgataaggtgcaatactacttccaaacatagaagattctgccaacaacaatgtatgtttccaaggggtttcttcttctacgacgttcggtcttctacctcctgtcacattctctccactcaatatacattgaacatttttagatacaaaatcgtgcgggatcattgtatgtgcatcaattcttaaaataatatcgccctttgatgctgtaattgctacattccatcctgctgcctgaattttcttcgcattatccaaaacaacaactcttctaaagccatgatcctcttctgaaaaatgttccattttccttctcgtttgatctgttgacattgcatttacaagaatcacctctatatctccatgtggataatcttgtgcaataatatctttgaacaacgaatcaagtgctttttcttcattatatgcaatcacgcaaaaagaaactaacatgttctctccccttgttatataaaatctgttatttaatcatataaacactttttccgataatatatccagtataccactcctgatactacatatacaaatcctgttgcaattccagctccccagattccaaattgactgattgcaaaataagtaatgattaaatgtaatccacaagaaattgctgccattattgcattgaattttgcaactcctattgccggcagaaaattcattggaaccattctgattcctgcattcaacgcatatactatccaaaaaacagttgataaagcagttgcatcttcataacgacttccgtacacaattcttatgatatacggactaagcactgctcctgcaacagttatgataccaataactcctgctgtcatcataccaactttctttgaaatattccacacttcttttccatctgatgcttttgcaataatagtaaaataataaataataattgattgagtcacgaatgacaactgaccgggaatcataatagcaattttataatttgctgttattgtttcattcctcagtaattcattaacaagtgtcatctcgttgattggcataatcagtgaaaacagattagaaagcattaatgagatagacattaccataaatgcctttatctgttccggactcagcttcgccgctttctctttagaaatatttctctttagtgctgcccatacagatatgattgcaactatgatcgccacgtatctggcaaatgcaattcctttgataccaatcaataaaacaaaacatacactacatccaaatacaactgttgtctgaaccacagcggcacgtgcatacgcctcattctcgctatgtgctctcaaataactaagtactgtagccaatatattattaaaaacaggataaagcaccagtacatatacaacgctacgcgcattagggaacggaatcgaagttaaagctacataaagtactacaatcaaagataagatagcttcaaatagagttccatatttcattgcaaattcaaaatatgctctatcttcctgttcagtatctgccgccgcacaatatttaagaatcgacgatgtcattccgagaccggcaaatgaaactacatagttatataaattatcagcatacgttaaataagcataatctgtcttgtcaactaaacgtacaattacaatacttgaaacaaaagcaatcattttcacaagtgtattacctacaaaaatgtgaaaaaagcctccttttatcaaaccatttaacttactttttattttttctcccataaacgaactggcctttcaccttttctgatattcctgtgatatacctttgtatctttccttctctttcaaagaagtaataaattgcaagtaaaaacagtacagttagtataagatcaaagctatatacaaaatcacaaaatccaccttccaacgctgttcctaatttaattgttaaaacagctccaagtgccaatgtagaaggtgtttttttaagtttcataattaacaaaactacgagactcaaaataagagcaacccaaatcaccgcaaaaatcacacctttatatccccaatttgcatatgcttcacctgcaaaaagagcattcattactccggccgagccatcatacactttttccgatccataaaatgccattgtcagttttgcgcttctcaaataatcactgctattcatcccgattaatcttaaaattgtcggagtaaagctccggcctccaagaaaaccaaacactgttgggaacaaatcaaaacaatatgccagggttcccacctgtgtaaacaaagttcttccaagcggtccattataaatatcaaaaagcgatccagaaaaacctgtatgaaaataaaatgctactataattactgccataaatgcaacagatataatcatataaatcttcttaatgccacccttataataaattaacataattataaaggctgcaaaataaaaaacaaccgatgatttttcaaatttatatgtctttataataacagaagaaataaatagagcaattgtgataattgtccattttattttctttgttttcagcatgtatgcaaatgccacataagaaagcagcggtaccatcatcagaacaaaaatgttgcttaaatatggatgtataaaataaagtcctcctattctggttctctctgtcgcaaaatcaaaatccgctgacgcatgaatcaatttcaaaagcggaatatatccaatcttcgccaaaagacctatcaacaagacgatacacccaattgaaagcaatgcaaaataaggaaaaatcaaatcttctttttcacattctatttctttctttaagtactcctgatactgtttcttcatgttgactctgaacattttctcccaaagcaaaataaatgccggtaaaaaaattgcaattccaaaaacaactacttctgtaatcatacagcttttatcacgatttaacagatatcccagtgtatagtgtttgtcaaatcctaataaaattaaagccgttcctgcaaatgtctgtaacatgaaaatatagtatatatatgatataacatttaccttaccaggattcaacgttcctgctgctttactgaacaaaatcgttgaaatcccaaaaatcaccaatataagtaatatctccaaaatataaccctcaatcatttaaattgtactgtttatccaataaatactgctttgttttttcatcaccattcttaaaattacctatcataaaatcaatctgtgatctgtcaaaatcattatccagataaattgtattaaaattatgaagattttccaacacgctaatatccgttatcttcgttcctttcatgcttagaaactcgagatccggacactgctcaattccatttaacccggaatactcattatatgaaatatttaatctttttatattcggacaactttttaaaacatcaaaatcttccagatgattagaataaatatcgagttcttctaactgttcaagatttcccaaatatcctaattcagaaaatgcattgttccccaaatctaacagaattaaatttgtcaagccttctaactccggtgtttcagaaagcatatttgatgatgcgtacaggaaatttaactgttcaatttttgctaattgatttatattcacaagtcggttctttgaaagatcaagaaatgtcaggctcttcatcttttcgattccttcttgaatatttccgatattattttgctggataaccagtttttgtattttttccaatccgtaaattggtgaaatatctgatatctgattatttgttaatgtcaattcagttaatgaataacattttgataacgctgttatatcctttatttcatttccagataaatcaagcacctggagttcatttaacccttctattgccgaaatatcattcaacttacaatttttgattgtaagctgagtaagtttcttacacttagccagatctgcaatttctgtaatttcctgattatcttctatatctattgtccgcagactgtctaaatcctcttgcgttattttatctttttttaaaatctgttgtagttctttttctatatatttattattaaatactatatactcatcttcttttgcagtgttatggcggaatgataatcccaccataactcctgccacaagaagagctgtaattaacacagaccatattatgatcaatattggatgtcttcgttcgtattcttttagtttagtcataaatattccacaaaattgtctcataatatcttcctttcaatctgttacaagactagttcaaaaaatctttcacgcaattacatactttctctaaatcttccgcattcatatacggatgcattggcaatgcaagaactttcttacagagttcctctgaaaccgaacaatccacatacttctttgtatcagcaaatgctgtctgtaaatgcatcggcttcggataataaaccatagatggaacaccattttcttttaagtaagcctgaagcccatctctttcttcctgattcttcagctgaattgtatactgtgcccagcttgaataaaatccgttcttaacacatggtgtcttaacaatatctgacagagcttctgtatacttctttgcaacttcattaacagctttcagttcattcttttcaaatgcagtaagtttaactccaagaattgctgcctgaagtgtatcaagccttgaattccaaccaatacgtacattgtcatacttaaactgtccttttccgtgtacacggatagactctaataattttgctgtctcatcgtcatctgtaaaaatagctccaccgtcaccataacagcctaatggttttgccgggaaaaatgatgttgtagatgcatcaccgaaactacatgcctctctgtcaccaattcttccgccaaatccctgcgcagcatcctccaacagaagaagattgttttcttttgcaattgcttcaagtttttcataatctgccggctgtccaaaaaggtctactgcaataattgcacgcggtataagttttccctcatcctttactttttgaattgcatccttcagagatgtcacatctgcattaaaactatccggatcaacatcatagaatacaggtgttgcaccttcaaatgaaactacttctgctgaagcaaaaaaagtgaaatctggaacaaaaactgcatctccttctttgatattccatgccatcatcatcatcgttaacgcatctgtaccatttccgcatgtaatacaatgttttcttccaacatatttcgcaagacgctcctctaattcttttacctgatttccgctgataaaattacaattttctaatacttcagaaattgcaacatccatttcttcttttaatacctgatattgtttctttaaatctctaaactgcatttctatttatccctctttttcacatgttccgatttactcagcattatgtattaactaattttcacattctttgccattatattcacaaaaacccatatatttatttaaaagatcattaatgtttttttaattttaatccatcagtatgttcttcatattctcgatgacaacattcacatttcaaatcttttccaagaacatttccacattcacatacccaaccgattctttttgccggaactcctgccattaatgcatgattttttacattctttgtaacgacagcacccgctgcgatcatagcccattttccaattgtatgaccacatacaatcgttgcatttgcacctactgttgaaccttcttttaaaagtgtcttcttatatccggcacttccttttggatatttggcacgtggtgtcaaatcattcgtaaaaaccatagaaggaccacaaaaaacgtagtcctccaattcaaccccttcataaatggatacattattctgtacttttacgccatttccaatttttacatgatttgacacattcacattctgtccaaaagaacagttttctcctatttctgatccactttgaatatgagaaaaatgccagatttttgtgccttttccgattttaacatcgtcatctatatagctgctttcatgtacaaaataatcactcattaaaattctcctgtcatatccagacttgcaaaattctccagtggaagttttacagcatgaccttctttctggctcttataaattgcaagaacaagctccagtgcatttcttcctgcatgtgcatcaacatatggtgctctgtcattcttaattgcatcaattacatctgcataaagacttgtgtgtccatttccatatacattacttgtctgctcttcaagtcctttgtttgcctgatcatcatctgtctcatcagcaaaattccatacatcaatgttatttgtagattttccaccaagcttgactgtaccattctcaccgaacaaatataatgtttcctcaagattctgtggatagacatttgttgttccttcaattgttgcaactgctccatttttgaactttacaactgccattccgatgtcttctgcttcaagataatggtggaactgctgttttgttacaccataaacttcatcgatttcatttcccatcatccaacgaagaagatcaattccatgaatacactgattcataagggctccaccatcctgagcccatgttcctctccatggagcctgtgtgtaataatcctgatttctgttccaacgtacatgaatagaaccatgggaaagttttccaaatcttcctgcttcaagagcttttctcatctcctggactgcaacattaaatctattctgatgacacgcagatacttttacgcctttttcctcagacagtttaataatcttatctgcatcttcaatgctcattgccatcggtttctcgataatacagttgattccatgctcaatacagtacaaagcaatctctgcatgaagaccgctttctgttgcaataccaacaagttcgatttcattttcttcaatcatttttttgtagtctgtatatcttttaatacttgtatcattttcaagtccatgttttgcaagaacattttcgatatgttccggtacaacatcgcaggcagctacaaattcgagcttattatttacaacagcttttacatgatttgttgaaattcttccacaaccaattaatgcatatttcatctttatatcctcctacagaacttcaatattctctctgttctcgatattcttcataacattctttgtatcaaagattgcttttgcattcttctgaatcatgtcataatctacattcgtatgtgctgctgttaccatgatcaggtcgtaagaagcaatgatttccggatcaattttctcaattccctgatgtttctctccatgatatttgtactcagaaatccatggatcatagaaatcaacatctgccatctcgcgtttgagtacttcaattacacgaagagccggactttctctataatcatcaatatcctgcttgtatgcaacaccaagaacaagtacctttgctccgttcatagctttcttatgacgattcagaaccttgcttgcgcgctctacgcagtattccggcatctgatcgttaataatcatagatccttcgatcatagatgtatggaatccatactctcttgctttccatgtaaggtaatatggatcaagcgggatacagtgtccgccaagtcccgggcctggatagaatgcctggaaaccatatggttttgtcttagcagcatcaataacttcccacatgctgattcccattctgtcacaaagcatagtcagttcatttacaagaccaatgttgatatttctatatgtgttttcaaggatcttctccatctcagcgattgccggtgaagaaacttcatatacatcaccttcaagtacagcacggtacattgttgcaattacctctgtcgcatctttaccgattgctccaacaacctttggtgtgttttttgtcttatagatcaggttacctggatcaacacgctctggagaaaatccaagatagaaatcttctccgcattttaatcctgatccttcttcaaggattggtttgatcagttcttctgttgttcccggatatgttgtagactcaagtactaccattgttccttttgtaagatatttagaaatagcttctgttgaggcctttacatagctgatgtccggctcctgatgggaatccaatggtgtaggtacgcagatagcgataaaatcaacatcttttacaaaactaaagtctgttgttgctttcagcattccctcgtcaacaagtttcttcagatcactgtctacaacatctccgatataattatgaccttcatttacaaggtttaccttttcttcctgaacatcaaatccgattgtcttaaatccagcttttgctttctctacagcaagtggaagtcctacatatccaagacctactacaccaacttcgatttctttgttttcaattttcttcaataattgttctttcatttttcttctcctttattttaaatctaaaataacctgttttgctctagctttccatgtattagcctcgtatgccgatatttccgattctcgcttttcctgcagtaatgccgggttttgtaagatattatgcaagcattgttttaatgcttcctgattatattctatactccatcccaggttttctttttcaataaatttacctgctgctgtatctttggttgctataatcggtatataatgtcctaaatattcaaacacctttatcggcattgccatacgcatataatcaccttcacctgcaaaggcacagcatatatctgcttttttataatatggctctaatccctgtccactctcatgaataatggaaatcttttcgctcatatatggtaaatacttgctctttgcattttcccattctttttctctgcaacagacataagcatgaacctgatcaggcatctgctgcatcgcctggaaaaatactgtcaaatcatagattctgtcaattccacccacatataagatttctagtttttttgcagtcaaatccgatattgcctgcacggcatcaacatcatattccgcacatcctggcataagaattgcacttctattcaacaattccggatattcttttaagtatgcccgcatttcatctgttggaagataaaatacattaagcaattttttatattgccttaaatcatatctgtacattggaatcgaaaagcacttcttataccatgatacattatcacgatacacagaaaatttccactgtatatctctataaaaaagtccgatttttatcccgtttttcttgcaaaatttaaaaaagctaaaatctaaaaacggataacgaggcaaatgatttttttcagtcagcaaagttggcattgtagaactctctgaataaagaaaatcatattttataccgttccttatattccgttttatcttgtttatttgaacttttctttcagtgccatatcctgaaatatattcaacaagataaccattttcttcaaatgcctgtttcatcttgattggacggatattggagcccgattttccgcttttttcaatatggttggggatgtggacaatacatcttttttcttgtttaatgttcattgtcacacctcactctttcatataaattaagcattttctctacattgtcattccatgaatacagttgttccactcgttgacgtccattatttcccatctttgtgcgcatcttttcatcaagcacaagtttcttcaatgcatcttttgccttatttatttcttttcgagaaataatcaatcctgtttttccgtcttctataacttctttaaatccatctgcatccgatgcaacaacgggctttttcatcgccatggcttctactgctgctactccaaaactctctttccggcttaatgcacaaaaaatatcaaattcgcttattgcttccggcaccttcgtgttaggtattttccctttcaggaaaacagaatcctgcaggttctgcttattgatcagatcttcatactgttcttttttgcttcccgaaccataaattaataatttaattttccttgaataatgctcctgttccaattcctttttcagatcccgaaatgcaagaatcatttcttcgataccataaatttcttctaaagcttttatattccctattatcagctcttctttttctatttctttatactttttcggatcaaacttatttaaatccactccaaatggggtaatcgtaatttccagtttttcatcctgcattacttttttcagttggacagccatacaattacttgttgaggccaaataagaagcacttctcacatttctttttaaaatatgatttttcaccctgctttcatatgggaaatcatatacatcacttccccatactgaaagaatatatttaggtaatcgtgctttcctcgccaatgtcccataaccgcttgcataatgtacgttaatgacatccggatttattcttttggcaatttttctcaattcaccggcatttagataatagcctttgccaccactgtgtttcatcaagtataattttactctcgaattcagtgcatcttctttcggctcatggcctctgtttgaaacaagatacacttcatgtcctctctctgctaatgcattcacccatctaacagtgtgcgtactatttgctgccgatacaaacattattttcatcaaaatgactcctctgttttactatctcgcttctcttcaaaacaaacttatcgttttgaactatcaattgccttttttaaaatccgctcaattttatttgtcagtatctgataatcatactcttgtgcgcattcttttaaacgttggcaatactctccgtattcttctgaagtaagttgacgaaactttgtaatctcttccgcatattcttttccattcgcaaatcgctttgcaattcctaattttttctctcttattaaatcataattcaccggaagattacataaaatcggcttttcactcgccatatactcaaacagtttattccaactgcatccgtatttatttaagcctgccccctgaacattaattatgttcaaatcagcattgctcagaatatacggaatatatttcttttctacacgcccttcaaatttaacattcaatgaatactttctgcactcatcttcaagcatgtctttttctgtgccatctccataaatataaaaatgaatatcctgatttttcaattcttttgcagcatcaaccaatgtctgaagattatttacttttcgaatagatcccatgtaaactactttaaatgcattatcattcgcaatctggctattctcaaggttatataattttttattctcttcaaattctgctaaatcgacgccattatttacgtgatttactttattgatattaacttttttcgtccagcccttatcgcatatgtactcttttccgcccggcattgtaaaaatcaattgatctgcgtgtacgtaaatccatttttcaagctgatacagtacttgaataattggattcattcgagacataccattatattctacaatcgactccggccataaatctcgtacttccacaacaactggtattttatgctttctaccaaataataatgcaaataatgcaacaaataaatctggagaagatgtataaatcacatctggcttttctttcttataaaaccgcttcattgccttccaggttttaaatggaagatccatcatattgataactctgtccattccatttcctttataatcacggcttctaacaaaggtatactctacaccatcttccatctcttctctataaagagatttatccctgatcatattaatatctgtattatgaatcttactggatgtaaagattttcaccgaatgtcccttcttctgaaggtactttgaaaaataataatgcctcaccaatccccccatactcggtggaatggcgtaatgattcacaatccatacgttcattgtgagttctccttcatacctttgttattttataactgctattactgttgctaacatcgtcttgatatcttgccagaaactaaattcttcaattgctttcaaattatatttcatcttttctggcagaatctgttcgatataaacctgatctgcattctctgctgattcaagaagcttgtcttcatctttatattcaatactcgcccttgatgttactcctgctggcaataacagtgtcgccttcatttcatctgtataatgggctacatacttttcaacttctggtctggtgcctacaaaagtcatatctccagataatatgttgagcaactgcggtagttcatctaatctgcatccgcgtaatgcttttcctacttttgttattctagtatcacctttcgtggtaacctgcgttccgattttatctgcgttgttaaccatcgtacggaatttaaaaatccgaaaagtcttaccgtatgtcgtcactcttacttgtcgaaagaaaaccggacctttagaatccagtttaatgcaaactgctagtatcaaaagcagtggtgataaaagcacaagcaacacacctgctactattatatcaaaaagacgcttcagaatcaaacttgctttatgccgctgcaaaatatcataatatctttttacttctttcacttgcatattctgaggcaattcgtcccatctgcacatcttttaaacctcacttacacatttcctaaatgtttcaatcacatactctacatcctcatctgtcagttttgtatggagtggtaaagtaatctcgttttcaaatagtgcataagcattcggataatctttgatatcaaatccaagatttttgtatgctgtcaaaagtggaagcggtttgtaatgaacatttgttgcaacgcctgcttcagccatctttgtaattactgcattgcattcttctcttgtctttccatttaatctgacaagatacaaatgaccacttgacgcaaaatcatccccataatggttcaatacactaagatccagatctttcaatccttcattgtatttttctataatttcttttcttcttgccaaaatcgatgggtatcttctcaactgtacaagtccaagagatgccataatatctgtcatattgcatttataatacggcgcaataatgtcatactcccacgctcccagctgtgtcttagccaaagcatctttagactgaccatgcagagaaagaagcataaactgtttgtaaatttcttcattatctattccgtcaatatctctccagactgctgctccgccttctgctgttgtaagattctttactgcatgaaaagaaaagcttgtaaaatctgcaatttctccactatgctttccattttttgtagcaccaaatgcatgcgcaccatcggctactaccgctattcttcccatctttttctgtatctctgtgctcggacggaataatgactttttcttttctacaatgtcgtatatcttgtcgtaatcacaaatcacccctccaagatcaaccggaatgattgcctttgttttctctgtaattgcagattccagcttttcataatccatctcataagaatccggctgagtatctactaatacaagtgttgcacctacatgtactgcaacacttgctgatgcagtatacgtatacgcacttgtaatcacttcatcccccggaccaattccaagaacacgtaaactcatctctgcacatgctgtagctgagttaagacaaactgccttactcgtatggcaaaatgctgctatttcgttttcgaatttctttgtcttaggtcctgtagttatccatccacttcttaaagtatctgcaacctctgcaatctcttcctccgtaatatccggtggtgaaaatgctatatgtctgttttccatctatctatcctccacaactggttcttcgtgactcgcttttccaagacttaataattcttcatacatctcttcatcacgttctttatcttcttctctgatatgatacgtcgaaacaattccagatacgatttttttcacatcccttgattcctctgatgcagcaatttcgagttttttcaactcgcttaagaaatgtacctcatcaaattctaacggttgtcccacataaatcagattatttgccgtcttctgtaaaccttcctcttttgttagaatctcctcatacaatttttctcctggtcgaagtcctgtatactcaatattcatatccacaccaagagtataacctgacaaacgaattaaattcttggcaagatcagcaattttaactggctcacccatatcaagcacgaagatttctcctccatgagccaatgcgcctgcctgcattaccaatgatacagcttccggaattgtcataaagaaacggataatatccggatgtgtaactgtcacaggacctccggctgccatctgtttcttaaacaatggaataacactaccattacttccaagcacatttccaaaacgcacagcaacaaattccgtcttggaatatctactgaatgtctgaatgatcatctcacataatctcttggacgcccccataatgtttgttggattaacagccttatctgtagaaatcagtacaaatttcttgaccccatacttatccgccgcacgtgctgtcttataagttccaaaaacattatttttaattgcttcattcggactgtcctccatcagcgggacatgcttatgtgcagctgcatgatacactacatctggtcgataaagatccatcacactttcaattctctttgtattacgaactgaaccaataagcacttctaatctaagttttggatatttcttttttaattcttgctgtatatcatatgcattattttcatatatatcaaaaataataagcattctcggattatgtgcagcaatctgtcggcagagttcgcttccgatagagccaccacctcccgttacaagaacattcttgcctctcacatatccggcaatactgtcaatatcaatcttcacagtatctcttcccagcaaatcctcaatagaaacttctcttaattttgagacacttacctcatcattgatcagctgatacacgcctggaagtaccttcagcttacaggttgtctcattacaaatacgcaggatatctctggtgtctttattatcagcagatggaattgcaagcataatctcatctacatcatattttttcgcagcctctttaattttcgtacggtcgccgacaatgcgtactccgcgaatatattttccggtttttgatggattgtcatcaattacacacacaacatttctgtttaaatgtttgcttgttttcatctcggtgattattatattaccggcttcgcctgctccgatcaccattgtattgattggacgatttgtgttctttgagatacctctttgaagagcatgcaaaatacgataagaaaatcttgtgatcaaagttgtcattgtcaagaaaaagaaatagaacaaatgaaaacttcttggcactgtcagataaagcagactcattccaaatgcctgaaatgctgttgataaaattgccgctgcacaaacaagtagcgcctcataaagacttgcatatgaccagactctattatataaattcaataaaagaaagatgatcattgtagtaactatattaatcaacaaatacgtattaacacttgccaaatcttccacaggaaccgtgttcccatccattttatatctaacaatcaacgctaggtaagaattcactataattgtaatgacatctacaataaatagtaatatcattcttgattttgatgtttttaagctgaatatatttttcatagaaatcctctccattaacaatgttacaaattattacaagttttttacataacttatatattatcaaatttcattccattattcaatgtctatacttatttttttcataaattgtgcaggttttatatttctctgcattacgtttttgaaatcattaccaatcaactttaaaaaaggagacgcttcttactatttctgcgcctcctctacccattcttaatttaatttttctccttcggtcaatatgccgccttcttcaacaacattcaccaaatcaataatattctgcacagaagattcaatcggttccataataaagagttctgtatctccactggaataacaagtacctgttgtattcgttccttctgctgctatagactgaattgtccatgttgcattattattcaactgatacttgatcagagcattgatctgttcctgagacatatttgtctcaacatctttgctgacctgttccataattgcatttgccttcaaaagcattgtaggcgacagacacttctttagcattgcagtaataaccgcctgctgattttttcctctctgattgtctccatcaggaagattgtgtctttccctgcaaaatgcaagagcttctttaccattaaaatgattatacccttcctgaacatccatagtatattctgaatctttacttgtcgtaaatgcaaattcagaatatacatcaattccgccaagcgtatcaacaatatcaattaatgaagtgaaattcaatctcgcataataattaatatctgtctcatataattcacccaaagttttcatagatgcatctataccatagattcccgcatgtgttaacttatctctctgtcctcctgaaactcccggaataggaacataataatcacgcggtgttgttacaagtaatatctgatgtgtttgtggatttacaactgcaataatattcacgtcacttcgacttgtttctgatacatcaccataaacatcaataccactgatataaactgtaaatggttcttttataatactgtcatctgttgctcctgttgaatttccgaaatccaactcaacacgtatattaaatgtatacaacactttcactttatcgctataaccatctactgcttcttccatcagacttgtatatgcactgttataaatgattgcatcacaatccccatcaatcaaagcctgtgcttgtgtctggacagaatcatactcttttacttcgatcgtatcaacgccaatctgcttttcaatatcggtcacagctgtctgtatattgccagcacctttctcaaactgtacaccatacgtatagtctgccgcatcttctattgtctctgctgaatcatctgctcgtactgcaacaaccatcttatccactttatagttgcttcctgtaatcttcccaatcatattattagcctgagcgacataataacttccagtaaacatcacaactgccataagtaaactgaacacttttcccaaagtcccccgttttctccttgccacctgtgaattcagtgtcacacaccataagaaaaacagtattgctgctgccagtatcagatacttatccggaatcattcctaacaaatacaataccgccattaaggctatactggcaatcgtctgaagaatgatacacaaagttcccagcttattacttcccgatctgcgggaatacttatttgtacttttctttctgcgtgcagaattgccagcagattcttttcgttttgccatcttacatcccttttctcaaattagaacaattttgacgggtaaactcctttttcaatcaatccacgaagtgctgctgttacagattctttatcttccttatatgtcaccccaaaccactggtcatgtgactgcagtacttttacttccagttttccatcacttaacagatctccaatcattgtcggaagcagatattctgcttttagatctgtactttctgttttctcaagaaactcatcaaatcctgtcttaagaatctcgaaaaattcaggtgtaattccccacatattcatagataccggtgaatcaacgtcaaggaatacatctccatcctctttgtggattacagcttttccgtcttctttttcgatgttatgtgtctcttcaatgtctgcaagcatgccatgtccgtctacttcgcacacacctctggtcacgcctccgttatcactcaatgtatttttcaatacaaaactgaccatacaaatctgcattatatcagcagatggaaggtttgtcaaataactgtatgcctctttaaatgcttcttttccataataatcatctgcattgattacaaggaatggagcatccaccacatctttacagcaaagaattgcctgacctgttccccaaggttttgttcttcctgtgaattttccgctgaatttttccggaatatcatcaagctcttgaaatgcatatgctacttctacttctttttcaatacggttgccaatgatctctttgaaatctttctcgagatctttgcggataacgaatacaactttgtcaaaccctgcttctaatgcatcatagatggagtagtccatgataatctctccatttggtccaatcggagccagctgcttgattccgcctccaaaacgacttccaatgcctgccgccatgattactaatgttgctttgctcatttctttttcctcctaatgtctcttcactgttacaatataccggtttataaacactacttattctcccaatccatcttttacaagttgaaccatgtctgaaagtgctgtttcttcgtcttctccttcacaaataattgtaatctcatctccgctttttatgcatgcacccagtacacttaatacacttttggcatttgcattcacttcttcatttttcatcttcttgtacactgtgatcttgctcttgtactgcattgcagttttacaaaacaatcctgccggtcttaaatgaagtcctgtcggatttttgatcactactttatcgcttatcatattattctcctattctatctctttgatagtttgaagttttaacttcaacatcatataatatgcattgaaaactgtcaatgccggccatcttaattcttttttaatttagacctgtaattcacaaaacaatataaagtatcactaatttgtctcagagttattttccggttgttcatcttctgtggattctttttcagtcaatacaagctgcactgacactggttttgtcaatgtcactccatctggaagatctacttctaccggtatgtcataagtaccttccttcgtgtaattctgtaggtttaccgatactgcattactgatatccagactatccagcgtatctttctctccctgaaatacaagtgtcacctcagcatctggctcataacttacctgaagattttttgccagataattctgtttgatggatgcaaccataaactcaattgtacgatttcccaactgttcgatcattgcagttgcggtaacctttcccgaagcgccttcaataagttctacaccttccggcagataatctgtaatgtcgaatgctttctctatcttttctgttgccccatcaatagacaattcagatgctggaatattgatactttcaatctgggataaagcctcttcttttccgcagacctgcacgctcgctggttcgctcgaacaacccagatattcatatccatctgccggtgttccagatgcttcaaatttcaacggaaccgtcttgatcctcatcactgtcacatctacagtgattccatcttctccaagattattacttagctgtccctgattgatcacatttccagatgcatcatataaaacaagttctgctgtaagttcttcatctttcgaaattccatctacattaatcttcgctacagccttatcaattgattttactgtggattctgctcctgtaatcgttattttttccggattaactttcatctctccaatctgataaccgtcacgctgcgttccggttgtgctaacagtcaatgtaaatacattcttacctgtcggttctgtcttaatctgtatgtttctcggaacagactctgccgactgataagatccactatactttggaattgatactgaaattggtatcaaccctgtcctggaatccatttctttaatatccgcagtagccacaatatcatctgacttaatctgttgaatcactgaacgttttgcataaacaactacgtttacattctgatcatctaaaaccgtataaacttccccaccctgtgcaatcacatcatcgttcgctatcgtaactttgatgtttgtataggttgatttcgtaaccggattagcaacattcgcaacaatcagccaaagaaatgctgcaaaaacaaatgcaataatcttaagcggaagattcgttgtcaatttgtattttttcatgatctgtgccatcctttccgtatagaaaacttgttctttgtctctgtctttctatactgaatctggcttaactgactccgaagttcttctgcgttaatagctcgaagcaatcgtcctccggaagccacagaaacaagtcccgtttcttctgaaacaacaatcacaagggcatcacaaacctcgctcattcccaatgcagcacgatgccttgttcccagatctttactgattgtcatgttatccgaaagtggcagatagcatgttgctgatgtaattctgtcccctctgataataaccgcgccgtcatgaagtggtgtgttatgttcaaaaatattgatcagcacctgagaagacactttacaatcaagctctatacctgtcatttcatactctgttaactgaatcacctgttctactacgatcaatgctcctgtacatacacttcccatagcataacaagctcttacaatactatccagtgtttcatctgaaaacctttgattttctttatttttatcaaacggattaatgttactaaataaattcttctctcccagcttctccagtgcccgtctaagttcgggttgaaaaacaacaattgctgctatcgctaatacattaattgactcttttgccagatacaggatcgtattcatttgaaaaagccatgccagaagaataaagcctcccaacatcagcattcctcgcagaagcatccaggcttttgtgttcttgatccagagcatgatttcatagacaataatcgtcacaatcagaatctctatgatatcttttatctgtatatgtggaaaatacattccatttgaataatttcttataaaattctgaatccactctatcatctcaagtctcaccaccttatgtaatcattcgttgtcatccacttttgagtcttttttctactgattactcgtttttctcattattctgatccaaacctaattccttactcagacttcttgttaaaagaatgtcttccgtcatctttgaatcattaaaaattgctgtctgtgtaaaatcaggctcctttttcaattgttctgctcggtttccgatctctttcttttcaatctttttcaaatcagatacctctgatgcagcaacattgctttctctctctgagatatccagcatctccgattcctgttcctgatgttctgtaatatgtttcacttgcttctcaggcatctgaactcctactttcggaactgcctttacataataatagtattcgtcatcttcaaactgaacattctctgttcttgaataatccacagagaaaaaaacaacttcaaggaacaatcctattacaacaccaagaattccactgaaaatcatcatcgtataagacatatgaagtccaagagaaatatttcccgatgcacctacgatcacacaaactgctgctcctgttgctgatgcaatcttccaggaatgatcgactgcccgatttttaataccgttcactaccagtattccaatcactactgcaaacagcataacccacatctcttgatagcctacaaactgttttgtaaaattggttaaagtgctgatcattgttgttccatctgtacctttcaatgctgttgcagaagctttgatcaggtaaagtagataataaacaagaattccgcaggatgcagggacaatccatactgtagtacctaacagcccaaatataaccggaatcaccagtggtattttcatgccgaacgctactaccgtcagcagaatcagccagctcttctccggggtaaatcgaaagtagaaaatatacattaacaaaaacagtatcaccgtaactccggctattggcatagataatgtatataaatgagccactattaacacagttgctgctgccgtcattactgccagagggagaaatgtacagactactgctaagccaacagtacaaagaacagatgatgccatcttcataaatccaatattagaattgatcaggttaaacaccaaaagtgcaagcaaaaactgtgctccctttcgaaccaagagagagtgagaaacataaatctgcttaaatctttctctaagaaccagtaaattgttcattgttcattcttctcctttttacacatcttctctaaacgggacaaattacgataataacgttttacattctgtttggcaactgcatgttttctcttataaaaactatttgcacaaaccccatatataactaaaagaactatatagcctgcaattgctgcaatcaagagaacgaatagttttaaaattgtcagatcagcagataaactatcacttgaataaatgcagaaactaacgaacaaaattgcataacctattgttacccagatcaatgtaatccatgtcttaagacttgcataatcttttctgtaataatcggcaattttaaaatcatctttgtgattcttctcatatatcgacatttttgtcattaaacgaatcctgtctttatctaacatatccgacattcacctttccagatttctctcctaagtataccatatgttcagatgccttgtccaatgcttagagtcaaaaagtagacattttcaacacctgctttttttaggattcctgcagcacgttctattgtacttccggttgtgtaaatatcatcaatcagaagaatattctggcgtggattccacgattttgaaaccgcaaatgcccccttcagatttctatgtctctgctccccgttcatttcctttaaaggccgggttttcttaatccgatataaaacatctttttccataggaattcccatgcattctgataactgctttgctaaaagttctgcctgattatatcctcgttttctcattttcgatctatgtaatggaattggaataattgcctggatcccccatcttcgaatctgaaattcaaactcatctgccagctctttcccaaagatttccgcataatatcgcttgttgtgatatttcaaccgatatactgaatttgaaaccggcggaatgtgaacccagaggctgcgtccttgttcataattactttttcttctttcacaatccctgcaatactctttcgtttcatcctccaatggcttcccacaatggatacattttatttctcccaccttaacaacctgttttctacagtcatcgcaaataccttttgagctgatcccctgacaaaacgggcatctttttggatacattttttctaaaattctttgattcgctcgtctaagcttgtaaatcttccctgttcgcttttgttttcgatcatttcctgaaatgttaattcactccctactattgttaaacatttttttgcccgcgtcactgctgtataaagcagattcctgttatatagtaactttggtcctggaagaagtgggataatgaccgccggatactcgcttccctgagatttatgaaccgtaatcgcataggcaagttctaactcatctgtcatatcgtatccatattttacctttctcccctcatcatattccacgataacagtttctgtatattcattgatttcatcaatgactcccatatcaccgttaaaaactccaattcctttgtcaactgttaatccaaatctggtagaaacttcccactctaattgataattatttttaatctgcattactttgtcaccttcacggaacaatctaccattaatttctttctccgttttttgggaatctgaaggattcagatattgctgtagaatcacattcaatcgttctacacccagcaatcccttacgtgttggtgtcattacctggatttcatttgggtcagcctgcacatatctgggtaatttcttctgtattaaagtaataacgacgctaatgatcgtattcgcatcctggcgttttaagaagaagaaatctcggcttttattatcaattgtaaccggttctcctgcattgatcttatgagcatttactacaatatcactctctcctgcctgacgaaaaatctttgtaagcgtcactacgtgaaatttttctgagcgtatgatatcttttaacacacttcccggtcccacggacggaagctgatccacatctcccacaagaataagtcttgttcccggaataactgctgataaaagcgcatgcatcagattcagatcaaccatggacatctcatctataatgataacatctgtctcaagtggattctctctgtttctcaaaaatccacctacactgttctcttcctcaggatttccacttacttcaagtaatctgtgaatcgtctgggcttcatatcctgttgcctctgtcattcgctttgccgcgcgtcctgttggcgctgcaagaaggatactcattccttcgctttcaaaaaattgaatcatcgtattgatcgttgtcgtcttacctgtacccggtcctcctgttaatatgagcaaaccatgtttaatagcttctataacagctctgtgctgcattggatccaattctatcttttctttctgttctactcttttcagacgtttctccatcatgtcttccggcatctgacagtcaatatcaagatcattaagcattttcgcagtattcaattccaagtaataataatgtgctggataaatgcgaatttcctcatccacttctttcataactgttttccgctctatacacagatccatgatgtacttctcaatatcttcaagatcaactcctaaaagtgcatttgcccttcgaagcaatatattctgtggtaaatacacatgcccctcacctactgcctgttgcaatgtataaaataaaccacttcgtatacgatagtctgaatctgtatgtatgccaatcttggatgcaatttcatccgcagtcttaaatccgattccttcaatattatctgcaagctgatacggattttcttctagcactttatacactttcattccgtaatactgataaatcttggctgccagctttgttgaaataccgtatttctgcagataaatcatggcttttcgcatatctttcttttcttcaagctgagatgcaatctcctgtgcttttctctcactgattcctttaatctccgcaagtctttccggctcttcttcaataatgcggaaagtatcctctttaaactttttcacgattcggccagccagtgccgcacccacacctttcactgctccggagccaagatatcgttcaatagaaacaatatcctccggctcttttactttataatgagaaatcttcaactgcttaccataaacattatgattcacatattctccttgaatttcaagaagttctccttcattaatatagttcagacttcccacgcatgtcacttcaccatcatcatgttcaatatggaatactgtatacccattatcagaatttctatatacaatatgactcacataccctgtaactgtttccacactttttcctctctcttcttgtatcttttcctatttatatgcagaaaaagggtgtgttcctattatacacaccccttgtaattgaatcttcttctctaagaacctgacacttcaaattcttttttcagaattctttctcttaaaactcttttcttccactcataaattccacaaactgtccggtaccaattgcaacgactttcatcggatcctccgctgtcatcgtattaattcctgttctctcttcgatcaattcttccagtccgcgaagaagtgatcctcctccggtaagaacaattccacgatcaaggatatctgccgacaactccggtggagtctgctcaagtactccgattacagcttctacaatctgtccggtagattctctcaaagcttcttctgtctcagatgaagtcaccgtaactgtcttcggaagccccgttaccagattacgccctctgacttccatcttctcttcttctacaagtggataagtcgttccaatcttaatcttgatatcttctgccgttctttctccaatcagaagattgtgtttctttctcatatagcgtacgattgcttcatcgaaatcatcacctgctatcttaattgatgtattcacaactgttccacccagcgaaataactgcaatatctgctgtaccgccaccgatatcaacaatcatatttccacaaggctttgaaatatctatccctgctcctattgctgctgccacaggttcttcaatcagatgaacttctcttgctccggctgcaaatgtagcctcttccactgcttttttttctacttctgtaacaccacttggtacacagatactaattctcggcttcttaaatgtacgttttcccagagctttctgaacaaaatacttaatcatcttctccgtcacggtataatcagagattactccttgtctgagtggtcttaccgcaataatatttcccggtgttcttccaagcatcagacgcgcttcttcaccaattgccttgatcacattcgtatcacgatcaaatgcgacaactgatggttctttcagaacaaccccttttcctttcacatataccagtacactggctgtccccaaatctattccaagatctactgacatcataatttctatatctcccttctaaaacgctcttttactgttctcagcaatctactgcaaataaacaactttgtctgttactgatttcagcattctctttcctcaatcaagtgtcttttgtcccttgaaggggtttatcgttactgtttttttcactcttactgttgtcaatattatgtaaccaaaacagtaatgttttatcatccgcatactttagtataatagacttcgcttaaaatagaaaggcattttttgcatatattttacgacttttttcgactttttttcgtctttatttctccaatatagacgcaatatatttccctgtataagaatctggattctttgcgacctcttccggagtaccacttgccacaacagttcctccgcggtctcctccttctggtccaatgtcaataatatagtctgccgtcttaatcacatccagattatgttcgattacaattactgtatttccatccccggaaagtctgcggagaatctctgttaatttatgcacatctgcaaaatgaagtcctgtcgtaggttcatccagaatatataccgtttttccggtactgcgtttgctaagttctgtcgcaagtttaattctctgtgcctcgccacctgaaagctctgtagaaggctgtcccaaacgaatatacgacaatccgacatctctcaacgtctccatctttcttcgaatacttggcacgttttcgaagaaatctaccgcttcttccactgtcatattcaatacatcataaatatttttccctttatagcgtacttccagagtctcacgattgtaacgctttccaccacagacctcacatggaacataaacatccggaagaaaatgcatctcgattttcaggattccatctcctgcacatgcttcgcaacgtccccctttaacattaaagctaaaccgtcctttcttgtatccacgtgcttttgcatctggcgttcctgcaaacaaatctcggatcaaatcaaacacgcctgtataagtggcaggatttgaccgtggcgtccttccgattggtgactggtcgatattaatcactttgtcaacctgctctagcccttctattctcttatgttttccagggattgttcttgcccggttcaagtctcttgcaagtcttttatataaaatctgattcacaagagaacttttccccgatccagacactcctgttacacaagtcataactcccaaagggaattttacatcaatgttcttgagattattctcttgtgcaccgactactttcagataacctgtcggcttctttctttctgtcggaaccggaatcctgatttttccactcaaatacgctcctgtgacagaatttggatttttcataatttcctgtgcatttcccacagcaacaacctgaccgccatgttctcctgcccccggaccgatatctactatataatccgctgccagcatcgtatcttcatcatgttctactacaatcaatgaatttccaagatcacgcaaatgtttcagcgtcgcaagaagtttatcattatctctttgatgaagtccgatactcggctcatccagaatatatgcaactccgaccagacctgatccaatctgtgttgcaagtcgaattctctgtgcttctccaccggaaagtgttcctgtcgcacgcgcaagcgtcagataatccagaccgacatccatcaaaaaactgattcttgctttaatctctttcagaatctgattaccaatcaactgctgtgtctctgtcaattgaagttcatctaaaaatttctgaagacgttctatagaaagtgttgtcacttctgaaatattcttatctccaactgttacagctaaagcccccggcttcaagcgctgtcctttacaggctgaacatggtgtaatattcataaatgtctcatattctgctttcatcgtctgagaacctgtctcacggtaacgacgttctacattcttgatcaaaccttcaaatgcaaccggataaattccttcgcctctctgacctttataataaacctttacttcttttccgtctgttccataaatcaaaatatcatggatttcttttggataatcctcaaaaggggtgtccagatcaaaatgatattctttacaaagtgcatccagaattgcacgtgtgaagctgctcttgtctgtacaggactgccatcctaaaactgcaatcgcaccttgattaatagacaacgacggatccggaatcatcagttcttctgaaaattccattttgtatccaagtccaaaacattccgggcaagcaccaaatggattgttaaaagaaaaactgcgtggttcaatctcatcaatactgatctcacagacaggacaggaaaaactctgactgaaattcagagattctccatcgatcacgtcaacaacaagcagaccttctgcgagctcaagtacattttcgacagaatctgtcagtcgtttttcaattccaggttttatcacaagacgatccacaataatttcaatattatgtttaacattcttatccagtgcaatctcttccgaaagctcatacatattgccatccacacgaacacgaacataaccactctttttcgcacgctcgaaaagctttgcatgtgttccttttcttccacgtacaacaggtgccaaaagctgtatcttcgttctctccggaagcgccatgatctgatccaccatctgatctaccgactgttttgcaatctcacgaccacatttcggacaatgaggaattccaactctcgcatataataatcgaaaataatcataaatctccgtaacagttccaactgtggaacgtggattgtggttcgttgatttctgatcgatagaaattgcaggtgaaagcccttcgatactttctacatccggtttctccatctgaccaagaaactgtcttgcataggaagacagtgattccatataacgtctctgtccttctgcataaattgtatcaaatgcaagggaagattttccagaaccgctaagccccgtcaaaacaaccagttcatttcttgggatatctacatctatattcttcaggttattctcattcgcgcctcgtatcttaatgtactgtctggcgtccattttcttacccattttgtaatctcctattccatatcattgagcatcttttttaattcaacaagcttatcacgaagctctgccgctgcctcaaagttcaattccgctgctgccttcttcatctgtttcgtcagatccgcgatcagtttctccagttctttctggctcatggactccggatctttttcaagccgcatctcttctgccgcaacctttttagagatactgatcagatcacgcactgacttctgaatcgtcttcggcgtaattccatgctcttcattgtatctcatctgaatctcacgacgacgctgcgtctcatcgatcgccagctgcattgattctgtaatcttatctgcatacatgattacatgtccttctgcattacgcgctgcacgaccgattgtctgaatcagcgaagtctctgaacgaaggaatccttctttatctgcatcaaggattgcaacaagagtgatttctggaatatcaagtccttctctcaagaggttgatcccaaccaacacatcaaacacatccagacgcatatctcggatgatctccgtacgttcaagcgtatcaatatccgaatgaagatattttacacggattcctacttcacgcatataatctgtcaaatcttctgccatgcgctttgtcagcgttgtgacaaggactttattcttcttactgatctctttgttcacttcaccgatcagatcatcaatctgtccttctaccggtcgcacttcaacttccggatcaagaagtcctgtcgggcggattacctgttctgcacgaagaagctcatgatccttctcatattctcccggtgtcgcagatacaaacatcacctgattgatcttactttcaaactcatcaaagttaagtggacggttatccttcgcagatggcaggcggaatccataatctaccaatgtctgctttctcgactggtctccgtgatacattccaccaatctgcgggattgtcttatgtgactcatcaatcatcatgatgaaatcatccgggaaataatcgatcaatgtatatggtgcctgtcccggtcgaagccctgccagatgtctggaataattctcaattccggaacaaaatccagtttctttaagcatctcaatatcaaaattcgttcgctctgcaatacgctgcgcttctagaagtttgtcatttctcttaaactctttgacacgttcttctaattcttcctcgatatctgccaccgcacgcttgatattctcacggtcaacaacataatgagatgccggaaagattgctacatgcttcagttcgtccttcacttctcctgtcaaaatatcaatctctgagatcctgtctatctcgtctccaaagaattccacacgaatcgctgtgtcactctcatatgccggaatgatttccaaaacatctccacgcacacgaaatgtaccacggtggaaatccatatcattacgatcatactggatctcaatcagctttgccattacttcatcacgatctttgatcataccaggacgcaaagaaactaccatgttctggtaatctaccgggttacccagcccatagatacaagatacacttgcaacaatgatcacatctcttcgctccatcagtgacatagttgcggagagtcgaagcttatcgatctcatcattgatggatgaatccttggcaatgtatgtgtccgaagatggaacatatgcttccggctgataatagtcgtagtaggagacaaaatattccactgcgttatttggaaagaactctttgaattccccatacagctgcgcagccagcgtcttattatgtgcaataatcaatgtcggcttgttcatctgttgaatgacattcgccatggtaaatgtcttaccagatccagtaacgccaagcaacgtctgacactggtttccttctttgaagccttcgaccaactctttaattgcctgcggctggtcgccagttgggttgtattgtgatactaattcaaaatgatccatgtaatttctcctgagcgctctaatttagcggtgatattttagaaatagtagttgttttcttagtattgttacttgtatagtatatcattcaggagaaaaaaagtacagaactaaatcgaatgtttgttctgtacttttacatcttagctcgattctacatacctttaaaatgtatctgaatttaaagtcaaattttttatttcgttgacagaataaacttttaagatatataatatttttattacatttgtaagatttggaggaatatcacatgagcaatctgcctcaaatttcagaagctgaatttgaagttatgaaaatcgtttggaaatacgcaccaatcaacaccaatgaaattactgaaaaattaacacaaatttccagttggagtcctaaaacaattcagacattgattaaacgtctcgtttctaaaaaagcactaacctatgaaaaacaaagccgggtttttgtctatactccattagtcaaggaagacgaatatattcggcaggaaagtaattcttttttaaagcgatattataatggtaatatcacttctatgcttgcctcttacattgaggatgataaattgtctgaagaagacattgccagcttacggaatcttctttccaatcattaaccatgggaggagcatattttgatatattttagttttcgatttttactctgtaattccatcatttgtatttttttaggtagtttactgggattaaaaaatttattgcaaaggcaattatccgcacgtatgcaatataatctttcgattatatttcttgccgttctaattgttccctttttaccgataaactctgccccatcttctatatcgtggagacatttgctgacagccagttcaagtaccaatggtgacattcaaaccacttttctttctggtaatggttataatttggataaaataaatgattttgctgtctctgtcagcacccaaataccaacttttattcacacattacttgtatttttctggagtatcggtatattcataatgttttttcttctctaccgctcagtaaaacaagtaaaagccttacatagttctgctttacctcttcaaaatgaagaactaaacgctctttatatagaatgtttaaacgaagtgaacagcaagcataccattccgatttatagtacagcatttttgaaatctcctgttttggctggtttcctgcatcctcgcatttatcttccaattcacttgatttcagattttaacgctggaactataagcgcaactgatattcgctatatgcttcttcatgaactgcagcactacaagcataaagatattctaattggatatttgataaatacagtaaatgttttctactggttcaatcccctaatctggtattttctaaaaagaatacggcaggaacgggaacttgcctgcgacagtgctgtattacaattattgaaagaaacagaatacaagtcatatggaaatacactgattaactttgccgaaacaatagctctgtctccattccctcttactatgggaatcagtggaaatataaaacagttaaaaggacgcattttaaatattgcatcattccaccaacctacttttaaacaaaaaattcgtggatatcttatatgcatattcgtctctactatcatcattggatgcattcccatactttctgtttatgcttctgatcagactagctatcattttgacacaaccgaaaagaatattactcagctaaatctttcttccaattttggggactacaccggaagttttgttttatatgatcagtctgctgatagatggaatatttataatataaatcatgcttccacacgtgtatcaccgaattcgacttataaaatatatgatgcattacttggcttggaatctggaattattacaccagaacattccactttcacatggaatggagaaccatatccttttcattcatgggaagccgatcaagatttaacctcggctatacataattccgtaaactggtattttcaggcaattgattcacaggcaggttttgaagccgtaagaacatttttacagacaataaactatgggaatcagaatactggaacaaatctaaatctctattggacagatttctctctgaagatatcacccatagaacaggtggaattgttacaagatttctatcaaaataattttcattttgacagtaaaaatatccaggcagtaaaaaaagccctgctactttccactacttcttccggttctctttacgggaaaacaggaaccgggcgtgtcaatggtaaagatgtcaatggctggtttatcggatacattgaaacatcaaataatacttactacttcgcaacaaatattcaatcctcttctggtgcaactggaagtcaggctaccgaaataacagaatctgtactttctaatcttggtatttggaaataaataaagagaactgatagcataatttcccgttatcagttctctttatttcattcttctctactgattaattctgcaaattgcctaaccggtactgatacctcggtatattatcaataccattatctaaaatcctgtttccaacatactgaatcgttccatcatcctgaattttcatcgtaagttcatgtgtaataacaacatcattacatacaacagaatcacatactgcatgaattgtcaaaacaatgcttccatcttcattgtgcctgacttctgttacttccggtaaagacaatccaaaatgtgttggtgaataattaccacatcccaatcgttcccagataaacatattactttgttcatcgtagaccgcccattctttcaattcttcttttgtaacaggaagatatgtcataattacattttcgaactcttctgctggaattcccacaacctctttttctgcagtaaatttttctccatatttcatttgataaaaatattcataaagtccattataatccaacccctgcatatcctccgcattccagtttgaacataacagattgtttccctgatagccgaacgtactcacatatttttttgaatattcccgacactcctcactcaaaggctttacccggataatacaacttccatctacaatctctgtcacttccggtggttcaggtacgcataattcataacagaaattcccattttcagtatatgcccattcttttatttttgatagcgatatgtatgtaagtacaggctctgtatcctcactccagatcatttttgcggacatcacactcatttcttttccatcataactatattcttttctggtaattccaccatctgtatctgcttcatataaaattacacttcctttttcttcttgttctgcagattttaaaaattgttccatcttctgataattatccataacagaataatgatcggaaccaatgaccggattcccattttgtttgataatttctttcatccgattcatcatttgctcagcagtattctgatctgcttcttgtattccattatattcagaataaatatctcggataatacccataatttcttcacaatcgttcacaacttcctttttcttgtcttcatcgattggtagattatatcccttatccggattttccatggtagtgtttttctgattcttctcattttttacatctgtgctgtttaacgatatcttactttcacaggaagtcagaatcattcctatacaaagtactaacaaaatactttttcttttcatattcccccctaattattactgtaattctcttcccactcttcttctgttaaccttggcttataccaccctgcatttgcattttgatctgaactgattaccttatttgataaatactggaaacttccgtcttccataggttttatcatcaattcactggtgattgcctgatctaacattctgatttcccatactgcttctatcgtaagttttaatgttccatcttgtaatttttcatatgagataacttccggatatggctcatatgggaattcacaatcatataaccctcgcggtctgtatctaaaagttttattattagagttataaaaagtttccttttcaatctcggtattactaaatggtaaataggtctttataacctcttcaaactcatcttctggaacttcatattctgctccaccataatttgcttcatatggaacttgctttccatatttcatataatacattttttcataaagatcataaaaatcaagttccgtataattctggttatcccaatttgtaatcaacagattattaagtgcataccccaacggcataacatattttcgattcaattcccggcatgttttatctaatggctgcactctgaatccagtttcacccggtgctccatcaaatcccggtgggtgatattcctccagaaacaagtatcctttttctgtatatttccactcatatgcttcatattcatcataataattagcctgtgggctattatccttccatttaacctgacataatcgaacatttatctttccattcattgactctaaatgatattgtataattttcccttcatcaaatacaacaacaatatcaactgctgcctgttcttctttctccgctgctttgcaaaattcttctactttttcacgattgaccatatcaatctgattatcacaatctactgccgcatatcctttctcttccagacaattgataatttttcttttcgcctttaatgtatttaactccgacttctccttcatataaacagaccgaaaagtttgcgctgctttttttgcttctgcattcatttcagattctacggtttctttcttttcttctttttccgtaattcgattttggccgcaccctgtaaaagcaataagaactatcaatatcatcgcaaatttcttacatatgtaataattccccgtaaaattttttttatttttcaaaatattcctccaatacggttgcatcctttttaacaacataaccacttccaccgattcctttcacattctcaaccatactgataagaagaattggtttgtccacgcttttatctgccgtaaacaccgaaaaccacccgatttctttgccagaagtatcttctttcgttgccttcaactcggctgtccctgtttttccagccagcaaaatatcgtcacgatgtgcagcatatccggttccttccggatcatttacaacaccttccacaccttgcataatttcttctacattttctttgctaaacgcattttctatccatgtttcaccggatgcttcttctttgtatttcaaatacggttttatcatattcccttcatttaaaaatgaagtataaatacttgccagatgtaatggatttacaagaatctgcccttgcccataaccactatctgccaattgtatttctgtttctattttatctgtattggaatatgttgattcctgcatcgcaatctcaaacggcatattctgattaaatcctatttcatttaaagtattcataaaattctcactaccaattttaagagctgcctttgcaaaataaatattatcagaatagataattgcatttttcataataaccggttcatattcatgaagtgttgttacttgataagatccccaagacgaatctttctgccatgccaaaccttcatttccaaaatcttcttttggatctatgcttcccgttttcaacccaattcctgccacaactggtttaaatgttgagccaggacaccatacttgacgaaaacgattatataatggcttcttttcatcttcgtttaatgatgtccatttctctgatgataagccccgtataaattcattattatcataagatggggtacttaccaaggccaatacttctcccgtataaggattcattgcgacagaacaccccggatcttctttaaactgctcgtataatgatttttgcaaatcggaatctatcgttaatcttatatccataccatcttctttaaaaatacttgcaagaacctcttttacttccccatcactatccaaaatctttatatcacaaccatcttttccttttaattgcttttcgtataacttttccaccccagatcttccgattacactttcagctgaatatccttcccctggatgattttccaaatcttctgctgttacagactgtacataaccaattaaatgagctgctgcttcccctaactcataggttctaacttccacatctgatagcataacccctggaatttccaaaagtttattctgacaattctgctcctcaagtgtcttttcttctggctgtattttcattaaatctatttcttctactttcggaatagtttcaattggtacaaaagaatcttcttttacccactttgctgtgagtttgttatttattgtttctacatctatctctaataactccgctattttttcaatagatacattcctgtcttccagctttcccggtataatgccaactgatgttgctactccttttcctgcaagcattttaccatctcgatctaatatttctcctctctccgcttttgatgtagtaacacttattttatcatcactctctaaatctggaaaaatcaggctatcctgccatactaatttatatccctgtttcgtcttcttcagttccgccatattgtcaaattgtattgttccggcaattgtattacatgatgtttcatacgaaagcgtaactgtatctgcttttttctctttcacagctatatgactgattttaatgtcactgacctctattccttcgtatatcttagaatttcgttgtatgtattcttcttttgtcagataaactttttcatctgaatctatcatagtatacattacttcatattcctttttttcaatatggttcatatattccacaagtgtgtcttctggtgattccataattgatctttttaataaaacacctcccaaaatagcaattactgttatagccattattaatctccaaatcctacaagtgtaagattttttagtgctttgtttttttcgtctttttttcatagataccactttctttcaacgcttttattttcttaaatcttacacttgtaatatctgaaagtcaagtcttttcttaggcattatatacgtgcgtcgcacgatgtatataaaaagaaatcctcgatcacaagtaaacttgtggggttttggtctaggtacagcttgtgcattgtaggtgcatcaagacatccgcacaagcacgcttagctcgatttcgcttcgcttcatctcgctatacgtgcgtcgcacgatgcatataaaaagaaatcctcgatcacaagtaaacttgtgtcgaggatttctttttatatacgccgtgcttgtgctagacgcttacattccagcctgagctgcaacttctgctgcgaagtcgtcaactttcttttcgattccttcaccagtctcgaaacgaacgaattttgtaactttaacgtttgcaccgttctcttttgctaccttatcaacgtattttgctactgtaaggtcgctgtcctgaacgtatacctgatcaagcagacagatctctttgagctctttgttcagacgtccgatgatcatcttctcgatgatgttttccggtttctccgggttctctttcttagcctgagcaagaagaatttctttctcgtgatcaaggtaatcctgagatacttcctcacgggatacatacttcggagacatagctgctacctgcatagctacgttcttcagtgctgctttgatctcgtcgttaacaacatctgtatcagcaacaacaagaacaccgatacgtccgccaccgtggatgtaaggaacaaccacaccgttgtctgctgcaactttctcgaatcttctgatgttcaggttctctccgataactgcgatcttctctacgagagcatcttttacagtctttgttgtatcagcttcccaagtctctgccataaatgcatcaagatcagctgcttctgaatctactacctggttagcaactgcttctacgaatccctggaactcgtcgttctttgcaacgaagtctgtctcagagtttacttctacgattgcagcaactttgtcatctttaacaactgtcttaacaataccttctgcagcgattcttccagcttttttctcagctttagcctgtccgttctttctaaggaactctacagctgcgtccatatctccgtttgtctcagcaagcgcttttttacagtccatcattccagcgcctgtcatttctcttaactcttttaccattcctgctgtgattgccatgataattttcctccattattcataatgtgtatgtcactgtaagcagtaacatatgcttttctctatagaactatttctataaagtaaaatgcttcaacctgataatcaggctgaagcattttctttcatatcaagaactgatattactcttctacagcctcttcagcttcagctgcttctgcagcctcctcgtaatactcatcctcagctgcaccctggtttgcttcgataatagcgtctgccatcttagaaacgatcagttttacagctctgattgcatcatcattacctgggattacgtaatccagttcttctggatcacagtttgtatcacagataccgatcagcggaattccgagtgtgtgtgcttcctgtacacagattctttctttcttaggatctacgatgaagatagcgtctggcagtttcttcatgtctttgattccgccaaggttcttctcaagctttgtccactcttttttaatttcgataacttctttcttcggaagtacttcgaatgttccatcttctgccattctctcgatgtctttcagacgtttgatacggctctggattgtcttgaagtttgtaagcattcctccaagccatctctcgtttacataatacattccgcaacgctcagcctcagctttgattgcatcctgtgcctgtttctttgttcctacgaaaagaactgtaccgccttctgcagcgatgtcagaaacagccttatatgcatcgtcaaccattcctacagatttctgcaggtcgatgatgtagataccatttctctctgtgtagatgtatggagccatcttagggttccatcttcttgtctgatgtccaaaatgaacacctgcttccaataactgcttcattgaaataacgctcatgttattctcctccatttggtttttttcttccgtatgttttactctccttcgcaaccggacgaaactcctgtctcgacttaggcaccttggaaggaatccacatacgtgttttttagcaacgttcgtagtatagcataaaacaagggacgttgcaagaactttttcccacaacacccccatttttcaacattttttgttattgttcgtactatgtgcgaccaacagctatttttatcctcctacgcaacaagatgtgaatttcctattcctataccagctgaaacgctttcagcacatacagccatcctgtcaacgtgaatgcactgaacaatgttgtcagcatcactacacttgatgataaaactccttcatgtcccatattctttgccataacaaaactgcttactgttgttgcagatccaagcattacaaggattgcaatcagttcttcctgacggaatcccagtttcacagcaatcggaagaaaaattgccacaaatacgatcaacttcataattgttgctgtcacagccggtttgatccttccaagtgctttcctaaaatcaaaggtagctcccattgccatcagccccattggtgtggacattcctccaatacttgtcaccgttttattaagaattgtcggcattgggatcttgcaggctgaccagatcagaccagccacgattccaatgatgatcggattggttacgattccctttaacgttttcatccatacagctttatcaattgcctttcgttccggatggaaaaaggataacacgataactgccatcacattataaagtggtacacttccaatgatcataagtggcgccatccctgcatttccataaatattctggataaatgcaattccaagaagtgctgcgctgctccggtaagaagcctgtataaattccccctggattgaacggtctttccagatgcaagataccagtgcagcaattgtaatacagataaatgttactacaaagcagaaaatcacaaatttgatattccacacttctttaaaatcaacctttgccaggtcaccaaacaacaataccggtaatggaatcagaaagacaaatttattcatctttgctgcaaactcttcatccatccagccaagctttctgaacagcattcccagtaccatcatcaaaaagatcggtacggttgcattcagactaaaaactaaattttccattcttctcaccagtcccctactctgtacgaagcgctgtcacaggatcactctttgctgctttctttgatgggatcagtccaccaagtaatgtaaggacaacacttaataaaatcagtatgattgccggaacaatcggcagaactgcatttaccttcgcattatccgccacactgtgaataatcgcatttcccggaatcagaagtaataaagtcagtccgattccgatcagtcctgcacaaagtccgataataaatgtctctgcattaaatacctgtgatacatttcgctttgacgcaccgattgctcttaatattccaatttccttcttccgctcaagcacactgatgtaggtaataacaccaatcataatggaagataccacaagagaaattgctacaaatgcaatcagcacataacttatcgtatctacgattgttgtgactgaggacattaaagttccaactacatcggtataagtaatgacctgctcatccttcccttctgcctccatcctgctattataatcgtccaaaatttttactacttgttcctttccttcaaaatcctttggataaatgttaatagcagacgggactgcaaaatctacatatcccagtttctgcagattactatcataagaagccaagcctttcccactcatcgacatcataagctctgccagatcatcttccgtcatattcatctgaaatgcgtctgcaaatgctgtcggatcaatctgcattgcatttccgaggctgttctgaagctgcgttcctacgttggtcatcatctgtttcattgcagattcaagcccagttgtcatctgactgacaatctgtgtcattgcagaggacacctgtgtctcaagtgcctgacctatcgcatttcccatagtccccattgcctgattcatataatttccgatgatttttgacacctggctttccagctgatccatatcgatcattgctgacagaccttcctgaaactgcttctttccatcatctgtttgcagataagccatgaaatgttctcccatcttagacggatccggaagaccattttctgaagcatatgccaaataacctttcacaagatcatctgatagtttctcaagctgttccggtgttatctcaatctccggattttccggcataacttctgacatccaatctgaaattattttcttcgcttcatccgtctgaagatattccatcaaatattcatcgaattgatccggatctgtatatcctttttccgtaatatactgttcgtatccggccataatatttttgatcaattcctgtattttctcggttgtaatcgtcacagttccgcttgatttcatgatatcttttatattatcagaaataatcttttttgctgcatctgtcttaagaaatgctgtaaaatcctctccaagacctgaataatctgcctctggatgtgtctttgcatactcctgatatcccgtcagcagtccacaagccatctgtttcataccatccggtgataccttcagatccagattcgaaacaatctctcccagattcatctgcggcattccggaaagatctaagttcagagaatctgaatttacaagtcccgacagatccagtgtattacttcctatctgaaatgctcttgacagatccatagactcactgagatttaacgaattcccgaaatccagagaatttcctaaattgttcatcgcacttgcgtcaaatccaaatgctttctgcagtgctgcttcatcaaccgtaaataaagaatccatggagaatccattttcactatctttctctccaaattttttatttgtaaatacgttaacatccggatttgccagctgctgtttcacaatctcactttttgctgcctgttctgccacatgtttcgtcaatgatgtcggatatgcaattcccggactcagagaggaggctttcgcatcttcagctggtttcacaataccaaccacggtaagatcttccccattcgctacaagtgatttcatataatcttcattatccgtcttatctttccagacctgatactgactatcatattcataatactcagaactgttcacaagcttgaactttgttccgataatatcatcataagaataagttcccagatcatccggtgtagtaacattttcctctttcataaaggactggatcatctcatcaagctccaacggatcacgaagtcccaatgtataaagcataaaatcactcattccgccattcgaagtcagaaccacaacacattcattatatctctctggccaatgacccttttccacttcatactgattttcatagagtttactgctctccggcatctcataaaaaacatctgtactcatcatagatgacatcatactattcgtacttatagaagaacccaatcccatagcagaaaaggattgatctggattcacctgacgaatactgtctttattttctttataaatctgcggagaaacgctgtacttatattctatagcattcgtatattgttccactccactcttgccagtatcaagatacttcttcaaagcaccaaggtcatttgaatccattgtggaaaacatattcgtcaccatctgaattactttaacctgatcctttgactttttctttgtatctgacttctctttgtctgtttttttatcatccgcagaagcactgtccatcccgaccatcatggatgtcagatcaaagcctgtactttgtatctgtagaggatattctgaaagcgtctcttcctctacgttctgaatatattgattcacacctgtagatagagacagaattaatgcaattccgataattccgattgaacctgcaaatgaagtcagaagcgttcgtgccttctttgtcttcagattgttaaagctcaaagctaatgctgtcagaaatgacatcgaggattttcccatattcctgtgttctgccactcccatcgtcgtttcatctacttcaaacggatctgtatctgaacggatcacaccatcttttaatgtaacgattcttgtcgcatactgctctgcaagctccggattatgtgtaaccataacaaccagacggtctttcgctacttcctgaagaagatccatgacctgcacacttgtatcactgtccagtgcacctgtcggttcatctgcaagcaggatatccggatcattcactaatgcccgggcaatcgcaacacgctgcatctgtcctccggacatctgacttgggcgcttgtgaagctgcgcacctagtccaaccttttcaagcgcttctgtcgcacgcttccttctctcggacttgccaatccccgaaatcgtaagtgccagttcaacatttgccagaacagtctgatgcggaatcagattataactctggaaaacaaatccaatcgtgtgattacgataagaatcccagtctctgtccttatatttcttcgttgatattccattgatgatcagatctccgctgtcataccgatccaaaccaccaatgatattcagaagcgttgtctttcccgaaccactcggtcccagaatagcaacaaattcattatctctgagattcaaactgacatcatccaatgctttctgtatcagattacctgttcgatattccttgcaaatatgttgtatctgaagcatgccttctctccttttccaatcactatacagtcattattttactattctacaccctgcttggatgaattgtcattcactttataaggtttttcttgatttctatacattttttccataatgtggttagatagtatgtaatacacgaaagcattgaaggaatttatcatggtgtctgggatcgctggggtactactggcggtaaaggtcttgctacaacaataaacgcttgcaaaggaatctcggaattttaacacaccaatggaaaaacacgaaattcacttgcaagctacataaaaactgccagcagataaatttctactggcaggaaaaatttatattttttcaattgtctacttgacggggagcagttcccattccaatctccttaacataatcctttaattgcttctattgttcgggtatattctcgttctacttcttcaaacatctctgtagtgttttctttgatttctttgtctcgaagctcttctgttaatgctgagctgacctcgaataactttgtaaatccaagattcatgcacacgcctttcaatgtatgtgcacttcggaatgcgagttctgcattctgattttcaagtccttcttttaatccctggaaacttgtatcatccaaaaacttcaatacaaatttacggaccagtgtttcacttccaagtcttctcatcacatcatcatagtcactatctattgcttcatagcattcttctaaattcatttttgtttactccttaattttcttttatttcaatagtcccattaattcttcaaaacagacaccatccgtcaacggaatttccatttcaattgacttttgtatgcacttctttataaatgcggatgcctttcggacagattttgtaaattccactccattaactgcatctgctgcaatgattgcagagaaaatatctcctgtaccacatctggaatgtcctactttatgtgtacggatcatctcgtatcctttacctttttcatagcacaggttggatacatacgtcttctgtggaattcctgtaatcacaactttttctggtccggtctgcacaatctgttctgccatctttgccagctctctcgttgtccaccgttccttatacggtgttcctgtcaggatacatgcctctgtcacatttggaacaactacatccgcatagcggactaattgaatcatctgtctgcacatttcttccgtataagtcgaatatgcctccccattgtcccccatcaccggatcgatcacagccactgtattctcgtctctaaaatactggataaactcactgacaatccgaatctgttctgctgatcccaaaaaaccagtacaaattccttcgaacttcagatccagtttcttccattgttcaatatatgcttccatatttgatgtataatctgtaaaataataatcttcatatgcggtatgatttgaaaaaatcgaggtaggcactgcacaacactgcactttcagcattgaaataatcggcatctgtaccgcaattgagcatctgccaaatcctgtaaagtcattgatcagcgcgatttttttctgttgattatgattctgcatcattctattccctcgtttcttctatataaatagacatactaatttaattacaatatgtcatagatgtcaatatttcttttttactattctctttcaccttctgtgtaactgccttttctactataataatttcttattaaataatatctgatttgtttatgatacctcaaaaacattctgtttttttcacttttcactcaacgtattccacaatcactctctttatttttccgttgtttttatacaaaaaacacaattttccacatttttccttcttcaatgattttttacacctttcttccctcgttttcagtccgcttgacagtttcccctaaaaagtgtacggttacgttgtaaattctaagaaaattctatgaggtgaaaaaatgcaggaattaaaaccaatcaaagaaggtaaagttcgtgaaatttatgataatggagacagcttaatcatggttgctacagaccgcatcagctgctttgacgtgattctcaacaatgaagttacaaagaaaggaactgtcctgactcagatgtccaaattctggtttgatctgacagaagacattcttcctaaccacatgctctctgttgatgtaaaagatatgccggagttcttccagcaggaaaaatatgatggaaaatctatgatgtgtaagaaactcgaaatgcttccaatcgagtgtatcgttcgtggttatatcactggaagtggctgggaaagctataaagaaaacggaactgtttgtggaatcacacttccggagggattaaaggaatctgacaaacttcctgaaccaatctatacaccttccacaaaggctgaaatcggagatcacgatgagaacatttcattcgagcagagcgttgatcaccttgaaaaatattaccctggaagaggacgtgaactcgctgagaaacttcgcgacaacacaattgctctctataagaaatgtgccgaatatgctctgagcaaaggtatcattattgcagatacaaaatttgagttcggacttgatgaaaatggaaatatggtaattggagatgagatgctcactcctgacagttcccgtttctggcctgctgacggttatgaagccggacatggacagccatcttttgacaaacagtttgcccgtgactggctgaaagcaaatccagacaacgactggacacttccacaggaaattgtagataagacgattgagaaataccttcaggcatataagatgctgacaggaaaagatctggataaataagatttcataaaacaaacagggacgaaacgaactgcttaacaagcttttcatttcgtccttttttactacatttctgtaaaaagaaaacgaggatcaactcctcgctttctctctggtttttagtttgttgttttcaccctacctgtgtgatcttttgtgattgctttgattgcaagcagaactccaatctgcagagcaattccgatcacgagacagatgactgcattctgcaagatacctgcgatcacatatgtaatacaggaaactgctgctacagtcattgcatatggaagctgcgtagatacatgatttacatgattacactgcgctcctgcggatgccatgattgttgtatctgaaataggtgaacaatgatctccgcaaactgctccggccatacaagctgagattgagatgatcatcattgtctcgttcgtaccctggaatactgcaactacgattggaatcagaattccgaatgttccccaggaagtacctgttgcaaatgcaaggaaacatcctacaaggaagataattgctgggagaaggttcatcaatccgcctgctgctgaattcattacagaagctacgaacggagctgctccgagactgtctgtcattgctttcagagtccatgcgaatgtaagaatcaggatagccggaaccattgccttaaatccttccggaatgcaagccatagaatccgaaaaacgaagaacttttcttactgcataaaaaacaattgtaattaccattgcaaagaaacttccaagcatcagtccaaccgatgcatcacttccggagaaagcctctacaaagcctgttcctgagaagaacccaccagaataaatcataccaatgacacagcatacaataagtgacagaatcgggaatacaagatcgattacttttcccttattgtaaatcgcattttcggatgtattttcaaatggtctgtctcctgttgtaaaaagatccccttcaatcgcatttttctcatgcgccttcatcgggccataatcttcttttgcaagaaccagtgttaccatcattataattgtaagaattgcataatagttatatgggattgcacggataaagattgaaaatccatcctcccctttaacaaatcctgttactgctgctgcccaggaagaaatcggtgcaataatgcagattggcgctgctgtagcatcgatcagatatgcaagtttcgcacgggatacattgtggctgtctgttacaggacgcataacgctcccaactgtaaggcagttaaaataatcatcaataaaaatcagcactccaagtacgattgttgcaagctgtgcacccgctcttgtcttgatatgctctttcgcccagcgtccgaatgctgcggaaccaccggctttattcatcatacataccataacaccaagaattaccaggaataccagaatacccatattgtaagaatctgtaagaactcctactataccatcttgaaatacatgtaagatcgtagcttccggtttaaatcctgaccaaaatacacctccgatcaaaattccaacaaataaggagctataaacttcctttgtaataagtgccagtacgattgcaacgaccggcggcaccagagaccagattgttgcatagagctgaggtacatactcggcagatgtatctgcggcaaatactgttgttgaactacagcacaaaatgagcagagacatcagaaacacataccccatttttcttttgtttctcatttcctttttttcctttcctgtaaacttatgtttgttaagtttgtgtgtaagcatagtgggttttgcctgggattctctaaacacaaaaaatgccataggcactctctgctggtgagtcacccatggcataataattctagcgtcatcgatagctctccacacctgtgacagtccggcgtatcttctacatccggcccaggaatcatatctgggaatatcattccttcggcggcttctcctttctctcactgacagtcttcccaagactctcgtcagcggatactcatatcaccgcgcctctatcaaacgttactatattatcacattctatttaaaaaagccagacttattttataatagttttcatttttatatttctacatttttattaaacttctattaaataaagtaatagctgtcaatactctcatatcaacagctatcactttcgtttcctacactataaaattagtttgttcgaaatccgctcactacatgatatattcccgtctttgaaggcatccctgcaaatccttcctgattttccaacaataacattgttccgtctgttgaaatataaacacgataatcttctgaccagttaacaggattttctccctcataataccattcaccacctgtccgcgtactttgtatagacaaataaggatgtccatcctgctgcgtacatgaccaggttccttcataaatttcataaatgatatcactatagtcttctattccgtattctttctcactccaggaaatacgtgcatatccgttgtctaataattctacaaaataatctccaaatatatcactattatactcatctactccgaattcccaacagctgcctatcagatctgcttcctgtatgttctcatgtacatctccataccaatctataaaacgacttgcatcacatgctttatagtctgtaaagtcctttgcctgctctacattattctccgttgttggcagccagacatgtccatctgttcccattatcggcacccagtcagcctgatatccggcttctgttcccatagataccatagttccaccaataccttcgttctccccattacacattaccaggaacggttcgcctgtctcagactgatataaactctccacaatctccgatatccctgtgtcataattcaattccattcgacctacactaactggatcctcgccacttcgaggtacaatgcagaaaagctccgccggaccatgaccacagattcgatccgtaccgatttctttaataaatgtcattttacttaacaggtcaggatacttcttttcaatccattcctgcacatgatcaacataatccgcctcaacatatcccaggtatgctactgcaaattgctgtaatgtgccatccatactctttcgtagattcgcaagagactcctctggactgataggcttatctgtatctgttgtttcaggctttttccccgaatccggtttctttgttttcttctgtttctttgattccgcatcctccttttcttctttcgaatcacccagccttatctgctctaatcccggtatgtcaatttttatctgacagcccgtcaaggtaaacataagcagcagacaaatcattcctgttacaattcgtctaattctctttttcgtagttctcataaaaagtttcctcctatccgttctaaacaattattggaaactcctatttcttaacttcatcttaccatatcgttatcattaaagatacttaaagttatatatttcccataaacaaaatagctgcttcccctactcagagaaacagctactataatcactgaaagatgattcatctaaaatctgattttttagttcattgaaccgtgcgtacgggtctcttatacagatctacagcttatattccaactttaactatggtgttgtgaagttcaatcaactttcagcatccgataccccacgccaatgtgtgtttggatatattgtggagagtttggttctttctcgatttttttacgaagtgttgccataaacacacgaagggaagcaatatcattatcccaactacttccccaaatgctttgcgtaaggaaagtatgggtcagaacttttcctatatttcttgtcaacaggcaaagcaacttatattcaataggtgttaaatgcaactcttcttcattcaaataagcacaacctgcagcataatctacacgaagttttccgtttacaaaaacaaccgcttcggcaggggatactttttgcatcatcgataaccttctttgcgtgactcgtagtctggcaagcagttcctcaacagaaaatggctttgttaaataatcatctgcgccagcatccaacgcatcaattttatcggtatcttcactgcgagcactgattacgataattggcacatttgaccaagtacggatttttttaataatctcaacaccgtctatatcaggaagtcctaaatcaagtaaaacaatgtcaggattgtgtgaagatgtttctaaaattgccgattgaccatcgggtgccgtcagatatcggtattcgtgcgtttttaaggttgttgtaattaaatttctgacagatgtgtcatcttctacaactaatattagtgacttattcatatactttgacctcccctgccggtaatgtaaatgtaaatactgttccgtgcggcagattatctgaaacagtaagttctccgccgtgggcgttaataatggacttgcacaaagataatccgagtcctaaacttcggcggctgtctgcaatttgatttgcaccgctatagaacatgtcgaatatccgtggctttatttcgtcagcaattccgtttccgtcatccgatatagatacgattgcttgttttccccgcttttctgtccgaataacaatatgagagtttttaggtgtatatttgatagcattatcaacaatattgatgattacctgaacaataagctttgcatccatttttgcaagaagaaattcttctttgctttcaacggaaatatgatgttcttcactctttcggttaatatgatgtaacgcttctgtgatcacgtcatccatcaaatcttccgttatacgaagattcaaccgtccttcttcaatccgggttacagccagcaagttttctacaagattaatcagccacatggaatcatcataaatatccatgtacagctgcttttttgtatcattatcaaagaaatcaccgttggacaaaagattgctggcattaccggaaatggatgtcagcggtgtcctcaaatcatgtgaaatagcacgcagcaggtttgctcgcaactgttcattttttgcaagaatggccgcctcctgtttctcacgggcatttttctcattttccaaagccagggcacattctccgagaatggatagtagaatactgttttcaaatggatcaagaggtatttcccccatcacgattccaataactccatataccatactgctgctgcgaacagcaaggtacaggcattttgcattggaaagcgttcctgttgtagctccggcacgtttattgtttttcaatacccagccggcaacggccttttcattttcggaaatacacgattccaaattttcttcagttacagaaaaaatatgcggcgtatccaacacttctccatcagctaaataaaaaacgatatcttttctcaaaagtttaatgagctgatttgaagttgccgatacaatttcatttttatcttttgcctgttgcaatagctggtttgtatcaaataacactttggtacggtaagcagattgtgccgcctgttttgcttggtttttaatccgtatagcaagagaactggttaaaaatgccgccaacaacatgataataaaggtaacaggataaccctgatcatacgcctgcaaggtaaattgaggttccgtaaacaggaaattaaagaccaaaacacttacaatcgaggaaattaggctatatatctgatgtttcgtgatgacagcggtgacaagaacacctaaaacaaaaacagtaatgatatttgctttatcaaatccaaatttctggaaaatcattccgactaaactggataaaatcagaatcgcagtagattttaatgtatcagtgacagagaatacgatatgattctttttcctgccccctcttaactgatacactgccgcattagaaaccgtatccggaataatatgcacatccaggttaggggcataatcaatcaatttttctgtcagagtcggtttgctgagcaaatgccgttttgtagcagagctacgtccgatcacaatctttgacacaccggacaaacgagtaaattccgcaatctgaaacggaacatcttctccgtaaactgtttctatttttgccccaagctgctcagcaagacaaatatttgaacgcaggcgttttacattttcctcgctcatcaccgaaaaatctggggtttctacaaatagagccgtaaactcccctttaaaagcagaagccatttttgcggcagtacggataattttcgcattggatggagaagaagatagacatacaagaatatgttcgcctgtgtgataatctccatgattttttatgcgggtattttctgtgaggatattcacccggtccgcacatcgccgcagtgaaatctcccggagagctgtcaaattttctattgtaaaaaaattttctactgcctgcttttcctgtgtctgtctgtatacatttcctgtattcaaacggttgatcaaatcctgtggttcaatatctattaattcaacctgatctgcattatcaaaaatagaatctgggatgcgttcccgtacaacaatttccgtaatggatgcaactgtatcacaaaggctttcaatatgctgaacattgacagtcgtatagacatcaatccctgcattcaaaagttccttaatgtcctgataccgttttgcatgacggcatccttcggcattcgtatgcgcaagttcatctacaaggataagctgtggttttcttttcaacgccatgccaatgtcgaattcgtccagtatcataccattataaaaaacttctcttgtaggaagaacttctaagccattcaaaagagctgctgttttgggacatgcgtggggttctacataaccggctaccacgtcaattccctgctgtttttccatatgagctgcttctaacatggcgtaggttttacccacaccagctgcatatccgaaaaagattttcaaatgtcctttattacgtttttcttcatcagcttggatttcctttgataactgatccggattatgtctgctttcactcatacggtcatctccttgtacaaaaacattatatagaataatacgtaaatttcagaaaagcattttagcactgacattaaaatcgcataaagattataccaccttttcttctttttttccattcgggcgtgtaaccgaaagcagaaaacgctccgaaaaatcacgcaatttttcgacaaatagacccttcatacaattaatgtcattttgccatatcactctcgctggtttctcaatcatattgatgggatgtaccgcaatgtccatagagcctggagtaatgacactttgctttatttgaaaggataaggaacaatactcatctttcaaaatatcgttggaattttctatgataaagccaaaatcaagtttattattttccagcccatttattatttcacttacagaaccgtagaacaggttcagctcatagtttgggtattcgcttgaaaattgttctaatagatctgcaatagaatctatgattgcaggtgtttcaaatccaatcctgagcttagaatctgaaataagtttttgggattgattttccttgagaaatttatccagcttttccataagaaaataaccataaataaatgctaccaataccactataagtaaaacaaagtctttcatatcaccaacttctttcaaaaattaaatatgaaaacatttttgaatatgtttcgtctccccaagaacaagcatggtactgccctttaacaactgcgtatcggaacttattttcaaattcataatatcatttgttttcagcgccataatattgatgtcatatttttttcgtatatccaactgaccgattgtttttcctatccattctcccggtatagatatttcaaagattgcatgttcttcatctagttctatgtaatcgaaaatatgatcagcactataacggatcgcaacccaatcggcaagctgcctttcgggataaacaatttcatctgcgccgtttcgtaaaagaaattttgcatgaacatcacgagcggcacgagacaccaccattcttgcaccgagttccttcaaaagggacgttacttccaatgaactctgaaagttatctccgatagccacaatacaaacatcaaaatttccaacaccaagcgaacttaaaaaatcctcattagtcgcatccccaatctgagcgttagttacaaagggaagtacagcatcaactcgagtatcttctttatctaccgccatcacatgatgatgcaattcatctaattttatagcaatgtgccgtccgaatcttcccagaccgataagtaatattgatttcatttttttattctccttaacctactgtaattttttcctgaggatattttgaaccgttagacttttttccagaaatggtagcaaaaatcaaggtcaatcctcccactctgccaaaaaacatcaggcaaatcaagattatatgggaaacaagccccaggtcaggagttattcccaacgataaccctaccgtcccgattgccgacgccgtctcaaacaaagcggtcataagtggaatatcttctgttctgcaaattaccattcctccgacaaggaataaaacgatatacatcaaaaaaatcgtagctgcatttctgatagtgccatccggaatttgtctgccgaaaaaatgggtgtgttccttttttctaaatacagataatgccgatgaaacgagaactgcaagagttgtcgttttcataccacctgcagtggaaccaggcgagccaccgatgagcatcagcataatgataagcatttgcccaacttcactgagtaaagtcaaatctgccgtattgaatcctgctgttctcggcgtaacggattgaaacaaagaaacccatactctttctgtaagaggcacatttgaaaactcaaaataaaaaaagtaaagagccggtaagaatatcaatattcctgttaccataaaaatcaccttgctttgcatccggtatttttttaaatgccatttatgattctttatatcctcccaggtaaggaatccaatacctcctgcaataatcagcatcataattacaagatttacaatcggctgtacagaataagaggtcaacgaggaaaaaggggttcttataccgattagatcaaatcctgcattgcaaaaagcagaaatagaatggaacagtgaataccatattcctttccaaaacccaaagtccctgcaaaaaacaggggctaaaagaactgcaccaatgatttcgataagaatagtagtccgaataataaattgcgttctccgcacaataccccccaccgttggagccgaaattgcctcttgcatggtacttcgctgcatcaacccgattttgcgtccggaaacaacagcaatcgcaatagcaatcgtaataattcccatacctccgatttgaatcagcagtaaaataactccttggccaaataaagaccagtaggttgccgtatcattaacaaccagtcccgtcacacaaaccgcagaagttgcggtaaacaaagcatccaaaaaggaggtacactgaccgctttttgtagcaatcggcagcatcaaaagcagactgcctaagagaatcgcggataaaaaccctaaactaatcacttgaaatgatgttatatgtcgatgtcttgatctgtttgtctgttgcataactatatccccatagtcttaatttcttttttatattttctttattttatctttatttgtattaaatgggcgtaagtaagtttgttttgaaattaagattgtgtaaagatgagcagaagtctgaaaccttttgctcatcttttgagaggggagatatgctgatcaagttcgctgccggaacaggtcacaagttcaaccggaatggctgtttcctccatattgggatttgccttacgaggcatctgcacccggctcgtgattctctgatgaacacatttctttcttctttgccattttttattttctcctttacctttgaataaaagaaaaggacactcatcttccagaagttctgaaagcaagcgtcctttcggtttttcttgccctgtttacctgttggtgtgaaactcatatacctcgtaaagtgcctgaatctgagaatttctatgaaattctcagatcgcgtacattcgtcaaattccgcataaacactggctttacagccagttgtttcttcggaactctcctcattgtcttcgcggaaattaaggacttctacgaattcacccgatgtagacaacacacgacttcgacatgcacggtctcgcagaattgatccaccgccgtcatcttctccacgcgatatcctgccagctgcatcatctccaaatctcttgccaggcttgtcatcttacaggaaatatatacaatcttatccaccccataattcaagatcttcggaagtgccttcggatgaattccgtctctcggcggatccagtacgatcacatccggcttctcttcaatctcatcaagtaccttaaacacatctccggcaataaatctgcagttggaaagtccgtttcggacagcattttcttttgctgcctcgactgcttcttcaataatctcgacaccgatcactttcttcgcaaccggagcaagcacctgaccgattgttcctgttccgctgaacagatcgaatacaacctgattatcaatatctccaatgtattctcttacagtctcgtacagcacttctgcaccttttgagtttggctggaagaaggaaaatggtgtaatcttgaattccaatccaagaagcttctcgtaaaagaagtcctgtccataaagaattcttgtctcatcactcttcacgacatcggacagagaatcattcaatatatgaaggattccaacaatctttccttctaattctaatgccagaagttcttctactaatggagttaagtcatattcttcctgcgttgtcgttacaagattcacaagaatctcgcctgttgtatcgcctcgtcttaaaagaagatggcggagataaccgacatgctgcatttttttataataacttacatttctttctttgaaataattaagcacacaaagaagaatcttatccatatcttcatggacaagctgacagtctcctgctgtcagtacatcataagtacttccttttttatgaagaccgagagataacggaccgtctttgaattcgtctccgaaagagaattccatcttgttacggtaatgaaattccttcgggctgtgcttcacaccctcaaaaagatactcgccctttactaccggatccataatcctgcggatctgcccttctttcatcttcacctgttcttcgtatggcatcgtctgatacatacagccaccacaggccggaaagatactacagaccggctctcttgtctctaattgagatttctccaacacttcaagaagtcttccttctgcatttcctcttttaaatttatttatcataaaacggatcttctgtcccggaatcccatttttcacagtaacatactgttcttcctccgcaacaaatacaatccccttgtttgggaaatctacacgttcaataataccttcgtagatctgaccttttttcatcctattctcctatcaattctaactttgtaactgttcagagtagttactctaatttattttaacagaaaaacagacaggatggtttcttctctcaccctgtctgcacttttacaattcactcaagaattatacctgatcatcctcgctgaagtaatcatcaaaatcgtcatcaaaatcatcttcaaaatcatcaagataatccggtgatacgaaacgatatactgcataagcgattgcagctactgctgctactgctccgatgatagccagtgtccagattactgtgttcttctgcttctcagcctcattcttatgaagaatctcgttcaatcttgtttctgcaatgatgtcttctattctcttgttcatattaacacgtcctttcttcaccttttgcggtgacagataatctgtgtttattataacacctgacgattcatattactactgatttatcatttttttataactttctcatacctttacaagcctggcaaattttgcaaacatcttgcgtgttccgacactgtcaaattcaatcgtaacctcgtgatctcgtccaccttctttgatatccgttactgttccttccccaaacttcacatgacgtacccggtctccgacctcataaccaagtggaccattcccacctgctgccagctgactgcccttctgcagagatgccagtgcctgacttcctgtaagcggcttacctaccccctgattctttgcaggtgtcattccgccaagtactcctgcgaatgcctgtgcccgaaatgcttctctggcacgtgcatatgtattctgctgtactggcatctccgtctcctgggtaaacttcttgtttcctgtatcaagcagttccctcgggatctctttcacaaatcttgacatcggattgtactgtgtctcaccgtgcaccattcttctgcgcgcacttgtcaaagtcagttcctcctctgcccttgtgattccaacataacaaagtctccgctcttcttccaattcttctctgtctcctgcattaatactcatatatcccgggaaaagcccatcttccatccctgcaagataaacacgtggaaattcaagtccctttgcactatgtaaagtcatcagaacaacatattcctggtcttcatctagactgtcaatatccgcaaccaaagcaacttcttcaaggaatccgctcaatgttgccttttcatctttatcctgacaactttcctcataagttgccgctttactgatcaactcgtctatattctcttttcttgttttcgcctcttctttatcttcattttcaaggctttctatatatcctgtcttctcaatcacttcctgtaaaagatctgtgatgttcatctcttctgccaacgtcttaaaatactcgatcaatgccgcaaaagagtccagttttgttgcacttcttcccactcctgcgatcagccccggtgccagtaatgcctcataaaaaccaattccacgttctgttgcagactcctgaatccggttaattgttgtaagaccgattcctctctttgggacattaatgattcttctaaccgcaacatcatcacgtccattgtcgattgtcttgagataagcaagaagatccttaatctctcttctcgcatagaaatttacaccgccgacaatcttataaggaatattcatagcaataaatttctcttccagcagacgggattgtgcattcgtacgataaagaactgcactgtcattataggaacctccctgtctgacagcacttttgatatcttcgcctatgaaatccgcctcatcaaatgcagtatcaaactgacgcagacggatcagttcaccttctccgttctccgtccaaagtgatttctcctttcttccgcggttattcgcgatcacactgttcgctgcattcagaatattccctgtagatctgtagttctgctccagtttgatcacctttgcatccggaaattcatgctcaaagtcaagaatattccgtatattcgctccacggaacttgtagattgactggtcatcatctccaacgacacaaagattcttatattttcctgcaagaaggcttaccagctgaaactggactgtatttgtatcctgatattcatctaccataatatagcggaatctttcctgataactctcaagcacatccggctgtgtctgcaaaagctgtactgtctttacaagcagatcatcaaaatccagtgcattattcgctctcatctgcgcctcatactcacggtaaaccttagcaatcttcatctttgcaaagtctcctccggcattcagttcaaattcatctggaaggatcatctcattcttggcagatgaaattgctgaaagcagacttctttctttaaacactttcgtatccacatctactttccgacagacttccttaatcaatgtcttctgatcatctgtatcatatatcgtaaaatgattctcataccctaatctgtcaataaaccttctcaaaatacgcacgcacgcagagtgaaatgtactcacccatacactttccgctccaaaaccgacaaggttatccacacgctggcgcatctcttctgctgctttgttcgtaaatgtgattgcaagaatattccttgcgttcacgtcacgttctccgatcagatatgcgatcctgtgcgtcagaactcttgtttttcctgaaccggctccggcaaggatcagaagaggaccgtccgtgtggtaaacagcctctctctgtggttcatttaatttatcataaatgctcatctttccactcctttaaagttataaagatatctgtaaatgtattcccattatcaaacacacgttcctgtttgtcaactacattttccggccttcttatcttttgcttgctatctagttttaaatactatataataaatgtattgaggtgataacatgaatatagacacaagtaatctgttaaacagcattttggaagaactttcttctttaagttatgtgcatcccggcgatgttccgaatattgatctttacatggatcaagtaactacttttatggatgaacagctggcttcgaccaaacgttaccctgatgataagatcctgacaaagaccatgatcaataattatacgaagaacaatcttcttccacccccggtgaagaagaagtattccagagagcacctgctccttctggtcttcatttattattttaaaaatatcctttcaatcaaagatattgagacagttcttgcaccgctcacagagaaatattttccggatggaagctcttttgaattagcggatatttacaaagaagtctgcaagattgaaaaagaacagctggattccatcaaagagaatgtaactgctacttatgagaaatctgctgagactttcactcatcttgctgatggcgaagataaggagatcttacagcagtttgcatttatatgcagcttgagttttgatgtatatatcaagaaaatgatcattgaacggatcattgatgacctctcttccaagtcttcaaaaaacgaagagaaaaagaaagggaaataaacatttctgtttaaaacgagatacagcctgcgaaagactttatcaggatcttccgcaagctgtatcttttgattgataaaaggtattttattgtaagcttaattcttaagtgttattcttccgttccattctcttcctcagcaagccctacacgtttgaaaaccatatcatatccgtcattcccataattaagagaacggttcacacgactgattgtcgcagtggatgctcctgtcttctccgcgatctccaaatatgtcttctgttcacggagcattcttgccacttcaaatctctgtgacaatgaaagcagctcattgatcgtacagatgtcttcaaaaaatgtataacactcttctttattctcaaggcttaagattgcctgaaacagataatctactgcctcggttctgatcttcttactcatacgaaacaatctccttctcaaccggctaattatatgatggcttacggcataccataaaccataacaataccttttgccttctcaggccactttttgattttaacacattaaatttttaaagtccaccatttcttatgaatttaaactaaattcttgcacaattttaatttttttctaaaacattttatgtaaaacacacttttttcgttgttcttcctcttttaagatgctataataaatctgttataaatattttgatacaaaagagaggagtacatgattaatatgaagtgcccaatatgtggaaaagacctggatttgcagaataagcagattggcaccagcgaaaacggggatccaatctttaatgaatatgcaatctgccatagctgtaaaaagcaatggaaccttgataaacaacgtgcaaagaagatcgctgccaagaaagccgcagaagagaaggcaaaagctgaggctgaggcccgcgctgctgaagagaaggcaaaagctgaagctgccgcccgcgctgctgaagaaaaagcgaaagctgaagctgctgcccgtgccgctgaggagaaagcgaaagctgatgctgccgcccgtgccgctgaagagaaacgagctgcccgcagagaagcaaaagcccgcgcccgcaaagaagcgattgcccgccttgctgctgacaaagggatttcagaagaagaagctgaacgtattcttaaggagagagccagagcccgcaaagccgctgcacagaaagctgccactgatgccactgccactgataattccgaagagcagaaatatgggaacattccagcggaagaaatccgtgataagcgtgaaaaagcagttcgcaagggatacgaagatatgcttgcaactgaccctgacagtaaagttgccaagaagaaaaagaaagaggaagccgaaactgctaaagcaaaagaagatgtaaaatccagaaaaatggatgactatgatgatgagaaatcctctgatgatgaagatgatgatgaatatgaatacgtagacgaatatccacgtttcagacctggacgcatcatccttggaatcatttccctgcttgcatttggtttctgtatttataaaggtttcgtaacaggactcagcacatcaggagctgacgtaacttctgctcctggcatgaattatgtcattgttgctctttgtatgcttgtcactgcactgttatacttcatcatgaataaccgtgatacactttttgcattccttatcccgatgattgtctatatcggtagtgctgtttttgctttcctgaaacatggagatgaattcgagcttctgattttagccggtgtaagtggtgtacttgctgttatttcactgattctcgcaattgcttcccgcggtggagatgattacgatgatgaagatgattacgacgatccatttgaagaagaacacgataattaaaatcgcgttgtaaatctttttggtttctaagaacaatttatataagataattacaagggagtatcattttgcggtacttccctttttttgtcctggtatgcatttttcatatcatatatctaaattttttttaggtgtcaaaaacttttttagaatagttgttgctttttgttgaatatgtgataaaatataaccataggtatctttatataattaaaaatacacaacaaacacatactcctcaaagatttttctttggggattttgtcacaaagaaaggagtaactgacatggcatcatttatagtaaatggtcaggaagtctcaccttcaaagaatcagaaactgttacggttcctgcgtgatgaactgcacattacctctgcaaaggatggttgcagcgaaggcgcttgtggagcctgtactgttatcattgatggacagacttgcaaatcctgcgtacctgacacagattcattggccggaaagaatgtcatcacagtcgaagggctttctgattgggaacagaaagtttacacttatgcttacgggaaggcaggcgctgtacagtgcggattctgtattcctggtatggttatgtgcacaaaagcacttttggatgtaaatccggaaccaaccgatgatgagattcgctatgcgctgcgcaacaactattgccgctgtacaggatatgttaagatcatggacgcggtacgtctggcagctaagattctgaaagaaggagttttaccagatgacggagatcctagctggactcttggttcccgtgtttctcgtatagatgttgaagaaaaagtgcttggaacaggtaaatatccggatgactattatccggaaggaatgctctatggcgctgctcttcgtagtaaatatccacgagctcgcgtactttctattgatacctctgctgccgaggctctgcctggcgtagaagcggttgtaacagccgatgatattcctggggagaataagatcggacacttaaaacatgatcagtattcactgattccggttggtggactgactcattatctcggagatgcaattgcccttgtagctgcaactgacatggcaactgtagaaaaagcaaagaaacttattaaagttgaatatgaagtacttcctcatgtgcatacagtggaagaagctgctgctccggatgcacctcttgtttatgatgaagaagagactaacgtatgtgcttataagcacatcagccgcggaaatgcggaagaagcaatcaagaattccaagtacgtgatctcacatcactttgagacaccttggactgagcatgctttccttgaaccggaatgtgctgtttctttctatgatgaagacggtgacattttcgtatattcaacagaccagtccgctcaccagacattgcacgaagttacacttatgcttggaacagataaagtaaaagttcagaacgcattagtcggcggtggtttcggtggtaaagaggacatgactgttcagcatttaagcgcattgcttacttacgtaacaaagaaaccgatcaagatgaaattatccagagcggaatccttgcttgttcatccgaaacgccacccattctacatggatatgacaatgggatgcgatgagaacggagtgatccagggtgtaaaagcgattgttaaatctgacacaggtgcattcgcttctcttggtggcccggttcttgaacgtgcatgtacacatgcagcaggaccttatcattatgaaaactttgaaattgaaggaactgcttactatacaaataacccacctgccggagcattccgcggatttggtgttacacagacttgtttcgcaacagagacacttctgaacatgatggctgacaaggtaggcattacgccttgggagattcattaccgcaatgcgatccgcccaggcgaagtacttccgaacggacagattgtagataactctacaggtcttgtagagacactggaagccgtcaaagaagagtatgatgctgcacttgcggccggtaaggctgttggccttggttgtgctatgaagaatgccggcgttggtgttggtatcccggacacaggacgtgtaaaattaattgttgaagaagatgaaaaacttcatatcttcaccggtgcttcctgtatcggtcagggacttggtactgtacttgtacagatgatcgttacaaatacagatctttcccatgatgatatcgtctatgagcgaagcaacacatggatttcacctgattccggtacaacttccggttctcgtcagacacttgtaactggtgaagcgtgccgcagagcatgtgaaaaattcatggaagcgaaaaacagcggtaagtccatgaaagatatgattggagaaactttctacggagagtatctcgctaagactcatccacttggtgcagatgtgcctaatccgatatctcacgttgcttatggatatgcaactcaggtctgcatccttgatcctaagacaggtaagattgagaaaatgattgccgcacatgatgttggtaaagctgtcaaccctctctcctgcgaaggtcagattgaaggcggtgttgtaatgtctatgggattcgcactcagagagcagtatccaatcgatgaaaactgtaaaccaattgacaaatatggttccttaggacttttccgttctcacgaagttcctgagattgaagcaatcgttattgataaacctggtctggatgttgcctgtggagcaatcggtatcggagagatcacatccatccctactgctcctgcaatcgcggatgcatattgcagatttgacggagaaagacgctacagccttcctctttctaacacaccatacgaaaggaagaaataatcatggcaattaaaaagagatttccttaccgggcagctctggttgcctgtaacggtggctgccgcgcagccggctctgaagacggtggatgcaaagatggctgcatcggatgtggagcctgtatagaaaaatgtaaattcggcgcgatttccatgaatgaatatggcgttgccgaagtagacgaagaaaaatgtattgcctgtggacagtgtgcaaaagtctgtccgcagaacctgatcaaaatccacgactgtgcaaactacattgtagtaaaatgctctaacaaagaaaaaggagctgttgcacgtaagcagtgtgaagtcagttgtattggatgcggtatttgcgaaaaaacatgtactgcaggtgcaattcacgtagaagataattgcgcagtaatccaggaagacatctgcttaagctgtggaatgtgctctgtaaaatgtccaagacatgtaatccatgatctccgcggagtatttacagcagtaagataatacaaaagctatcgactacgataacaacacagatatgtgttaagttattgtaatcgatagcttttttatctactcatcttcatccagaaactcgatatcatcatcgtcatcaagataatctaaatcatccagatcattcaagtcatctaagtcatccggatcttcatcaaaatcataatcctctgtcgcatctgccgcatcagcagttacttcaatttcgacgtcttcctcccagtcttcctcgtctacatcaaacttctcttctttaaacttctccacttcatcctcttccagatcatcttcaagatcatcaaattcatccatgctgacaactgttgtgcccttgtcttctttcaggacattttccggaagactctctataatctcatccagctcatcaaaatcatccagattttcaaccagtgcccttgccttctcgacttcattttctgtagaatgttcttcacggatctctgcggctttaagtaaattctttttcttacgttttccggattccaaaagaagctggatccagatactaagtgcaccaattgcagcacaaagtgccacatggatcattccgtttttatatggctgcagataaaagatactgctgcccgctgccattgctccaaacacagaagaagaagcaatcagcataaagttatgaaacttaatagaaagcaatgcacacacaagaccaatacccgcacagattccatagataataaaatcctgtggtttcatcaaatgtacactgacaacaaagacgagtaccgctactgtcacaaatccaccaatctgcttcttccatgcaccaagcaccgccaatacaagtcccacacctgctcctgccgccaatgcgattgtctgatccagatctgcaatcactccgaccgcaattccggctgcgcatcctgctgacaatcctgcgatcacagaccagaaacgtaccagtttcagccccgtcagacataacagtaccgctccggccattataacgatcagagaaataaattccatctgactcaaatgatgactgctttcattaagtccagccagaacaacatccaggtcaaaattcagaattgtatcaatcatatcatttacattcattatttacaccttcgtcccttactatttattactcactactgctcattttagcaattttttttactgattacaagtgttcatttcacctttccattgacttcttattcttctccacttaaaatagaagagaaatgctattgctgaccgcataatactgtgaacagcaataaaatgctaacataaaggagtttattatggaacagttaagaatacctgctggctatcattcccctcttacaattcgtgagacagaagtagccatcaaagaagtgaaagaccacttcgagcgtgctcttgcaaagaatctccacctgacacgagtgtcagcaccactgtttgtccgtccggaatccggtctgaatgataacttaaacggtgttgaacgtccggtttcctttgacatcaaagaacaggatggttctgttgcagagatcgttcattctcttgcaaaatggaagagatatgcattgaagaattataatttccattccggcgaagggctttacacagatatgagtgcgatacgtcgtgatgaagatacagacaacatccattctctgtatgttgaccagtgggactgggaaaaagtaatttctaaggaagaacgtaacacagagacacttcagtacactgtccgcaaagtctaccgggctctgaaagatacagaagaatacatttccagacgttacaactatatcgatcctcttcttcctgatgatatctttttcatcactacacaggagctggaagacctttatccggatcttactaccaaagaacgtgaaaaagcgattgcgaaggaaaaaggcgcagtgtttatctccaagattggtggcgtacttgcttccggcgaaagacatgacggtcgtgctccggactatgatgactgggagctgaacggtgacattatcgtttactatccggttcttgacatcggtcttgaactctcttctatgggaatccgtgttgacgaagactcattaaaggcacagctaaaagaagccggatgtgaagatcgtgcagaacttccattccagaaggcactgctgaacggcgagcttccatatacagtcggcggcggtattggacagtcccgtatctgtatgtattacttaagaaaggctcatatcggtgaagtacagtcttccctctggcctgaaaatgtagttgaagctgctgctgatgccggcattcaccttctctaaacacaagacagaccagccaattatatgataaaaagcagattcgaattctaccggagcatctctcctttgaattcgaatctgcttttttcattctcctcttattctacaatcagcaactgttctttctcttcctcagacaccctgttccaaaaaacattaaaatcatcaaattccggcaaatagatatctgccgtattccagatctgcgccagattcttgtcatttgccttatcataaactgctactgtcttaaatcccgcatgctttgccgttctcaaagcctggtaagtatcttcaaacacccaggtctgttccggctccgtatccagctgcaaaagtgctgcaaaataaatatccggctgatccttaccgcttccgatctcagatgctgtaaaaactccttgaaaataaggtaataccttcaatctgctcagagctgcttctgcattcttccggtcaccggttgttgcgatcaccataggaatcttccgctctctgaattcctccagatactgacgaaccccttctttcaatggaactcgttttgcataatagtcttccacttctttattcagtccctgtacaacctcttccactgtcttctccaggttataatgtgagatcagataatctgccgcctcctccaggctcatctcaaataatgtctcccccaggttcttctcggcctcaattcccaaatgatccagatacaattctccaagattctcccagacaggcatggaattgagaaggacaccatctacgtcaaatattacaccttttatcatgtcattcctcttttctgctatgcactacattataatctccctggaaacgcatgtcaaccgttactgttcacacgatgtgtgaccagcaacgcatctcgccattttaaatcgcctttggcgatgggcgagatgcatgcctgcggcggtcgcttgcgacacctaccttgtacgccgcagtgcgcatcctgagaggagcgttttttacatattaggaaaggactttcctaatatataaaaaagctgtgaaagataagtaatttcatctttcacagcttctatttacatatttattctatcaatcccagaattttggaatacaagaacaatcttacagctgaggacctgcagcaacaagtgctttaccagcttcatttccttcgtatttagcgaagttcttgatgaatctctgagcaaggtcttttgccttaacatcccattcagcagcgtcagcgtatgtgtcacgaggatcaaggattcctgtgtcaacaccctcaagctctgtaggtacttcgaagttgaagtatgggattgtctttgtaggagctttgttgattgctccgttaaggatagcgtcgatgattccacgagtatctttaatggagatacgttttcctgttccgttccatcctgtgttaacaaggtaagccttagctccgctaacttccatcttcttaacaagttcctctgcatattttgtaggatgcagctcaaggaatgcctgtccgaagcaagctgagaatgttggtgtaggctctgtaattccacgctctgtaccagcaagttttgctgtaaatccagacaggaagtagtactgtgtctgattctctgtcaggatagataccggaggaagtactccgaaagcatctgcagacaggaagattacattcttagctgccggtgcagaagatactggacgaacgatgttcttaatgtggttgatcgggtaagatacacgagtgttctctgttacgctcttgtcgttaaagtcgatctttccgttctcgtcaagtgtaacgttctcaagaagagcgtcacgaacgattgcgttgtagatgtctggctcagactctttgtcaaggttgataaccttagcgtagcatccaccctcgaagttgaatactccgttgtcatcccagccgtgctcgtcatcaccgatgaggagtctcttaggatctgtggaaagtgttgtcttacctgttcctgaaagaccgaagaagattgctgtgttctctccgttgaggtctgtgttagctgagcagtgcatggaagcaattcccttaagtggaaggaagtagttcatcatagagaacatacctttcttcatctctccgccgtaccatgtgttaacgataacctgctctttgcttgtgatgttgaaaagtacagctgtctcagagttaagtccgagctctttgtagttctcaactttagctttggaagcattgtaaacaacgaaatctggctcgaagttctcaagttcttcctctgttggctgaatgaacatatttgttacgaaatgtgcctgccaagctacttcaacgataaaacggattgccatacgagtatctttattagcaccgcagaatgcatctacaacgaaaagtctcttgttagagagctctttgattgcgatatctttaacagctgcccaagcttcttctgtagccgggtggttgtcgttcttgtattcatcagatgtccaccaaactgtatctttggagttctcatccataacgatgaatttatctttaggagaacgtcctgtgtaaacacctgtcataacattgacagcaccgagttcactttcctgtcctttttcaaaaccttcaagctccggttttgtctcttcttcgaataataattcgtaggaagggttgtatacgacttctgttgttccagtaatgccatacttacttaaatcaatttttgccatcttacatatacctctttctttctagtgatagaataaaatgctgctcatgcaagcttttcatatccttttttaattatacatattatgtgaagaaaatcaataaaaatcccgtaaattttttaacaaagaactgagaaaaatgaaagatttcatattaaaaatgcaagaagaaaaaagaaaaatgtcaaataatgaaaaattacaaggaaaatatgacagattccgttgcttttttatatatcagaatgaaaaaaattatgataaaataggagaataatgccagaaaatgcgaaaaaactggcttgtgaagttagaaagacaaactatagatcaaaagaaaataataagaaaagcagacataacaatggtagatgatgaaagaaaaacgacaaaaaatgaaaagatgtcgatgaaagaaaatgaaagattattgattgaaaaattcaaaacgataaaaccggtggagaaatcctatgaagaacaggcaaaaagacgatggaaaacagttgcaaaaccactgttcagcttaggaaaactggaagaagctgtgatccgaatggcaggaatccgaagagaagcagattttgagattaaaaagaaaggattactgatcttttgtgcggataatggagttgtttcagagggagtgacccagaccggacaggaagtgacagcaatcgttgcggacaattttacaaaatgtgcgacgagcgtatgtattatggcagagacagccggagtggacttattcccaatcgatattggaatggtgacagatgttccgtcggtgacagatccggaagaaaaagtgatgtacggaacaaagaatatggcgatggaacctgcaatgtcaagagaacaggctgcacaagccgttcttattggcatacgaaaggtcaaagagctggcagaacaagggtatgatctgatcgcaaccggtgagatggggattggaaatacaacgaccagcagtgctgttgtgtccgttctgcttgatgaaagtgtagaaaatgtgacagggagaggcgcaggccttagttcagaagggctgaatagaaagattcgtgcaattgagagagcaattgaaaagcatcagccggacaagaaagatattttagatgtcttgtccaaagtcggagggcttgatattgcaggaatgacaggtgcatttctcggaggtgcgatctatcatattccggttctgattgatgggttcatctcttctgcagcagcattgtgcgcagtgcgtatggttcctgagacggcggattatatcctggcatcacattgctctggggaaccggctgggcgaatggtcttagaagagctgaaacttccatatctgattgatgcgaagatgtctcttggagaaggtagtggtgcagttgcagcaattccacttcttgagatgggtgtgaatgtttatcggaagatgagtacctttgaagagattaaagtagagcagtatgaagaacttaagtgaagatgaggagtaagaaaaatgtggttattgaacgcaatgatcattgcaatcgcaatgtattctaagattccgatgccgcgggttgactggaatgaaaaaaatatgagatatgcgatgtgctttttcccattggtcggagttataattggagtattggaaatagttgccgggaatctgatcacagtatggaggggagaaggaaatttcttttatgcagttgtattgactttgattccggtttttataacaggaggaattcatctggatggattcgcagatacaatggacgcaaaaagttcttatggagaccgggagaagaagttggagattctgaaagaccctcatacgggagcatttgcgattatcagtctttgctgttatttccttctgtgtgtggggatttttagtgaaatgagaacagaacacctgtttgcggcagcactcgtgtttgtgttctctcgttcgctgagtggaatttctgttgtgacgtttcaggcagcgaagaacagtggactgcttcggacatttcaagacggtgcacagaagagaaatgtaagaattgtattgatcatatggctattggcagccggagttggattctatctgacagcaggtttatgcggagtggtagcagcagttgtcggacttgctgttttcttttattattatcagtttagcagaaaacagtttggaggtattacgggtgatcttgccggatacttcctgcagttatgtgaactgtttatgctggcagtgcttgcattattctagaaatgttattgcatataaatgttttatgatagatgctttattatagaaatgaaaatgaaataaaatagatttttttggagtgatttatggagcttattttgatccggcatctgaagacaccgggcaatgaaaagagacaatatatcggaagtacagatgaagaactgtcagaacaggaagtactgaattttaaacagaaatataaaatagatagctatccacaggtacagcaagtgattgtcagcccaatgaagagatgtattcaaacggcagagttgatttatccgaagaaccagatcacgcaggaagtattgttaaaggaatgtgattttggtatttttgaaggtaagacatatgaagaactgaaagatagagaagaatatcaggcatggctggattccggtggaacgattgcatttccggaaggggaggaacagaaggaattccgttcacgttgtgtgagaggcatgctctgtcaggttgatagattatgcaaagaaaatgtagaaagtgcagcttttgtcgttcatggaggaacgattatggcggtgttggaacaactggcggaagaccaaaaagatttttatcactggcaggtggaaaatggcggaggatatagaatgcttgttgacgaagaagagtggaagtccggcgttcacagattttatgaaattcaaaagctgggaggagtgacagaatgaatggaaggatgacgattctggcatgcattacaggatttctgttagattgcattttcggagatccggtctggatgtatcatccgatacgcgtgatcggaaacctgatcagtgtgttggaaaaaggattgaggaagttgttgtgcagtcggattcctgcgtcagaacaagagaagaaaaacagaagagaagttctggcaggtggaattttatggattctgacagtttcattatcctttcttgtaccggcggtactcttatttgctgcaggaaaggttcatccggcagtacggtttcttttggaaaccttctggtgttaccagatatttgcggcgcggtgtcttgtaggagaaagtaggaaggtttatcagaaattaaaagaagacgacttgcctggtgcaagaagagctgtatccatgattgtcggaagagacacagagaaccttacagcagaaggtgtgacgaaagctgcggtagagacagtggcggagaatacttccgacggcgtgacggctccgcttttattccttctgatcggtggtgcaccgcttggattcttatataaagcagtgaatacgatggattctatgcttggatacaaaaatgaaaaatatctgtatttcggaagaattccggcaaagatggatgatgtatttaattacattccagctaggttgactgcgtggtttatggttgttgcagcatttttgacggggatggatggagagaatgcgtggaagatttatctgcgtgataagagaaaacatgcaagtccgaattccgcccagtcagaggctgtctgcgcaggagcacttgatgtacagttagccggagatgcggtttatttcgggaaagtctataaaaaggattatattggtgatgcaatccgtaagattgaaccggaggatattcttcgtgccgggaaattaatgtatatgacaacgatactgatgatggttgtctttggaggtttattattatggatttattgattcgatttgcaaaaatggaagatgcagaagaacttctggcgctctatacaccgtatgtaacggatacagtgattacatttgaatatgaagttccgtcactggaagaattcaaagatcgaatgcgtcagacgatgaaaaagtacccgtatctggtcgcagaacagaatggcgagattcttggatatagctgtgcaggggcattcaaaggtcgtgcggcatatgactgggcagtggaaacaacaatttatataagaaaagaccggcagaaaaccggagttggtaaaaagctgtatgaggcactggagaaagtactgcacgctcagaacatttgcaatctatatgcatgcattggatatccagagattgaagataaatatctgacaaagaacagcgcacagttccatgcacatcttgggtaccgcatggtgggagaattctatcattgcggatacaaatttgaccgctggtataatatggtctggatggaaaagcttctggatccggagattaaacatccaaagccaatcaaatggatggaagagaatcgcgaggaactggaggcagtacttttagattaaaaatgacatacatagagaagtaggggtaagattcatggaatatgtacacggaggagacatttatacatatggtgatgtgctggatttttcagttaatgtaaatccttacggtccgtcagaagaagttcttgaagcggcaaaaagatcgatggatgaagtgagcctttatccggacagtcaatgcagacggctcagaaagagactggcagagaaaaaaagtctgccggaggaatatttccttttcggaaatggagcagcggagctgttcttttctgtcgttcttgcagaaaaaccagagaaagcacttcttccgattccggctttcgcagaatatgaacaggcacttcggacggtagactgcgaaattatttatcatgagttgaaaagagagaataactttgcattgacagaaagctttttggaagaactgacagaggatattgaccttgtatttttatgctccccatcgaatccgtcaggccaggtgattgaaccaaagctgatggaacagattcttacgcgatgtgaagaaaagaagatacgtcttgttttagacgagtgttttattgaatttctggaagaagcgcagaaatataccatggtgaaaaaggtgacagatcatgcgtgcctttttcttgtacaggcatttacgaagatgtatggaatcccgggattgagactgggctatgcaatgacttcggatggagaacttagagagcggatgcagcagatccgtcagccgtggagtgtgtcggttccggcgcaggcagcagggatagaagcgctgacagagagagaagaacaaagagttcagaaaatacgaaacaaaatcgtggaagaaaaaatgcgcatggaaaagaaaatgcgtgagtttgggattagatttattccaacaaaggcaaatttcttcttattatataatgaaatcccattgtttgatcgactgttagaacaggggattttggttcgaaattgtgagaactatagagggttgaagaaaggctggtatcggattgcagtgcggacaaaagaggaaaatgatgttcttttacgggcactagaaacaatcctgtcaaagcagtgaaggaggcgaaaaatatggcgaaatcaattatgatacagggaacgatgtcaaatgtcggaaagagcgcactggcagcaggactttgccgtgttctgaaacaggatggatacaaagttgcacctttcaaatcccaaaatatggcactcaattcttttatcacaaaagaaggactggagatgggaagagcccaggtgatgcaggcagaagctgcagggattgaaccggaagcaataatgaatccaattttacttaagccgacgaacgatacaggctctcaggtgattatcaatggtaaaccaatcggagtgatggctgcaagagagtattaccgtcataagaaggaatatattccggcaattatggatgcatatcatgagttagaaaaaaagtatgatatcattgtaattgaaggggccggaagtccggcagaaatcaacctgaaaaaagatgatattgtaaatatgggaatggcaaagcttgcagatgcaccggtgcttcttgtcggagatattgatcgtggtggagtatttgcccagatcgccggaactgtaatgcttcttgaagaggatgaaaaagcgcggatcaaaggaacgatcattaataaattccgtggagatgtatccattttggagccgggtcttcggatgctggaagaaaagacggatatccctgtaacgggagtagttccgtatttttatttagatctggatgaggaagacagcctgacggaacgatttcagaaaaaagagaagccgggactgattgatctggcagtgatccgattcccaaggatctctaattttactgacttagcacctctagaagcattggaagaggtgagcgtgcgttatgtttcatctccggctgagtttggcaatccggatgcggtgatccttccgggaacaaagaatacgatcagcgatcttctgtggatgcgtcagaacggactggaagcaagagttctgaaacacagcgcacagaacaaaccggtctttggaatctgcggcgggtatcagatgcttggaatagaaatctcagatccaacaggagaagagtacggaggaactgtacagggaatgggacttttggatacaaagactgtgttccgcccagagaaacatagaaccagagtacatggaacatttggcgagatgaaaggaatcctgaaagagatggcgggacttcctttcgaaggatatgagatccatatgggagagacgattcttgatgagcacgcatctgggcttgtaacaatagaaaatgattctgatacgctacaacaaggacatccggatggttcacagaaggaaaatgtctatggctgttatgtgcatggaatctttgattcaccggaaatgtcaggtgggtttctctccgctttattgaaagagaaaggctatgatccggagacggtacaggcagtagactggaagtcttataaggaagaacagtatgataagcttgcagatatcgttcgtgctagtctggatatgaaagaaatttatagaattattggattgtagagtttgtaatgagagaggggaaagtatggttacagatttaacgaaagaacatccgaataagacattatggcggttccttctgccaatgttgttcagcgtgatgttccagcagatttacaatatcgcagatagtatgattgcaggaagatttgcaggagaaaatgcgttggcagcagtcggcgcatcttatccgatcacaattattttcatggcatttgccgtgggaatgaatctgggggcatccgtagtcgtatcaagactgttcggagcggaagaccggggcggtgtgaagcgtgcggttacaacagcatttcttagttctatggtgctgggaatcatactgacattattcgggtatttctttaatcatcagatgatgagatggatccgcacaccacagaatattatggcagatggagttttatatttgaaaatttacattttcggaattatcttcctgatgctttataatgtgtgtaccggagtatttacagcactcggggattctaagacaccgttatattttctgctaggatcctcagctggaaatattattcttgattacatcttcgtagcaaaattccagtggggtgtgagcggtgttgcctgggcaacatttatcgcgcaaggtgtgtcagctgtgcttgcattagtaacacttctcggaagattgcagaaatttgccgggaaagaaaagcagccgtggtttgataagaaattatttgcacagatcatggcgattgcaattccaagcattcttcagcagagcgtattgagtgtaggaaatcttttcgtgcagggaattgtaaatcaattcggttcagcagttgttgcgggatattcgggagcgatcaagctgaatacatttgccattaatatctttatgacacttggttcctgtctatccagttatacggcacagaatatcggcgcgggaaagaaagaacgaattccattgggattccgtaccggagtgaaattgtcagagcttacggcattaccgtttgttattctgtatttcattttcagtcgtcagatgatggggctattcttaggtgcggagagtgtagaggctatcagcgcaggaatggcatttttgaaaatagtatcgccgtggtattttatgattgtaattaagctgatgacagatggaattatccgaggctccggagcgatggtttattttgtggttgcaacagttccggatcttattttgagaatcggatttgcattgattttgacaaaaagttttggaagtaccgggatctggatggcatggccatttggttggatcgtagcgaccacattaacattgatcttttatagaaagttgggatataagaatgataaaagcagtgatttttgatatggatggggttttgatcaatacagaaccgcttcattatcaatgttgggtagaaatttttaaagaacgatatggaattgatttggattatgaggtatataagccatgcatcggatctacaagactccatttcatgaatctgatcaaagaaaattatggaatcacatttgaaaatcttgaagttatgaatcagattatgaaagaaaagaaggatgaaattattgcaagagacggatttcctgagatgccgggagttgggcagatgctttgctgtctgaaagatgcggggtatcgcctggccgtggcctcttcttctccaaaacctgtaatcacagagacgctggaaacgctggatctgatgaaatatttcgatgtcgtgacaagtggagatgaagtgaagaatccaaagccggcaccggatacatttctctttgcagcgaaacagctgggcgtaccggtagaggagtgtattgtaatcgaagattcaacgaatggaggaaaggctgctaaggcggctaagatgccatgtatctggatgcataatccggattccggagaccaggagataccggatgcagtgctcgagattacggcctggacaaaggagaatatagaaaaaatcatgaagcttttacattttggtcaagaaaaagtgtaaaaataaatgagcgatataaaatttttttgagtagaatacttaaaaatagtagacctggaagtattattaggatgtgattgaatgaaaaaactgaaatttatatttggcaagcttagtgttctctattacattttgtttttgctcgtgacctgtgtactttgcaagtacggaagcatcagacagctgaagtttgcatttttggctttaggtatccttctggtactcagtctttgtatctggatcggctgcctgatcgcggaaaaggaaaacccttttaaaatgaaaggtgcatttaggaaaacagtgtttggtacagagcttctgattttgcttgcagttacagttggatgtatttcttatatcgtatatacagcgattccttataatggagcattgtcctggaaggtagacagcctgtttaagacgaagaaaattgagtatgaacataacaacttctttcgtgatggcgcagaagggctgataaaagatgtcaataagaaattgaaacttccggacgagttatatatcacagatagttttgagatgtcctttgataaagacggaacgataacccgcgtgtcggcctatctctacggacagaatgaaaagggaaaagataagacctatctgattgattatgatatagataaaagtgataagattattgtgcaaatcgcaggttacgcaaatgcagattatgatgatgacaagaaattagatcctatgtttaccattctggaaaaatcagattgtaagatgcaggtaacacaatggaatctgaattatgcatttgcagataattcgccggaatatgagattctgtattatggaaaacgctccttcgtttcttctgaaggtcttgtttatcttccgggagatgtggatggtgacggagaggtcagcggtatgactgattttacagctctcgaccgcggtggagaagcacttggatatgaagtgtctctgtatcttccgcaggatgaatctgtgactccggtgcgttatatgatggaaccagaatatatcagtcctgatacaattagtcagaatgagcaggcggagaaagattcacaggcgaaagaacaaggaaaagagaataatacctgggcggtcgatacggacggaagtggtgttgtccgattcttcttaaacgaacagaaaggctggaaactttcagttgttgatgcggctcttggaacacgttattacaaactggaaactacgtcagatggtggatataactggacaacagtaaatgaagatccatttgacggaaatggcggagcaggagaagggatacaattctttgacgagcagtttggattcatcggtctgagtggggcatcgcagacacattcatctatttatgttacaaaagacggtggaaagacactgaaggaaatagagctcccgatggatactgtgacagaatacccgccgcatatgcaggaatatggcctcacgcttgcagattatcagtatctggaaatgccacagcaggatggagagaattacacgatccatgtaatgacgcagagtggcgagacggaaggccttgtgttcacatctgaagaccagggtgagaactggagttttgcaggggtgtttgatgaaaataacttatcctgaattattcacagaacaatatttaaactgataactgtaccatgaacttgaaaattgatccatgtagtcgtaataccgcgcactcaaccgtcaaaagggcataaaattccactagaagagtttagaacagctgcttatgctgttaagctgtcaaggttcattaatagttgctattccagctgtacatttgcttaccgataattggtaacatatctgaaaatcccctcaatcaagaaaataatatatcatcagtgcattgtataactcctgattctggaatctgttcgcaaaactctttcctgtaagctgttctactctctgtaatctgtacttcacagtgttcttatgcgaaaacagtttatcagccgttcgctgcagattacagtcacactcgaaataggcccacatcgtctctatcaactgtgtatgagctttcttttcgtactgtatgataggatcaagcacttcatccgcaaatcgctgcattggcgcagtgttctcatatgacatcagcatacggtaaaatcccatctcatcatagaagatgatttcatttttcctgttaatatgctccaatacggagttcgttttagaggtctcatgaaagctcttctgtaatttggatatgctctcacatttttcacctatgttgagagtgtattcaattccgttcaggtcattttgcaaaaactcaccaaactgttcaaaaatttttattatcttcttgcgattatctgtacagtctttcataaaacctatgatcctgtcaccatagcaggaaatgattgcaggataatcacattcagcaaaatattcttttagagtctgtgcatagtttcttatcttgtcatttgtaattccctgatctaattcattgcatgcctctttcgaactttttttgctcagatgaagcacgaaaacctgttctaacatctttggatcatttcccatttgcctgcatttctgctcgatgctagatgtattgatacagtttccaaaaataatctctgcaagcagactgtcctctatatcttttctgtcatccaaatatgatatagcgtgtcccagttcctcaaaaaagtctaaaagaggcacattccaaggcatggtgaaaagcggaaaatcattattttctgctaaatctattaccttttcgtcaatctgtgttacataattctcgcccatcaataaaagagcacacgacatattaagttcaattgccttttttattgtttgatacagatcaaaattttttctctgtgttaccggagcacttactattaaaagttcgttcccacgtacccatttctcaaaattaatattctctgccttataagaccagcgtatgcccttttccatgccacccgatccggctattacacttgcctgtgacattgtcgtaagtgatagaagatccttgcactgaaacattattttcccaccttttatttcagcaggtcaatagctcctgttacctttgcaggaatttttttgaacaaaaattcaccgtgtctgacagaagcagtgattcctgctctctcacatattgcttcaaattctgattttgcatcaagcacgataaagtttgcaggtttattttcctcaattccgtagtgatctgtaatattcatggtcacagctccgttcgttgtcacaagatcaagaacattcgtaatctcttcaggtgacatcatctgtgccagatggattccgtgatcgagtatcatcatcatatttccatttccaagaggataccaaggatcagacatggaatcctgtgcaaaacagacattgattccgttgtcataaagctcctttactcttgtgattcctcgtctcttcggataggtatcctgacgtccttcaagatatacattctcagtaggacatgagatgaaattgatgcctgattttttgaaaagcttcatcatccggaatgcataactattatccgctgaaccaaaggaacatgtgtggctggctgtagttcttgtgcctataccttccataagtgccaatgcattcaacagctccaaaaagcggctctgcgtatcgtctgtctcatcacaatgtacatcgataagcttattgtatttgacagcaagttcgattgtcttgtggattgatttttcaccgaactctcgagccagttcaaaatgaggtattgcgccaacacagtcagcccccatcttaagtccttcctctaccagtttgtcaccgcccttgtatgcatacattccttcctgaggaaatgcaacaatctgcagatcaaggatatcttttacttcatctcttacttcaagtgccgccttaagacctgtaaatgtcggatctgtcacatcaatatgtgttcggatagcctgaacaccatgcagcatctcttttcttattccactgtaaatacgttccttcatctgtgcaacagtcatagttccttttgattcactccaacgctggattccttcaaaaagagttcccgatccgttttcctcaccaaggcttgctgtaaatacataatcaagatgcaaatgtggatctacatatggtggaaccaccagttgtccatttaaatctacttcttcacatcccacagttttttcctgtggtatagctgctgcgatttttttgaaaattccatcttcaactaatatagaaacaagtcctttttgaccttttagccttacattcttaaataattttgaacccttcataccgtattcctcttttcttattaacagtaatgatttgaaataatgtcattaccgttaggttgctatttgttctttacgcacaaatcatagcatccggtcagaatacagtcaataaaatgcaaaatcaacgcttttattttattcttgcgtacaaaaaaagtcaattcactttgtgcgttacacacaaaataaaccggacagatgtaaaagcattatctcctgaaaaaacgatatcataaatatttttgcgagtttcctgtaaggagtacactgactcaaaatctcttgcaagtatatcgctgtagcgatatacttaatacataaggaggagctggtatgaaaaaaatattatatcatggatcagaattcttaattgaaaaaccagtgttcgggaagggtaccagacacaatgattacggaagaggtttttattgtacagaaaatatagaattagcaagagagtgggcatgtgtaaagcaaaaaaatggatatgtgaatatttatgaattggacatggaaggattaaaagtattgaatctgaatgattcaaaataccacatattgaattggcttgctattcttggagataatagaacgtactggcagaatggaagtattgcagaagaggcaaaaaaatacataaaagagcatttcctgatagatattactccatatgatattattgtaggatatcgtgcagatgattcatacttttcgtttgcccaggattttgtttcgggagtaatttcgttggaaaaattatctgaggcgatgcggttaggtaaattgggcgagcagattgtattaaaaagtccgaaagcttttgagacgatttattttcagaattatgaaaatgtagatgcggaaatatattatatcaagaaagcggagcgcgagcgtgaagcaagacgagaatatagaagacgtaaaaaagaaagtgcagatattcatgagttattcatgctggacatcatgagggagggtatggaaaatggtgatacacgcttattcagatgattatcttacatcagcccaacgaatattgggagatatgttggatttcgcggtgaacacatatgatatggatattgataaattttttgaaatgtttctggtttcaaatgtgtcacggcaatttgaaattggaaatcctacttatgtagccggaaaaacagggtgtgagttagtcaaagaagtgattcgggattctgggttagtaatggaagagtacccagatgagatgtatttggataaatcaccagaatattggagtggctgggcattggcctattatcagtggtatcgaggaagaacattttcacgcatctacagggcggtatcaatgacggaaattcgaaatatgtatgaagtataccacgagatggatttggcacatttcgtggagcggttggatgaattatggaaccaacattatccggagacaaatctgaaacgaattcgtgatttggcgggactatcacagcgagaactggcagaactgtcaggagtatctgtgcggcagatacaactctttgagcaaagacagagagatatcaatcagaccagagcaattgatgtgttgcgattgagcagggcgcttggatgcaagaatgaagatttgctggaactatgaggatcaggctaaagcaaagaatcgtctaaagacagcgagatatgggaaagacctgtatctcgctgttaaaatagatgctcctgagttggtgttttaggaaattgtcttaaggactctttttagaattgaagtcagaacaggggcagttattgcagtaaagatcattccaggagctgcgcttactactaaaggctgccaggcaacacccaagatcgttgccaataccagtctggctgcaaacgttccggcaggaccagcaataatgagggccagtgggtccttttttaatactgttaagataagaccggctacaatacggtacaccattgcgataatgacattgtatatagtctgaagacctaatatcatcccaataatgctggcaatgatgccgatggtaagataatgtagaaatcctctgattcttccgatgcttatggctaatggggctgataattgaaattcagttcctggaatgggtgatgggattttaaataagcccgagatgaacagcagaacaacccacatgccgtccatagtcagatttttgacgctaaaaaaatgattggataaatttctttcttttgattcttctgtagtattcatagttttcccatccttttgtttaaaatatttctgccattttccattgagagagattaaaagcaaagttattgtatacaataagcaactaattgtcaaccattaaataaaaaaggttgacaattagttgcgagtaagtatatactttgcctaaagtatgcaaaaaaaaaggagaatgcaatgggaaaagggatatttgtaaccggtacaggtacggatgttggtaaaacatacgttacaggattgattataaaaaagataaaagagaacgggatgactccaggctattttaaagctgctatgagtggaaatgaaagagaggaagatggaacgctgattcctggtgacgctttgtgggttaagaatgtatcaggaatctcccagtcagtagaggaaatgtgcctgtatgtctatgagcatgcttattctccgcatctggcttcacgtctggaaggaaatcatgttgagatggcagttgttttggataattatagaaaagtaaaagagaaatacgactatataacagttgagggaagtggcggtattttatgtccgatctgttttgatgaggcacgtattgggttgacagatataatagatgagatggaacttgactgcattctggttgcagatgcaggacttggaacaatcaatagtgttgtactaacttatgaatatatgaaaaacagaaatatgaatataaaaggaatgatttttaatcattatatagcggataatatcatgcatgaagataatatacgcatgtgcgaatatatgacggggcttccaactctggcgaaagtttccatgggagacgtggacttgaatattgatatagcagaattaatttcattatacagataacaatataacggaatgaggaaagcaaaaataagaataattttaggagataaacttatgatctggtatccatatgtacagatgaagaaaatgaagacaccatataaaattgtagatgcagaaggagtttatttgtatacgcaggataataaaatgatagattccgtatcttcctggtggtgtatgatacatggctataaaaataaagaaattaacgaagcaatgaagaatcagattgatcaattcagtcatgtcatgctgggtgggcttactcatgaaccagttttgaaattatcagaaaaactaaaagattttctcccgggagatcttgattactgttttttttcagattcgggttcggttgctgtagaggttgccttgaaaatggcattgcaatttaatattaatcgtggcagcggaagaaaaaaactcctttcgcttaccagctcgtatcatggagatacatttatgtgtatgaaggccggagatgatgaggattatcattttatattatcagaagatgataagaaggatgtaattcacattccaacggaaatggatgcattggaaaaagtatttcggacacacggaaatgaattttatgcatttattgtagagccacttcttcagggagccggcgggatgaaaatgtatagtattgatttcctgagaagggcaagagaactttgcaatgaatatgatgttgtttttatatttgatgaagttgcaactggtttcggacgtactggaaatcgttttgtgtctgatcttgtacttccggatattatcgtgcttggaaaagcattgactgccgggtatataggacatgcagtgacagtagcaaatcataaaatatataatggattctattctgataaggatacagatgcacttatgcatggtcctacatttatgggaaatccggtcgcatgcagtgcagcattaaaatctatagaaatatttgagcgtgaaaactatatggaaaaaatcaagcatatagaggatatggttagaaatctggtctccggattcactcatccgcttatcaaagaaatcagatatatgggtggctgtctttgtttccaggtacatgacccatcatgtcttatcggatttcaggagtatgcatatcaacgaggagtattttcaagaccatttctcgatattatgtatgccatgtttccgtatatcatacaggataatgagatcaggcagattgttgatgtcatgaaagactggttcactgaacagaaaggaatttaatctatgagtgcggaggaattgtacagtattaagatgcgtgcaagcaaaaaggaaaacggtacggatgtacacatatccggagcagagaaaatcgttgaggcaccggatgttgatatatttgccaatgcgctgatagagagaggaatgcatcattccaagggtgaagcagatgcgttgaacttgaagataaataaagtctgcaaggagaacattatttatcttgatgcactttcagtagagacaattgaggtcgaaacatgggaaaaagggcaggaagagataaaaaaatatttaaaagaaactggaatagacaatccgcaagatgtcatgcaattcttagatgaaacttatgccatgagaggagctatgcttcttgatgttgacaggctcattcgtttagaaccggataaaaaacgtgggattcgtgctaccaatatggatcaggagagaatgaaaggggacagaatcggaaacgagaagaatcattatgaagaagcaattgtacttgcgacaaaagtggcaaattgtcctggtattattggtgagatatgtatttcagatgatcccgagtacgtgaccggttatgtgagctcaaaagaaatcggttatagaagaatcacgaagatgaagagaatggggagcgaaaaaggaggaagaatatttctgtttcgaggaacagatgcagaagaacaaaaagcaattgattttcttcagaatcagcatgtgatcgtcagaaatgtacccaaaaagatttgcaaaaaatcagatatgaaaagaccacagaagtgggataaaattgataaagcactggtatctttaaaagaaaaccatctttttcgcacaatgaagacaatagaatcagcacagagttcacatgtaactatagatggaaaagattatgtattaatggcatccaataactacctggatattgccagtcatccttccataaaatcagcagtcgtagaatcgacagctatgtatggatttggctccggtggctccagacttacaaccggaaatacagtgatacataatgcactggagaataagattgcttcctacaaggaaacagaagcagcgatcgtgtttaacacaggatatgttgcaaatgtagcaacaatatccgcaatggtgaaaaaaggagatactgtttttagtgatgaattaaatcatgcaagtattattgatggatgccgtctttcaaaagccaaaattgtaacatatgctcataatgatatggatgatctgcgaaaaaaaatacaggagaatccatgtgagacaggcattgttgtcagtgatgcagttttttctatggatggagatatattaaagcttccggaatttcttgatatctgtgaagagaatcaattgttttccatggtagatgaagcacattccacaggagtgatcggcaaaactggtcatggaatccgggaatactggcaggaaaaaagacaggtagatattttaatgggaacatttagtaagtcgataggtggcgaaggtggttatgtggccggagagacaagactgataaactatctgagaaatgtggcaagaggattcatattttctacttcactttcgccagtaaccatggctgcgaatctggctggaatcgaagttcttgaaaaggaaatctcaagagtaacaaaattgcagtacaatgtaaaatatttttgtacacaacttgggaaatatggtatcaatgtaaaatctgaaactgccataattcctgttattattggtgatgaggaaaatgcactgacagtttccaactatcttcatgagaatggatattttatatcagcgatacgttatccaactgttgctaaaggagcagcaaggcttagagtcgcgcttatgtccagccatacagaagcagaactgaaaaagtgtgcagaattaataggaaaagccttattgatgaagtaaaaatatgttaacactttaggagtgaataatcatccaaagacagcgagatatggaaaagacctgtatctcgctgtctttttattaagaaattcttagttttcatctgcaacagtttttctatttgaagactctagtgtatataacctataataaagataatgtgaaactgtttatagattttatgaaaatataggtgcttcataaaaaatggttataggaatcttcaaatgacatagatgattcgagaggagggaacagatattggataaagataattcaagggaaatacaattcaaagaggaattggttcgcaaggcgaagaatggagatacgaaagcattttccctgttatatgccggcgtttgcaaggaaatgtataaattcgcattatatatgatgaagcatacagaagatgcagaagacgcggtaagtgagaccgttatatctgcatttgaaaatattgcgaagctcaagaatgagagtagttttaaaagctggatctttacaattttaggaaatcaatgcagaaaaatgttgggaaagcgtggaaatcatgtgtcagaggaagagacaccagaggctggacatgaaccggactatgagcagcattttgatgtgaaggaagcatttgcaaggcttgaggaagaagagcgtatgatactttcgtattctgtgttcgctggatatggaagtgaagaaattgcgcagatgcttgagatgaatgctgcaacggttcgatcaaagaaaagcagggcacttgggaagatgcgtaagatgttggaagcaggatgatcgtacaggatgatcttataagagatgggtttgaaaaaagaatagaagaaggaggcggaaaagatggaagaaaatagagaaaagaacaacaagaagattgaggatgaaaagcgtttagagcaggatttgagacagatggcagatgatgtgatccttccagactcactggaaccggaggcaattcagaaaatgcttcaggcaagacaggaagaaaagcagcagggatcaaaaacgaaaaagaactggaaacgtatcgttccgatcgtagcagcggcatgtgtctgtgtgatagttggagcgacagttggaatcaagcagatcaacaaaggaaacaacaaaacattagatgcagcgactatcgcatcagcagcagatcagacagagacaacccagacacttacaacagcgaaagattataaagaaattgaaaaatgtatcaaagaatataataagcagatggcacgggataacaacagtatggccattggactgtatgaaagtgcgtcttcggcagacgcagcaacagcagaaagcagtaatgttagtgacacggggggttattcggatacgaatgtccgtgagaacggcgtgggggaagccgacattgtcaaaaccgatggaaaaaacatttatacactgtgtcggagtgttgtgacaatcacagctattgacaatgggtccatggaaaagctggcctcgatcgaacagggtgcagaacgctatgtagaggacatttatgtacaggatgataaattagttctgtttggaacattaggaagacaggtgggaaattcagaggattcagaagcttatgatggatattatgagaacaatacttatgcccaggtatatgacatcagtgatccatccaatccgaaagagatcggtaacatggaacagagcggaggatataatacatccaggattgttgatggatatgtctatgtgcttagtcagttccatccttatgaagacaatgttacagcaagagatctgtggtatattccggaagtgcagggaaaatctatcgaagcagaaaatatttatatgccacaggaagcagaaggaaatgaatatacgatcattacagcattttcattagatgatccgtcagaaaaaacagacagtaaggcagtctttggttattcagatgtgtgttatgtaagcgaaaataatatttatattacaagtaattattatgaagattcagatgtgagcagaacgctgattcgcaagatttcttatacagacggaaagcttgcaggtgttgcgcagacgaagatcaagggaatgctgaacgattctttcagcattgacgagtatgaaggaaaccttagattagttacaacaattgatgaaatttattcgaatgatgatattatgccgttgaatgagaccgcagatgagacggctgataagaacggaacaacggataaatcagatgcaagtaaggtgactgagaaggctgtggcagaaaatgtaaaggatgcggtacctggtacaaattcactttatgtactgaatgacaaactggagatcattggctccattcacaatctggcaaaagatgaaacaatctattccgcaagatttatgggagatacaggatatttcgttacttaccgtcaggtggatccattgttctcggtagatctttccgatccagagaatccgaagattcttggagagcttaagattcctggattttccgaatatctgcatccatatggagacggaaaactgcttggcatagggatggatgtaagtgaagatggatttacaacagaaggtgtgaaactttcgatgtttaatgttacagatccatccaatgttacagaggaaaataagtatacgattgaagaaagctatggtacagatgtaggatacaattataaaggcgtatttgtagatgttcagaagaatctgttcgggtttattacctatcatgatggagtgacttatcagttgtatacgtatgatgaggcagaaggattcaaagaagtgatgagcagacagctgagcggatatgaaggcagcagaggactgtatattggtgacgtattctatcttgtaagcggaaatatgatagaatcgtattctatgaatggattcgagaagatggacgatattgttctgtagacaatttgtaactgttcagagctaacctccaaaatactacgcattttatacctttttttgaaattttgcttggctctgaacagttacaatattttggattgacagtttgtaagacgaaaattatactaataggagatgaaatttgtttgaaattgtagttttgtaataagagaaaaggggttagaaatcatgagttccagaaataaaggaatttgctttattatattatcggcattttcatttgcgttaatgggtgcctgtgtcaggcttgcgggagatgtgccgtccatacagaaaagctttttccgaaatctggttgcattctttgttgcactcataatgattgtgcggagtggtgacggatttgaaatcaagaagggaaacttaggttatatggttttgcgtgcaacatttggcacgctgggaatcctttgtaatttttatgcagtagatcatctggtactttcagatgcatctatgctgaacaaaatgtctccgttttttgttattttattttcgtttcttctgttgaaagagaaattaaaaccggcgcaggcaattgcaatttttgttgcatttatcggaagcctgtttatcattaagccaacctttacaaatatggaactctttccgtcagtgatcggtctatgtgggggaatcggtgccggtattgcgtatgcaatggtaaggattcttggtcagagaggtcagaaaggaagctctgttgttctgtttttctcagggttttcctgcatcgtgacacttccgtatctgctgtttaactatcatcctatgacaggaacgcagatgctggcactgcttggtgccgggcttgcggcagcaggaggacaatttggaattaccgcagcatattatcatgcacctgcgaaagagatatccatctatgattattcacagattattttctctacgattctcggatactttcttttcggacaggttccggacaagtacagtgtgctgggatatgtgattattctcgcaatggcagcatggatgttcttctataataaaagaccggaagaaaaagaatagaaactgtttgaagccaaatatatttcagatgaaaaggattataaaatcatggattttgcaagacttgagaaaaatattatagatgtaataaaggaagaacaggcgaagctgggctaccgtaaggagaagattcgtctgtattatccgctgagttctctgaatcatttctttcagttagatgtggatgagacaggaatgcaggaaaaattgagccggttttctgagtatgaagaagggaagcttggaagtgttgaagtgacaaataagggggagcggttctgttttcatattccggaggaaggtgcagaatatgtacacaataatatgaaagagaatgaattcatcaaagacctgatcgggttgatctctcatcatggctgcaagatggaagatatctttgaactgttccgtcagcattcggatcagattacgatcgaagagatgcacagcgatgaatttgattatatgatctgctttgaaaatgatccggaggatacttaccggtattgctttaaagatgaaggatgccatatcatttaccatagattcctgccggaagattatgaagaatttggatttggaaaatagctgtcaggtcagacaaaaaggagaaaaaagtgaagcttacaatacttggaacaggaaatgcaaccgttacggagtgctataacacatgctttgtgatcagtgataacgaccgtcattttatggtagacggtggtggcggaaatacgattcttcatcagttgaaagcagcgggacttaactggatggatatgagagatattttcgtaacacataagcatatcgatcatcttcttggaattatctggatgatgcgtatgattcttcagaatatgaacagaggaaaatacgaaggagaagctacaatttacggacacgaagaagtgatccgtatcctgaaagagatggcaggcgaagttctctcggcgaaggagatgaaatatgtagatgatcgtctgcacatggtcgtagtagaagatggagaagaacgtgagattattggaaagaaagtaacatttttcgatattcattctacaaaggcaaaacagtttggattttgtatgcagttagaagaggatgagaaactgacctgttgcggagatgagccgtacaatgaactggagcagaaatatgctgagaacagtacatggctcttgcatgaggcattctgtctctacggacaggcggatgaattcaagccatatgagaagcatcactccacagtaaaagatgcgtgtgagatggcagcagacctgaatgtggagaatctgattctctatcatacagaagataagaatattgaacacagacaggagttgtatctggaagaaggcaaagcttattatgacggaaatctgtttgtgccggatgatctggatgtgatagagttataaggaaatagttaaggagaggtgaaggagaatgcttgagttagtaacaggaggcagcggaagcggaaaatcagcttatgcggaaagccggatctgtgaatggaacaggcaggatccgaagcctctcttttatattgcaaccatgtatccttatggggaagagacagaaaagaagattgagagacatcggatgcttcgtaaaggaaaagggtttgagacattagagtggtatacaggacttaagctacatttggaagagggatcattacaaggctcagatgtgcttctcgaatgtatgtcgaatctcgtggcaaatgaaatgtatatggaatccggtgcaggatgtcatgcagatcaagccattctggaagggatccgagaattgaatcaacagtgttcgaatctggtgattgtgacaaatgaagtgttttccgaatcagttccggattcgccggagataaaagaatacaaaaggattctaggaaggatcaactgtgaaattgcagcgatggcagatcaggtgacagaagttatttatggaattgcacagcagaaaaaggaaacggatacgatggtcaatagaacagaaaaaccgggcgtggacagtaacaaatcaggagagtttgtgatgtgtcagaaagaaaatagagctcatataattataggtggtgcatttcagggaaaaacacaatatgcaacgaaaatttgtccagaacttgggctgacagatgggatcaattgttcgctggatgaaatcagaaattgtgtggcaatcaataaattccattcatttacaaggcgctggcttttggaaggaagaacaaaggaagcgttgctgacgacgctagagaagaatgaaaatctacaattactaattagtgacgaaatcggatatggccttgtgccagttgatgattttgaaagagaatacagggaatttcacgggcgtgtcatgacggaacttgcagaacaggcagattgtgtagaacgtgttgtgtgtgggattccgcagagaataaagtgaaaggaaattagggatgctttcagagatagaacaggtacttccttctgaaatagagaagagaagttttgagattataacagaagaattaaaagagatgggaaagattctctgtccggagacagaactgatcgtgaaacgttgtattcacacaagcgctgattttgagtatgcggacagtcttgtttttacagaaggtgttgtggagaaagcaaaggatgctatccgcagaggtgtgccgattatcacagatacacagatgggaaaagcaggaattaataagaaacgtctggcagagtatggcagtgaagtgctttgttttatgtcggatgaagatgtggcagagatggcgaaaaagaatggtacaacaagagcggtggcaagtatggataaggctgctgcactgggaagagaggctatctttgcagttggaaatgcaccgacagcattggtacggctttatgagttgatcaaagaaggaaagattaatccggaattaatcattgcagttccggtagggtttgtaaatgtcgtgcaatcaaaggaactgatcttaagtctggaagatacaccgtcgattgtggcacggggaagaaaaggtggaagcaatattgccgcatgtatttgcaatgctttattatatcagatgtaaaacagatgcaaaaaaactttgttagaacttgttagaaagatagaatagtggtattataagactgtttgattagaaaaaagaatagagagggaacaaaacgtgacctataaagaagcaagggtatatttggacgagatgtcgaaatacggaagtgtacttggcttagatacgattcgaggtctgttgcgtgagcttgggaatccacaggatgacttaaagtttatacacattgcaggaacgaatggcaagggatctgtgcttgcatacacttcaacaatattaagtgaggcaggatacagaaccgggcgctatgtctcaccgacagtaatctcttatctggagcggattcagattgacggaacatggattccggaagatgaatttgcagaattgacagagaatgtaaaagaagctattgcccggatggaggcggccggagaggaatctccgacagtctttgaagcagaaacggcaatagcttttctgtattttaagaagaaaaaatgtgatctggtcgtactggagtccggtcttggaggaattctggatgcgacgaacatcatcggagcaccggtgtgtgcagcatttgcaacgatcagtgtggatcatcttggtgtgatcggagattcgttggaagagattgcgcagaacaaggctggaatcattaagccgggatgtgcagtagtatctgcaaagcagaaagaaaatgtccgggagattctgaaaaaaactgcagaagaaaaaggctgtcctttcacagaagcgcagcctgaacagatgatgatttttgaagattcctaccacggaattacattttcttataaagaatatgaaaagatgcatagtccgcttgcaggccagtgtcagagagagaatcttgcaacagcgctcgaagttatccactgtctgaacagactggggtatcgaattacagaagcgcaggtgcgagaggggctttcaaagacgagatggacaggacggtttacctgcctgtcagagtccccgttatttttcgtagacggagcgcataatgaagacgcagcattaaagctgaaagtgacggtagaacgttatttttcggattataagaaaatctttatcatgggagtctttaaagataaagaatatgagaaaatcacatctattctttgcccgttggcagaaagtatatatactgttagtcttccaaataaggagaggacgcttccggcagaaaagctggcagaagtagtgaagaaacattgtcagaaagtgaaagctgaacagaccatcgaaacagctgttgaggatgcaagtaaagaggcaatgacccaaggcaaggatattgtgcagaaaactgtgattcttgcatgcggatccctgtcttatcttggagaggttcagcggatcgtgttgaataaccggcagtgagatataggagagaaatataaaatgatagatcatgaaaaagtagaacaggcagttcgtcttttgttggaaggaatcggtgaagatgtgaaccgcgaaggtcttatagatacacctgacaggatcgccagaatgtatgaagagatatatggtggaatggaagaagatgcgggagttcatcttatgaagacatttacggtagaaagcagtgagatggtgatagagaaagatattacattctattcaacctgtgagcatcatttactgcctttttatggaaaagcccatattgcctatattccggatggtaaggtggtaggactgagtaagctggcgcgtacggtagaagtatttgcaagaaggcttcagcttcaggagcagctgacaggacagattgcagacgcattgatggagtatatgcagccgaagggagctctcgttatggtggaagcagagcatatgtgtatgacaatgcgcggaatcaagaaaccgggaagccagacagttacgttggcacggagaggtgtgtttgagacagacccgacattagaagaaagattcttccgtatgcttggaagataaagaatacgtaaaggaaaagaagtgaacagacttgaaacaggaaaatatgtatc

SEQ ID NO: 55 - DNA, 3014040 bp, Ruminococcus torques (residues 1,507,021-3,014,040 of 3,014,040)
ggttaaatgaagtggtccatcactggatctatcaggattattatggaagaatcaagcggttagagaaggagcgtatcttttgctgtcatcagatgacacattttctggatgtagcaaggatcgcatatattaaaaatctggaagagaaccttgggtttgagaaagatgtgatctatacggcagcagtacttcatgacattggaaaatcatttcaatataaatggacaattccacatgaagtagcaggtgaaaagattgcaaaagagattttaacaacattacctgaagatgcacagtttacagaagaggaacagcaacagattcttcgggctatccgtggtcatcgcagaaaacatgagggaatggaaccaattgaagaattgttttatgacagtgacaaacgctcgcgtatgtgccattcctgcccggcacagaaacagtgtaactggacggaagaagagaagaatatggagatagagatatgagaattggcggaaaagaatttgacctgaagaaaaatacctatatcatgggaattctgaatgtaacaccggattccttttctgacggaggaagatacgacggattggatcgtgcaatcgaacatgcgaagcagatgattcaggaaggtgtggacatcattgatgtcggtggagaatcaactcgtccgggacatgtacagattacagaagaggaagaaattgcgcgtgttgttccggtaatccgaaaactcaaagaagaatttgatattccggtatcgattgatacttataaaagtgcagttgcagcagcggcaattgaagcaggcgcggatcttgtgaatgatatctggggattaaaatacgattctaagatggcaggattgatagcaaaaacaggagtagcgtgttgtctgatgcataatcgtgagaatacagattatcagaatttccttgcagactttatggatgacatgaaagaatgtgtgaagattgcgaaggacgcggggattgcagatgataggatcattcttgatccaggtgttggatttggcaagacatacgagatgaatctcgaaattattgataaacttgaaatcatgaaagaacttggatatccggtacttcttggaacttcaagaaaatcagtgatcggtctgacactggatcttccggtagaagaacgtgaagagggaacgatggttacaacagtttacggagtgcagaagggttgtgcatttgtccgtgttcatgatgtggagaagaataagagagcaatccgtatgacaagagcattaatgagagaacatgaggtatagaggacagatgcagaagaagttcgatgaaatcagaattgaagatctggaagtgtttgcaaatcatggtgtgtttccggaggaaaatacgttaggacagaagtttgttgtctcagcagtgctttttacagataccaggatggcgggaaaaacagatgatctgacagcgtccatccactacggagaagttagtgcatttattactgaatttttacagaaaaacacttatcagttattagaacgtgcagcggaagaactggctgaagcgttgcttcttgagtgggacagaatagaaaaaatatctatagagatcaagaaaccatgggcacctgtaagacttccgttaaaaacagtcagcgtgaagatagagcgtggctggcacacagcatacattgcgttaggatctaacattggggacagtaagatgtatctggataatgcagtaaaggcattggatgaacttccgacaagtaaagttgaggtcgtatctgaatatcttgtgacacctccctacggagtgacagatcagccggatttcctgaacggctgtctgaaacttcgcacgctgctttatccatatgagcttttagctgaattgaacagaattgagaaagaagcaggaagagagcgaatcattcactggggtccgagaacattagatttggatattattttttatgacgatcttgttcttgaagaggcggatctgtgtattccgcatgtagagatgcacaagagaaaattcgtgctggaaccgttgggagagatcgctccgtataagcgccatccgataagtggaaaaagcgtttgcgagatgcttgttgaactgaacgaaaatgataattagaggctgttagcaactatgagaaacacgctctgcgagtttctcaagttatcgcgacagtcgccaaggtctcgtgcaagcacggactttggctcgttgttcgcgtaaataagagctggacagaagcatgttgaaaacttctgtccagctctttgtagtcagaaaataattaagtcaatttgtttacagcagctgctcaaaggtgtcataaaatgttgggtaagacacatctacgcatttactgtcaagaatctttgtagtaccttctgcaacaagtgcagcaatactgaatgccattgcaattctgtggtctaacaaagtatgaatagaagcaccgtgaagaggtcttccgccattgatgatcattccgtcttcagtaggtgttacatcacagcccattgctttcagattatctgttacagtctcaatacgatccgtttccttgactttcagttcagcagcatctttgattatagtagtaccttctgccatggctgccataactgcaataaccggaatctcatcgatcaaagttgggatgatgtctccttcgattgtagttccatgtagtctacttgtgcggacaagaacatctgcaattctttccccaccttctgtacgttcgttaaggagggtgatatcaccacccatatcttcacatactctcaagattcctgcacgtgtcggattgattcctacattttctacaagaatttcagaatcagggacgatcagtccggcagcaatgaaataagcagcggaagagatgtctcccggaactgtgatttcctgtccgtaaagttcttcacaaggtcggatgatagcggttgctttggaagaaccaatctcaaaagtagagtggatgtctgcaccgaattctttcagcattaattctgtatggtttctggaaagactcggttctgtgacagaggtctctccatctgcgtaaagaccggcgagtagcaggcaggatttcacctgcgcactggcaaccggtgaatcataatggattccatgaagctgcgccggagtaatataaagcggggcacatccattgcggagaatactggaaatatgtgcgcccatctgtgtcaatggttcgatgattcttttcattgggcgggagttcagtgattcatctccggacaatttagagtcaaacggctgtccggcgagaataccggaaatcagtcttgttgttgttccgctgtttcccacatcaaggatcttctccggagcactcagtccatgcaatccctttccgtgtacgataacggaagaataatcgctctcaacttcaatctcaataccaagctctctgaaacaacggatagtcgcgagacagtcggcaccagaaagaaagttgtggatctgcgtcgttccgtttgcaatcgagccgaacataatgcagcggtgggagatggatttgtctcctggtattgtaacttttccttttaatcctgtaatattacataattccataatcttattcctcatttctgctatcagacttcatagatgacatagcggtatttctgcaaaagtacagaagctctgtttgcagaatcttcatcataaaattcaatacgaagaactccttcctcgaattcacggttgtggatgattccgatattcttgatactgatattattacttgcaagaattgtggcaatcgtagcaattccacctgtttcatcgatgatatcacaataaagtgcaaactgctttttgatcggtcctgcagatccgttcggcatggagttcctgtaatctttggaattctcaaacagagcgtacagggcaggttcatttccttcatccacaagatcctttgcatgtgaaagagcttcaatatattcacctaagatctgggagatgttctcactgtttttcagacagatctgctgccacatgaccggggaggaagaagcaattctcgtaatatctttaaatccccctgcggccaacgctttcatcatcccttccttcgaatccgtatcatgtacaaaattcacaagtgtggatgcaataatatgcggcaggtggctgatcgttccggtaatatgatcgtgctcgtggtaatccagaataacaggaagagcttttaaagatgaaacaaagtctttgtaagcatccactttttcttccgctactttagcagaaggagtcaggatatagtatgcattttcaatcaaatgagctttggaattcataaatccgctcttctcagaaccagccatcggatgtccgccaatgaaattcgcttccattcccagacgaatcacctcttcgtggatggaagtcttcacgcttccgacatctgtgagaatacagttttcatccaggagatctttcagctgggaaagataggcagcattgtaagtgaccggtgcacagaggaaaatgtagttacatcccctgaaattgtcatcaatggatgaacaggaagtatgaatagtgccttcctggattgccagtgcaagggattctttatttttatcgaatgcgatgatgtcgtaatccggataatactggcggattgccttcgcaatagagccgccgataagtccaagtccgataaatccaatttttttagcattcatagttgtaaaatcctttctgttgttgtgcaaaacatatcttactgttcagaaatcttaaatcagtaagaaacatatattcgtattttaacactttgctctgtaaaagtaaattggtaatattgcgttactgttcgcacattgtgtgaacagcaacacaatattgcttctatatataagcggagtgttttcaaagaatagctttatgatagaaagttaaaattgtataaaatgtaaaaaatagttgtaattaatcagaatatttagtacaatatacccatgatatgtatatcgacgacaaaaaaacgatgtgcataatagctacataacaaggaggcagcagtatgaaggtttacagaacagacgaaatcagaaatgtggtattacttggtcatggtggaagcggaaagacaagtcttgcagaggcgatgctctacgtatcaggtgcaacgaatcgtatgggaaagatttccgaatccaatacggtgagcgattttgataaagaggagcagaaacgtggattttcaatcagcacaagtctggtaccgatcgagtgggagaaagcgaagatcaatattcttgacacaccgggatattttgattttgtcggagaagtagaagaggcagtcagtgcagcagatgcagcggttatcgtagtatctggtaaggcaggagtacaggttggaacggaaaaagcatgggagctttgtgacaaatataatctgccgagaatgatctatgtgacagagatggatgtggatgatgcaagtttccgtcaggtagtagcagatctgacagagagatatggaaagaaaatcgcaccacatttccagccaatccgtgagaatgagaagcttgtaggatatattaatattattaagaatgccggaagaagatatacaggcattggacagagagaagagtgcgagattccggattactgtatgccgaaccttgagattttgagagattctcttatggaagctgtagcagagacaagtgaagagtttatggagcgctattttaatggtgaggaattctctatagaagagatccgtgcagccatgagaacagaagtaatggatggggatatcgtaccggttgcgatgggatccaatatccaggcacagggagtagccaacctgctttcagatattgttcgtttcttcccgagtccggataagagaacctgtgcaggaatcaaccgcagaacaaacgagatttttgaagcaaattatgatttcgcaaaagcaaaatcagcgtatgtatttaagacaatggtagatccatttattggaaaatactctttcgtaaaggtatgctccggagtacttaaaggagatgatgtactttataatgcagacacagacgcagaagagaaaccaggtaaactttataccatgtgcggaagtaagccaagcgaagtgacagagctttttgcaggtgatatcggagcaatcggtaaactgacaaatacaagaacaggagatactctttccgtaaagggaacaccggtatcttatgcaaagacagattattctgtaccatatacatatatgaagtatcgcgtaaagaataaaggcgatgaagataaggtatcacaggctcttgcaagaatgacagcagaagatgttacattgaaagctgtgaatgacagtgagaacagacagtctcttctttatggaatgggtgagcagcaccttgagatcgtagcaagtaaactggcggcaagatataaagtagagatcacactggagacaccaaaagttgcattccgtgagacaatccgtaagaattctgacgttgattccaagtataagaaacagagcggcggacatggacagtacggacatgttaagatgaaattcgaaccatcaggagatctcgaaactccatttgtattcgaagaatgtgttgttggaggagcagttccgaagaactatttcccggcagtagagaaaggtctgcaggaatctgtagtgaaaggacctcttgccggatacccggtagttggtgtgaaagctactttatatgacggatcctatcatccggtagactcttcagagatggcatttaagacagctacaatccaggcattcaagaaaggattcatggaggcatctccggtacttcttgaaccaatcgcatccctgaaagttacagttccggatgattacacaggagatatcatgggagacctgaacaaacgcagaggacgtgtgcttggcatgacaccggtagccggaggaaagcaggttattgaagcagatattccaatgacaggactgtttggctattgcacagcacttcgctccatgacaggtggaagaggatcttacgaatatacatttgcaagatatgagcaggctccatctgatgtacaggagaaagaaattgctgcaagagcagaagaagcataattaaagattcaggcaatacaaagagtgtgttatccggctgataaaaaggagtggatagcacgctcttattgcttgttttagaaaaaacagtaacattatatttcacaaaaaaatcataagtttgcgaatatggttgtactttcaaaacaaaggtgctataattcatctacctgtctgcattagacaggtatgttgttgtttatgaaatcctgtgaacagtgacataaagtgactgtgtagagcagttataagattattataataatatgagggataagaaaatgaggattattattatcggtgacggaaaggttggttacaagcttgccaagcaactttccgccgagaaatatgacattataatgattgacagtaatgaaaataagttgagatttgctatggatcgtctggatattgcctgcgtgacgggagatggcgcagacgcagaagtacttaaacaggcagatgtagcgcatgccgacctggtgattgcttgtacatcagcagatgaatgcaatatgttaagctgtctgatcgccagaaaattaggtgcaagacatacgattgcccgtgtgcgtaatccgatttattatcgtcagatcggacttctgaaagaagatctgcatcttagtatggctgtaaacccggaacttatcgtggcagatgagattagcagacttctgctcttcccggatgcgagtcaggtggagacttttgtgaagggacgtgtagaattgattgaattaccggttgcgaagggaagcagcctggcagggttaagccttgcggaaatgtataaccggttccagatccgtctgcttgtctgtgcagtggaacatggagatgaagtttgcattccagatggagaatacaggatgcgtgcaggagaccgtctgcatattgcggcatctcataaagatttagaggcattttttaaagcaaatggaaagcgtaaggacaaaatcaaaaaagtcattatttgtggagctggaagagttggttactatcttgcacttcagcttagcacacttggcatgcagataaagatcatagaacagaatcgccagagatgtgaagaactttgcgaattacttccaaaagcaacgatcattaatggagatgcaacagatcatgaccttcttgtagaagaagggattgatgaagcggatgcatttgttgccctgacagggatggatgaagagaacattatactttctctttttgcaaagagtcagaatgtggacaaaattgttacgaaagtcaatgaagacagacgtgcacgtatggtagaagactttggaattgatagtattgtttctgttaaaacagctacagcagacgcaatcatgagttatgtcagagcgcgtaaaaactctcagggaagtgcgaatgttgagacaatgtatcaattggttgatgacaaagttgaagcactggaatttattgttaaggctgagacaaattatacaggaattccattgaagaatctctcattgaaaccgaataatctgattgcatgtattgcaagaaaacgtcagatcattcttccgagcggagatgattgtattcaggtaggagataatgtgatcattatcacgatggaaaaacagattgaagatattaaagatattttaatgtaggtgcagcgcgatgaataagaagatgatagtatatattttggggaaaatgatgggagtcgaaggattacttctgctgatcccagcgttggtttccctgatatatcatgaaaaaagcgtaatttcttttctgattgtagcagcaatcctgctcgtaatttatatggtgttcggaaggaagcttccggcttcaaagcagatttacggaaaagaaggttttgttattgttgggcttgcatggattttatggtccgcattcggagcgcttccgtttgtaatttcgggaagtattccatattatattgatgcactttttgagacgatttccggtttcactacaaccgggtctacaatcctggcagatattgaggctctgccaatgggaatttccttctggcgaagctttacacactggatcggtggtatgggggtacttgtatttgttatgatgatcacatctctggatgatgagaatgcaatgccgctcatgcgtgcggaagtaccgggaccggaggcggataagcttgtcccaaaggcaagacataccgcaagacttttatatggaatgtattttgttctgacagcagcagaagtggtttttctgctttttggcggaatgaacctgtatgatgcacttttacatgcattcagtactgccggaacgggaggattttctaatagagctgcaagcgtcagcttctacgacagtgcatatattgatggtgtgatcacagtatttatgattttgtttggaattaactttaacttgtattttttcatattgctcaaagactggaaatccattctgaaaaatgaagagctgtgggcatatcttggaatagtaggtgtgtcaatcgctataatcacaggaaatatcctcaagatttatggaacggttgcacatgcattccgctatgcatctttccaggtcggttcgatcattacgacaaccggatttgcaaccgcagattatgaccagtggccggaactctcgaaatcaatattattggcacttatgtttgtgggagcctgtgcaggatccaccggaggaggtattaaagtaagccgtttattgatcatcgtgaaatcaatccgcagagaagtgcgtaagatgttacatccaaatgcagttacgatcattaaagtcaatggtaaaaagattggacaggatacattgaagaatgtaaatctctatctgacgtgttacattataattatgattgtatcaattttacttgtctctattgataattttgattttgcgacaacatttagtggagtacttactacgatgagcaatgtaggacctggaatttcaaaggtaggacctgtgatgaatttccacccattttcagcagtatccaagctggtattctgctttgatatgctgattggaagattagagatcttcccatacctgcttcttctttctccggaactttggagaagaagattctagacgattttttgttaattatgtgcggaaaaatttgaatgaaacagattttttcgcacattttatttttatatgataaaatgataactgttcagagctaagcaaaatttcaaaaaacaggtgtaaaatgcgtagcattttggaggttggctctgaacagttacgtaaaatgaaagaaaggaagaggtgagatgaacaaatttaaaatgaaagtgacagctgtcataggagtgattctgttgattggaatctattactatgtgacactcccggcgatcaatattcatgcctcagaattctggatgtatcttgtggtgttggttattctggcagctgtggtatttatcagaaagaaaaatttaaaccgttacgactggaaagagtcgaagggattaaaagtgatccttggaattcttgcaatacttgtgattgcatatgtggcaggatcagttttgtcttctccaattgtgaatgcgaagaagtatcaggaacttttgacggtgaagaatggagaatttacgaaagatatcgaagaattatcttttgatcagattccattgctggataaggattcagcagagcttctcggtgacaggaagatgggaagtatggtagatatggtatcccagttcgaggtagatgaactgtattcccagatcaactatcaggatcagccggtgagagtttctcctttgaaatatgccagtgtgatcaaatggtttacgaacatgagagaaggaatcccggcctatatcaagattgatatggcaacacagaatacggaactcgtaaaactgagtgaagggatgaagtacacgacaagtgatcattttaacagaaatatttaccgtcatctgagatttaactatccgacctatatttttaatgatctgagttttgaaattgatgaagacggggttccgtactggatctgcccggtgaagaagtacaatatcggattattcggtggaacaacaatcggaagagttgtgctttgcaacgcgatcacaggagaaacgaaggattatgcagttgaggatgttccacagtgggttgacagagtatattccgcagatctgttagttgagctttataattatcacggaacattgaaacatggtttctttaatagtgtattggggcagaaagactgcctgaatacaactgacggatacaattatcttgcaatcgatgacgatgtatgggtatacacaggtgttacctcgattaccggagaccagtcgaatgtagggtttgttctgatgaatcagagaacaatggagacaaagttctatgagattgaaggagcaacagagagttcagcgatgtcttccgcagaagggcaggtacagaatctgcactatacggcaacattcccactgcttttaaatatttccggtgaaccgacctatttcattgcactgaaggatgatgccggtctggtgaagaagtatgcgatggtaaatgtgcagaaatatcagattgttgcaattggagatacggtcagtgaatgcgaggagtcttacactaatctgatgtataagaacgggatcaagacagaagctgaggatacaagatccgtagagacactgacagctaagatcacaaagatcgcccagggcgttatagacggtgattctcattattatatcatgcttgaaggttcggatgagatctttgatgtatctgttgtagattttattgatattatccggtttaatgtcggagatgaagtcacagttgagtataagaagggggagcaggtggatacagttctttccctgaatggaaaagcgagtgaacagatcagcacaaaagctacgaaagaagagcaggcagaagatacggcaggggattctgcacagacagaataagagaaagaagcgaaaaaaagaagtacaaccggagaacggaagtacttcttttttaattcttaaaattattgtaactgttcagacccagaagggcgaatcctgtgttacactacgctgtaaatgcttacagaactgtgcatccaagtgtgtcaacatctgcaatctcagctttatctgcgctgacgctgaggtagaagtcaatcttagcatcttcggaaatcttatttaatttctcgatgaatgtcggaagactttctaatgtgatattagcctgctttaagatactgtcaatgaaaacagcctcgatatcgtgattgccagcagccataccatagaggaaacctacgaattcttctaaggtaaggatgtcaggataatcagccatcttgatgacacggatattgaaatctacagaataagtgtctttgctgctccttttaataaatacgacattaccggaagaagtcttaaccttctcgtttgcaagatcgatcatctgctgtgtttttccgctgcctcttgggcctgtgattaaatttaccatggcgaatctctcctttatgtaagtgtgtataatgtttgagattttctcacctctcaaatatttataaattcattatacactaaagatatgtgagtaacaactaaaaaagtgttaaaatttgaaaaagttttatgcggaattaccataagaaatgagtagtaagatgccatcaaggtaatgagaaaagttctcaaaaaccgtattgaaaatcattttcatttatgataacataatacttgaatgaaaacaattctcaaaataaagctaaggagaacgatatgccgacggaagtattatcctactatctaaaaaataaagaccggaaggtgaggcttggatttcaggttatattacagtgtgcgccttttctgaaagggcttaaagtatctggcctgatttcaatggaaaatgaatcatattctgaattggaagaaatgttttccgggatggagatcaatttttataaattatcctgctcagaggggaaatgccttgtccttttctatcgccccaaagagctggaagaatatatgaaccagccaaaactccgcgaactaatcggacaatacggatataaggaaagcaatatcgaggaaatgctggcacatctgtcagaacgtatctgtgagtgtactgcacaaggaattggattcccacatgagattggagcttttctcggatatccgacggcagatgtgcagagctttattgaaaaagaaggcagagattttattatgacaggatactggaaagtatatagtaatcctgaaaaagcgagaatgatttttcatgaatatgaccgtgcaaaggtttgtgcggtgaatgagtatctggatggaaaaaacatccgtgaaattgcattgaatcaaagaaagtggaggaatttataaaatgagtatatcagttgtatattggagtggaaccggtaatacacaggcaatggcagaggcggttgccgaaggaatcaaagcggcaggtcaggaagcagaacttctggaagtaggaaatgcagatgcaaaaacagtggcagaagaagctgcatttgcacttggatgcccggcaatgggggcagaggtgcttgaagaatctgagatggaaccatttgtagaagaactggaatcttatgtgtcagggaagaagatccttctcttcggttcttatggatggggagacggagaatggatgagagactgggcagaccgcatgaaaaacgctggggcacagttgatccgtgaagaaggaatcatcgcaaatgaggctccggaggatgacgtacttgaagaacttaaggcagcaggaaaagagctggcagaataatcttattgttaatgtttattaataaatattagtaatcctaattgaaaaaatgtttgaaacgtattgcatttcttataacatagtgctattcttaattttatcgtgttaaagcacgaaagagaaaacttgctgtcatttacatctggcgtgaatgacagcaatactcaggagagtctctttaaaaagagcgccgaaggtgtaagcggtcatggatgcagttacatgccgcgagtctctcaggcaaaaggatggaggaataaagaaatgtttgcacaaatcgacaaaatcatcactgcaatcgacaatgctgtgtgggggcttccgttgatctgcctcatcatggcaacaggtatctttctaacagccagacttggtcttgtacagatcaggcatcttggcaaagctttcaaattcatgtttaaagatgaagaagacggtagcggagaagtgaccagctttggggcactttgtacagctctgtcagcaacgatcggaaccggtaatatcacaggggttgcaacagcaatcgcacttggtggtccgggagcgttgttctggatggttatcgcggcattctttggaatggcgacaaaatacgcagaaggtcttctggcaatcaaatatcgtacaatcgacgaagacgggcatgtacttggcggaccattctattatattgaaaacggaatgggtaagaagtggacatggcttgcgaagattttcgcattcttcggagccggagttggtctctttggaatcggtacatttacacaggtgaatagtattgcatccgcagttaagaacttctttgatccggatatggcacatacaatttctctgttcggaggaaattattcatgggctactgtgatcgcaggattattcctgacagtgtgtgtaggtcttgtagttcttggaggaatccagagaattgctaaagtatcagaagttatcgtaccatttatggcagttctttatgtaggacttgcagtaatcatcattattgcaaatatcacagctgttccggcagcactggcttctatcgtgaaatctgcatttacaggaagtgcacttgcaggaggagcggttggatccatgttcgtagcaatgcagaaaggtgttgcaagaggaatcttctcaaacgagtccggacttggtagtgcaccgatcgcagcagctgcagcaagaacaaaagagccggtccgtcagggtcttgtgtctatgacaggaacatttattgatacaattgtaatctgtacaatgacaggactttctatcgtgatcgccggttcctggctgaacccggaacttgaaggtgtggcaatcacaatggatgctttccagaaaggacttccattcccgtcgttcgtagcgacattctccctgatgctgtgtcttgtattctttgcattcacaacaattctcggatggaactattacggcgagagatgcgtggaatacctgtttaacagaaataaaggagttgtaatgggatatcgtatcctgtatatccttgcagtattcattggaccttatatgacagtaaaagcagtatggaatattgcagatatcttcaatgcactgatggcattcccgaacctgatcgcacttcttgcattgaacggagtgattgtcaaagagacaagagatttccatgcaaaacataacggatcttattagaaaaagaattgaccgaattatctgtgaattcgaaaaataaatagaattattacctgaaataaaacgaaagaaaaggcagccaaagtccttgaataaggactgtttggctgccttttccgcaggtgtgaaaggagaatgagtagacagataattcatagacagttttgattttgtataacagatggagtaaagattatcagttaaatgaaaaactcaaaaaatgtagcagatgttctgaaaatacatgatactgtgttttggggattgcattatactatattttgtattagaataagtatcagacagcacgatagaaacggataaaacacaagatatcgtgcaagaataagaaaaagtgaggagactgatcaatgaaaattatcaagcgaaatgggtcggaagagacatttgatatacagaaaattgtggttgctgtgacgaaagcggataaggataatggggagcgtacgctgacagacagccagattgaagatatcgcagaatatgtggaattcaagtgtaacaagttgaatcgtgcagtatccgtagaagagatccaggatatggtagagaatcagattatggctaccggagcttttgaacttgcacgtaagtatgtaagatatcgttataagagatccctcgtacgtaaggcgaatacaacagacaatcgtattctgtcactgattgagtacaacaacgaggatgtaaagcaggagaactcgaacaagaacccggcagtcaacagcgtacagagagattatatggcaggagaggtcagccgtgacctgacaacaagaatgcttctcccacatgatattgtggaggcagacagagaaggaatcattcacttccatgattctgactattatgcacagcatatgcacaattgtgatcttgtgaatcttgatgacatgcttcagaacggaactgtgatcagtggtacaatgattgaaaaaccacacagcttctctacagcatgtaatatcgcaactcagattattgctcaggttgcaagtaaccagtatggtggacagagtatctcacttactcatctggcaccgtttgtagatgtttccagagagaagatccgcaaggaagtgatcagcgagcaggaactggtcggaatggaatatccggaagatgtgctcaatgagatcgtagagagaagactgaagaaagagatcacaaagggtgtccagacaatcgaatatcaggtgatcacactgatgacaactaacggacaggcaccgttccttacagttttcatgtatttgaacgaggcaaagaacgagagagagaagaaagacctggcgatgattatcgaagagacacttcgtcagcgttatcagggagttaagaatgaagccggagtatgggtgacaccggcattcccgaaactgatctatgttctggaagaagataatatcgaagaaggaagcgaatattattatctgacagaacttgcagcaaagtgtactgcaaagcgtcttgttccggattacatttccgagaaaaagatgaaagagcttaaagaaggaaattgtttcccggttatgggatgcagaagctgcttaagcccatggaaagacgagaacggaaactacaagttctacggacgtttcaatcagggagttgttacgattaaccttgttgatgttgcactttcttccggtggagatatggataagttctggaaaatctttgatgacagactggaactttgctatcgcgcattgatgtgcagacacaaccgtttgaaaggaacactgtctgacgcagcaccgattctgtggcagttcggagcacttgcccgcctgaagaagggagaaccgattgataaacttctctatggaggatattcaacgatttctcttggatatgcaggactttacgagtgtgtgaaatatatgacaggaaaatcccatacagatccggatgctacaccatttgcactggatgttatgaagcacatgaacgatgcatgtaaccagtggaaagaggagacgaacgttgctttcagtatctatggttcaccgattgaaagtacaacctataagttcgcaaaatgtctgcagaagagatttggcattgttcctggaattacagataagagttatattacaaacagctatcatgtatttgtcagagaagagattgatgctttctcaaaactgaagtttgaatctcagttccaggcactttcttccggtggagccatcagctatgtagaagttccggacatgaaagacaacattgcagctgtactccaggtcatccgtttcatttatgacaacattatgtatgcggaactcaatacaaagagcgattactgtcaggagtgtggatatgacggagagatccagattataacagatgaggaaggaaagctcgtatgggagtgtccacattgcggaaaccgcaaccaggatacactgaatgttgcaagacgtacctgcggatatatcggaacgcagttctggaatcagggaagaacgcaggagatcaaggagagagttctgcatctgtagaatcacaattgtatttgtaacaggaattttgtgcataatgtaaaatcacaattgtatttgtaatatgacaattgtatttgtaataagtgaaaaatggtgcttaggtctgtatacaattgtatttgtaacaggaattgttttcaaaagtaaaaatggagcttgacgattaatcgtcaggctctttttatattgtctttttgcacttgctgtgatattattagtataaatactaaaatatttgaagagaggtgatatatttgcgaagagacagcagcgaaacaaagaggaaaatactgaccgtatgcgtccgtctctttttggagcaggggtataaaaacaccactgtcagtcagattgtggacgaggcaggtgtggcaaggggaagctatttgaatctgtttcctaccaaggacagaattttgctggaattgaccgaaacgatgttcggcggacagttcggtgtggcaagaagcattgcagacagcaagctgccaccggtttatgcctatgcggtggaaacggcgatccaactgacactgaccgagctgaatgagaacctgagggaaatctacattgaagcttattccctgcccgatacgtcggaatatatttacttgcatactacggcagagctgaagcagattttcggtgaaaattttcccgatgataccgagagcgatttttatgagatggaaattggcacggcgggattgatgcgcagctatatggcgagaaaatgtgatattcattttccgttggaacgcaagctcagttgctttttgacggcagcaatgagagtatatcgtgtgccagaggaagaacaggcaaaggtgcttgcctttattcaatcactggatattaaagcaattgctacagaggttatgtataagctgtttgcaatgctggaaatgaaatacgattttaagctgtcaaagaatagtgaaatggagggaacaagatgagaaaacgattattcagtattctgttggctcagtgtatggtgctctgccttgtgccgaccacggcatttgccgagagcgagacggaagaaacacctgtatgcacctgcgaaatagcttgcacggaagaaacaatgaacacagagtgccctgtctgcggtgcagagggtgctttggcagaaaactgtgggaaacatgtcgaaccagcagccgagggtgaagcatcccagccggaaggagagaaaactcaggagaagcaggacagcgatatgccgaagatacaatccgaagcagctctagcacagatgagcggcgaaggagaaaatggcattgccgttcagagtgccggtgttgttattgacaataccaactttccggatgcaaatttccgcagctatgttgcttctttgtttgacgaggacaacgacaattatttgagcgatacggagatcaatgaggtcaagtttataaactgcgcaaatgaaggaatcagcgatcttaccggaatcagtcattttacagcattggagtcttttaattgcttcaataaccaattgacctctctggatgtcagcaagaatacggcgctgactgatttagactgctccaataaccaattgacctctctggatgtcagcaagaatacggcgttgactgatttagactgctacaataaccaattgacctttctggatgtcagtaagaatacggcgttgactacattatactgttgggacaatcagctgactaaattggatgtcagcaagaatacggcgttgacttatttagactgctacaataaccaattccaatcttcatcggtgagctgctggagcagggaaagatgtctgtgaaggttctgaggactaatgatacctggtacggaatgacctaccatgaggacgttgcagcagtaaaggacagtttcaagaaaatgttggcggatggcgtatacaaggctgatttatttgcagacttgtgatatactaggagcggtagctccctacgctgctctgataatcacacacctctccgtggtgagcagcaggcaacgatctattatgatcggcgaagatgtgagaaaagtaactatccattttgaaaaattaatggagaagcgtattatggaatttcaaacaaatatttttgaaggagtagaaccgccatcaagcagtaaatacaatttgataggtacaaaatttccaacgagtcaagatgtgtattttgtaagtaagtggcatgaactttttgaacgctatgaaatggcgagaatatttttaagtaaaactgaggaagataattgggattactggtttgataaagtaaatgatgaggttgcccaaaaagaaattgaattaatgttcaaagcccaaatgcttgaaacagcattagtaaattacaacattctagttgatttaacatggacgatgacgtatgtttcagcggaatatgttttatacaaattcgacaatgaaggtaatgtgactaatgcggatgaaatcattggtatgcattcgattgaaaagtcattggatatgttgcgaaagacagaaaatggagtgagtacgccgcatgcagaaggtaattcatttcaatatcttaaagtaatgagaccagaattttctgatgcaattgatttaattattgagttctggaaagaattttctgagtcgaatatcagaaatacatataactatattaagcacaaaggtactccatgctacaaggaaattgaagcactgagagatactcgtttttttaacctcactataggcaaggaatcatatcctacagatataagagatgtgagaaaaattctgtcaatagacgaattaatggatgagttgagaaaatttgatgacgaaaaattgtatccgtatgttgttgggctgattgaaaaactgaaaatagcagtttctccatctccaatgataatataatagaatacattcaagttgaaatcgaggtgagagaatgagtaatcttggatggtatcaatggattaccaccgcttcaaagaaagttggcggtccattaaatctcttagcaataattggaggcggttgtcttgctgtaggtggtacagtgggaagcgtgatcacaaacaaatacagagatattaaggacaaaaaagagttgaaaactctgagaacatactccatgaaaaaagatgcagaaatcaagaagataaatttggttttgaaaaccggtgatcagattgccattcttgcagcagatgatgattcgatcttaattgtaaaaaacggagataaggataatccgtattttgtgtctgctgattttttgatgggctgttcggattacaagggaaagtgagcatattcccctcaccccaacacagtgctatacttaaataactataaaaggaaagaggttattacctatgcccagaacgaaaggcagcaaaaaccgtcccaaaatcaataccgactacgcattccagattgcagagaagcaggagactatagcgtctctgaatactgagatcgcctccatcaccgtcaatgaccacattggggtcaacctagtgtcaacttaagacaagtgcctgatcaggttaatgactaacggtacgaaatcgagaaaagaggaaagcagacttgaaaagaagacgcactttaatagggcttcacggaaaagccatatgaaaagctattgattataagcaacatgtataagggtcagaccccatgaaagatatataaacttatcaaactatattgaccaaacctatcattaatgatataataacgaaaagtttaatggggtgaaggaatatggatcatacagtagaaatctatgaaacggagaaagaattaagagaaaagcgtctggcagcatatgcagaagcaatacagaaaaaggtacagagggattcagagcagataataaaagaacttgtagaagagagataccgtcaaaagaagacacagcaggagatggcagatataactggagtgagggcatctaatatagccaggtttgagggggcaacgtgtacaccaacactgattatgttggagaagtatgcgaatgcactgggaaaacatatagaaataagagtatgtgaagataaataatagcgagatttctcgctattatcttttataacaatcataaatgatagtatgatataaaataaaaaatgttaagaaaaacagtgttaataaaagagagtataagaataaatgtgcaactatatatagttgcacattttagccaaaagatgatataatgttgattaaagaaaggataatatgggacagaaagataaattaattaaaaaactgaaagcaaatccaaagactttcttatttgatgaggccgaagcgttgcttaattatctggaattctcaagagtaaacaagggaaaaacaagtggatcaagagttatgtttgtaaatgaagatcatggaaatattttattgcataagccacatccacagaaagagttaaaagcttatcaagtgaaacagttaatagagtttttagaacaggagaagttgatatgaaaaatatcatggaatataaggggtatcttggcagtgtggaattttcagaagaagatgaaatgttttttggcagagtgttaggaattcgttctttaatttcctatgaaggtgataatgccaaagatttgattgctgattttcataactctgtagatgaatatttaaaatggtgtgaagacgagggaagaaaacctgaaaaagcatataaagggagtttcaatataaggatttctccaaagttgcataaacaattagttatctgtgcaatgtcgcatgatatgacattaaatggatatatacaggaaattttagagaaggcagttgttttataattcttttttcaagcgatgattaattgtatagaagtgaggagcatcttatgagaaaaaccagaaaggattttgaagagatgacaaagaaaaattctgaattggaagaagtatatgacgtattggataaattaagtgcagatgaaaagaagaggctagaatgcgagacaagacaacgagcaatcagggattataatatcggaatgttaactgcggaaagacgaggaatagaagctggacgcaagattggaagagaagagggagaaactttgggagtaagcagaattaatcaattaattcttgaattatcaaagcatggacgtacagatgatattgtgaaagcagcagctgacaaggagtatcaggaaaagttgctgaaggaatttgatttataacaggcagacaaagaatgttaactttcaattctattatgatatggaagaagacaattactactggggatgccgaaattttgctattaaccggcagccccacttttgaatgaaattattgaaagtttgccgagttttagtaagtaggtaatcatccgtattacctacttacgagttttacttcaagctgcgtacagcaggaaatccataggaaggttctgctgcttgtacagctcgcaggattgctttagccatgacacgtgctcccagtgctcctacgacatcctgatctgcagctacattccctaatgagacggcatagatactgtccccatcagctgaggtgtgtaccggacggatggcacgtgcgtagccgtcatgcgccatacttgcaattttgcatagctgggatttgtcgaactttgcgttcgtgaacacaacaccaatagtcgtattgccaacaaatttgttttctttcacatcaatattttgtaatgcgagcagctcggagtccaggaaagttttcccgtcgtttgcaaggagtccggccactttgcgacctgtttcagagtcatagatatcacctaatgcgttaactgcgacaacagcaccaacctgcagtggaccaacctgaacggcgtagctgccgatgccggatttcatgcattggctcattccaagcagtttacctacggtagcaccggtgcctgcaccatagtttccgtcctgatagttgccgcattcagcattgatacaggcttgataggccattttggcatctggacggatgtgtgcatctgctacagttagatcaaacagatcagcctgacaaacgagtggaacttttgtgacaccgacatcaaagccgatattatgctcttcaagatattgcataacaccgccagcagcatccagtccaaatgcgctgcctccggccagcacaatggcatggatggcttgtgcagctgcgagtgggtgaagcaattcactttcacgggaagccggtccgccgccgcggacatccagtccggttggagcaccgttctttccaagtaggaagacagtacatccggtgcctgccgcgctgttttctgcttgaccgattttaaggttttcaaaggatgtgatggagatttctttcatgagttttttcctttcatcgtttgttttattagtatctttattgtacaactttctcttatctcatgcaataaacaggtatcttgagttttataacagacaaactaaagattattgaagaaaagacgataagctcatgtgaacctatcgtctttccttttaaggttataaaaagtttattatgaagatggcatactttaaacgaatatgcattaacttaacatcatacggtcatttgcgaattctccgccgctgacttcttcgaattttgcaagaaggtcagataccttgagatttttcttttcttcaccggatacatcatagatgacttttccttcatgcatcatgatcaggcggttgccgtgtgcgatggcgtctttcatgttatgtgttaccatcatggctgtcagattattttcgctgatgattttgtcggagagtgcaagtacttttgcggcagtctttggatcaagagcggctgtatgctcatcaaggagcagaagtttcggctttttaagggaagccatcagaagtgtgatcgcctgacgctgtccgccggagaggagaccaaccttactgcttaagcggtcttcaagtccaagatcaagttcttttaacgcttctctatagtgttcacgttctttctttgtaacgccccagccaagacctcttttctgaccgcggcgtgcagcgatggccatattttcttcaatagacatcgttgctgcggttcctgtcataggatcctggaacacacggccaaggaagagtgcacgtttatgttcggaaagttttgtgatgtcagtaccgtcgatgatgatatttcctttatcgattccccatacacctgcaatcgcattcagtgttgttgattttccagcaccatttcctccgatgatcgtaacgaaatcgccaggatttaagttgaggttaactccgttgagggcacgtttttcattgattgtaccggcgttaaatgtcttataaatatctttgatttctaacatgtatcccattattttgcccgtcctttcttgaagtaagtatctttcatataaggaactgcgaggaagcatgcaacaactacagctgagaacagtttcatataatcagatggcatcttcagccagagtactaatgcaattacaaggtagtaaaggattgctccgatgaagactgcaccgagtgtgaaggcaaaagctgcttttctgtgtgcacagaattttccgaagatcacttcgctgatgatgactgctgcaagtccgataacgatcgcgccacgtcccatattgacatcagctgcgccctggtactgtgcgtaaattccaccgcaaagtcctacaagaccgttggagatcataagtgcaagaactttattgaatcctgtgttgatgccctgagcacgagccatctgttcgttacatcctgtcgcacggatggatgcaccgagttctgttccgaagaaccagtagcagagtgcgatcagaatcagtgctgcaaggattaatttcaggaagaagatccagttaccttctccggttacataacgaagagaagcaaccagtttgtactgcatgacattgaccgcctggttggatttccccataatgccaaggtttacggagtaaagtccgatctgtgtcaggatacttgccagaattccaggaattccgaaaaatgtatgtaagactcccgttacgaatcctgctgccatacctgcaaggaatgcaaagacaagtgcaagtgcaggattcacacctgcgcgaatgagcataactgcgactgcaccgccggttgcaagtgaaccgtctacggtcagatccgcaaagtcaagtatacgaaatgtaatgtaaacaccgagtgccataattccccagataatgccctgggccacgttgcccgggagagcacgtaccagagtcattggatcaagggctgcgaaatatgctgccatgatttatccctctaatctttctttttattgtttcatataaatagataattccatcaccgaaggtgatttggaatgaattttgaccaagttgctgtgaacggccaatcttcatcggtgagctgctggagcagggaaagatgtctgtgaaggttctgaagaccaacgacacctggtacggcatgacctaccatgaggatgtcgcagcagtaaaggacagcttcaagaaaatgttagaaaaaggcgtgtacaaggctgatctgttcagtgatctgtaatggaagcaataaaggtattagccaaaattctcacaaacatcctgactgctttgtacgagccgtttggattttcacttctgctttccttcctcgccatgttcttctatctatatgcgtatgaacctgaagaggctggcaaaggatggaagagtgtcatagtgacctggtatcaaaaattcaaggggagtgtgttctttcggaggttgtttttcttagcttttgtgacctcacttattctgttccgaaccctgttaaaccgtcagatgtggatgaatcctttatccgatgtcatgggtggctggggaatctgggagactgtgaatggcgaacagaagctaaccaccgagtgcattgagaacgtaatcatgatggtaccgttttcagcagtagtgatgtggacgttcggagaaaagattggaaaaggctggaagaagatactgtgttatagcgggaagatagcatttatcttttcgataagcatagagatgctacaattattgcttcgcttgggtacgtttcagctatcagacatcttctataacacagtcggcggagtgctaggcgggttattgtactgtgtagtgatgaaggtaagaaagcgtctgtaaaagaatatagttttgtgatatactagaaaaagagacttctatgttgttctcatacctacacaatacttgatttaaacgattataattttggaaagaggtttgtgtcctatgcctagaactaaaggtagcaagaataagcccaaaactgtgattgcagattttgcaacacagattgcagaaaagcagtccgcaaaggaagaactcacagccgagatcgcggccatcaccgccaacattgatactttgaaggcggatttgaaggagaagaagactgctctgaagaaggccgaaaaagaagtggcaacgctggaagcgaaagaaggcaaaggcagatgcgaaggccgctgaggaagctaagaagatcgaggcagaggctgtgctgaagaagctgctggccagcggcatgagtgcggatgaaatcctcgaaaaactgaaataagatcggccgtgtggacaaactgaactccagaagttcacacggtttttttgaaggtcgctatatagtttataacggaaataaaagaaatggagtgtgacataaaatgaatttatcaaaaatacatcatattgcaatcatcgtatctgactatgaagcagctaaggatttctatgtgaacaagctgggcttctctgttatcagagaaaactaccgtccagagcgtaaagattggaagctagatctgcgtgttaacgaacacacagagctggagatttttgcagaagaaaacccgccgaagcgtgtgaaccgcccggaggcttgtgggctgcgtcaccttgcattttgtgtggagagtgtggagcagacagtgaatgagttgacagaggtaggaattgaatgtgagccaattcgtatgtacaaaccattggtgacaggcaccattaaatttttataaacagataaattcgtatttacaaactatccgtaaagtgataaacttatgaaaataataaaagcaattaagtgtccagcagctacattatgtgtagttgctggtaggataaaagaaggtaagagaaaagaggcgaaaaaatgaaaacaatcagtgataagatttttgaattattaaaagaaaagggaatgagccagaaagaattttcccagagaacaggaattgcagagagttccataagtgactggaagaaaaaaagaacaaatccggtaagtgataaaattttgattatttgtgaagtgttggatgtgacaccatatgagctgttatcaggagcagagcatacaggaaaacatgcatcctccgtgtcaatcagcggagtgattgacacgggagtgaacagtaaagggaaagctatcatacgataacaacacaaagtgtgtcagattatcgtatgatagctttcccttattttgcagctttaatcaaaagccacctcttctttctgctcctcacggaaaataaccccaaatacttttctgacaatcggtcctgcgaagcacagctgccagaagaatgccattgggaaattgaatactgttgtctggaaccacacagcaatcatctgatttcctgcatccttaaagagcagtgttgctgcaaggctcatcagcgggcacattccaatgatggataaaacggatatcgccagcacgatcataaacggattatctttctgtgggttcacgatcataaatgctttcttctttgcaatcggtcctacgagaaagaaatccagaatgaaagcaatcggtcccatgataataagttcatggaatgctgccagaaagacctcattactcattcctcccatattcagagagatgttgtagcagatcattgcataaaccatgacaaaaaccatcatgattgtgaaaattacttcttgaaacttattttttggcataaaaaatcctcctatcatgataagcgtaacagattgtgttgttcgttcatcattccggagggaatgtatcgtttccaatataaataccattctattcatttttttacgtgcattgcgcttcgaacttggcccacaagcgttaccccggtagttaactcagcccaggcaccctcacggcacccgagaggttctgcttagtgctgctccgttcccgacctgacacggttcacagagtcccgtcgcgtgagacccagacgtcaacgtcactttccgggggcagccctgcagactgtcgccctctgcgcaatatcacccctgctatagcggattgcaggttcaaggtaccgctaccaccccggctgcacggattattattttacatgataaatgaatgcttgtcaagtatgctgctttttcttttgcacaagattccacatgattttatacctctgtgttacagactctgtgcttctgcttttttcttcatcttcctggcttccctgagttctctgaaaaactgcttcatcaactggctgcattcttcttccaatacgcctgttgtaagatctgcctgatggttaaatgcctggatatccagtagattcagaatggaacctgtacatcctgctttcggattcatacacccgacaaccactcttggtatacgggactggacaattgcacctgcacacatctgacatggctctaatgtcacatacaatgtacattcttccagacgccagtcaccaagctttttgcttgctttcttgattgctgcgacctcagcatgtgccagtggattcttgtctgtattccgtcggttataaccgcgtgcaataatcttatcttcatgaacgatcacgcaaccaatcggggtttctcccagattatacgctttctctgcctgttttaaggccgcacgcatatatttttcatccgttgtcatcctcattttgtttcctttcggttattgtataaaaatagcattaatattccttttcattctgaataaactatatagaaaaattcttttcaggggcttgctatgaatccgggaagttattatttatatgagtacgaatcctgctgccgccgcagaaatcttggttttctacaaatttcatcacataattattcttatctcttaacacttcatgttaaaaatcttccgattgtccctggagaacagttggaagtccatgcatttattctcgaaaatcaaacacttacaggttctccggttgcacttcttcagtgctctggtcagaacttatccacacaactggtcatttccggggaacgttttccacataaaagaactcttaaacacattgatgggttcattattttctccatcacccagaatcgatcacagcattggattgcctccgctgtacctctgccggatttttattctttttctgattgctctttatcaactgaagagagtttatcctctgaacctgagaatccatccctttcggaagaatccctcataacagaagacactgtatctgagactgtatccgaagcagcattatctgacgcttctattgatgctgcttcaactgaagaggtaccaactgaggtgacaccaactgaggtgactgcaattcaggacacttcaattcaagccagaaaaatcacacacgcagagatttccacacttccgcgcagattctggccacttgccaacaatagttttcttctgcatggctgtcataattatcatcaccttctcctaatcaaagaaaaggatcatctttggcttggcgttcccggtctttacgatcccagagaagcacatatggctaacttgttcggctttcctcaatttaccagttcttacatctctattctggaacttaccgaagatgaatgtgaaaactctgaatctttcggtcactggtgtcgatacttaatgtgattcttaaaaagaaaggaaaaagatagagaaaggaagcgttcacagcggatgcacttcttttctctatcaattttaattttaatccagataaattggcggttcgtaatcctctccaagaagtactttcttgcgttcctgatatccgaggaatgcccattctgtcatatctgtccatttatgatttgcacggtcataaacctgcacatatccaattcttttcggatgcatacgtacgctgttggattcatattctcttcccgtatgtggattaatgtctccaacttcttcctgtacaggctcttcgtatgttgcctcttcctgcaccggctctaccggctgtgtctcataggatgtaacttctgcttcttcatatggttctgcttcttcctctgccggctgatcataatcttccgtataggaaacttctggttccacagagttttcttcttcctgatctgattccggcacttcctgaagctcttccttatattcctcttcttctgtctgaagatcttctctgacatcttcagttggctctgcttctactgcattcttttcaagttcagcaagttcttcatgcatatcataaatctcaccgatcgtcatgtcacgttcttcacctgtaagctgctgttcttccttctctgtctccaccgtttcctctgaaaagctctcttccggctgttcctgttcattccattttacttcctgcttcctgatacgtccggctgcgctctctgtaatctctcctgacatgatactcagctgaaacgtacagccgagaatggatgcgatcaatctcatatcctgttcctgaaaattatcccttccaagacgctgtgttaaattctgacgtgacatcttctttcctgtctctttctcaatcgtctccgccagttctttgatcgtcattccttttcttcccaggacgattttcacctgttctccaaatgttaaatcttccatttacttctcctccttatgtattatttatacttctctcttatctgtcgatcagaacagtttttcacttaatttgcagaaacatattcttccaaagtaagtccgttctctgtcatctcttttgcagcatctactcccacataacgataatgccacggctcatatataattcctgtaatatcagacttatcctgcggaaaccgaagaacaaaaccatactctgaacaatgttccatcaaccacttttgctcttctgtatctccctgtttctcatcaagctccccgtactttgtcgacataatgtcaactgcaagaccagttgcatgctcgcttgttcctggaattgcaactgatttttttgtctcatcatacgcatttaacggtgtatatccctgattgatccagtcctgcatcgtcgtattaaagacatctctctgcttctcataagaacgatatcctgatgtcacatacatgctgagtcctgccttcttcgcatcatccagcatcttattcagactgtctgccatcctggaatctatctgttttccaccacttatctccgttagattcgccggcacataagaagtatccaatggatgcttctcattcacaagtgcaagacaccaccggtcatcatcacttgccagcaactccgcagtattttctgttacttcttctctgtctaactctgcctgcagttcttcgttcttctttgtctgctcctgtaatttggcattgctgatttctagcttcttttcagcttttttcaatgtaattgaggagattcctgaagtaattgccactcctgcaattactcctgccaaagcacctgtaagcatcagtttctttgctctgtctctaaacaatgctttattcatcttatttaatttcaactccatctgtatttttcatcttatcctctgtaatatttagaatcttttccgtttcattccccccggcagatcactctattccttcagatatcgcacttcaaatgtctccactttgatcggtttattaaataatgttccctgtgcataatcgcatcctaattcctgaagaacattcagctgatcctgcgtttcaacactctccgcaagaacagaacatcccaattgatgacaaatatcaattacggcctttgctactactctgcttcttctgtttccaaccagatttgtaatcaggctctcatccagcttcaatccatcaaaatccataatggacagaatcgaaaagctggaattcttagctccgaaatgatccaatactacgcgaacattcgcttttctgatcttactgcatgatgccgccagcatctcctgattcgtatctgtataagattcggatacttctacttccaaatattcgcataatacctgatatttctcaatcagcgcactcatctgatccgcaatgttctcctgcctcaatgtttcacctgcaaagtttactgaaatcggcaccatctggattccttctgtctcccacttatgaaggatctgacatacctgttcaaatatatagagatcgagataatgtgacaaccttgtctcttccagaagattaatatatcttcccggatccataattccaagatccttatgatgatatctgacaatcgcttcagcacctgcaatttctccggtctgcacatcaatcttcggtaccagacatacaataaaattcttctgttcaatatcctccagaagatcctttttgatgattggctcatgatgacctttacgcagatttttataatacttctttttctcttcccgcatcatattctctgcactgatcacaagaccattcacatctatgtctacttttccccaggcataccctactgaaaccagtcccagacttatgttctcaagctttgtatatgcactatgtacctgttgtgtgaaatcttcatatgaagcgttctctacaagaaccagatactcatctcctgtcattctgtatacattaccattatggaaatactccgaaagcacttcaccaactctggtgacaacttcatctccataatctctgccaaattctttattaaaattcttcagtccattaatgtctacagaaagagctcccaatgtcttcaattcttccggttccacatgatccagatatgcaacaaaactatttctgttaagtactcctgtcagattatcatgataactgagatactcctgctgtttctggagtttatgaagagtgattgcctgcggtatatacggaatcaccgtacgaagcaatccaacatcacatccgccccggtgaactccaactgctgcaagaattgctactgtattctcatccagctgcaaactcacactgtaatcggcctctgttgaatttgtaatctcctgcttcatccactttggctgctgttcttccggaagcatctttatcttatctctctgccagggaacattctctgcacaccactcaaagatggtctcaatatccccatactctttctcaatatagtacacgtattccgaatcataataatcacgtaccgcacgaagtacatcatttacgatttctgaaagagatcgtggcttttttctatcactcatatcgtttttcctctgtctttctataattttagacactcagataagattattgtattatactacgaattaaaatgcaatacaaaaaagtttcgcagttcacttttaaatgtaaaaaagagggggatttcccattccggaaaatctgtccctcttctataattaaatgatatatcctgcaggtacttctgatctctgcacatctacatgctctagaaatctataaattccactttttatcctgtgaaacacgaagtcggttcatcgctcttgccagagatgcctgcgtatgataatactgctggatactctgctgctgacgtaacctttcctctgcacgctctttctgctcctgtgctcgtcgcacatcgatgtcttctggtttctcggctgtatcaacaatcagtgtaactcggttgtttacgatttcaacaaatcccacgcccactgcaatgtctttccattcttcgccgtccagactcatatgtgcaactccaacattcacagcgattaccatattctcatgatttgcaagaattcccttttctccatccggagccggaatgatcagcttcttacaacgaccttcgtagaatacaccatcacttgctatgattttcagaccaaatgtatccatatgcacattctcctatttcaacaattactcttcttccatctcttttgccttggcaattacatcatcaattgttccgacattgaagaaagcgttttccggataagcatccatctctccatcgatgatcatcttaaatccacggattgtctcttttaatggtacatattttccaggaattcctgtaaatgtctctgctacgaagaatggctgggacaagaatttctgaatctttcttgcacgcataacagttgctttatcctcatctgaaagctcttccataccaaggattgcaatgatatcctgcagttctttatatttctgaagaattgcgatcaccttgttggctacttcgtaatgttcttctcctacaacgtctgcttccaggatacgggagcttgactccagcggatctacggccggataaataccctgctcaacgatctttctggaaagtacggttgttgcatccaggtgggcaaatgttgttgccggagccgggtctgtcaggtcgtcggccggtacatatactgcctgaaccgatgttacagaaccgttctttgtagatgcgatacgctcctgaagttcacccatttctgttgccagtgtcggctgataacctacggctgaaggcatacgtccaagaagagctgatacctcagatccagcctgtgtaaaacggaaaatattatcgataaagagaagcacgttctgatgctgctcatcacggaaatattctgccattgtaagccctgtctcagcgacacgcatacgagctccaggtggctcattcatctgtccgaataccagggctgttttctccagtactccggattctttcatctctgtccagaggtcgttaccctcacgggaacgctctccaactcctgtaaaaatggaatatcctccatgctctgttgcaatgttacggatcaattcctgaatcagcacggtcttacctacaccggcaccaccgaacagaccaatcttaccaccttttgcataaggagcaagaaggtcgataactttaatacctgtctcaaggatctctactaccgggctctgatcctcgaatgtaggcggctgtctgtggattacccattttttagaatctgtaatcggctctccgttatcaattgtctcgccgagtacattaaataatcttccaagtgtctgctcgccgacaggaacctgaataccggctcctgttgcagtaacttccatatctttgcaaagtccttcacttgcagcaagcatcaggcagcgcacctcattatttccaaggtgctgtgcaacctccatgatgcatttctttccattattatcaacttcaagagcatctttgataaaaggaagatcaccgttttcaaacactacgtcaacgacaggtcccataacctgtacaattcgtcctttattcatgttctctctctctttctatatttcagtcattacaaactgcaacaacctgctgtctgtaacgcatctcgacattttaactcttcttctgctgagctcttgcgccggcacaaacctctgtgatctcctgtgtgatcgcagcctgtcttgctctgttatagaggattgacagatctttgatcagatcctgtgcactgtctgttgctgacttcattgccatcatacgggcattatgctcactggcataagcctcaaccagacatccgtagatcataccgttgatataacttggtacaatactgttcatgacatccataggagatggatttagttcgatttcctcgcgatacatattcaaaggcatcttcatttcgccaaagtcccctctctcgagtggaagaagttttaacacttctgcctctgactgaactgcattttccattcgtgtatatactacgtaaacttcatccagctcatgattgttaaactgatccagaataaccgctgagatgtcacgggcacgatgcatggtcggcttctgaactgtgtaacggaagtttgtatcaatatctacatccttctttgcgaaataatgacgtccaagctctcccacaacaaaaagcttatgctgacccggcttggaaagaatctcttcctcaagcttcacaatattgtgattgtatgcaccggccagtcccttgtccgccgtgataacaatcgatccaatcttacgttcctctgccagaatgttttccctcttgttgaaataactatgatgtaattctggtagatgacgtaaaatacgactgatctcaccctgcagcgcatagaaatatggttctgtatctgccagcttctttctcgcttgtgtcagtttggaagaagagatcatatacattgcattggtaatcttcattgtgtctttgacactgttgattctgctctgtatctctctgatatttgccatattaacacctgctcttcttgaattccttcgctgtctctacgatcttgtcgatcagttcctctgtcaggactttcttctcttcgatttcctgaccgatttccggatgctctgtctcgaacatctgaagcatatcatactggaactgtttgatttttgtcttctcaacacctaagagtactttatgtgttgctgcacacagtgtaattactttctcatgcaaggaaagtggatgatacagcggctgtttcagaagttccatcagaccacttccatattccagttcttccttcgtagctgcatcaagatctgaactgaactgtgtgaagacttccatctcacgatactgcgccagatcgatacgaatacttcctgatgctttcttcattgcttttgtctgagctgcaccaccaacacgggatacggaaagtccaacgttgaccgccggtctcattcctgatgcgaaaagtccactctccaggaagatctgcccatctgtaatggaaataacatttgtcggaatatatgctgatacatctcctgcctgtgtttcaatgatcggaagtgctgtgatagaacctccgcccatctcatcactcaaacggctggatctctccagaagtcttgaatgcaggtagaatacgtctccaggatatgcctcacgtcccggagaacgtccaagcagaagagaaagtgcacggtatgcaaccgcatgcttggaaagatcatcataaatgatcagtgcatcttttcccttgtgcataaagtactctgccatagcagttcctgcatatggtgcaatatactgaagcggagcacagtcacttgctgtggaagatacgatgatcgtataatccattgctccgtgtgtctgtaatgtgttaacaactttggctactgtagatgctttctgtccgattgcaacataaacacagatcacatctttgcctttctgattcaggatcgtatccagtgcaatggatgtctttcctgtctgacggtctccgatgatcagctcacgctgtccacggccgattgggaacattgcatcaatagaaaggatacctgtctcaagcggaacgcttactgacttacgatcaacaattccaggtgcctcattctcgattgggcgatagtcatcagatttgatctcaccttttccgtcaatcgcctcaccaagggcgttgacaactcttcctacataagcgtctccaaccggaacgcctgctttctttcctgtacgggctacctttgtgccttcacggattcctgtgtcgcttccaagaaggatacatccgatttcattcttacgaatatcctgtaccattcccttaaggccgttttcaaaagtaacgatttccccgtacatggcgtgatcaatcccgtagattgtggcgataccatcgccgacagtaacaacagtacctacttcactgtccttactcattgtatcaaaattctctatttcttctttcaggatagaaataatttcatctgaattgattgaactcaccttgttcacctccaggtcaatctttgttctaatctgttcaggcgtcctttcatactccagtcatactcatcactgccaacccggagaataaatcctccgagcagtgctttgtcctgacggacttcgattttagcactctttgcgccatatttcttacaaaggaacgcctccattccttttttctgttcctccgtcggaggctgaatacatgtcagaactgcgttcagaacctgattctgttcatcacagtatctgtcatatgctgtgaagatatcttcgatcagatccattctctgatatctgcacgctactttaaggaaattttttatctcctttggaaatactctatctaccacattcatttttttctgaagttcaatggtaggattcgcgaaaatctcgtgaagctgcggtacttcctcaaaaatctcacgtgttttctgtacagcttcttttgggacacctacttcatacaggacacgtgcatatctgattgctgccattgggcagtaaatctgactcttacttgtctgtgttttcatctgtcccacctacttctcccaaaaactggtcataaatgttctgctctttgtctcccacgatcttctcagcggatgccatagccagtcctgcaatctgagtctgaagatctttcattgtcttctcacgctcaatacgtacattctcttttgcagcttccagaagatctccggccttgcttcctgcttcacttacgatgcggtcatactctgtcttagcctctgagcgtgccttctcaacaatcgctgctgattcaagctttgctccctttaaagcatcttcatattcctgtttcatcttctgcgcatcactctgtgcatcctgtgcaccctgaagaccatctgcgatcatctgtctgcgcttctccatgatatcactcaccggtttgattagaaaatgtctcaacaggaggaagagaacaataaggttgataatggtatagacaaggttcatatttaactgaagcaccttttacacctgcctttcctgttatctgcttccatcattttcataagattcttttcgtttcttatttcaggaagaagatgatcaggataccaatgatgaaaccgtagatagctgttgcctctgcaagagcacatccaaggataaggttcttactgatcttgctttcagcctctggctgtcttgcgatagcttctactgctttacctgttgcatgtccgataccgatacctgctccgatacctgtgaatactgcgatagctgctccaatagcaataagtgttgacataattttaatctccttttcttttcaatagaatgtgttaagttcttactccatctcttcattcataaacagagatgtcaggaatacaaatacgtatgcctgaagtaggccgtcgaaaatatcaaagtaaaaactgattggaatcggaatgatcagtggaacgattgctttcaaaagttccatgactacgaatcctgccagcatgttaccaaagagtcgcatacaaagcgacaacggccggatgacgatttccaaaatcatgatcggtgctacaatcggaatcggctgtgcgaaatgtttcgcccagtgtccgaatccattcttgcggatacctgaaaattcaatgagacacatactcatgattgccagggctgccgtcacgttcagatctttcgtcggaggcttaaagccaaacaatggtgcaattgtgtttgaacaggcgagatataacagaaccgtaatcagatacggtacatagcccttgttctctttcccaagtactccgacaaagaagtcctcagcggcgtcgataccggcttcgagagccaactgcacttttccgggattctcaacctttaagtttcttaccaggataatggatgctatcacaagcactgccatgatgatccaggtaactactacagattcattgatcccgccaagaaccggaagtgtgaacactgtctcacaattcagttctttcataagattgtctgccagatttcccgtattgctccctccctttctacctaatgtatattgctgtattttgtcacttttcgtatacagcatggcaaatgttactgcttataatcgcattaaaacgtcatgttctccgaaaagttgactaaatattactcccatgttttctctttgtcaacgttccacttcaacaagttaaattcataaaaaaaacactttttttatttcaatttgctctttttttattctacgttttgtctattttttattacttttttaaccgtttttcgctctcatttttgaatccgctctttttttatgcgcattttccacaataaaattgtttttatttctgtacatttgtacgattcaaaaaaaaattcatagacactttgtcttaatttgtatattaatgataatttttctcctgtttttcgtatccttttcagaataataacaaaaacagatgttacatttttgttacgattttgttttctcaaaagaaaagcacccatttttaaaccatagcataggtgtgataaataaaattttatttttcaatggttgagcatccattcaggctaattgtcgctgtcatctccgtctagccatttgcaaactaattacaaatgtaacaatatatgtttagcgttttttcaattgctggtaaacatatgataccggcagtccaaccacattatagtaatccccttcgattccatctatatacgccgcaaagcttccctgaattccataagctcccgccttatccatcggatctccggttgcgatatacgcacggatttcttcttcgctcatctcatgcacatgaacctttgtctctaccgcatggttaatgatttctttctcgcttgcattattataggaaagaattgcaacacctgtatagacttcatgtgctcttccctgaagacttagaagaatctcatatgcatgatcttcattctttggcttgccaaggatttcttcgtcacgtacaacgattgtatctgctccgatcacaattgtatttttcaattctactccctctgcctgaagatcagatgcgacattttctgctttcatcaatgcaagttcttctacaatcttctgtggttttgtacttgtatagacttcctctttattacttacctttacctcaaattctaaaccgatttgcgcaagcagctctcgtctgcgcggagatgctgatgcaagaatgattttctgattcattatcattatcctttcctattattataatataattttcaccgatgtcatttctttcttcataatagcataactgttcagagccaacctccaaaatgctacgcatttcgtcggtgtggcgtatcccgtgcttgcacgagaccttggcgactgccgcgataacttgagaaactcgcgaagtgtgtttctcatagtttcataagaaaggaatcaggaatggaacaatttcttcaggtgggagtgatttcttccacacatggtctgcgtggtgaagttaaggtattcccgacaacggatgatgctgcgcgttttcagacattgaaaaatgttgtccttgatacaggacgggaaaagttggatcttgagattcagtctgttcgtttttttaagcaatttgtaattgtgaaattcaagggtattgataatatcaatgatattgaaaaatataaaggaaaaagtctctttgtaacaagagaaaatgctgtcgaactggaagaggacgagtattatatcggtgatctgatcggtatggaggtctatacagatgacagtgaggaacgctttggagtactcaaagacgtgatggagacaggagcaaacgaagtgtatatcattacttctgagaatcacggagaagtgctgcttcctgcaattcacgagtgtattttggatattgatgtagaagcgaagaagatgaaagtgcatctgatggagggattactgtaatgaatttccatgtattgactttatttccggagatgatcgagcaaggtgtgaatacaagtattacaggccgtgcaatcaacaatggacttctttcgatcaatgcagtgaatatccgtgattatgcatttaataagcataacagtgtggatgattatccatatggcggcggtgcaggcatgttgatgcaggcagaaccggtgtatctggcttatgaggctgtgaaagagcagatcgacaagagaaagcaggagaacatcaagtcggaagaagtcacgtcaacggaaccagcggattgttctgaagtgcgcaacagtgatttgcaggatgaaaattcgaagaagcgtccactgcgtgtagtctatctctctccacagggagatgtatttaaccagaagatggcagaggagatggctcaggaggaagaccttgtgttgctttgcggtcattatgaaggaatcgacgaacgcgttctggaagaaatcgtgacagattatgtttccatcggagattatgtactgaccggaggcgagcttccggcaatggtcatgatcgatacgatctcaagactggttccgggagtgcttcacaatgatgtctcagcagaatttgagtcatttcaggataatcttctggagtatccgcagtattctagaccggaagagtggagagggaagaaagttccgcctatccttctgtccggacatcatgcgaatattgaaaaatggagaagagagcagtcaatccttcgtacaatggagcgacgcccggatcttctcaaggagagcaatctgacggataaagagaagaaatggatccgccaggtgaaacgggaacgcaaagaagcagaaaaaatgaaatagggacttgaaaaaagcccggaaatatggtaaactacaaaagttgtgaaaagaagcgcgatggtcctctggcacaaaagtgaagtgttaagaacgtcaaatattaaggaggtcacacaaaatgaacgaaatcattagaaaaatcgaagcagaacagttaaaggagaacgcacctgaatttcatgttggtgatacagtaaaagtatatgccaagatcaaagagggtaaccgcgaaagaatccaggttttcgaaggaacagtcctgaaaagacagggtggcggagcaagagagactttcacagtaagaaagacatctaacggaatcggtgttgagaagacatggccggtacattctccacatgttgagagagtagaagttgttcgcagaggtaaagtaagaagagcgaaactgaactacttaagacagcgtgttggtaaagctgctaaggtaaaagaattagtaaaatagtaactatgagagggacaattacagaacttgtatattgtcccttttcttatagcttacgcgagcaacgagccaaagtccgtgcttgcacgagaccttggcgactgccgcggatcagactgtgcattaaacgcactcgccattgatgaacctcttgaatatgcaagattatatcttgatggaaatttgcagatgtgggtagatgcggaagattcattagaattataaaatacaagtagcctgtattctttatttcacatacaggctacttaatcaaaattactataattgatggtaagcaagtttcttaatataccttgtttgaataatactgagccatttgcatattaatttcaaatgaaaactttttagttttgattcagtatttaatcaatgttcctatattttaaatattctgtgaactttttaactgctggagtaattttggtccgatctttcatcgccaatgcaatttctctgaaatatggtgtttgaaatggtcggattgcaatctgatatggtatacgtctcaaaatcatttcaggaagtataccaaatgcgattattatttataagtatttcttgaaggtatttttcatcttcagggcaacgtccatcgcccaatcgaactgttcagaccacttatccttattttaaaaatttgccgaataagatataaggattctgttggctttcttgtccagtcattaggcttttctaccacttcaaatttaacggcgatatccgaactgcctatttggtatagtttgatttctaccaagaagagcgcaatattctcatcggtgtgattattcagccactcaattgcagagcgatgttcttctctggctctcttgacaacccaaattacaatatcggcagatttgccggaggcatatgtaatcaatttaccaaggtaatcatggtctgtatcttcaagctgattttcaataatggtttttctgtccgttcctgtttcagttgcataaatgtctacattaaaatctccaacgctggactcagtttcatcaaaggttatctccaagccaacggcatccgccagcaacgcaagattgtcctcttctgcaagccaaagagtaaagtctattgcctaaaaagttgcttgatcaagaggtgagtgctaattatttgagattttttttgcacaccttgattttgcttggtatgcagccattttttctttccaactgccaaagatgggattttactataaccggattttttatttcgcgcactccataataaccgcttcacatctgccatatccaagctgtgaactgttcagacacaacgtgtaattgctggcctttccccacttctgcccggtataaaagttataatttgtcatacgccttttatctgtatcctctatcagctttgctgctttctggtcactgacattatataaccagctgatacgctgtatgcatcatccagaagcattcccttggtctcaagcaattacctgcagtgtctctcccgctcccttttttaaacatataatgatttataaagcgttactttttttctctgcacggtcaagataaatataaaatccaacatttagcacgattcccaccattgtcgatactggtgccgcaagaccgatcttcgtcaggcttgcattcggctggatactcatcacataggcaaatggaagacgtaccagcaatgtctggattaatccctgtgtcattacccataccgtcttgttattaccattgaaatatccgaccatactgaacagaattgctgtcacgattgtttccagtgcgaatcctttcagatatgcataccctttctggataacggctacatccgttgtgaagaaccctgccagtatatcgcctccaaacatcaccaataaaaatactatacatcccacaaccaggccaacaccgattccggtaaacatggatttcttcgcacgctttgccttgcctgctccgatgttctgagatacaaaggatgccatcgactgcatcagcgcacttggaaccagcatcgcaaagttgacaatcttacatgcaacaccgtaacccgaagaagcttccaggccaagccggttcacaaatgcacaaagtgccaggaaggacatctgtgtcaggaactcctgcagtgcaagcggaagtccgatctttaggaatttcttacactgactattcaacccgaaatcttttctggtaatcttaaatggaagttcctttttgatcagaataacaatagcaaatactacgctgagtgcctgcgctgtaacagttgcaatcgccgcacctgctgcgtccatatgaaatcctgccacaagtactatatctccgatcacatttacaatacatgcaacaaatacaaatagcaacggtgatttactgtcccccagtccacggaaaattgctgataaaagattgtatgcaacaataaagaaaataccgcctccgcagatacgcacatataccgaggtcagctcaaccgcctctttcggagcctgcatcaggactgagattggatgtgcaaatccaaccataacaataaataatccgactgcaatcatcgtaaatacaactgctgatccgccaatgaccgatccaatctgctctggtctcttttcaccgagatatctcgcaatcagtaccgtaatacccattgcaaactgtgtcactacaaaagttacaagattcaatacctgacttcccgtagaaaccgctgaaagcccggatgtagaaccgaatcttccaactaccagaagatccactgcaccgtatgccgcctgcaggatcaatgatcccagcaccggtatcataaatgcaatcagttttttaagtatgcttccttgtgtaaaatctgccttatcgttcatcgtaatgttttctcctttcgcacatgatctgataaaatttctctatcgtccgtatcatacattctgcatcttcgtccgagatttcttccatgtaagggagcagacttttaaaatattgttcgtcatatttctgcgaaagatttgttccctttcttgtaacagctatgtatgtgacacgtccatctgcttcagaagccattttcttaaggtatcctttttcttccatctctttgacagttcttgtaactcccggtcttggaagctccattgcatcactgatatccgacacctttacctgtacgccctgtccttccaaagactgtatcgtatccagatattgaataaaggatgaacgaacaccttcgggcaacggtgggagcatctcccgggtccgctttgcctgataacatgcatcgaacatcctttttattatttcacttgtcatattctgtcctccttatatattatcagtaaaatcaccacttatactttcttttgcattcatggcacttctagtaattatcacagttaattacctttgataattatataaaaatttagaaatttgtcaagcttttattccattgttaacagctgatccgctgaaaatttatcatcttcttaatatcttccggaattttttcccagatttccgcagacacatattccatattttcccaaatctacccttccatttatcacttcaactccatccgctcgaagaagttctgcctgtacatcctctccaccaaacgcaaatgccccggccagttcacctttcgcattgaccactctgaagcacggaatatgttccggatccggattcttatgcagtgcattgcccacggctcttgccattctgtggtctcccgccatctctgcgatcttcccataagttgccacatgtcctttcggaatacgcttcactgcttcatagattctctttgtcggactgtccgtaaccagatcatacccagacaatctgatctttctctttatccggcaaaggctcttttttctctagctgtttcagaatcgcttcttcccgttctctggctgccttgtctacttccagaagatgctctccaatggtgtcctgcagaagcatcacctgataagttgaatttcgatgattcttcagataatctctgtgaagaaaaccatacttgccaagttgctccatctgctcaccggatttataggtgagattcgggatcagatatccatttacatttgtatacgttatataaataggacattcgcaatccgctttcgctacttgctcatgaacgcagttgcttcgctgcctgcgttcattttattatgagattccgacaggtgtattaagaggtactgggcactctttatacccggctattgcaactatcataggaacctgttgttttcgtatcctctggatatatactattttcaggcagcattgccagttaaatattctgtattatgcttttcctatttcatggatactaacactatttcttattataattggctttattataataaaaccaataaagtaatatccaaacgaataaattttatttttatgcacaaatcggacagctttaaaaatttagctgtccgacctactcttaataatatccccgttcttcctgccagtctttcacatagcatcgaattccaatataaatcacatgcaccagtagcaacagcgtgataagatttacaggaataacagattttatccattctccaaagtaaattacaatagctgcactcgttatcgccactattatactgaggatatcccagcaatatttccggtagatttttccaacctgatagccaatcccaactatcagtaatccggttattataaataaaattcccataacaatagctacgatcagccagtacataagcccggaaaggatacggttaggtattccgctgcttaactgtccgaaagaatctgcacctatgacaaactcccgaaacaagcttcccattccttttcctaacacaccgaaaaaggtgatacagtcgttaaggaaaactggcgaaagaatagccgtaaacagggttattgttatgctgtaccatgccagtaggaacaggatactttcataaccagttgtcatatttttaaatttcttttccagctgacttttgcggttatcgcatttttcttttgctttctggtaagcagtgcggtcacatttttcacatttctcataaggcacttttttctcaacagctacctctaccgtcttttggtgtgtctgtgcataaagtttctcctgttctgctttttcatacttaaatttccatgccacgacttctgcgtcggctcttttccttctgtctgtctcgttggtcaatcgctcctctgtttgccttaatcttgtccgcaatgcttcgatattctcgactctgttttcgctgttcaatttctcgttcaaggtcagcgattcgcttagctgcttgttcagttccaaaattgtctggtctttctgatccagttcgtcctgcatctgttctgtcatcagcaaaagttcttccacctgcccgacgttctctaagtctttgcatccgttcatcaagctccctcactttctctatctgctgtttaaggtcagcaattcggtgttctgtttctgcaataagctgttctcgctgttcagcttctgcgttaattcctgccattgctgattctcggtttccaactgttcgattctggttttctgttgctcgatctgtgagagcagttcttctgtatctggcaaaagattcagcagcccggataattcgctgtttaagttttttaaactctggttctgctcctgaaaaaacagaagctgcctgtcccgttcctgtaattcctgtatcatctctgccataagattctgctgttcctcgatctggtttatcattgtctccatcatgggaatgacttcccggctttcttctaatgtcatccaatcgctccttccattgtgtcaatgcaccagatacttttccaaaagaaatctttattttacccagcagtgcattttgtctttttatgatctggttttcctccactttccatgaagcggaggatgtctgtccgttttgaaatttctcatcaatttttctggcatccgcaccctcatggatcgttggtatctcaaattttccctgccttgcataagaacggtggtcaatgtgattttccgttttcaaatgtgcattacagacatttgcccattcgctccgccatagttcacaatttttgggattgttccatccggtagcatcggttaatacacgtttccactgtttacgattccttgcaccgattttcggattaccgttttcgtccaataccgggattcggattccatgacgggcagggttctttttatcctgccaccagtccgggtgagactcatcaaccacgatatttccatcattatctctgacaaaatcccagtctttgacttctttgtttccccatgaatggtctggattgaatggacgcatggtaacaagtaaatgcacatgtgggtttccatcgcccttatcgtgaatgctccaatctgcacacatgcctttgtctacaaagattttctgaatataatccgttgtatattcaatctgttcctttcggttccattctttcggtagtgagaactcaaacgacctgccaagctgtgcatccgcggtcttctcaatcttcaaaacttcattccacaaacgctgtttctgaaaagtaagtttgaatttttccagtgcagcttctttgttatctgctcttttatatcggactgatttctggaaccgtctgatagtttcagcaggtacattctgccattcctgtggtgcattttcacacatcatcaggctggtataaacgacttctttttttgaagtgtagtagctgatcctgcctgtttcttcatttttcatcacatcgccattgagataagcagacgccgatatgatggattttcctttgctgcgtccaacaatctttactgtataatgaaaaatcgccatgctccgtttccccctttctgccgtatccggctttgatttccagcaggtaaccttttccctaaaagaaaatggtatctgccggaacgccctctgcataagagtgcctcctgcggcatgagcaggtctggctgaaagccccgccgacggaacgcattaacctgagcaggcacttgtcttaagttgacattaggttgaccacattggtgtcaggcaccttatatagtttcttatcaattataaatatctgtccgtatctcttgcaccatacattaaacgtcgtacttccatcacatcatcaatcactacataataaacaacgtaattgcgtacataaatccgatagtaagggtagtcacgtttttttgcggatggggatggttcaaaggcaacaggattgttcagcctttccagtatggcagcttctacatcatcaaccagacgaattgctgcgtcctcgttctttaaaacattcataatgtaattcgctgtgctaatcaaatcctgttcaaagagtggtaaataccgcagcttataggatttattttccatgtatagctctccttacattgctgaatactgtttcatgtgaaagacgttcctctgtcatagctgcctgtctgtcagcttcatcaagtttcatttctatgctgtctgtcagacttgcatattcttccagacttaaaacaaccatagcaccataaccattctttgtcagatacactggttttcctccgtttacaatagcttcaatttctggaaatttatttctaaggtctgaaacaggtcgaatttgtatcatgttcaatcgctcctttcatatcatttattctatcctaattttatcagaatattatcacagaagcaatatttacttattcgctgctgcggattgcctgtcagttggttctgtttattcttcagaacattattagaaatttaatggtgcctgtcaccaatggtaggtagtttctattaagttaagggactacctatttttttgtacttatttcaaaatatacttgacaaaacctcaaaaaaatgcggcgcttcgcgccctttgattaataagaaaaatccggtcgtgccggaaaattaaattaatcggaggcgtgttatgaatctttcaccagaatcagtaaagaaaacattactaaacaaagtaaacgaattatctgcatcttcctggcagtacacaaaaaaacctacggattttacaagaaatcgtaagatttcattcagcgatgtcttgctctctacaatctccatgcaaaaatctgcatctaaaacagaattgttaaagtatttcgattttaacgcttctgcaccaacagcgtctgctttgattcaacagcgtaaaaaaatatctccagaggcctttgattctcttttttactcattttccaatgcatttttcctcgataagactttgaaaggctatgatccaattgctgttgatggctcggatatttatatcccaagaaatcctaaggaccccgatacctatcgggttaccgatcggtacaataaaggatttaatatgattcatctgaatgctgcttacaatttattatcacatttgtatactgatgtaattctccaaccattgaatcatatcaatgaatatatagcaatgtgtgacataatagatcattatacggctactaatcctacgcgaaaacctttatttattgctgataggggatttgtatcattcaatgtgtttgcacatgccattgaaaacaatgcatattttctagttcgtgctagagaatcgaacccgcgtagtatgttggctacaattaaactcccagattcgcctgagtatgatatcattttcgaaagatggcttactagaaaaaatacaaagactgttaaagcagagcctgaagtgtataaaactattgcaaacagaacttttgattacctcgaccctaaaagtaaaagtttatactacatctcttttcggattgtgagttttgtccttccaaatgggaacaccgaagtcgtatatacctatcttccaaaagaagattttagcacagaggaattacgggaattgtacaatatgcgttggggaatcgaaacatcttttcgtgacataaagtatgccgcaggacttcttttcttccatagtagaaaaaaggatttagtaatccaagaaatctatgccaaactcattctttataacttttgtgaactgattactggcgcaattgttgttgaaaaaaaggagcggaagtatagttatcggataaatttcagcatagctatcgctatatgtacggaatttctgagacgctcttgtgcctcaccgcccattgatgttattgctttaataggtagggaattaattgctgtaagacccgacaggcgcaatcctcgctacttaagagcaaggactgcaactacattccaataccgataaaatattcatatcttgatattttttcagtaggcagattccccaatctgtctgtttgccgtgcctgaattatttatctagagacgcaatacgagaactgtatcaagaaattcataatttctcggctcttctagtatatcatgattcttatcttaatgatagctacctaccattggtgcctgtcaccttttacttttttaccttcctcagctttttcacggctctgtatctccgctgccgctctgctccgacactgattttctttttatctgctgtacttggaaagtacacaccttttttatatggcaggtacgaggtgactgaggctttggagagctggagagcatttgcggttgaaagtatggaggttttgtagtcttgtgtttctcggtattcttcaaaagtattttttactttctccgccacttccgattcatacacgtcggctgtgatgagcagcttccgtacctttattggatttaatcctagttcctcaccgatggtctgcaaggacatctcagaattataaagggccacagcagcgtccatctgatctttcaaattcttcccggcctcgtactccggcttcagcttctttcggcccccgccgtgcttccggggtttatatgttcttttctctcccataattattcgtgcagctccagcggcagtccatccgggtcatgaaagaaagtcatcttcttgccggtataatcatccacacggattggctcacattcaattcctacttccgccaattctttgaccgtctgctccacactgtctacgcagaacgcaaggtgacgcaatccacaggcttccgggcggttcacacgctttggaggattttcttcagcgaaaatctccaactcagtgtgctcattcactcgcagatccagcttccagtccttacgctctgggcggtagttttctctgatgactgagaaacccagtttgtttacatagaagtcctttgctgcttcgtagtcagatacgatgattgcgatgtgatgtattttggataagttcatttttctcacactccgtttcttttgtttttgttcttcttttatttccgttataaactatatagcaaccttcaaaatataccgtgtgaactcctggagttcagtttgtccacacggcatttctttttttcttgggtcttgtttatttcagcttttcaaggatctcatcagcactcatgccgccgaccagcagcttcttaaccacattctcggcttcagccttcttagcttcttcagcgaccttagcatctgcctttgtctacttcgattccagcgttgccacttctttttcggccttcttcagagcagtcttcttctctttcagatcagcttttaaagtatcaatgttggtggtgatggatgcgatctcagtattcagagatgcaacagtttcttgcttctccgcaatctgggatgaaatttccggtgcctgaccccaatgtcacagatcactcaatcttcccatataagttgccataaccagcccgagtgcctgcagctgccatcttttgttatcttctgacaaggctgataaacgaagtttggctcattgctacgtgatatatatctccgcaccctagctcgtttgatatagtattcagaatatctctatgttctttagaacaattcattcctgcaataatacgattagcctttagaccagctcccgtaattccgaccttacatccagtagttcccggcgaaagcggatatactaatctatattcctgctcatgttgccacgatgtatgcttcataaataactgcatgataataacattcgagcaaaactccatttttgattcatccattaccaaaccttttttgttcttatagaactctcccatcatatctacgaatattctcgctaatggtattctatctggctcgtaaaacactttatgaatctgatttggagaaatcacttcatattcgatacaaaaacctcatccattattggcataataagcccacataggcatattattctcaggctctttttcagaaaaacatgttacaccaatttgggtcatgttgtcttgaagcatattctcgaaagtggcgattatctcatccgaataaccagcttttctaaatttctccttatccacatacatacatctgtattcatatggatcatttagttgcttcacatgagatagccacaaatagttgttttgcaaagccgaaaactttaggctattcgatttttttccttaattttccaatgtagcaaacttttggaatcatcctcaagccatacaaatttgtagagtttatgtggaacatgtaacttatgataatcttccgcttcgtggtattttccttctgtgagtagcttaaaatattgtcgattagaaaactctttatacatcttgtatactccaatgccttatctttttacatttgttcattcttaaaaactgaggcaaaactctttatactctataccatcatttagtctttctaaaaatcatttcaccactctttgaaccggattaggttccataattaactgttttctgctccgatcagacgtatcttcctcttcgatacaatcccgattggtaacgaacaacactacacaccgctctccattgacaccaaactgatcatttgtcacagcgaattttgagcttggataaacaattcctgccagtgtcgtctttctctgaatatatttcgtaaatacctgtgtaggcttgtactcttttatcttgtcatcaaaatcagataccggcatggaaatgttcctcataaactccattagaaagaaccatgcgctccttttctcatcctgctccacatcgaataaactcggcaaattgcagcgattcagtgtagataaattcaggactttaaaaatcttattcgtatgaaacttcgccgttgtcagtatctggtccttttttgtccctatctcggcaaccgccacattttccttaaacgccccgtaaaacatcatatcacctttttcgctcatacgattatggttggtcagtaatggcggggctgtacccataagcgttgccggaattacaggtatatcatacttcttatcaaaatcctgtccgatatgtgtaccacaacgaaaaattgtatcttccggacgaatcctctctgtcatattcagttctttcagataagatattattttttccattgttgttcggattgctttaagattatccgatgcacgttttctgtagcactctgttacaatttgttctgctgatagtgtggatgtctgcaccagataacagaatttattccattcctgcaggtctatctcatcctgtcttctggaaaactcgtagcgagaacaacgatcctcgaacggcaaaatattttccagtgctaacaacactttcccattttcacattccagatactgattcagttcatctgtcacaaaatcccatggatcaaaagtatctcccaaaagtgattttgtttctgaatcccatggcagagctacgtgtgcatccagatagtcccggttgattacgttcatgataacaggcatgagttcctccaatggcataacttttttatatctcgctttgtcattactgtctttgcaaaaactgcaggagccatattccccatgcttctttatataattcttcagaaatggatctccgaagcagcccgcgcaaacaatcttatcactgtgaccgtagcctctctcttgaacattcatcatgtcattctttgcatatcccataacagttactccaaattcttcatctgaataatcatcgatgtgattactcacccagcattatttgccattattatttacaatgttttgggcgtttcaacgataagaattaataggttgaaaacgctgtcacacacatctcacattagtggttatgccagtagtgcttccaatccaacacagcatacactactccgccaatcagtccacccagtgtgttataaaacaaatccgccaactgaaacgttcccaaccgcagaaataattgagcaaactcaatccccaatgaaaacacaaaggtaaccttaaccgactgccacagtattctagcaacactatggcgattctctcctaacattttatcgctgaatgcccataacagcaatactacaaacggaataaataacatcaaattttctatcggctctgttgaaagctcacccttcttattatgtagaaaccatccacccataacgtctgataaaggattcatccacagatttcggttcagcaatgttctgaaaagtatcatagccgtataaaatgccagaaaaaaagttctccggaataccacatcggttctaaatgctctccaccacttcagcaaagattctttccaaccatgctccattacatataagtgcagaaacataaataatattgccagcagaacggagaatccaaatggctgatatagtgctgtaagcacgtttgtaataatactctttatgatatggaccacttatccctgccctcctattcgttctggtacactatcagttcacacttttttaataaagtttatggaattctggattcccctgtcatcataaactacacctcccacagtgtgccgtcggacacaggatcagaagtaaatcactccagttctctgaattatctcataaatttacaactgggggctacccggtcgattattgagcgcttacatcataaattcctctatctaatcatttcatccagaagtttttccactgattacccctcattgcttttctgaccaacttttcaacttctatagcctgtgtatttcttacttcgataggaaacttcatatcctgttcaatcggatacttactattgtacgtatcgacaaagagtttgataaatgttggatcataacccagataatcaaagagagccttccaatacaagccatgaatttcaaatccataaagtaggttggcagtatgtttccgagttttatcaaatcttcttcattttgattcttctcataacgtgtaaatatctcttcaatttcaggatacttctttctcaaatttggcaagcgattctttacatggttaatgatactaagcaactcaaaatttaggttaatgaaaaaacatgattgaatcgagtctaatagcaaatccgttttacagccatcagattgttcttttgtaggaacctcttgatagaatttgacaaactcttcgataccatcatatacaccttcaatgacttcattacatctaaagtcagccttcaactttcttttgctataccacacttgccatttgtaaatcaggtacacggcaatgatgctacagcaaatgctacaaaaccacgaattattaagcacactcttaattaccgggaaaaatggtactgtcataagtatctggaacacttgaactttctaggcaatagctattagaagaaggagtgctacacacaacataatgaaaatcactttgcgatatactgatttcttcatcataacaacatacctccgtcttggtttataatgtttctttatcaaaataatgaagattcttttttaagtcatgcatagattataagttgtgactttatagaaatttaatttcccctgtcattgccatttctatacttttttataaattttatatcttctttatttccacaggcattgtgatcttcctcaatacacttcaaactacaattttctcacaatccccatggacaacatttgagtcacctgattatccgcataatcttttgacaattcatcggcaattgcttttatttcataatatattttgtttgcctcgcttatattatcaaggctgtccatataaagccatttctcaaacaatatgaaagagtaatactccatcaattcaagtttattttccgggaactttcttatccactttttgaacaaagggattaattcttcatcgatcggtctcggaaaatcaagccaagtgacatagttccacgaaaccaaatacgaataaccaagcacaactttcccctcgttcggaaatgcttcataaatctctcttagcctttcttctgtcgaaagaagaatctcagctttgttagaatcaaatacggcaggaggatcataaatagtatgttcatttgcctcaagaatcgcaagtgtattcgccacatccacattatgtgtttcgtcaaaaatccgctccatatctttcagtaatttgcgtcttcttcccagcacttgattctctctgtagatatcatacagatcattggcaaccatcgctatagcttttaaaatatcttcatcgtccgtaaacctctgctgaaacttcatcatctgtttccagcaattagctgccgcacaataatcatttctacgtaaccaaagcactgttaacctgacataattttctgtacaccaagttgcaatataaccatttccaggaattttgtcggcgatttgattatacttattcattaaatcggcagcctgttgtgttaattccgcattatgaacaccaacaaaaaatgcatcccacacaccttctatatatttacatactacttcattgttcagtctatctgcaatataatcagcgctttgcaatccaagtgcatacagacgttccagttcgcctctttctgtcaatacaattcctatatccttccaaacctccatttcataagcacaaactatctctggggcctgagatgcacataggttatctgcaatttgctcaaaattattcaagttcttcgcagcaagaataacaaaaatccattgcccgaatctgtcacgctcatcctctaacggagcaaactccattgccatatatgattttttgtctggaaaatcttctattgcgtgcagtaagaacatatcaaactctgtgactgttcctaatcttgcggcttgagcaaatccaatccactcatactcaggaatatagtaatccacaagaaattcttttataatgtcagggtactctgggtcgattatagtaagaagctttgagcatcctttttcatcaagtcttaaatattttggatcattagcacgtcttagtatttcttcctgaatctcctccagtgtagaaacttcatccatttcataatcatgcgcatattcctgataaacaaacaaatctgaaaaatccgtctgcttctttccgggacgttgacttgcattgatatactgctgaagattttgtgccgcctgttgataaattccttggtcatcatccaggcatactaaaaccgatgctgaagctaatgcaagcaatttaacataatccttcagcaagtttgaatgattatcgaggcacaacagccacctgtcctcttctctctttaagaaagccgccaacatctcatcaaggctggtgacactgatgcatccatccttataaatccacagttcagtgtatacagctacaaacagtggtctatcacactcttctttcaacgcagtcttaaaattgctatatatttgatccgcagtatccggcagtacagaggagtattttacttttgtgtcatcatctgccacattatttaaatatgcctcaagatacacatttataaattctaattcttcctcttctgaaagttcagaaatgactaaaggcgaaagggtagttttattgttatacgaacactcctgaaaccaaagcctcgtttgcatatccatttttccaacaattcggtcataccagttgttttcattattctgatatcttctgtcaataaaaagaagacggagtttaaatctactgtattcaaagcgctcgaacaacgtagtcacaatagtagcacacttatcttcattgcctaacacataatcaattacaatgaccgtatcagaaaacggtttaaattctctgtatctttcaacgtcaacatccgtcttggcaaaaaagccaaaccaattattggaaagctgcttgagccattgatatactaaccggctcttcccaatgcctccctttcctactagcgaccaccacagcaattctttatctgctgaacaaaacttatttaactcaaccagttctttttctcttcctacaaatttgcagaactcatttaaataatgcagacgatatgatgctgtaaatgactttctagtttttacatatgggtttactctaataattcctgaatctctataccgtgtgcgaatccgataatttgccatgtcttcaacagaattagataaatcactgtattccattccatagcaaaccggtatcacattaggtcctaaatctgacaaatcatctcctgctttatgtagataaaaatatggaatgtttaagtgaagctgcttcgaagcaaatgacataaaccccttcagatttggatcatccacggttgctccacagccaagtataaccaatgtgcacgtactgataaggttctggataaactgtgcgccctgatttgctatgacatctttatactgtttttgatcagcaactatatcgtccgtatttgtggcagcatcataaataccatgaaggtgaattacactcatctctgcctgcccgctcaacatctgaactatttttcccggcatattatatgtataataacccagaccggtaacttcctccagaagcttatcatagttcgttgtcgcaaaataatccccgcagcgcacaaataaagtaagggccttcgccatctttttattctgtactctgagactgccaatcgtagagtccatataagccgtatagtttccattttttctcaatgcttctatcaaaaagcttgctgcatcaatcagttcggatgcactataagaaccgaatcttctatccaattcctccgcttcgacatcagaaagataagctttaccttccttaagccaaccaacccacccttttgcatgatcaccaagtgaaacagacaaacctgcaccacataggaatataataggtcgcccttgagaaagagcactttcaaatttgggataatccgatattttcataaactattctgcgagtttcgtttgcacacatatgcaatgtgcagtaatacctcgcgacctcccttctcacaatatttatgtacagaacttattttatcgaaggctgactccttttatgtcaaggctgttgacttggatgactaccgcacagcttgtgcggtgaataaatcatttttaattttatactttttcaagaaagtttataggattttgagttcccctatcatcataaagtcggtactatgagcgtatcggacttcctgttatccatttgaatttctatcgcatttctttggtttgattttcataccttttttcgaggagataacaggacctccgctgttctgtattgtatacttatcatcaacctcgccaagctctcagactgggggatgtttctgttccctagccatcagaagttatgactttacaaaaattttagccacttttcattttttctttcgcgtaccgtaccccttttaccacaaaaaaagaaatttcccgagtgcgttagcactcgggactttgtctgcagtctgcggaggagacaacatcgtctcctcctgttttatattccagccttagctaaacgcactttctgaatctagtgtcatcgtgaacaaattattaattttgtcacaagtcactataaacgttgcactacttcaatctcaatcatttcataatcatatctatgtatttttgacatcacaatcataaacacgtagcaatactaacttttcattatataatgttctcatcaatgatcttgaatcatcacaaagtaaatgtaatttttctccatctttaacacaaatacattccataaatcgtcttgctcttaatgcaggaagatcatcttctgtggttacatcagcatcctctggatgtgcatttccggcatcaacaagcttctgtaattgttcatcaaaatctttctgtttcatttgcttgctcataggtcttacattgaacaatgcaacttttgaaccataattttcaagttttttatacgtatttgaattttgtaattctcgttttatctcatcaatatcatttgaaactactttaacttcactgctcttttcaaactgtaaatcggtatgatttagcaattttctacaaaaactcttcacaaaattcggttcggtatcccttagtggattgtccaatatgttttgtaaagatgaccagaaaaaattatcagtaaaagctaaatatttgtcagactcttcttgcgatttaacccatttctctaaatccatacataatggaaaaaatgcattattcttttgcatccagttgacgatttgttctgccatccattccgttacaataatatgtttattaaacacaacctgtgaatatgaaaaaaacttatttattaagtattgatcagctgcagcaattcctttaggattaatacacaaaattggtttatgattatattctcctatctccatacaaccaatcaattgctccaattcaaacgcaccaaaactagtccctgaaaacattgcatctctcatcaaataatcaattccatccgcatccaattcagaatgcaaaatttgcactaataatggatttacatttactctctcagtattgccaataatcatatctgcaataatatcaggtgcattcgaatcgcattcatcttcaataatttttctaattgtcttattattgcaaacgatatctgcgccgattttttcatgatgatagcctgttgactgttccatatattgactcctaggatgatcttccaattcatcaatattcatttttactttcatatttacatttttgcagaattcttcatctatgtatatttcaaaagattttttatatggagattcacagacatgcgataacggataatgccctatgtcgtgcagtaacccagccattcgaacaattttacgttctttgattgataaattaagtttcactgcaattttgtcagcgatatacattactcctaatgaatggatatatcttgtatgctctgaacccggaaaaatccaatttactatacttaactgcttgatactttgcaaacgcttaaataatgccgtttgcataattttctcctctgcctctgtataatagataaatccatgcacattatctaaaactcgacctacaaattcaatttctgtttcagacataaaatctcctatcttatccataaagagtctttagttcactcagcgccatcttgttgtcacctgttttatttaaatgaggttttctcttttctaactcagacaatagcatttcatcggatgcattagatggtaaaagattctcttttatataatgcaatgaccccaagcattctgcccactcacctctattatagctaatctcttgattagttataacaccttttaatcttgataacattctctttgcttcttcagaaaaacgaacatcagcttctcctgtattgcttaagccaagaatatcattttgtaatgtttgtgaatatggaccatgtttataccacataaaattgtaatcacctacagaaacacccaaatcttgtaataaataaattgatttttgcatctccaaacgatcatcaaaagaatatcgatcaaaatcatgaccaaatattgttgagaaaacaggttttaatacatagtttgccatattatccctcctattttacttacatttaaaaagtgatagatattaatagtataccattttcaatgaaaaaagtacccctttttttaatttttataaaattattcgtaactgttcagaaccccctgattagattcaagtaatatttgtacaaaacagagaaattaatatttctgttttgcattgtgtttcctgtaatctgtggataatcaaaccacatgtacttcgttaattattctattgtggattactccacaaataaatgaaataatcatgtttcaaagctgtaatctgcagcttttgaataaatttagcaacacctgaaccttgaaatttgatacttatccaccgtcattttgacttagccatattgttctcctcaccatggattctaaatatcttccttatccatttcttctcttgatttcttggtaatattttccattcgaatataatattccaataatcgcaagacatattctggggcatgacgattatccacttcccacctactgcatatataccgcagattaaattcgacatccttcatatcgtctctactctaacgtgctgttttttacggcacgtttttatctgccctattgaccattctttccctatcatctatagtcagttttgtaaccaataaaaaagagaaggaacagccctgaccaaagttcgttctttctccataccatacaatgagtactgcaggcaggtcttacaggatctatgtcctaatggtttacgcctgtctcgttagcagtcttctcaatgcaactattatgataagaaaaaactctctgttttgcaagctgattcgtataaaaacttcatctaaatttatctttgattcctacatggctatatttcagccagaactggagacctgtccggtctgcggaagctgtaacaactgtcatgttcatgcttattacgaccgctccgttatcgatttccgaaacgggagaaaggtgactgacagtctctgcgttctccgtttaatctgcgacagctgccatcatacccatgccttgcttcccgacatactgattccatatgcctcttattccctgatgttcatcctccgcgtactgggggaatggtttcttggactaccactgaagattgtcatttttgacagatgaacagcatctgtcttatcagcatgcccttttttctgaatctgtatttccaagcaccaaaatatcctcttgcacatgtttcaatgcaaattcgaacaaaacctcgaacacctagtttaatggcattgcctggtattccaatgcatttttaaaaatctgatcgtcaggacttaggtgggtgtttttgtcttcatgagatatatacaaaaatataagttttttgtgttatttatctcttgacatcacaccgctggactatctctatctttctatcatatttctttgcataatcagccgtaataagcgagccacttcctttacctggcgctattataattacttcatccgcccaggcactaattagccgatttcttcttgggaaattatatctcattggttttgtccctggtggatactccgaaagcagcgcacctttttcacgaattttctccatcaacaattgatgttctgatggataacatatatccaaaccattccctactattgcaattgtataaccaccttcattgatatatacagtacttgcgcatgcatctatcccctttgccattccacttataactgttgtcccttgacatatatatttttctgttatttcaacacatttcttttttatttcttgactacaccttcttgctccaacaatcgccactgtatgatttagatttttcaattcgccttgataatataatacagctggagcgtcttctaactgctttgctttatacggatatttgtaattttcttttgtaaggatcaatattttttgtctttgacatttatctaaaatttcttctgctttttctaatgattttgaactttgaatactctcaatatgccttgagtttattccttttaccaatcgtaatgaatcttcagttgctttataaatctcaatcggattttcatacttttcgagtaacctatttgataatactggccctatattcggaatttgtgtcaaccatatccaatatttcaatctacttcaccaccatcattttactattgctctcatccagatctcggcacgaaataactcgtttgatatcctcaagcctgaccttatctactccatctaaatctgcacttgtccttgcaagacgtaatagcttatgaattactcttgcactataaccatatttttcacttgtttcctttagtaaattcaggctatctgcatccaactcacaatatttttgtaataaagtggttgtcatttgtgcattacaatttactccctcttcgttcttataccgttcctgttgtatttttcttgctgattcaacttttttccgtaattcttctgatgaatatgttgaactttcattttccatatcaaaaaatccaactggatgtacttctttttgaatatcaattcgatccatgattggaccggatatttttcctctgtatttaataatctcataatctgtgcatcgacatctggaacttggatagtatccacatggacatggattcattgccgtgacaaacatgaaatttgctggatatgtatgtgttccattcactcttgcaacagaaacctttttatcttctaccggttgcctcaaagcatctaatgttcttctggaaaattcaggtaattcatctaagaatagcactccattatgcgcaagtgatacttctcctggcattgcattaactccgccaccaattaaagagtttagagaagcattatgatgcggtgcacgaaaagggcgattcctaagcaaactatgtcctgccggtaaaagacctgctatactatatattttagtaacttccaaacattcttcttctgacattgtaggtaaaatcgacggaattctttgtgcgatcatcgtctttccgcatcctggttcaccaatcataagcatattatgtccaccagctgctgccagaagtgcagcatcaacaattttcttttgtccttttacatctttaaaatcaaatatctgtttattaaatgtgtcttctctctttttcttctttgatttttcaacaaagctttgttttccttccaaatattgaatcacatctattaatgttgaaaagccaaatatttctattccttgtacaagttttgcctcatccttattcgtttccggaataatgattttctttattccttcttttttggctgcaagtatcattggcagaattccacaacatgctctaagccctccgtctaaacacaattctccaataaaaccatattgctctaattctttcactgctatacttttatcctcctgcaataccccaatcgccatagccagatcataatgagaacctctctttttcttatcccccggcgcaagacttataatcactcttttctttggaaatatgtatccactttcatctattgctgactgaattctatccccggcttcttttactgcaacatctcccattccaataattgatgtcataggctgaccttctaatatctttgtctcaatatctacgttatatccttcaatcccttgtattgcaaaactttttaccacggtagccataattcattttcccccatacttttccttatttcgctctcctcaacgatatatttatgtgcaatatcttctacaaactctctataacgcaacacgctctgattattaaaatatgataatgttcgatttctctctgttatcctgtcatctttcagtgcgagcattgcccgataactgctccatttataatcttccgggtgtgctgccatctttgcttttactggatttaaatgaatgtatcgactcgtctgcaaaaaatatgcatccttttttaccaaacatgatttatatctgtcttcaaacaaatgtcctctatatccatattttcgattatatgttttcgcataatcaccggctattttctgcataatcttcccaatctcataatttgatgtttcaatcagcagatggatatgatttgtcattaaacaatatgcatgcacttttgcctcgtactcttccgtaacttttttcaatatgatcagaaatatttcatagtccatttcttctttaaatatctccagtcttcgaatccctctctccattaaatgatagatagctccaggataccactctctttcttttcttcctatattctcacctcttatttcattattaattcgtttatacgtatttaattgctaaatttttatgaaagctcttttagtgcttccaaatatccgatcaaccttttctgtgcatttgtatctaatttttgatatgtttccactaacattccgatttctgtctctttactaattacataggtattattatctctgcttctgtttcctgtatgctctgctcctgataacagctcatatggtgttacatccaacacttcgcaaatgatcaaaatcttatcacttaccggatttgttctttttttcttccaatcacttatggaactctctgcaattcctgttcgcgaatagtgggtaggattgtgggagtgcattgcacgaaacaatccgtaggtatcctagttgggggcttttgcccccaacatcaaaatatcagtatagttacgatataatatacagggctgtgaaaaatgaaaattttctggagatttttggaaaattgagtttttcacagcttttttttcgttcaccgaagtaattgatacaagagcagactctatgttaaaataagaaactgacagaatgcatatgcatacaacaagaattaatactaagaaagaactcaggcagaattccagaaaggaggctaccatggcgcgcattattttccacatcgacgtcaattcagcatttttaagctggacggcggttgaacaattgaaaaatggatcaaaagtggatctgcgggagattccggcgattattggcggagatcagagctcgcgtcatggaatcgtccttgcaaaatcatcacttgccaaatcctatgggattcagacgggtgaacctgtagtaaatgcatttcgaaaatgtccgaatcttgtgacagcaccgccgaatcataagatgtatcgagaaaagagcaggatgctgatggatttcctgcggacatatacaaagaagatcgagcaggtcagtgtcgatgaatgttatatggatttcacagagcttgccgggcgctatccaacaccggtggacggggcgatggagattaaggaagaggtaaagagacgttttggattcacggtgaatattggaatctccagtaataaactgttagcgaagatggcttcggattttcagaaaccggatcggatccatacgttatttccggaagaggttccgcagaaaatgtggccacttccgatcggagaactctttatggcagggcgttcaagtgtggaagtctttaagaaacttgaaattaatacaattggagatcttgctcgtgcggatgtaaatgtaattacgctgcatttaaaaagtcatggacggatgctttggaattttgcaaatggaatcggggacgataaggtacagtatgaaccggaagaggcaaagggagtaggaaattcaacgactctgtcagaggatgcaacgacttatgaagaagcgagagatgtatttcgtgagcttgcgcagagcgtgggaaacaggctgaagaaggcaggaaagaaagccgggatggtgagcatggaggttcgctattatgatttcagaaatatgtcgcatcaggtgcagcttcaaaagccgacgaatgatccggttatcttatgtgagacagcctgtaatttgttccgtgaaagctggagtggagaacctgtccgtctgctcggaatccgaacgtcaaagttagtagaagagaatgcaccggagcagctgacaatttttgatattgaatttccaaaagaaccggacgagaaacataaaaaattaaatgccgcattggaacagctgaacaatcgttatggaaagggtgcggttgtgaaaggcacattttataaaccggacggaaagaagaaaaaagatggaatttagaagagatagaaagaggaacgtgcattgaaagagaaaaattataatctggaattgattcgaatgatttcttttatatttgttattgtgatccatgtatcaaactattactgcagagcctatggcgatattacgattggggagtacagtttttcactgctattaaatctgctggcaaggataagtgtaccatgttttttcatgatcacaggagcacttctgcttggaagacaggaatcacttcataaacatgcaaaaagaatctttcgttttctaattgttctgcttgtgtggagtgtaatatatatgatctggaatgcagtttatatgagggatccttatcaaatcaaagatttattatataagccggtagaacagcatctgtggtatctgtatgcaatgattccgatctatctggtacttccttttttccaggttatgtgtaaagggatgaaccttcggatggaacgcgcatttcttgtggtgattacggcggctgttttgttcaattatatttccacattttttgatgaaaagatgtattattctgtcccaatggtgggggacagaatctattcttattatgtatttatcggatattatatatataaatatcgtaagcatgtgatgaaggggaaaatgattccggcaggtatttttgtagtatgcatggcattaaattatgggctgacttatgcggcaaccttgcaggatggagaacattatgaacgtctgctggaatatggtaatccactgcttgcactggcagcaacgatggcatttcttatgttagtacgattgaaaaagagcgaattcaatccgtccgaacaggcaaagaagtggattgacagattttgtggatgttcctttgggatttatttgatccatatcatgtttcttgatgtttataagagaaatattaagccagagacattttcagcctggatcatgattccggtagtgagtgtgggacttgtgttattgtcatttggatgtgtctggctgattcgaaagacgaaaacaggacgaaagattatgtaggtttttttgcatatgtggtgagattatgttattctataaaggttaagacaatcgttatttgcctgaaagtcaatgatgcaatacaccagttcagaacaggagggttagatcatgaaattagataaattattagaacgcctggactacacagtagtacagggaagtgattctacggaagtaacaacactgatcaatgattcaagaaaagtggaagaaggatctgttttcgtgtgtatcagcggagcagtatctgatggacataaatatgcagcggacgttgcggcgaaaggtgcggcagctgttgttgtagagaaagatgtcgaagtgccggacaatgtgactgtaattaaggtagaggatactcgttatgcactggctctgatgtcagcggcttactttggatatccggcagataagatgaaagtcatcggtattacaggaacaaaaggaaagacaacaacaacttacatgatcaagtctattcttgaagagacaggacacaaggttggattgatcggtacaatcgaggcaattatcggagacaagaagatcccgtcatgtaatacaacaccggagtcttatacaatccataaatattttgcagagatggtagaagctggctgtgactgtgttgttatggaagtttcatcacagggactgatgcttcacagaacagcgggaattccatttgagatcggtattttcacaaatcttggaagagatcatattggtccgaatgagcataaggattttgatgattacaagagatgcaaagggcttttgtttaaacagtgtaagctcggaatcgccaatgtggatgacaagtatttcaaagatgtatttaaagggtctacatgtaagattgagacatttggattttcaccggaggcagatcttcgcgcagagaatgtagaactggtatccagaccgggatatcttggtgttgcataccatgttgcaggcgtgatggactttgatgtggaaatcgatgttccaggcaagttcagtgtttacaattcactgactgcaatctcagtctgccgccatttccaggtgccggttgagatgatcaaagatgcacttaagaaggcaaaggtaaaaggacgtatcgagatgatcaaggtgtctgatgattttacactgatgatcgattatgcgcacaatgcgatgagtcttgaaagtcttctgacaacattgaaagaatataatccgaaacgtcttgtatgtctgttcggatgcggcggaaaccgttctaaagacagaagattcgagatgggtgaggtatctggaagactggcagatctgacaatcattacatcagataatccgagatttgaagaaccacaggatattattaacgatatcaaaaccggaatcgcaaagacagatggaaaatatgtggaaatttgtgatcgtaaagaggcaatcaaatatgcaatcgaacacggcgaaccgggtgatgttattgtgctggcaggaaaaggacatgaggactatcaggagatctgcggcgtgaagcatccgatggatgagcgcgtgctgatcaaagaagttttggaagaattaaaagagaaataagattgtgtttgcagatgttattgtagatatacaacatgaaaaactggataagatctttcagtaccgaataccggaacgactgaaagacgagctgcatccggggatggaagtaattattccttttggaaaaggaaaccgacagatcaaaggttatgtgacttcattatcagagacttgcaattatgatctgtcaaaggtgaagaaaattacagacatttccagaaacagtgtggcaatcgaagcgagactgatcgcgctggcggcatggatgaaagagcagtatggcggaacgatgatccaggcgcttaagacagtgctgccaatcaagcagaaggagaatgcgaaggtaaagaaacatctccgtttgctgcttactgaggaagagagtcaggagaagctggctttttatcagaaaaagaatcagaaagcaagagcaaggcttttggaagctttgaaggaagccccaattctggattatgagctggtgacgaaaaaattaaatgtgacactgcctgtgatccgggcattggaagagcagggcgtgttgaagatagagtcagagcaggtataccgtaatccggtgaaacaggcaaagaaatcacaacaggagatcatctatacggaagaacagcagcatgtgatccaggggttccggcaagactatctgtgtggaacaaggagaacttatctgcttcacggagtgaccgggagtggaaagacagaagtctatatggagatgatccgcacggttgttgaccagggaaaacaggcaattgttctgattccggagatcgcactgacctatcagacagtgatgcggttttaccgctgtttcggcgacagagtttctatcatgaactcaagactgtctgccggagaacgttacgatcagatgatgcgtgcaaagaggggcgaggtcgatgtgatgattggaccacgctctgcactttttactccatttccggatttggggctgatcgttattgacgaagagcatgaaccaacctacaagagtgagcaggtgccacgttatcatgcaagagaagtagcagtccacagggcagaagtagaagatgcaagcgttgtgcttggaagtgcaactccgtcgatggaggcaatgtatcgggcaaggcttggtgagtatcagctttacgagatgaagaatcgttctcatatgcaacagatggcgactgtgcatacagttgatatgcgaaaggaactgaagaatggaaaccgttccatcttgagtgagaagttgcaggaactgattgaagacagactgaatgcaaaagagcagatcatgctgtttttgaatcgcagaggatattctggttttatttcctgcagagaatgtggccatgtagtgaaatgcccgcactgtaatgtatccttgtcggtacacaaaggtggaaaaatggtctgccattactgtggttatgaacagccgaaggtgacggagtgtccggaatgcggttcccgttatatcggagaatttcgtgcgggaacccagcagatcgaggacatggtgaaagcaagatttccacaggcaagagttctccgtatggatatggatacgacgaagaaaaaggattcccatgagcagattttatctgcctttgcgaatgaagaggcggatattcttgtgggaacacagatgatcgtaaagggacatgattttccaaaggtcacattagtcggtgcattggcagcagatatgtcactttatacagatgattatcgttccggtgagcgaacatttcagcttttgacacaggcagcaggccgtgccggaagaggtgacagaccgggtgaggtcgtgattcagacttacgatccggagcattatgcaatcgaggcttcagcagcgcaggattatgaagcattctatgagaaagaaatccgttaccgcagtctgatgggatatccaccggtggagaacctgatggcagtacttgcagtatgtgaagatgaggtgcttttagagaaagcgtgcaagtatctgaaggaatacattttgcggatcaaaggtcaggcacagctcgatgtgatcggcccggcaagtccgggagtggataagatcaaagatatttaccggagggtgatttacgtaaaagcgccggaataccgaaccttagttgtattaaaagacaggatggaacaatatatagaaattaactcagggtttcagaaaatgagaatccaattcgattttaacccgatgaatttatagaaaagagaggaaagaataatggcaatcagagaagtaagagagatgggcgatgatgttcttgaaaaaaagtgtaaaccagtgacgaagatgacacttcgtacaaagattttaattgaagatatgcttgatacgatgtatgagaagatgggggtgggtcttgcagcaccgcaggttggtattctcaaacagattgtagtgattgatgtcggagagggtccgatcgttttgatcaatcctgagattgttgagacatccggtgagcagacaggcgaagaaggttgcttaagtgtgcctggaaaatggggaatcgtaactcgtccgaattatgtaaaagtacgtgcacttaatgaaaatatggaggagtttgagatagaaggagaagaacttcttgcaagagcgttctgtcatgagatcgatcacctgggaggacacctctatgtagagaaagtagaaggagaactgcatgattcaccggcctacaacgagggagatatggaatacgaagtggaggaataattgatgagaataattttcatgggaacaccggacttctccgtgggaacactggaggcactggtggaagcaggacatgaggtatgtctcgtagtgagccagccagataaaccaaagggacgcggtaaagagatgcagccaaccccggtgaaagaagctgcgataaaacatggaattccggtttatcagccaaagaagatccgtgatccggaatgtgtagaagaactgagaaaatacaatgcagatgtgatggttgtcattgcatttggtcagatcattccgaaagaaattctggagatgacaccatacggatgtattaatgtacacgcatctctacttccgaaataccgtggtgccgcgccaatccagtggtctatcatcaatggcgaggaagtgacaggtgttacaacaatgcagatgaacgaaggactggatacaggcgacatgatccagaaggttgaagtgccgatcacagaagatgagacaggagaaagccttcatgataagcttgcagaggcaggagcaaagctttgtgtaaaaactctgaaagcaattgaagatcatacggcaactttcgagaagcagggtgaaagcccgacagaatatgccagaatgctcgataagaagcttggaaatattgactggaatacatccgcagtacagatcgaacgtctggtgcgtggcctgaattcctggccaagtgcttacacacattgggacaaaaaggtagtgaagatctggagagcaaaagcagaggctgatggcacggtaaaagcagagcctggaacagtgttgagtgtagagaaagattcctttactgttcagacaggggatggcgtcttacgagttctggaacttcagattccggggaaaaagagaatggatacaggagctttcttaaggggatacacaattgaaagcggagttaaatttacacaggaataagaggacttctagagggggactgcagatagataacaggaggtagttttagtatgtattatggattttattatgactggacttatatactggtactgatcggtgtggttctcagcctgctcgcatcgtcccaggtgaaaggaacatttgcaaaatattcgaagatccgcagttattcagggatgacaggacgagaagcggcagaacagatcctcagaagaaatggaatctatgatgtgcaggtgactcatattgcgggaaatctgaccgatcattatgatccgagaaacaagacactggcactttctgatccggtttataattcaacttctgtagcagcaatcggagttgcggcacatgagtgtggtcatgcagtacagcattttgaagggtatgcacctttatcaatccgtggggcacttgtgccggtcgtaaatttcggttccatgatttcctggccgttgatcattataggcctgtttatgaatggccagatgtccagcttccttattgatatcggaattctgctctttatggtagctgtggcatttcatcttataacacttccggtggaaatcaatgcttccagaagagcggtgaaggtacttggaaattcaggaatgctccgtgaagacgaagttggtggagtgaagaaggtacttcgggcagcagcaatgacatatgtggcaagtgcggccgcaatgattttacagcttttacgtttgttgatcctgacaaatggacgaagaaggaatgactgataaaaagaaaaaatgctgtaactgttcagagccaacctccaaaatgcggagaataggagattatttatgggaaagcagatcaatgaacgcgaggtcgttcttgagattttgatggaaataacagagaatggagcatatagtcataagattcttggcgatgttctgtcaaaatatcaatatcttgagaaacgtgagcgtgcatttattaccagagttgtggaaggtactctggaacatatgatagaaattgattatattttgaatcagatttctaagacaaaggttaagaagatgaaaccggtcatccgtaatcttcttcgtagcagtgtctatcagctgaaatatatggatagcgtaccggatcatgcggtgtgcagtgaggcagtaaagcttgcggttcgaaaaggattttcaggtctgcggggatatgtgaatggagttctgagaaatgttgtccgcaagatggatgagatcgagtatccaaaagaagatgtacagagattgtctgtgaaatattctgtcccggaatggattctttctttatggaagaaagaatatggggaagagattacagagaagatggcagcagattttcagaaagagaagccgattacgatccgatgttgtatgaaccgggttacaccggaagtattgaaagaaaaactggaagcagaaggagcgaaagtagaagcacatccgtatcttccttatgcgttttatctttcagattatgattatctggaaggtctggaaagttttcaggaaggactctttgcagtacaggatatcagttctatgtttgtcggagaactggcagatccaaaagccggcgatcatgtaattgatgtctgcgcagcaccgggaggaaaatcacttcatgtggcagagaagcttcagctggcagatgaagtggcggcgagagagaatggaacagaagaaaagacaggacgggttgaagcaagagatctgactgaatataagacagatctgatttggcagaatatcgaccgttccggacttggaaatatttgtgctgtatgcaaggacgcttctgtatttgatgagtatgataaggaaacagcggatcttgtgattgcagaccttccatgttcaggtcttggcgttcttggcaaaaaaccagatctgaaatatcgcgtacaaccggaagatcttgaagaacttgcagatttgcagagaaagattctgacttgcgcacaggcaatcgtcaaggatggcggcacattgctgtacagcacatgtaccgtaaatccgggagaaaacatggacaatgtacactggttcttgaaagaatacccacaatttgaactggatgatattacagaaaatctttgcaaggagttacgaagtgatgtgatcgagaagggatgtatccaattcttcccgggagttcacgattgtgacggattctttattgcaagattaaagaaaaagcatgattttcaggaaatgtgaaaaaatagaaaaagcaaacaaataatgtgaataactcacagaaaaaacgaaatacaggaggaaaactttaagatgaagaaggatatccgtgcttatggatatgaagaattacagaaagagatggcgacgatcggagaaaaagcatttcgtgcaaaacagatttatgaatggctgcatgtgaagctggtagatcattttgatgagatgacgaatctttcaaaggctttgagggaaaaactggaagagaattatgagattctcccggttgttatgcttgagagacagatttcccagattgacggtacgaacaagttcctgttccgtctctatgatggaaatgtagtcgaaagtgttcttatgaaatataagcatggaaattctgtctgtatttcctcccaggtcggttgcaggatgggatgtgcattctgtgcatcaacgatcggaggtctggtgagaaatctttctccgtctgagatgcttggacagatctatcagattcagaagataagtggtgagagggtttcgaatgtggtgatcatgggaaccggagaaccgatggataattacgataatttcctgaagtttattcatttacttacagatgagcatggactgaatatcagtcagagaaatgtcaccgtatcaacctgtggaatagttccaaagatgaaagaactggcgaaagagcatttacagattacacttgcactttcgcttcacggttccaatcaggaaaaacgaagaaaattgatgccggttgcaaataaatatgatatcacagaagtactcgcagcctgtgacgaatatttcaaagaaaccggccggagagtgagctttgagtacagtcttgtacatggtgtgaatgatacggatgaagatgcacaggaactgattcatttattaaagcataagaactgtcatatcaatctgataccggtcaacccggtaaaagagcgtgattttgttcgtccaagccggaaaagtgctttgaatttcaaaaataaacttgaaaaaagcggaataaatgttactataagaagggaaatgggctctgatattgacggagcctgcggtcagctcaggcgccgctacgtagaaactgaaggagaatagaaggtatgaagacattttcaattacagatgttggaatggtgcgacaggtaaatcaggactacgtctttacgacgggaaaaccactgggtattctccagaacctgttcgtggtagcggatggtatgggtggccatcaggcaggagattatgcttccaagtgtacggtggaagtgatgatcaaagagattgcgaagagcgagggtgaggatatcgaacgtgttcttgtgaaagcaatcaaggctgccaatcgtgagattatcaaagaagcatccggtgacgaacatctgaaggggatgggaacaacggttgttgccgctactgtgaaagaacagatgctgtattttgccaatgtgggagacagccgtctgtatctgatcaatcagggaatccaacagctaagtaaggatcattctcttgtagaagagatggttcgtctcggtggaattaagccggaagaagcgaagcatcatccggataagaatattatcacaagagcgatcggtgcaaaagctgatgtggatgtggacttttatgaacaccgtctgaaacggggagacatcattctgatgtgtacagacggattaagtaatatggtggaagatgaagaacttttccatattgtgcagggaagccgggatatcgtcgaggcaggtgagatgctggtggaagcagcaaaagagaatggaggaacagataacatcggagtggtattgtttgagccatttgcagatgaggtgagtgtatgattaaagaaggagtatttttagggaaacgatacgagatacttggtcgtatcggttctggcggaatggcagatgtctataaaggcaaggaccataagctgaatcgttttgttgcgatcaaggtgttgaagagcacatatcgttcggatgagacgtttattaagaagtttttaagcgaagctcaggcagcagcaggattgatgcatccaaacgtagtcaatgtctatgatgtagggcaggatcgtggtctttattatatggtcatggagcttgtagaaggaattacgctgaaggattatatcgagaagaaaggaaagctttcagcaaaagagacgatcagtatttctattcagatggtgacaggcattcaggcagcgcataactgccatatcattcaccgggatattaagccgcagaatattattatttccaaagatggaaaggttaaggttactgatttcggaatcgcgcgggctacgacatcaacggcaacgcaggcagtaacaacaacggtgatgggatctgtacattacacatctccggaacaggccagaggcggtattgtagatgagaagagtgatatctattcagcaggtatcacgatgtatgagatgatcaccgggcatgttccgtttgacggagattcgacagtaacggttgctttgaaacatttgaatgaagtgattaagtctccagcagaagaagtaccggatattccgtacagtctggagtgcattattatgaaatgtacacagaaactgccgaataaacgatatatgagctgtgaggaactgcttcaggatctgaagcactcactggtagatccggatggagattttgtagttcttgatggtgtgacaaaacgtatgccggcagcatctcaggatacaggacggaccacggttgttatgtcacaggatgaactgaatcgtatgaagaatcgtcaaaattataatgatgattatgacgacgattacgaggatgactatgacgattacgatgaccgccgcagaagccgttatgatgatgacgatgactacgacgaccgccgcagaagccgttatgatgatgacgatgattatgatgatcgccgcagaagccgcgaatagtgggtaggattgtgggagtgcattgcacgaaacaatccgtaggtatcatagttggggacttttgcccccaacatcataatatatagctgagaaaaaagaaggaggaattcgatggaacagaacagcaatgaaaaagacagagaaaatttatccatggaagaatatctgaagaggagacaggcagtaaaaacccgggaaacagcttcgcatgtcgcccggggagtagattctgtcagtgcattactgactgcagtattttatttatgatcagaattgtcttttgaatcatctttcaacagtcgtgtgaccagcagcagtccatagagaataacaggaacgaaaatggttgcagcgatagatgctttgagaagatcagaagcaacaggtgaatcaatcagtgcaaaaatcagtgtgcacaaatacattgcgataagaataaaaactcctaacagtgcagaaatacgtttcagttttttcatgtgaccagtcctttcatacgccaatatagtaatagtaacagtatatatcaaataattgtttacggcaaataaaatttgttatataataaaagggcgattgaattcgaagtttaaagataaaggagcaatatacaatgagtgagaaatgtttattagaccagtggcgtgatatggcctatgaccgtaatcttccgaaagatcagctggagaagttctggggaacatactttacaatcgaaagagagatttacgagcagctgctcgagaacccggatgaagaagtgaagggaacagtgaaagagcttgctgagaaatatggacaggatgtcatgacaatggttggattccttgacggaatcaatgacagtctgaagacagcaaacccgatcgagacaatggaagaagatacagttgtaagtcttgcatttgataaagaacttctttacaagaacatgatcgatgcaaaagctgactggctgtatggactcccacagtgggataagatctttgatgcagagacaaagaaacgtctgtatcgtgagcagaaacagtccggtacagttcgcaaggcgaaaaagatcggaagaaatgatccatgtccgtgcggaagtggaaagaaatataaattctgctgtggaaagaacgcataagaatcagattactggcggtatgtattgagagatacataccgttttgtgtttttggatataagtgtatatatttaaaagaaagggacatactgatattgttctaataagattaagaggaggaaatcagtatgccagaattaagctgtaccgtacagacatgtgtacacaattatcagtatctttgcgaactggataagatccaggtgggaggaaacagtgcgaagaatgcgcaggagacctgttgcgataactttgaagaaagaagagagggaagttatagcaataagacggattcgatgaagtctgtttcagattgctcagacgttgactgccaggcgaaagattgcagatataatgaagagtgcaaatgtcacgcagggaaaatcagtgtagaaggcggtgacgcctgccacagcagtgggacagaatgtgcaacatttgattgttgccgtaattgagcatcagataaaagtataaaatcgtgataaatagaaagagatttggaagagaggatcttctgaatctcttttttctactgttgactctattattgcaaccgcgttataatcgtaatatgtatatttaacagaagaaaggaaatgatcgtacatgagtgaatatcgacaggatgagcatacgacagcgaaagaggcgtcaaagactcatacagatcaaagttataggcacaattcgtgggaagagcatgaaaaaagaaggtatagcttcaaagaacagaccataaaaagtatgacgttgttcttcgtagttgcgacatgtatcttattttattttgcacttttgagattgggacagatttcgtctgtatttaagcagtttttaacagtggcaaaacctattatttatggactggcaattgcatatttgctgaatccgattgtgaagtggatagaccgtcggatgattccgcttttggagaaacattgtcccaaattaaagaagaaaaaacagatatcaagaggagttggaatcttcgtatctgtcatcttaatgttggcattgattactacacttctcaatatgatgattccggagttatatggaagtatccgcgacatgattttcaatgtgccgagtcagatgaaccggtttatccatgaattcagtaagatgcattcttctgattcaacagttggaaagatgttggagagcatagttgaagaagcaagtgattttgttcagaactggatgaagacagatttgatggagaaagtgaatctgtggatgacacagcttactgtgggaatgattcagatggttcgtgaagtctttaattttattattggaatcattgtctctatttatgttttgtttagcaaagagaagttccagaaacagacaaagaagctgatctacgctgtatttcgtccgggacaggctaacatgattctccagattggcggaaaaagcaatgagatcttcggtggatttattatcggaaagattattgattctctgattatcggagtaatctgttttataggattatcaattctgaatatgccatatacaatgctggtcagcgtgatcgtaggagtgacaaatgtaattccattctttggaccgtatatcggagcaattccgagtgcaattctgattctgcttgcagatccattgaaaggactctattttatcatttttgttattgcattgcagcagtttgatggaaatgtgctgggaccaaagattttaggaaattcgacaggactttcctcgttctgggttgttttctcaatcctgatcgcagggggattatttggtattccgggaatgctttttggcgtaccgacatttgcggtgatttattatattgtaaatatgctggttaattctatcctgaagaaaaaagaacttccaacagatacagagtgctatgggaagaacggatatgtagattccgaaggaatttatatacagaaagaaaaacaggaagagataaaagaaatacaagaagaaaagggagataaggacaatgccgattcgagtacaaaatgatttgccggtaaaggaaatattggaacaagagaacatcttcgtgatggatgagatgcgtgcggcacatcaggatatccgtccgattagtatcggacttctgaatctgatgccacttaaggaagatacagagcttcagattctgagagcactttcaaactctccgctgcaggtggatgttactttcgtaagagtaacaagtcatgtgtcaaagaatacatcaacaagtcacatttataagttctatgaagcttttgatgatatcaaggataaaaggtttgacggatttattatcacgggcgcacctgtagaacagatgccgtttgaagatgtagattattgggaagaactgaaacgtattatggagtggacaaagacaaatgttgtgtctacacttcatctttgctggggagcacaggctggtatttattatcattatggaattgataaggtacaacttccggaaaaacgttcaggtttgttctggcaccacgtaaggaacagaaagattccgatcgtcagaggatttgatgataagtttctggcaccgcattccagacatacagaagttccgcaagatctattggaaaaagatgacagaattacaattcttgcagattcggaagaagcaggagtttatctttgcatggcgcaggatggacgtcagatctttgtaatgggacatccggagtatgatagaatgacactggattccgagtataagagagatatggggaaaggattgaatccacagattccggaaaattattatccgaatgatgatccagagaagaaaccaatgctgacttggagagcgcattgcaataacctgtatacgaactggttgaattattacgtatatcaggtgacaccttatgatctgtatggaacaccgttctaaaggtttggattagagagttttagtataacgataagaaaaaacaaaaaagcaccttcggaagatactattcttccgaaagtgctttttctatatcctgttgccgattacgaatatcctcaacaactctgaaaccaattcctatcgcccaatccagttgtcgaaaggatccggttttacagatatgaaatcattctgtacattcgcgctgttcagcttgatctgctgtctgctcttttcagcagcttcttcagattcaaatagctgatcttccggcattgtcagtgcgccgcaggagccgatcagctgaatgatatagttatccccctgcttgcgtgcaatctttcctttacgaattgttgtgttgttctcaagaatatatataacatcatctttgttgtacatcatttcacatcctcttcatcaaattccagggtgatatagttgaatctgtcgtccttccagatcttaatgactttgcctttgcgggtcttcaagcgttcccggttcttgaaattcgtgcttgcgccgtaggcatgctcgagcatataccaataggaagtgggaagctcatgttcgacaatctccaaataatcaccgacagagcagcaatctggctgttctgtagtaaagtccattgttcgcatactctcaccttctgtttcgtgtctatagaatctattatactctaaacacagaatatctcaagagaattatttcaccaacttgttttttactttcaagtattttataataatgaattacagtgcttgcgggcaggaaagaataaacttcctgtatacgagacaagaagaatgagaaaacagataaaatgtggtaactgttcagaaccaaccttcaaaatgctacgcattttgaaggtgtggcgtatccgccaaataaaatttcaaaaacagtcttaaaaatacaagcattttacatcttttttgaaattttgcttggctctgaacagttacaaaatgtgaaaataaattggaggttattaacagagatgaatcgaattgcaagatttgaaaaagtgagtaaagaaaagttctttgaagggtggaaagacacatttgagacagcggaagaaaaagagatggaagcaatctacgagtctttaaaactgccgggaagagcgacagccggaagtgcaggatatgacttttttgcaccggtgaagatcacactgaaaccgggagaaaccgtcaagattccaacgggagtccgtgtgtggatggaacaggactgggtactgaagtgttatccgagaagcggactgggattcaagtacagactgcagctgaataatacagtaggaattatcgacagtgattattattattccgacaatgaaggacagatctttgcaaagatcacaaatgattctaatgaaggaaaaaccgtagaagtagaagcaggagatggattcatgcagggaatcttcgtacagtacggaattacattagatgatgacgtgacagaagtaagaaatggtggatttggaagtacaacaaaaaagaaataaaaggctgacagaataatttgtaagaaaaagggaaacctaaactcagtgaagccaaggcaaataagaggcagaaaaaagagggttaggttttatgatcaaaaagattaaaaaagaagtcggttgttcttttaaagaaaatattcaatatatggatcagacccttccggtggagaaaagctttgacattatccgccgggagatggagatcggtggaaaagaatcggtattctactacattgatggatttataaaagatgaagcaatgttaaagattatggattcttttctttctattacagccgaagatcttccgcgggatgcggaaactttttcaaaacagaagattccttatgtagaagtggatgtgctgaaatgttttgatgatattctgagaaatgtactctccggtacagcggtgttttttgtagagggttatgatgcggcactgtgtatggactgcagaagttatcctgcccgtggtgtagacgagccggataaagataaatcgcttcgcggttccagagatggttttgtagagacaattgtatttaatacggcactgatgcggagaaggatcagagatccacatctgattatggaaatgacagaagcaggtcagagttccagaacggacatagcagtctgttatatgtcagaccgtgtagatgaagaacttttaaacaatataaaatcaaggattgagaaacttgaggtagatgacctgagaatgaatcagcagagtcttgcagaagcacttttcaagagaaaatggttcaatcctttcccaaagttcaaatttacagagagaccggatacggcagcagcctgtcttttggaaggaaaggttgtgattctggtggataactcgccgtcggcaatgatacttccaacgtccattttggatatgatagaagaggcaaatgattattattttccgacattgaccggaatgtatctgaagatttccagaaccctgatcacaatcgcaacggtgttttttacaccattgtatctattatatatgcagaatccgcagtggctaccgggcgttttttcatttgtaatggtgcgtgatcagatcaatcttccattgatctggcagtttcttctgcttgaactgtcaattgacggtttacggctggctgcaatgaatacgccaacgatgctcagtactccactgagtgtgatcgccggtattgtgatgggagaattttcggtagaatccggttggttcaattcagaagtaatgctatatatggcatttgtggcagtggcaaattatacgcagccgaatttcgaacttggatatgcattaaaatttatgagactgatgcttcttgtactgactgcagtgtttaatttgtatggatttgttgcgggatgtattttggtattatgtttcctcgtgtttaataaaacactttcaggaagaaattatctaaatgtaaaaattaactgacaaaatcttaattttgttaatatatctttgctctttattataaaagatggtatgatatagaaaatattgcttatccggaaaatacatgtctgctatatggaatgtagtggtggtttccggaagaaagagagcaggaggttattgacatgagagagttcattattaccgtgaacagtactgtagacttaccgaaggaatggctgaaagagagacatgttccggttcttccgttgaaatatacgattgatggagaaacttacacagatatgtcaggattgacagcaaaagagttctttcagaaattaagagaaggccatatgtctgtgacttctcagattaatccggaggaagcacgcgagatgcttgaaccgtttgtgaaggaaggaaaagatgtacttcatcttggattctcttccggattaagcggaacatgcaatagtatgcgaatcgcggcggaagaactggcggaggattatccggaagcaaagattatcgtgatcgatacactttgcgcctgcctgggagagggcttgcttttgtactatgctcttaagttgaaagaagaaggcaagacgattgatgagatcgcaaagtgggcagaagagaacaagcttcacgtttgccataatgttacggtggatgatctgaatcatctgcagagaggtggacgtatttccaaagcggcagcagttttggggacactcgtgcaagtgaaaccgatcatacatatggataacaatggaaaacttcaggtgattgcgaaagaacgaggtcgcaagaagtctctgaataaaattgttgatatggcagtagaacagtcgaaaggctgggagaatgagatcataatgatcacgcacggagattgcctgaaagatgcagagtatgttgccggacgtgtcagagagaagatgggaatagagaatattctgatcaataatatcggaacagtgatcggaagtcatacaggaccgggtgttgttgccgtattctgcatgggaaatgaaagataaatttcgaaaaaaataaaaaaacaaaagaaaatgcatttaaagtgttgacaggaaagagtggatatggtagattagatgttgcgttaagcaaaaaacaaagtagagtatccactctcaccgcagcacaattgagtgactgatggtccgatatcgataataaggagctcctgttggagttattacatttgtcgggtggatatgatattcactcgtttttttgtgttttcgcgtaagaacctaaaggaaattcatttgacggaggtatacgacaattagcgatttaatgattaacgagcagatcagagataaagaagtaagattgatcagcgcggatggggaacagttaggcatcatgtcatccagagatgcaatgaagcttgcacaggaagcagagcttgatctggtgaagattgcaccgggagcaaagccgccggtatgtaagatcattgactatggcaagtacaaatacgagcagactcgtaaagagaaagaagccaagaagaaacagaaaactgttgaaatcaaagaagtgcgtttatcaccgaacattgatacgaatgacctgaataccaaagtgaacaatgctaagaagttcatttccaaggggaataaggttaaggtgacactgcgtttcagaggtcgtgagatggctcacgtacagcagagcaagcatatccttgatgattttgcaaagcagctggaagatgttgctacagtagaaaaggcagcaaaactggaaggcagaaatatgagtatggttttagctgaaaaacgttaagacaatatgatccgggatgaagatcctgtaaggcagcacaataaaggaggaaattatcatgccaaaaattaaaacaaatagagcggcagcaaagcgcttcaaagtaacaggtacaggaaagctgaaaagaaataaagcttacaagagccatatcttaacaaagaagtctacaaagagaaagagaaatctgagacaggcaactattacagatgcaacaaatgtaaagaacatgaagaaggttttaccatatctgtaagatttggaagtagattaaggaggagattaggaaatggcaagaatcaaaggcggaatgaacgctaagaagaaacataacagaacactgaaactggctaaaggatacagaggagctcgttccaaacagtacagagttgcaaaacagtctgtaatgagagcactcacatcttcttacgcaggaagaaaacagcgtaagcgtcagatgagacagctttggatcgctcgtattaacgcagctgcaagaatgaatggactttcttacagcaaattcatgtatggtcttaaactggctaacgttgacatgaacagaaagatgcttgcagagcttgcagtaagcgacaaagaaggattcgcagcactcgcagcagtagcaaaagagaaacttgcttaatttgagcttgtattttcacccggttttcttcggaagaccgggttttcttattgtattaattgtatataaaaaataaatttttaaaaaaattaaaaaaactgttgacatttaatgccgcaacgtgtattatagtcgttgtggcaaggcggtaacgcagatgaccacggtaaaatgatgatatgcggaagtgtcggaactggcagacgagcaagactaaggatcttgtgatcaatgttccgcgagcacctgtaaacttgttgaatacaagtccttttccaaagaatgcagaactgcgtttttcgaatacttcagcatacatcggatcataagctgcgctcacatcagaagaaagcattctggaattcatcagcgctcttctgactttcaggtcagactccccttctgtcagtgccacaagttctgcaactgtattttcaaagaaacgagaatgcattccggtcgcaccgacacttccgatttcttctttatctacgagaatgcaacatgctgtgtgctccacttctttcacatcaagcattgcaaagagagaggtaaatgcacatacacggtcatcctgtccgtaagccagtaccatactgcgatccaatccacagtcgcgggcctttcctgccggaacaatttcaagctctgcagagaggaaatcctcttcctccatgtcataatattgtttcagaagattgattacatttgcttttacagcctctttttccttttcttctaatgtctcatccagctcaatcgggcggcttccgatcagaagatcaagcttctctccctctacaaccgttgcagcctttttctccatctgtttcgacgcaagatggatcagcagatccgtgataacaaaaactggatcatcttctttttcaccgatacttacctgaactgttgtgccatctttctttgcaatcactccatgaagggcaagtggaagtgtcacccactgatatttcttgattccaccataataatgtgtatcaagataagcaaactcttcattctcatacaatggattctgttttacgtcaatgcgcggggaatcgatatgagctccaagaatattcataccttctgtcagcggttttgtacccatatgaaacagcgcaattgttttgttcatacatactgcatacagtttatctccggctttcacttcttctccatttttaatgatatctctgatatccttatatccttctgcttttgccttttcaactgccaatgtaacgcactcgcgctctgtcttgccggcatcaaggcagttcttgtattctgtattcacctgttctaatctgtccagctcttccttactgtaagttgtccatgcattttttctgtccatgtcattctcctcctgttctatcttccatgctattttaaagttataaagaaacagcccaaactgaatccacaagcttacctgtgaactacagtccgggcttttcttatttatcttaccactcgaatttcttctcgaagtatgctttcagatcttcaatcttaactctttcctgttccattgtgtcacggtcacgtactgtaacagctccgtcttcctcagaatcgaagtcatatgttacacagaacggagtaccgatctcgtcctgacgacggtaacgttttccgatatttccacgatcatcgaactcacagttgtagtacttggataactctgcaaatactttctctgcgccttcgttcagtttcttggaaagtgggagcacaccgatcttaaccggagccagtgccggatggaaatgaagtacagttctcatatccggtttctcttctgttccgatattctcctcatcatatgcactgcaaaggaatgcaagtacaacacggtcagcaccaagtgatggctcgataacgtatggaatgtatttctcctttgtctcatcatcaaagtatgtcatatcctgtccggatacattctgatgctgagtcaggtcataatctgtacggtcagcgattccccacagctcaccccatccgaatgggaaaaggaactcaacgtctgtagtagccttactgtagaaggaaagctcttcctgatcatggtcacggtaacgtacttcctcatctttcagtccaagagatgacagccagttcagacagaagctcttccagtaatcaaaccactcaaggtctgtgtccggtttgcagaagaactcaagctccatctgctcgaactctcttgtacggaatgtaaagttacccggtgtgatctcattacggaaagacttaccgatctgtccgataccgaatggaagtttctttctggatgtacgctgtacattcttgaagtttacaaagataccctgtgctgtctcaggacgaaggtatactgtgttcttcgcatcctctgtaacaccctggaatgtcttgaacatcaggttgaactgacggatatctgtaaaatcatgctttccacaagtcggacatggaatgttattatcctcgataaatgctgccatctgctcctgtgtccatccgtctacagagctctcaagctcgattccattctctgctgcataatcttcaataatcttatctgcacggaaacgctcatgacactgtttacagtccatcagcggatcactgaatcctccaagatgtccggaagcaacccatgtctgtgggttcataaggattgcacagtcaactccaacgttgtatggattctcctgaatgaacttcttccaccatgctctcttcacattattcttaagttcaacaccaagattaccataatcccatgtgttggcaagtccgccgtagatctcagaacccggatatacgaatcctcttgactttgcgagtgctacgatcttgtccattgtcttttcaaccattgtatgttcctcacattcttttttatcatttacattatttatataccttatgcactttggtcagtattttcagagaagttatccacattttcttaagaaaatattcaccttgcacatcaatgttacttattataactactaatgccttatttttcaagctgttttaagtacttctctttatgtttccgcttatattcatacataacttcatccgctctttgcagaatctcttcggtagaaactatatcatgtctttcagggagttctgtaataccgtaactgaagctcttcggatagtcattgtcttcctccttacagaatacttcatacacatgctcaaatttcttcttcataatttctttcgaacaattcaggagcacaatacagaattcatcaccgccaagacgcacaaagagatctcccggccgaatgtttgctttcactatatcgacaaaatgtttcagatactgatctccttcctgatgtccaaaatagtcattcacatatttcaaatgatcaagatcacaataacaaaagacaatcttctttcctgtagcaagcatcgtctccgcccgttcatggaacagatgacgatttccaatccctgtaagtttgtctctgtaagcctcttcttcaagttcctcttctcgttctttcaactgctttgtcattgtattaaatgcttctgaaaattctcccagataagaaacactctgagaataatcccctttcgccacctgctttgcctgccaggtgagatggttcagattcgcatggatattcttcagattctcacagaggaaattatctcgccccggtgcttcaattgacagatttccctttgaaatctccgctgaataatgcttcacttctttcaccgctttatccagatattgaagaccttttccaagtttccaaaaaggttcgtccagctgttcaagatccaactttgcattctcggaatcatatataatatccctcagatattcaaataatatctcacagtttttctcttccataactaactgtcaccttctcttacatctgcctggaaacggcagacacggcctcctgtagcccagcagtccgtttccactgctacatattcctttccagagtataaagataaaattccggaaataaatccttcatcataattgcagacagtctcaccaagcaccggaagccccgaacagtccgcatcttccgagacggtcagaatgatctgcccgctctcctcgtctactgattcaatacggagtactccaatcttcatttctgccatcttcttctggagttcacccacaaactgatccagcggctgattcagattcagcatcttacgtgcaaaaaattctcccgctttccttcccgcattccggaaaatctcaacctgttctgctcttccgtaacgtaccgcaagctcgtcttttatagaatattccaatagccgatatacaatcacagggagttctcctccaagattccccctgctgttctcatcatattcaaggtagtcttcgaaagaaatcggtttcttctccttcataaaaatgttctcgtccatcatttttctcttttctttcctctgctactattacatttacaacaaaatgcactcgtttcacactgtcatgtaacaggtgatataaccgtagtatagcatgatttttttcatgattcaacaattgcataatgtcttaaatgttgttgagaatttttaaataataccccaaatatcacagcaatgtctgcagtatctccagagacttgaactccttatctacatacatcttcatcaaccgtcccatcacacgtccaaacttctccaacacttccggcttcacgttaaatgtatataatttctcaattgtactggattcaatatactgcatcgtatacagcgtagaaccgtcaagaaacattccgtctctcacttctccgtcacattcattacacacaagtccgcccttcgccgcgctgaacactgccggcctcgtccggtcgccacactgtacacactggaacacctgcggtccctgtccgttgattgtcagcactttcaactcgaaaatgtaacggatcaactgattcggaagatgtggatttgtcagcgcacgcatcgtctgataaagtaatttcaaaagttcccgctcatcatttcgttccctcgcatagtaattcgcaacctcaaggaaataaaagccataatatgcacctaccacatctgctctcaattccgaaaaataattggatacatttacagactgaattgtgtaagaagaacgaccttcatacatcatgaattcaccgaaagtaaatggattcaccgctcccactagaggactgtttggtcttcttgatccctttgcaaaggctgagatcttcccctgttcttttgtaagtatgacaactctgcggtcgtactcgcccaccggtgcgacagaaagcaccattcctgtcaaaacgatctgattcacgatgaaagtcaccttctttctgctatatttgtaaagatgttggagacaaaacccacaactacgatgcctgcggatgtttcgtgcaacgcatttccaatatcttctaatatatccgatttcgcgtgtaaatacaaggagctgttctagggggattttttgggatatgagttttgctggatatttgacacatgttaagattttggaaaaccagaccaagagaaacttgctataaatcatctatttaaccttgattccctgaatctgcttttcaattattcccatatcatattcttcagcgtattagcgacttacgtcgccagatatgctaaaaagcggcagccaccaacctctcagtcagcatctgccgctctcatcattctttttattctttatcttcaaaggcttctttcatcttatccatgaatccttttttcttgccttttttctctgatttctcagattttgtagcaagatcgtcatgctgatgaagtgtatttccactgagctcatcgaattttctcagagcctctttcgcctctgcgcttaatctctccggtgtctggatcactaatgttacataatgatctcctcttacctgagtatttctaagggatggaactccctttcctttcagacgtacttttgtatctgtctttgttcccggttttactgtgtagagaacgtctccgtctacagttggaatcttcacatcaccaccgagtgtagccactgcgaaggaaatcgcaacggttgagaagatatgcatatcctgtctctggaagattggatgtctggatacgttaacctcaacgaggagatctcctctcggtcctccattaactcccggttctcctttttcacggatgcgtacgctctgtccgttatcaatacctgccggaatcgtaactttgatcttctttctgctggatgtatatcctgtacctgcacatttcggacatttctctttcacgattttaccggaaccaccacagttcggacatgtttgtacattctgtacggttccaaagaaggactgggatgtatatacgacctgacctttaccaccgcactttggacatgtctccggtgatgttccaggctttgcacctgtgccgtgacagtcttcgcaaggatctttcagcacaagatccagttctttctcacatccgaagacagcttcctcgaatgtgatgcggatgctctttctgatattagcccctttcataggaccattgcttgcgccgcctcttctggagccaccgaacatatctccgaagatatctccgaaaatgtcgctgaaatctgctccattgaagttaaatccgccaccgaatccacctgctccgccgccggcaccgccatcaaatgcagcgtggccgaactgatcatactgacgacgtttgtcagcgtcactcagaacggcataggcttcggaagcctctttaaactttatttctgcttctttatcccctggattcatatctggatggtacttcttcgcaagctggcggtatgctttcttgattgtagcatcatctgcatctttgcttacgccgagcacctcataataatctctctttgcctctgccataacacaaatactaacctttctgtatctctttcttaacctcaagaaattctacgaagctacaaagctccgtagaatttctcttcatgcttcatttatctgatgccctgctgcctgtttctcttctgtcttaccggcatcttttctatattttagacttctttgtaatctccgtctacaacatcatcaccctggaaaccatccggagccggaccagcttctggtgtaggaccagcctgtgcacctgcacctgctgcagcacctgcctgctcatacatctttgtgaacagtttctgtgcgctctccatcagtttttccttcgcagctttgatctctgctacctgctcttctgttgtattctccggagcagattttgcaaggatatctttcagtgcctgaacgtcagcctctacagctgccttctctgtagcatcgactttgtcgccaacctctttgattgccttctctgtctggaataccatagcgtctgcttcgtttcttgtatcgattgcttctttacgtttcttatcctgagcctcgaattcagctgcttcttttacagctttatcgatatcgtcatcagacatattagaacctgctgtgattgtaatatgctgctctttacctgttccaagatccttagcagatacatttacgataccatttgcatcgatatcgaatgtaacttcgatctgcgggattccacgtggagccggcgggattccatcaagtctgaactgtccgagggacttgttgtctcttgcgaactgtctctcaccctgtacaacgttgatatctacagctgtctggttatctgctgctgttgagaagatctggctcttctttgtcgggattgttgtatttctctcgatcagtcttgtagctacaccacccattgtctcgatagacagtgacagtggagttacatcaagaagaaggatgtctcctgcgcctgcatctcctgcaagtttaccaccctgtacggaagcaccaagtgctacacactcatctgggttaagggatttgctaggctctttgcctgtcagtctcttaacttcttcctgaacagccggaatacgtgttgatccaccaacgagaagtacctgtccaagctcggaagctgtgattcctgcgtcagaaagtgcacgtcttaccggttcctgagttttttctacgaggtctcttgtcagctcgtcgaatttagctcttgtaaggttcatatcgaaatgcttcggtccttcagctgttgctgtgatgaacggaaggttaatatttgttgttgttgcacttgaaagctctttctttgctttctctgcagcttctcttaatctctgaagagccatcttatctgcagaaagatctacgccttcttttgccttgaagtctgcaagcatgtaatctgtgatcttctggtcgaagtcatctccaccaagtctgttgttaccggctgttgaaagtacttcgataactccatcaccaatctcgataacagatacgtcgaatgtaccaccaccaaggtcgtaaaccataatcttctgctctttctcgttgtcaagaccataagcaagtgcagctgctgtaggctcgttgatgatacgttttacatcaagtcctgcgatcttacctgcatcttttgtagcctgacgctgagcatcgttgaagtaagccggaactgtgataacagcttctgttactttctcaccaaggtatccttctgcatctgctttcagtttctgaaggatcattgcagaaatctcctgtggagaatatttcttgtcgtcaatatctactttataatctgttcccatctctcttttgatggatgagattgttcttgctgcgtttgttacagcctgacgttttgcaggctcacctacaagacgctctcctgtctttgtaaatgctacaacagacggtgttgttcttgcgccttctgtattcgcgataactgttggctgtccaccttccataacggctacacagctgtttgttgtaccaaggtcaataccaataatttttcccatgataaatttcctcctctatctaatctctgaatcttgttaaaaatcaaattagtttgctacttttaccatgctgtgtcttacaacactctcacggtacatgtaacctttctggaattcttctgcgatgatgttctcaccgagtccctcatcttctacatgcatcactgcgttgtggaaatccggattgaattcctgaccaactgcctcgattggttttactccaacggattccagtgtagtcataagctgtttgtagatcttctccattccttctacgaacggagcattcttctcctcctccggtacggaaccaagtccacgctcgaagttgtctacaaccggaagaatcttttctatgatatctttcgctccgatctcgtacatctgggatttctccttctcagatctcttgcggaagttatcaaactctgccatctgacgagtaacgcggtctgtgagttcctcgatcttctcgtctttcttgtccttcttttctttctttccgaagaactttttcttaccttctgatgctgcttctgaatctccttcagtctcagttgcttcctctgttgcttctttcgcttcagcctcaactccctgggcatcttctgtttctactgtctcttcagcttctgcctgctcttttgcagcctttgcttttgcctcttcaacagcttcttttaccatatcttctttgctcatgttctctgtcaccagctttctaccttcctattattactctttgggttctttattataaatcgcatccaactcactttgcagcgttttcagcgtcttcatgacatgttcataatccattctcttcggaccgatgattccaatcgttcctttcataccttctcccagctcatatgtggcggtaacaacactgcagtctttcatggtcttaaccggagtttcatctccgatataaacctgtatgccgttgttctcctcacttgccagtgtctctgtcaccagatctgccagctgctgtttctcttcaaatgcactgatgatctcctgtgcgctctgcttatcactaagctccggatatttgaaaatattcgttgcgccgcttgtgtagatctccatgtcattatctacatgaatgatctctgccactgcatccagtacatgaccgacaacttcgctgtggataccagcctgttctttcaatctggcaatcaaacctaatgtaatctgatcaatggataatccattcagtgtcgtgttcagaagcatattcagcttcaacagattctcgttacttaaggtttctccaacttcaatgatcttattcttgatcacattaccaccaagtacgatgactgctacgatctgttcttcatccacctgtgatagctgaatgaacttcaatgtgttccggctgttgaccggtgcggaaaccatcgttgcataattggtgttcgaagcaagaacctttgctgcctgctggagtaccttctcgaccttatcggtcttctcaagaagtgcatcctctcgtttgctaatctcctgctccttattctccatcagaagatctacataaaagcgatatcccttatctgatggaattcttcctgccgatgtgtgtggctggaagatgtaaccaagatcttccagatctgccatctcattccttatcgttgcggaacttaatttcaaatctgtgtattttgaaagggttcgtgatccgaccggttcgccagtctccagataattctgtatgatggctttcaatatcgtaagttttctttcacttaattcagcttctacagacatctctgtgttcccctttctgttcatctttgtttgttattagcactctttgtttttgagtgctaacaccttacagatactaagatagcacctcgatttctgtttgtcaacactgattgttatttttataagttttttattttcttcttattttattaataggatgctttttgggggaggaaatgtgattttatagaaatattgttgacttggattgtaattttgtgaattccaggcaagcttatagccaaatcataagttgacttgaattatgatacataaaatccaggtcaaagacaagtttatttaacttacactaattgacctggattttaaaacctgctatctatactatcccctgatctgtccgtttccgaagataatatactttgttgttgtcaatgcttcgagtcccatcgggcctcttgcatgaagcttctgtgtgctgattccgatctctgcaccgaatccgaattcgaatccatctgtaaatcttgttgatgcatttacataaaccgctgccgcatcgatctcatcctggaatctcaatgcattgtcgtaatcctttgtaataatggattcagaatgtcctgtattatatgtattgatatgtgtgattgcctcatcgatggaatcaacaatctttacagaaataattgcatccaggtactctgttccccagtcttcttctgttgccggaataatctctgaactgattgcctgtgctctctcatctccacgtatctctacaccatgttccttcagtcttgttacaatcttcggcaaagctgcatctgctatcttggaatgaatcacaagtgactcacatgcattgcacacaccaagacgctgtgtcttcgcattttcgataatgtctgttgccatcttaatgtctgctgtctcatcaacatatacatgacaatttccggttcctgtctcaattaccggaacagtgctgttcgcaactacatttgcaataagtcctgctccacctcttggaatcagaacatcaatccagccatgcatcttcatcatctcatttacaacttctctgcttgtatcttctacaagaagaatgaggtcctgagataacttctctttgcggagtccttccttgattacacgggcaattgcctgattggaatggatcgcatcacttcctccgcgaagaattaccgcatttcctgtcttgaagcaaagtccgaatgcatctgctgtcacattcggtctggattcatagataattccgacaacgccaagcggtacgcgcttctttccgatgcgaagcccgttcggtcttgtcttcatgccaagcacttctccgatcggatcatcaagtgctgcgatctgacgcagaccttctgccatatcctcgattctctgttctgtcagtgccaatcgatcaatcaaagactgcttcacgcctttcgctttcgcagcttcaatatcctttgcattctcctgtaaaatcaattctctctcttctacaagttcattcgctactgcgagaagccctctgttctttgccttcgttccaagctttgctgcctcacgggatgcactctttgcaagtcttccaagcatctgcatatatgtctccattttattgctcctttcatcagcctgccgttaaatatctctatcagtttccattcaggaatgcctcggcatttctgcaatcctgccagaggctatgtcgagagtataccacataccttttcttttttctatattatatcagtatttcgctttatctttttcacgtattaacgtattagtgtatttctgtgaaaacaaacatcagatgtttattccgatgtttgttttcttattctataatatttttcatccagatatctcttaagaatccgccatatttttccttcgtaagcatcttctgatacccctgtttcatgacatttgatctgctgaaaacattttccggatgcaccgtacaaagcaggtagcgatatcctatctgtctcaaatcaccttccgcgtgctgcatcattttatattgtaaatagtgccctcgaaactctggtaatacagccgccgtatccatcatagcacaaagcttcagtttctctttctccattccaagatcatatcccagattatccgggtgagcgcccggtaaaattacgaaaaacatagctcccgccttgccctcttcatcaacagcaagatataaaagacctcggtccttcttcatccaaaaatcaaattcttcatacggttctgcaacaaaccattccggaacgttcatcccctggtctaccttattcacaatttcgtacgcttctcgtaagcgctctcttccaacgcgaattatctttatcatcaataaatcttcctattttgtaatcacttctgttcatttatgtctaatgcttatacactaaaattatttttacaattcttgtagtcctgcaaaaaacaattcataagggtcatcctctcctgtaagcaccggtgaattctctccgcctccattcgtactgcgcttcattgcggcataaaattcatctcctgcctgcacaatatccatcggataaagttcataacccgtctcacgacatacagagcagaatcctccaagaggatcttctgcatcccttgtctttatgaactgttctcttaatttatcatcatgtcttgctttgcgctgtaattcgtctaaagcttctactgcgttcatctctttctcctcattctgctctgtttttcgtggtatttgtttcagcctcacttccaatatgtgtttaagtattcctctgtttgctcctctgttaatttatactctttccgaacattattaaacgtctctattctagaagcattcaaattttgacacgttctaatagttgctgctattccttgctgaattccatttttcactccatcatcatacatttcctgtattgccttacacatatctaccatctcctccttctgctctgtttcacctggtatttgtttcatgttcaaaaatgctttcatcgcctgacttgtttcataatcaacattctgaaaaaactttttattttcatcaatatagtgtttcagttcttccttactgtccctatatcttagcatagttagtatcacttgtaaatcatccgaaaatttttcaacaaaaatttatttaaaaacctgctaaaaagccttgacttttgttagcaggtttttctgcccaaaatgaggtggtaaaacgcccacccatccaccaattaccgaaaggagggacacgaaatgccctgtccgcacaacgaaatcacgattgttcagcgcagccagcggcagtctgcggttgccgccgctgcttaccagagtggcgaaaagctgttctgtgaatacgaccagcaagtgaagcactacccagaaaagcgtggtatcgtccacaatgaaatcctgctcccggcaaatgccccacaggaatatgcagaccgcaataccttatggaacgccgccgaagcggtggagaagcaatggaactctcagcttgcaaggcggtgggtgcttaccatccccagagaaataccgcccgaccagtacgctgtccttgtccgggagttttgccagaagcagtttgtttccaaaggcatgattgctgattttgctatccatgacccccatccgccgggacataatccccacgcccatgtcctgctgaccatgcgggcaatggacgaacatgggaaatggcttcccaaaagccgcaaggtttatgaccttgatgagaacggggaacggataaaactgccatccggcaggttgaaaagccacaaggaagatacggtggactggaacaaccagaagtattgtgaaatctggcggcatgaatgggaggtcatccagaaccgctatctggaagccaatgaccgcccggagcgtgtggacttgcgttcctatgccagacaggggcttgatatagtccctactgtccatgagggagctgctgtccggcagatggaaaagcgaggtatccagacgaatatcggcaacctgaaccgggaaatcagagctgccaacaatctgatgaagtccatccggcagcttatccaaaacctcaaaggctggattaccgagctgggcgaaaaacggaaagagctgcttgcacaaaaggcggcggaggaagcaacacttcttcccaatctgctgatgaagtatatggagatacgaaaggaagaacggaaggactggacaagggctggacagaaccgggggacttcacaggacttaaaggcagtcagcgaagccctatcctatctccggcaaaaggggctttccactgtggaggacttagaagcatttctggaatcttccgggaaatcagccgcagattaccgcaatcagatgaagccaaaggaagcccgcagcaaagtgattgacgggattcttgccagccggacagactgcaaggaatgtaagcctgtctatgagaagtaccagaagatattttttaagaaaacaaaggagaaattcaaacaggaacacccagaggttgcccggtatgcgaaagccgccgcctatcttgccaagcacccggacgataaggacagtacccaaaaggagctgcaagaggagcaggaaatgcttcttagcgaaatcgcagagctgaaagtaccgctgaccgaggtacaggaggatttgaagaagctgcgggacatccgctactgggtacggaaagccacacccggcacagaggaaagtaaagagccgcccaagaaacagcctatcaaagaaatcttgcaggataagactgacgagaaaaaagcacaaagaaccgccccggcacaggcgaaacacagacaacaggatatggaactttaacaggcacttgccattttcaatcagagaatgtcaggtgtttttttcttttttcaaggagggatagatttgaatgtatttgaagctgtgaagcagtccgtcacaaccagacaggctgcggagcattatggaatccatgtagggcggaacgggatggcttgctgcccgttccatcatgataaaaccccaagcatgaagctggatcggcgttaccactgcttcggctgcggtgcggatggggatgtgattgattttgccgccgccctgtatgggctgggaaagaaagacgccgccgtacaactggcacaggacttcgggctttcctatgaggactggaaaccgccgggaaaagcaaaaaagcccaagccccggcagaaatccccggaggaacagtttcaggaagcaaaaaaccgctgcttccgtattcttgccgattatctccacctactccgagtgtggagaaaggaatatgccccgcactccccggaggaagtctttcatccccggtttgtggaagccttacagaagcaagaccatgtggaatatctgctggatgtgctgctgttcggggaaacagaggaaaaagcggctttgattacggaatacggaaaggatgtgatacagcttgaacagcgaatggcagagcttgcagccgcagacgcagcaagaactaaaaaacaccatgaacgccatgcagccgccccagagcattgaggaaatcaaggcggggctggaaaccaccgagaaaggcggtgtccgtcagagcatacggaactgcctgaccgtattccagcgtgacccgctgctttccggggctatcgcatacaacatcctgaccgaccgcaaggacatcataaagcccatcggcttccacagggacagcaccgccttaaacgatacggacatgaaatatctgcttctctatctggaagaaacctacgggcttaccaatgagaaaaagattgataacgccatcgggattgtggcaaatgaaaacaagtaccatcccatccgggactatctcaatacccttgtgtgggacgggacagagcgaatccgtttctgcctgcggcactttctgggggctgacgcagacgattacacctatgaagcattgaagctgttcctgctgggtgcaatctcacgagcctttcagccggggtgcaagtttgaaatcatgctctgcctggtaggcggtcagggggctggcaagtccaccttcttccgtctgctggcagtccgggacgagtggttctccgatgatttgcggaagctggacgatgacaatgtgtaccgtaagctgcaaggtcactggattatcgaaatgtcggaaatgatggcaaccgccaacgccaagagcattgaggaaatcaagtcgtttttaagccggcagaaagaggtttacaagataccctatgaaacccacccggcagaccgcccccgtcagtgcgtgtttggcggcacttccaatgcccttgacttcctgccccttgaccgttcaggcaaccgccgttttatcccggtcatggtgtacccggagcaggcggaggttcacattttggaggacgaagccgcttccagagcctatatcgagcagatgtgggcagaagctatggagatttaccgaagcggcaggttcaagctggctttcagccccaccatgcagcggtatctcaaagaacaccagcgggattttatgccggaggacaccaaagccggaatgatacaggcgtatcttgataagtacaccgggagcatggtctgttccaagcagctttacaaggaagccttgaaccacacctttgacgagccgaagcaatgggaaatccgggaaatcaacgagattatgaaccagtgcattaccggctggcggtacttcccgaacccaagaatgttttccgaatatggcagacaaaagggctgggagcgtgaaaacccggcaacggactccggcaacccgtctgaaaaaacgatggatggttttgtggaggtcacagaacagatggagcttccattctgaaaatgaccgcccgttgcaccccctgttgctatcccgttgccgagccggttgccggggaaaaccccttatttccgggcttttctcccttataacaaccaaaacaacagaaaaataaaagaaaagtataaatagtaaccatcgccagattgagattgtttgcaaggtcttttgaagcccgttgccggacttcgttgccgacaccctctgtctggctattttcatgtatggaggataactgcctatggcaaaaaacaaaacagagattcatgtgaccactgtatttgacggggaactggacgcaaccgatgtgttcgtcagcctgatttcccagaaatacggtaaaataaatacaaaagaatatcttgctaaaaagaaagatataggctataatgaagatgaggttcaaaagagccagataccgtctggattgtgtgggtaaatggctatgatgaacgaaatggaatacagaacaatcggttcggcacttgccgggggctatcgtgcggcggtctattgcaggctgtcaaaggacgatgacctgcaaggcgaaagtgccagtatcgccaaccagcgggatatgctggaaaaatactgcgaaaagcagggatgggaggttgtggcagtctatcaggacgatggcttcacaggtcttaatatggagcgtcctgatttacagaggatgttgagagctattgagcgcaggcaaatcaaccttgtcatcacgaaagacctcagccgactggggcggaactatctgcaaaccgggcatttgattgaggacttttttccaagaaacggtgtccgctatattgccatgaatgacggtatcgacaccctgcgggataacaacgacatcgccccgttcaagaatatcctgaatgagatgtacagcaaggatatttccaagaaagtccattcctcttatcttctgaaagcgcagaaaggacagtttaccgggtgtcttgccccgtttgggtatcggaaagacccggaggacaaaaaccatctgctcattgacgaggaaaccgccccgattgtgcggctgattttcggatatgccctgaacggtcatggtccgaactatatccgcagacggctggaggaagaaaaaatcccctgccccacatggtggaaccgggaacgggggcttcgcaacacccgaaccaaatgggaaaagaaagacccggaaaacgggcggtatatgtgggacttctccgttatcaaagaccttttgatgaatcccgtctacaccggtgcgattgcttcccagaaaaaagactaccgtttcaaaatcggcacaattggggaaaagaagccggaggactggattgtggtggagggacagcatgaaccgctgattgaccgcatgagctttgacattgtgcagaacaagctgaaatcccgccagcgtccggggcagaccgatgaaatcagcctgtttgccggattgttaaaatgcggcgagtgtgggaagtcgctgacggtacgctacacaaacgcaaaacatccccagcggatttattcctgcaagacctacaacgcctttggaaagaaccactgcacccagcaccggattgactatgacaccctttacagccatgtgctgcggaaaatccgggaatgtgccagagctgccctgatggacggggaagcggttgccgaccgcctgaccaatacctgtgaagcagagcagcgggaacagcgggaagcaatggaacgctcccttacaagggacgaggaacggattgaggttctggacaaaatggtcatgcggctttatgaggatatgattgcagggcgtatcagtgagcagaatttcaacaccatgctggaaaagacacagaccgagcagacggagcttaaagcaaaagtgtccgagggcagaaagcggctgtctgatgaagtccagcttgccaatgacgcaaaacaatgggtggaagccattcaggaatatgccaacatcacagagctggacgcagccacccttaaccgcttaatcaaagaaatcgtcgtgcatgaacgcattgacgaagataaaacaagacacatttctatcgaaattcattttaatctcaaacccatcccggaggtggaacaggtcactgcctgacctgtcccgccgggacggttctctaaaaaacaccatatagattttttgtacgccgccgcccgccatcgagcagagttttacacctaattggggataaaacagcttatggccggtgctggtgtagccgttgttggtatggttcttgtacctctgctctccgggctgttctctgtctaagcgttcctgcatgaaatccttgccgctcccgcagctctgcgggggcggcggaaaggaggttgacaccgtatggatttcttacttgaagccctgacgaattggctgaaagaaatgctggtgggcggtattatgagcaacctttcggggatgtttgacagtgtaaaccaacaggtcgcggatatatccgtacaggtaggacagaccccacagggatggaatggcagtattttcaatatgattgagaatctgtcaaactccatcatggtgccgattgcaggtgtgatcctggctatcgttatgaccgtagacctgatccagatgattgcagacaagaacaacctgcatgatgtggatacctggatgattttcaagtgggtgttcaaatcagctgccgccatcctcattgtcacaaacacatggaatatcgtgatgggcgtctttgatatggcgcagagcgtagtggcgcaggcggcagggattatcaattcggatgcatccattgacatttcctcagttatgaccgatctggaaccgaggctgatggaaatggatttgggaccgctgttcggactgtggttccaatccctctttattggcattaccatgtgggcgttgtatatctgtatctttatcgttatttatggccgtatgatcgagatctaccttgtaacttcggtggctcccgttccaatggctgcaatgatgggcaaagaatggggcggtatgggacagaattacctccgatccctgctggcactgggctttcaggcgtttctcattatcgtctgcgtggcaatttatgctgtgctggtgcagaacatcgctctggaagatgacatcatcatggcaatctggagctgcgtgggctacaccgtactgctatgttttacgctgttcaaaaccggcagtctcgcaaaatcagtctttcaggcgcactaaaacggaaggaggtttccacattggcttatgtacccgtacccaaggacttaacaaaagtcaaaacaaagatcatgttcaatctgaccaagcggcagcttatctgcttcacgggcggagcgcttattggcgtaccgcttttctttttgctcagaaaacctaccggaaacagtgtagcggctatgtgtatgatgctggttatgctgcccttctttatgctggctatgtacgaaaagcatggacagcccctggaaaagatcgtgggcaacattctcaaagtagctgtgatccgtccaaagcagcgacattaccagaccaacaacttttatgccgtattaaagcggcaggaaatgctcgataaggaggtgtatgacattgttcaccgcaataaaaaaatggctgcatcggatgttcggaaaaaccgaggaaaaaactgtgcagccggtaaagacaaagaaaaaactgtcccgcgccgataagaagcagatcgaagcggccattgcccgcgctaaccgcacggacaaaaaaggaaaatctgcacaggacagtatcccttatgaacggatgtggccggacggaatctgccgcgtatcggacagccactacacaaagaccatccagtttcaggacatcaactatcagctttcccaaaacgaagataagacggcaatctttgagggttggtgtgatttcctcaattattttgacagctcgattcatttccagctgtcttttttgaaccttgcggcatctgaggagacctttgccaactccatttccatcccgccccagagggatgcctttgacagtatccgcgaggaatacaccacaatgctgcaaaatcagctggccagaggtaacaacggtctcatcaagaccaaatacctgacttttggtatcgacgcagacagcatcaaagctgccaagccccgtctggagcgtattgagaccgatatacttaataacttcaagcgtcttggtgtagctgccagaacgctgaacggtaaagaaaggctttctcagcttcatgcagtattccacatggacgaacagctcccatttcagtttgaatgggactggttggccccttccggtctgtccacaaaggattttattgcaccaagctcctttgagttccgcaccggcaagcagttccgtatgggcaagaaatacggggctgtttcttttttgcagattctcgcaccggagctgaatgaccgtctgctggctgattttttggatatggaaagctcgctcattgtgagtatgcacattcagtcggtggatcaggtgaaagccatcaaaacggtaaagcgcaagattaccgaccttgaccgcagtaagatcgaggaacagaaaaaagcagtccgtgccggatatgacatggacatcattccatctgaccttgctacctacggcagtgaagcgaaaaaactcttgcaggatttgcagagccgcaacgagagaatgttccttttgacctttctggtgctgaacacagcggacaatccccgtcagcttggcaacaacatttttcaggcaggctccattgcccagaagtataactgtcagctgaccaggctggacttccagcaggaagaagggctgatgagctgtctgcccctgggactcaatcagatcgagattcagcgaggactgaccaccagttctactgccatctttgtaccgttcaccacacaggaattattccagaacggcaaagaagctctgtactatggcatcaacgccctgtccaacaacctcatcatggtggatcgaaagctgctgaaaaaccctaacggcttgattttgggtacgccgggttccggtaagtccttcagcgcaaaacgagaaatcgccaactgctttttgcttaccagtgatgatgtcattatctgtgacccggaagcggagtatgcacctctggtggagcgtctgcatgggcaggtcatcaagatttcgcctacatctaccaactacatcaatccgatggatttgaacctggactactcggatgatgaaagcccgctgtcactcaagtctgattttatcctcagcttgtgtgagctgatcgtgggcggtaaggagggcttgcagccggtgcagaaaaccatcatcgaccgctgtgtgcgtctggtctatcagacttacctcaatgacccgcgcccggagaatatgccgattttggaggacctttataacctgcttcgggaacaggaggaaaaggaagcccagtatatcgctacggcccttgaaatctatgtaaccggctccctcaatgtgttcaatcaccagagcaatgtggacatcaacaaccgcattgtctgctatgacattaaggagctgggcaagcagctgaaaaagatcggtatgctggtggtgcaggaccaggtgtggaaccgcgttaccattaaccgtgccgcccacaagtccacccgttactacatcgacgagatgcacctgctcctcaaagaggaacagaccgccgcctatacggtggaaatctggaagcgattccgtaaatggggcggcatccccaccggcatcacgcagaatgtcaaagatctgctttccagccgtgaggtggagaacatctttgaaaactcggacttcgtgtatatgcttaaccaggcaggcggagaccgtcagattttggcgaagcaactggggatttccacgcaccagcttagctatgtgacccactccggtgagggcgagggcctgctgttctatggctctacaattttgcctttcgtggaccacttcccaaagaataccgagctgtaccgcattatgaccaccaaaccccaggaactgaaaaagaaggaggatgaatgatgatgaacctcaacattttgaatcaaaacccgttgatgttttttgacagggcggtaaatgcccagcgcagccagctgcttacggtcatggccgatgcggtaagtgagtgccgcacggcggcagatcaggcagccgaactgaatgagaccggtcagatggggcttctccgtctggcagaggtctggagcaccatccgtgccaaggaaggtatgggcggtctggttctggaaggaaccgaagcgaagatcctgtccgatgtggtggcacagttttatgcctacctgtccggctgtatgttcaacgatcctgtgggaatggccatttatgcagagctgcactacatgatgtcctccctcatgctgggagaatggtttgaataaagagccgcgcctgcgctttactgatgaggaacggtctgatcctgcactggaaaagccgatccgtaaagcggagaaagctgcggccagagcagataaggcgcaggccaatatcccaaagaaaaaggtcaggcagacggtcatcgacccggataccggaaaaaagacctcgaagctgacctttgaggacaagaaaaagccaccctccaaactttctcaaggggtcaaggaagctcccgtccatctggttgcgggcaagctccacaaagagatccgggaaacagaacaggacaatgtgggcgtggaaagcgcccacaagtccgaggaagcggtggagaccggcgcttatctggtgcgggagggctatcgcagccacaagctgaagccgtaccgcaaagcagcacaggcagagcgccaactggaaaaggcaaatgtaaatgttctgtaccagaaatctttgcaggaaaatccccagtttgccagcaatccgctttcccgctggcagcaaaagcaggccatcaaaaggcagtatgccgccgccaaacacgccggtcagactgccggaaataccgcccaggctgcatccaaaaccggaaaagccgcaaggacggtaaaagaaaaggcacagcaggcaggggcgttcgtcatgcgccacaagaagggtttcctgatggcaggggttttattcctcattacctgtatgctgatgaataccatgtcctcctgctccatgatggcgcagagcatcggttccgttctctccggcactacttatccgtcggatgacccggaaatgctggcagtggaggcagattatgcagccagagaagcccagttgcaggaggaaatcgacaacattgaaagcagtcacccagggtatgacgagtatcgctatgaccttggtatgatcggccatgaccctcatgagctggcagcatttctctctgccgtcttgcaaggctacacccggcagagcgctcaggcagagctggcgcgtgtgtttgcagcacagtatcagctgacgcttactgaggaagtggagattcgctaccgcacggagacctcaaccgacccggagaccggcgagaccacctcagaagaagttccctatgagtattacattttgaatgtgaaactcgccagcaagcccatttccgctgtggtgtcggaacttctgaccccggagcagatgaaaatgtatcaggtttaccggcagaccatgggcaataagccgctgttgtttggcggcggctcccctgataccagcggctcggaagatctgtccggtgtgcagttcattaacggtacccgccccggcaatcctcagctggtggaactggccaaacgtcaggtgggcaatgtgggcggttatccctactggagctggtacggctttgactcccgtgtggaatggtgcgcctgcttcgtatcctggtgctataaccaggcaggaaaaagtgaaccgcgctttgcaggctgtgagtggcagggcgttccgtggttccagtctcatggacagtggggcgcaagaggctataacaatctggctcccggagatgcaattttctttgactgggatttggatgggacagcagaccatgtaggtatcgtgatcggtacggatggcagccgtgtttataccgtggagggaaattccggcgatgcctgcaagattaaaagttatgacctgaattatcaaagcattaagggctacggcctgatgaactggtaacagagatttttaagaaggagtgatagacgatggcaaagaacaaaattgagcgcattgaccaggagattacaaaggtccgcgagaagatcgcagagtatcaggaaaagctcaaggcgctggaagcacagaaaaccgaggcagaaaatctggagatcgtccagatggtgcgcgccctgcgtatgaccccgacccagttgagcgccatgctgtccggtggcacagttcccgacagtttggctgatgacaataacgaacaggaggaaaacagctatgaggaataaacgattgctccgaacactttccgccttttgcctgacaatggttgtggcatttggctttacgatccctgcttttgcacaggggtcagaacaggctccggcggcaccggcagaggattctaccaatgacagcaatgtgattgtggaagaaacagaaccagcaccggcacttacaccggaggggaatgcggcactggtggatgattttggaggcaataagcagcttattactgttaccaccaaggctggaaattacttttacatcctgattgacagggcgaatgaggataaaaagactgctgttcactttctgaatcaggtggatgaagcggatttgatggcactgatggaagatgaaaatgtcaaagagaagccgtctgctgtgtgtagctgcacgacaaaatgtgaagcaggggcaatcaatacggcttgtccggtctgtgcaactgataagagtaaatgtacgggcaaagcaccggaacctccggcagaaacaccggagccggaaaaagagaagcctgccggactgaacccggctgcgatagtccttttgctggctctgcttggaggcggtggcgtatttgcctacttgaagctcgttaagaataagcctaagaccaagggcaatgacagtctggacgattatgattatggcgaggaagattccgaggaatgggaaaccgaaaatgaggagtcggacgagccggacgctgatgggggcagcacagaagaagatgatgaggacagtgtgaaatgacccgtttcacagacagtccctatgaacgcatgatgacacgcaggccggagggcgggaaggaaatttcccgtcctccttctttaccccacaaccacccctgctatggttgcgggaattatggaagtccctgtgtaggtatctgccatcgtgagatggaacgatggctcaaagaaaggaaacgaaaaaaatgagtgttctgattatatttatcaagctgattgctgtttttgacctgctggtaattgctgtgtattttggcggcgacattctttctaccatgttaaacaaacttcagagaaagccaaagcaagatgactcctttgatttctccttagataccatgacagtttcattgtccatagattctattcgtcagctttattccggtgacgcggcagattttgtggaagaaaagattctgccaaatgcggagaaaacaatggccgttttgacggaacaagaacggacggcggctcgtctgctcttatccgctctaatcggttttcttgcagcagaagctcctatggatgaacagagctttcctttgatgatggaacttctgaactgcatggaaggggaaaaagaagatggttgtcaggatgcagtagatagtttacttgaagatgccgcctgcaatacccgccgtcacgaagaatattacagcaattatcaacgctaccagctgatgcaggtggataaaacccgtgtcattttggcttgccgtatcatcatcaatgacctgctggggaaactgtaccgctatgactaccggtttggttataacctgctactggatgaggaaaacagcatagagaaaaaactgcacacgcctgtgcgggaagaatgggaggctgaagatgatgagatataaactggtaatcgctgaaaaaccatcggttgcacaaagtctggctgcggtaatcggtgcaactgctcgtaaggacgggtatctggagggcaacggctggcgtgtcagctggtgcgtgggccacctggccggtcttgcggatgcagacagctatgacccaaagtatgccaagtggcgatatgatgatctgcctatcctgccggaacattggcagatggtggtgggaaaagataagaaaaagcagtttgatattctcaaaaagctgatgaatgccccggatgtgacggaagtggtaaatgcctgtgatgccggacgcgagggtgagatgatcttccgcagcgtctatgagctggcaggttgcaagaagccgatgaaaaggctctggatttcttcgatggaggactccgccataagggagggctttgcaaacctgcgcccaggtgcggactatgacggacttcgagatgctgccctctgccgtgccaaggccgactggctggtggggatcaatgccacaaggcttttttccgtgctgtatcaccgcaccctcaacatcgggcgcgtgatgtccccaacactggcgctcattgtccagcgagaagctgagatcgacacctttaagccggttcccttttataccgtggcgctggagctgcccggtcttaccgtatccggagagcgcatggcggataagactgctgctgagcagctgaaagaagcctgccagggtgcaaatgtcacaatcaaaaaggtggagtgcaaggaaaagtccgaaaagccgcctgccctctatgatctgactactctgcaaagagatgccaaccgcctgcttggatttacagcccagcagaccctggactatctgcaaagtctgtatgaaaagaagctatgcacctatccccgtactgacagccgctatctgactggcgatatggcagacagcctgccggtgttggtgaatctggttgccaatgctatgccgtttcgcaaagggatcgccattacctgtgatccgcagacggtcatcaacgataagaaagtaactgaccaccacgcagtaatccctaccagaaatctcaaggatgcagacctttctgcccttcctgcgggagaaaaagcggtgctggagctggtggccctgcgtctgctgtgcgccgtagcccagccccatatctattcggaaactgttgtgattgcagcgtgtgccggtggagagtttaccgccaaaggaaaaacggtgaagcaccccggatggaaagcactggaggacgcttaccgtgccaaaatgaaggatgcagagccgaaaaaagagggcgcagagaaagctctgccggagctgaccgaaggacagaccctttcggttgctgcggcaatcgtcaaagaaggtaaaagcagtccacctcagcactttacggaggataccttgttgtccgcaatggagactgccggaaaagaggatatgccggaggatgccgagcgaaaaggtctggggacaccggccacccgtgccggtattttggaaaagctggtatctgccggttttctggaacgaaaaaagagcaggaaaacggtgcagcttctcccttcccacgatgcagtttccctgatcaccgttctgccggaacaactgcaatcgccgcttctgactgccgagtgggagtaccgcctgggagagatcgagcgcgggcagcttgccccggaggagtttttagacggtatcagtgccatgctgaaagatctggtggggacttatcaggtcatcaagggaactgagtacctgttcactccgccccgtgaggtggtgggcaaatgccctcgctgcggcggggaagttgcagaactgcaaaaaggtttcttctgtcagaatgattcttgcagatttgcaatctggaaaaacaacaaatggtgggctgtcaagaaaaaacagccgaccaaggctgtggtgtctgcactgctgaacgatggccgtgtccgtgtgacgggcctatattcggagaaaaccggaaagacctacgatgccgctgtggttttggaggatgatggacagtacgccaacttcaagctggaatttgaccagcggaaaggaggcagccgatgaagctctctttagtggaacgggaaaccattctcctctataatcaggcagaaccaatggctgagatctatacccatgatccccgtctgatggagaagctggatttgctggcaaaaaagcacccagatcagatcacccgaaaggatgcccataactttaccgtccccaagcggtgtgtatcagtccgggagccatatagcgcagaacgccgcaaagctgccagtgagcgtgcgaaagttgccggataccagcctcctgtgagaaagcccagcggttaaaggcacatggcagagaatgtatttgaagcagtcaagcagtcggtcagcaccagagatgcggcagcgttttatgggatcgaggtcaaacgaaatggcatggcctgctgtccctttcacgaggataagaacccaagcatgaaggtagaccagcggttccactgctttggctgcggtgaagatggggatgtgatcgactttaccgcaaagctctttgacctctccccaaaagaagcggcagagaaactggcacaggactttggcctgatttatgacagtcaggcccctccccgtaggagatatgtccggcagaaaacagaggcacaaaagtttcgggaggaccggcagcggtgttatcgcgtactgtccgattattaccatctgctgaaaaaatggggaatcgaccattctccccagacaccggaggaagaactgcaccccaattttgtggaggcgatccggaaggaaaactatgtagagtacctgctggacctttttctttatgaaagtgaagaagaacaaaaggcatggattgcagaacacacagcagaaatcacacacttggaaaggagattgaaaatcatggctgagaacaaacccaccaaccgagaacggctaagggaaatcacagatggcatagagcagggcatcaaagaactgtttgagagtgaaaagtatatgcgctatctgtccgtcatgtcccgcttccaccgctattcggtaaacaacaccatgctcatctatatgcagaagccggacgctacattggtagccggatacaataagtggaaagaccagtttgagcgtcatgtaaaaaagggcgagcatggcattaccatcatcgcccccacaccgtataagaagaaaatcgaggagcagaagctggacccggataccaaggctccgattctggataaagacggaaagatcgtcacagaggaaaaagaaatcgaaatccccatgtttcgtccggtcaaggtctttgatgtgagccagaccgacgggaaacctttgccggagcttgcttcctccctttccggcaatgtgccaaattatgaggcattcatggaggctctgcgccgcagtgcgccggtgccgatcacttttgaagcaatggctgccgatacggacggctatttttctgccgatcatcagaaaatcgccattcgtcagggcatgagtgaggtgcagacggtttcggccacggttcatgagattgcccacagcaagctccatgaccctaaaaaatatgaaatgctaccgtcatggaaggttgtactggagagtgaaggtggaaccaagcatgatttcaagctggattttgccacagaaaaagaagctgaacagtttgcttctgatatggattggcgctatgtggacgaaaatcagtttgaatggcgtcttgcagttgaggaagatccaaccacagaaaaacaggcaatcaaaagtcgccacacggaggaagtggaggctgaaagcatctcctacgcagtctgcaaatattttggcatcgagaccggagaaaacagcttcggctatattgcaagctggagtcagggcaaggaactgaaagagctgagagccagtttggaaaccatcaacaagacctccggtactttgatctctgacattgagcgccactataaggaaatctgcaaagagcgtggaatagacccccatgcaaaggcaaagccggaaaccgccccgatagagcagccaaccggcaatctgacttactatgtagcagagtgcatggagtttccaaaccttggagaatatcacgataacctgtctttggaggaggcggtccgcatttatcaggagattccggcagagcgaatgaacgggatcaagggcattggctttgagctgaaagatggaagcgactatgaaggaccttttccgattttgaccgggcagaccattgacctggacaccattcaggcaatcgactattaccgtgataatccgttggtgcaaaaagcggtaaaggaactggctgcggccatgccggaaatggaggtgctgggagcggacgccaaccagcaggaggctttgtttctgatcgacgatgccacttatcttcatatccagccctgtgacagtggctgggactataccctttacgatgccgcatccatgaaagagctggatggcggtcagctggatatgccggagctttcccgcaaaaatgcagttctccagatttgtgatgacaacaatctggacagcacttcgctcagacacgctcctatgtccatgattgagaccttgcaggaagcggcctatcagcaaatgcaggcagagaccagtcagatgactgcttcttcccagctgccggaagcgcaggagcaggcactggatgaataccccatgccggatgagcaggtctccacaccagatatgcaggaatacggctactcctatgatgggatgttccctgttaccagagaacgggcgctggaactggatgccgccggtttgaccgtttatgtgctgcatgaggacaatacggagagcatggtgtttgacccgcaggaaatcatggatcatggcggtctttttggcgtggaccgtgaggaatgggagaaaagccctcagttccacgaaaaggtcatggagcgccaggaacatcagcaggaacgcgaacaggcatttctatcccagaacagagattgctttgctatctatcaggtgagccgtgacgatccgcagaatgtgcgctttatgaatctggattggttaaagtcccatgacatttccatagaccgcagcaattatgacctcatttacacagctccgctgagggagtctggcacggtaccggagcagctggaaaaactatatgagcagtttaatctgcaaaagccggcggattttcacagtccttctatgagtgtcagtgacatcgttgcgatcaagcaggacggtaaggtatcctgtcattactgtgacagtgttggttttacccagatccccggattcctgccggaaaatccgttgaaaaatgcggagatggccgtggaggacgattacggcatgatcgacggtatcatcaacaatggcgcaaaagagcctacggtggcagagctggaacagcaggcccgcaacggtcagcccatttccctcatggatttggctaccgctgcccatcgggaggaacgggaaaagaaaaagtccgtcatggagcagctgaaaagccagcccaaggcagaacacaaaaagatagcgccaaaaaagagtgcggaaagggagatttgatatgggaaactttacttttgaggaaatgaacctgatgtgcatttacaataccggcagccgcaccggactgatcgacagcctacgtgagatgcgcggcgagctggccccggaggaaaccgagctgcgggagttgacagacagcgcactgggcaagctccaggccatgagtgatgccgagtttgccgagctggagttgtatccggattttgaccagtaaacactataatcgcagggatggggtggcaatatgccaccccacctttttaccccaaaactgaaaggaggacagaacactatgccaaccaaagctgaactatatgcacagatggcggagaaggtaacaacgcagctcacggggagctggcaggaatgggcagggtttctcaccactgcttcccgcctttacaagtacccgttccatgagcagttgatgatctacgcccagcgtccggacgccaccgcctgtgcagagtacgatttgtggaatgaaaagatgggccggtatgtaaggcgcggctccaagggaattgctctggtggacgattccggggacaggccccgcctgcgctatgtttttgatatttccgacaccggaacccgtgaacattcccgcactccctggctgtggcagctggaggagagccatttggattcggtgcaggccatgcttgagcgcacctatgatgtttccggtgatgaccttgccggacagctcaccgaggtagccggaaaactggctgaggaatactggacggagcatcagcaggacttcttctatatcgttgacggttcctttttggaggaatatgatgagtttaacatcggagtacagttcaaggcagcagccaccgtcagtatcacttacgctttgatgtcccgctgtggactggagccggaacgctacttcgaccacgaagatttcatggcgatctttgatttcaatactccggcaaccatcggagcgctgggaacagcggtcagccagatcaaccagcaggtgctgcggcagatcggcgttaccgtccgaaatgcagagcgcgaagccaaccaagaaaggagcaaacaagatgaacaatcccatgacctatatccagaacggagactatctgattcccgacctgaagctgagccagcagccggagaaacccttgggcaagtacggaaggatgaggaaaacctacctgaaggaacaccgtcccatcctctacaaccagatgctgctgagcgagaagctgtacccgcaccttctggagatcgacgagaccgcccagagcagactggagcagatgatgccccagctggcgaaggaagcgggagccaccgaggacctgaaagccagcgatcccatgaagtgggtggggctgatgaacacctgcaaagctcaggccgaggagatcctgatggcggagcttatcaacagctgactctaaacctgttcctctccgaagcggaacagatccaatccatagatgaagcagagaatgtagcgcatacatcctctgctttttcttttacccaaaatgacatcgaccatgtgctgcgtttgggcggcaatacagaccgtcaaagggagcgtgtggttgcagcctttgaaaagcagaaaaccaccgctgagattgccgagatactgaaaacgctgtaccacggcggcaatggccttggcagtgtgagcgcatggtatgccgaggatggtatccatctttcacatgggaagtctgtccgttatgacaggtctgcccaggtcatttcctgggagagtgccgcagagcgtatcggggagcttttggaaagtggtcagtttgcctccaatgtggagcttgcagaagcggcaggctatgaacgctccctcctctcggaaaagctctggcatctgtatcacgatctcagtgaggacgccagaaaagccggatatttgtcctgcctgtcagagatcaaaggcaatggtttcccggaggagacccgccgcctgacggagcagctgagtgacccggctttccgccagacactcaaggaagaatacgccgccttcttgactgcctatcagcaggaccgtgacctgttgcgttttcactatcatagaccgagggagatctgggagaacctgaaggaccttgacctgccccgcaggaccttttcttcagagctttccaaagtgccaaccgtccagcactttattaccgaggatgagatcgacgccgccatgaccggcggaagcagttttgccggaggaaaaggccgtatctatgcgttcttcatggcaaaccatacggataaggagaaagtgagattcctcaaagacgagtatggcattggcggacgctctcatgccctgtccggcgcaacacacagcggcgaagatcacgatgggaaaggactgcactataaaaagcaggactgcccggatgttcacttgaactgggaaaaggttgccaagcgcattacctcacttgtccagaaagaccgctatcttaccgaacaggaacaggcgcagtatgacaaaatccaggctgaaaaggaactggcagaagaagatgccattcaagcccggcagccggagatggaggaagaaacgccaaagcctatccttcgggagcagtttgagcagtataagcctgtggtgactgccgctatttccgaggatgccgcataccgcaatgcctgcgggcattctgaccgtgaaaatgctgtcatcgagggcaatgccgctgtgcgccgtgcggttcttggttctaaggatatggagctgatccgactctattcggatgtgccggagttccgtcagcgtttacactgggaagtgatcgacgagacctatccaaagctccatgagcttctgcgccctctttctcaggaagatattgatactgccctttgtgcatggaacggcaatatcgagagtaaacacgctgttgtccgctatatgaaagaccatgcaagagaaaaagataccgccgcatggctggctcaggaatacggcggcagtaacagcaacagcctgttcgttgtccgtgccggcagcccggagaaaacgcagctgccctggccgaaggtacagcgccggattgcccagctcattcaggaggaccggttctataccgaagaagaacaggaccgttttgacgacatcgaccccatcgccatccgggaagctctggaagaaagaggaatcgtcaacggacaggtgacagacccggaaaaactggacaatgatccgtttatccaacaggtgatgtcagatgccgagcagatcgcagatgccgagacagagcagacttccaaagtttccatttccgatgaggaatatgacgcagttcgccgcccaattccgcaaagaacctcctatgacccagccgccccggtctatgccgtgggcgataccgtgtatatcgaggatgacgcctatcagatcaccgagctgcgggaggacaccgtacagcttctgcccaccggaatggtatatcccatctaccgggcagagcgcaaagaacagttcgagcagctgcttcgggcagaccggcgcaatgcttactataccgagtttcttcccattgacccggacaaggcagatcaggacttgcgggatgtattggctcatggactgatggatgaagcggataaaaagcagatttccacgctgctgcaatccggcaggagcaacagcgagatcgcctactggctgagcagagcctattccggtgagattgagacactgaatctggagaccggcgatattgccgattaccgtaccacggcacagggcatagaactggaagtcatggatgcagaggaaaagcgtctggctatgctatatttccgctgggatgaggttgcatctttgctgcgcgggatgtatgctcgtcagcaggacggttttggacaggaacagccccaactgtctgccgaatccccggccttccattccgagaccgtggccgtctatccgggcgataagaacaatctgccttatgatgtggtggtggaacgactgcatatcgaggagccggagccgccagcccctgtgactgagccggagaaaacctttgaggaagtgttggatgaacacccggtttccattcaggtcaatggccagtggcagaccttccccaatgccaaagctgccgaggaagcatcttatgaggaatacaaggctaacctgcgccgcaatgcaaaaaacttccgcattaccgatgagcatttgggcgaaggcggtccgaaagccaagttccaggcaaatgtcaatgcgattcgtttgctgaaagagctggaagctgccggacagcaggcaagccccgaacagcaggaggttctttctcgatatgtgggctggggcggtctctctgatgcgtttgacccggagaaaccggcatgggctttagagtatgcccagctaaaagaactgctgaccccggaggaatatgccgccgccagaagctctacactcaacgcccattacaccagccctacggtcattcaggccatctatgaagtggtggaacgtatgggatttgagaccggaaatattctggagccgtctatgggtgtgggcaatttctttggtatgctgccggagaaaatgcgaaacagccatttgtacggcgtggagctggaccctgtttccgggcgcatcgcaaagcagctctatcccaaggcggacatcacagtaggcggctttgagaccacagacaggcgtgatttctttgaccttgccatcggcaatgtgcctttcggccagtatcaggtcaacgacaaagcctacaacaagctgaatttcagtattcataactactttttcgccaaagcactcgaccaggtgcgccccggcggcgtggtagcttttgtgacctcccgctataccatggacgccaaggattccaccgtgcgccgctatcttgctcagcgtgctgagctgctgggagctatccgtctgccgaatgacgcgttcaaaaagaatgccggtgccgaggtggtatcggacatcatcttcctccaaaagcgggaccgcccgctggacatcgtgccggaatggacccagaccggacagacggaggacggatttgccatcaaccggtattttatcgagcacccggaaatggtgttgggcagacaggagccggtaagcactgctcatggtatggactacactgtgaaccccatcgaggaactgaagctttccgaccagctgcatgatgctgtgaagtacattcatgggacttatcaggaggcagagctgccggagctgggcgaaggcgaagccattgacacctccattcctgccgatcctaatgtgaagaactattcctatgccattgtagacgggcaggtgtactaccgggaaaacagtcgcatggtccgccctgacctcaacaccacagcagaagcccgcgtaaaaggtcttgtgggactgcgcgattgtgtgcaggaactgatcgaccttcagatggatgcagcggttccggacagcaccattacccagaagcaggcggaactgaacagcctctatgacagcttttctgcaaaatatggccttatcaatgaccgtgcaaaccgactggcctatgcagatgattcttcctattacctgctctgtgcgctggaagtcatcgacgaggacggaaagctggagcgcaaggcggatatgttcaccaagcggaccatcaagccccatcaggcggtggctgtggtggatacggcaagcgaagcactggcggtgtccatctcggaaaaagcctgcgtggatatggactatatgagccagcttaccggaaaaacaaaagaagaactgggcggagagctgcaaggcgtaatcttccgtgtaccgggacagttggagcaggacggaacgccccattatgtgactgctgatgaatacctctccggcaatgtacgccgaaaactgcgtcaggcgcagcgggcggcacagcaggaccctgtttatgcagtcaatgtggaagctcttactgccgcgcagcccaaagacctggatgcgtcggagatcgaggtgcgtctgggtgctacctggattgacaaggaatatatccagcagtttatgtatgagactttcaacaccccgttttatctccagcgcagtatcgaggtcaactattcgtcctttaccgctgaatggcagatcaaggggaaatcttccgtatcctacaacgatgtggcagcctacaccacctacggaaccggccgtgccaatgcctacaagattttggaggacagcctgaacctgcgagatgtccgtatctatgacaccatagaggacgcagacggaaaagagcgccgcgtgctgaacgccaaggagaccaccctggctgcccaaaaacagcaagctatccgggaagtctttagggactggatctggagagacccggagcgccgccagactttggtgcgccagtacaacgaagaaatgaactccacccgtccccgtgagtatgatggcagccatatcacttttggcggcatgaatccggccattaccctgcgggaacaccagaaaagcgccatcgcccatgtgctgtatggcggtaatactctgctggcacacgaagtgggcgcaggcaaaacatttgagatggtggctgcttcgatggaagccaaacgcttgggactgtgccagaaatctctctttgtggttccaaaccatctgaccgagcagtgggcgtcggagtttctgcgtctctatccttccgccaatatcttagtcaccaccaaaaaggactttgagacccataaccgaaagaagttctgcgctcgtattgcgacgggtgattatgatgccatcatcatgggacacagccagtttgagcgtatccccatcagccgggagcgtcaggaacggcttctctatgagcagatcgacgagatcaccgaggggattgcagaggtacaggccagcggcggcgagcgttttactgtcaagcagctggagcgtaccagaaagtctctggaagccagactggaaaagctgcaagccgaagggcgaaaagacgatgtggtaaccttcgagcagctgggcgtggaccgtttgtttgtggacgaggcccacaactataaaaacctgtttctatacacaaaaatgcggaatgtggctggtctttccacatcggacgcgcagaaatcctccgatatgtttgccaagtgccgctatatggatgagattaccggaaaccgtggcgtgatttttgccaccggcaccccggtcagcaactccatgaccgagctttacaccatgcagcgttatcttcagtatgaacgcctgcaagaactgaacatgacccacttcgactgctgggcttcccgatttggagagaccgtcacagcattggagctggcaccggaaggcaccggctaccgggcaagaacgagattcagcaagttctttaatctgccggagctgatgaacctgttcaaagaagtggcggacatcaagaccgccgaccaactgaacctgcccaccccggaggtggaataccacaacatcgtggcgcagcctaccgaacatcagcaggaaatggtcaaggccctttcggagcgcgcatcgctggtacacagcggaaccgttgacccgtcccaggacaatatgctcaagattacctcggatggccgtaagttggggcttgaccagagaatcgtcaaccagatgctgccggatgaacctggcacaaaggtcaatcagtgcgtggacaacatcatgcagatctggcgggatggcaaagctgacaagctgacccagctggtgttctgcgacatttctacaccgcaggcaaaagctcctgcaagcaaggcggcaaaaacgctggataatccactgcttcacgcattggaaggctctgtgcctctgccggagcaggaaccggtctttacggtatatgacgatattcgtcagaaactcattgctcagggaatgcctgccgaccagatcgcttttatccatgaagccaataccgaagtgcggaaaaaggagctgttctctaaggtccgtaccggtcaggttcgtgtccttttgggcagcaccgcaaagatgggcgcaggcaccaatgtgcaagaccgcctggtggcacttcatgacctggactgtccgtggagaccgggagatgtaggacggattttacggacattcaaaataaaaaagaatgtggaggtaacatacaatggcaaaatcattatttgaggaactgggcggaagatacgaaagacaagaggattatctaattccatgtatgactttacccgccgaagaagaacagccgataggcatatggggacagcggcatttagattatctgaagcaataccgcaaagttacatacaccaattttctcacaagcggcaggctcaacgcctatcttgccgacatcgacagacaggcgcaggaacgctttgaacggctcatagagggcatgaaacaggcacagggcataacggaacagctaaaggcagaaaacgccttagaatggacaggatacctcaataacataagggcttgtgcgagggagattgtggaaaaggaaattatttttgcataaacagatgattagtggcaggggaaatcctgccgctttttctgctttagtttgtcagcttgacaaataaagggttaaggaatataattagattcagtattatacaaggagttaataaatatgcggcaaggtattcttaaataaactgtcaatttgatagtgggaacaaaaagtagcagtcccgtttcacttttaatatggggcttagttttttgtacccagtttaagaatacttttatcatgtaattttatatgcccgaaaacatataagtgttttggggctattggagttatttacccagtgataggagtatttatcactgggtatttttatgcccttttttgggtgttgataggaggaaaatcacatgaaaataattaacttaggcattctggctcacgttgacgcaggaaagacaacattaacggagagtttattgtataccagtggtgcaattgcagaactagggagcgtagataaaggcacaacaaggacagatacaatgaatttggagcgtcaaaggggaatcactatccagacagcagtgacatcttttcagtgggaggatgtaaaagtcaacattatagatacgccaggccatatggattttttggcggaagtataccgttctttatccgtattagacggagcagtattattagtttctgcaaaggatggcatacaggcacagacccgtatactgtttcatgcactacagacaatgaagattccgacaatttttttcatcaataaaattgaccaagaggggattgatttgccaatggtatatcgggaaatgaaagcaaagctttcttcggaaattatagtgaagcaaaaggttgggcagcatccccatgtaaatgtaacggacaatgatgatatggaacagtgggatgcggtaattatgggaaacgatgaactattagagaaatatatgtcaggaaaaccgtttaaaatgtcagaactggaacaggaagaaaacaggagattccaaaacggaacgttatttcccgtttatcacggaagcgctaaaaacaatctggggattcggcagcttatagaagtaattgccagtaagttttattcatcaacgcctgaaggtcaatctgaactatgcgggcaggtttttaagattgaatattcagagaaaaggcggcgttttgtttatgtgcgtatatatagcggaacattgcatttgagggatgttattagaatatctgaaaaagagaaaataaaaatcacagagatgtgtgttccgacaaacggtgaattatattcatccgatacagcctgctctggtgatattgtaattttaccaaatgatgttttgcagctaaacagtattttggggaacggaatgctgttgccgcagagaaaatttattgaaaatcctctccctatgctccaaacaacgattgcagtaaagaaatctgaacagcgggaaatattgcttggggcacttacagaaatttcagatggcgaccctcttttaaaatattatgtggatactacaacgcatgagattatactttcttttttggggaatgtgcagatggaagtcatttgtgccatccttgaggaaaaatatcatgtggaggcagaaataaaagagcctactgttatatatatggaaagaccacttagaaaagcagaatataccatccacatagaagtcccgccaaatcctttctgggcttctgtcgggttgtccatagagccgctccctattggaagcggagtgcagtatgaaagcagagtttcacttggatatttaaaccaatcgttccaaaatgcggttatggagggggttctttatggctgcgagcaggggttgtatggatggaaagtgacagactgtaaaatctgttttgaatatggattgtattatagccctgtaagtacccccgcagactttcggctgctttcccctatcgtattggagcaggctttaaaaaaagcagggacagaactattagagccatatctccactttgaaatttatgcaccgcaggaatatctctcacgggcgtatcatgatgctccaaggtattgtgcagatattgtaagtactcagataaagaatgacgaggtcattctgaaaggagaaatccctgccagatgtattcaagaatacaggaacgatttaacttatttcacgaatgggcagggagtctgcttgacagagttaaaaggataccagccagctattggtaaatttatttgccaaccccgccgcccgaatagccgtatagataaggttcggcatatgttccacaagttagcttaacagcttgcaaaagtcatataaaatgagatttgaaaggattagagactaattatgatgaaatgcgaatggatattgtgtcctgtttgtgggagcaaaacccgtaataaaattaggaaggacactgttttggagaattatcctctttattgtccaaaatgcagacaagaaagattgattaaagttgacaacttgaagataactgtcatcaaagagccagacgcttaagacgcagagccgatgaaattgtggaacaattcacgaatcatcggctctttttgtttcgtatttgaaagaacaaactcaccaaataaaaaaaacgatattcgggtgggttattttgttataccctaaattaccctctgaatttgttttttaatttggagggatttttttatgttcttttttcgggcggttatttatctgctcatacgaagtaaaatttatcaatacatagcatgtcagagaacggcaggaaaccagttaaaaaaatttctgccagtgcagcggtacttctcaccttgaaagtagaagtacaatctccatacaacagaattactatttcctataaccgtaaaggtcacagagcctttgcggtttttcttttgtcgatttttgttggaaagtgccgcagggctgtttcttatattaggtgtcgttcgccgcctctccatctggattttagatttcaaaaattcagatgggaggtacttacggtgaagtatgcaccaaaaaaagtatatatcagagaaagcggtggctatgtggaattatcttacacggacttctgccgccgcaggcaagccgaccagacctatatggacaagctgtttattcccgttcagggctgtctgcttgaagtcgtgagggagcaatacacagacttctatcgtgacaaggaacggtggcgttatctgcaaaaattagatacaaagaacagcctgctatctctggacgggtttacagacagcgaggggaatcctctggactttatcgctgatgaagcgatggacgttgcggaaatcgttgtcaatgcggtcatggtggacaggctgaaagctgccctgcctttgctgtcggatagtgaacaggaactgatacaggcaatcttttttgacggactttccgagcgtgaagtcggggcgaggttaggcataacccagagcgttgtgaacaaacgcaaagccaaaatcctaataaagctaagaaagataatagaaaattaaaatttaaggcgttcagcccccttgttttttcctttgggaagatgaggggggcttttctctgccctctcaatcaattctgattggaggaagtaagaatggcatacaaccacggacgggaggacaggaaatggcgtatctggaaagaagcggaggaaaagctgctgcgtgagtgcggcgttgatgaagcgaccattgagcagatacgaatagaggacagggcagacttcaattccaacaggcggttttaccgatggacgaatgacgttgcggaataccttgaggatatggcagacagggagcggcaggcggaagtgggtacggttgcggagttactggacgagattgagagcgaaaatctctatcaagtattagtcacggtggacgggcgtaccttgaaaatcgtcctgctgaaaatgcaggggtattccacaaaggagattgccccgcttgtgcatttgacgactggtgccatctatgcgaggttagaccatctgcggaagaagctgcggaaaattttgtaagcgtctaatacatcccattatcctgcgggctactgggtggggagtggaatctccccgcttattttttggcaggaggacagagggatggcatataaggctaaggcgtacacgctttgggaggaatccacggaaagcggcacaaggtattttatcagctttaaggacgggcagggcaaatcccacgagttggaagtgtcggaacagttctttatggagtttcggcagatggagcgcaggaacaggaatcttctccaatgggacgagcggcacagggagtttaacgaggtatgggacgaaaccctttacagacgggcgttgcgtgtgcctaagagccttgatgaacgcatgattgaggaagaacggaatgaaacgctctgtaaggcggttgggagcctgccagagatacaaaggcggcgtttcctgctctattacgagtatgggttcaatttttaccaaatcgccgctatggagcattgcaccgcttcggcaatacagaaatctgttgcgattgcaaaggagaaagtaaaggcggaaatgaggaagtatctccaaccgtgaccgacaccgcccgaaaaagaaatctgttttttatttgtgtgggattggcggcattacatactctcatttttttcatgggagtaaatctatttttaaggaggtcaacgcctatgtgcaacgaaaacaaagacaccgcccgaaaggaggaaagccatgcagaagttacagacagtcaacgccgaaacgctcctttatgagccgcttgagaaaccgtcctttgtggtggacagccttattccgacaggtttatcgctgttctgcggctcacagaagataggcaagagctggctcatgctgaagctatgcctatgcgtgtcgcagggacttcccttgtgggatatgccgacaatggagggcgacgtgctttacctctgccttgaggacacgttctgccgcatacaggacaggctgttccgattgacggacgaagcgagcaggcggcttcactttgccgtggcaagctgcaagctgtcagacggtcttatcgtgcagttggaggattatctgaaagactatccagacagcaggctcattgtgattgacactttgcagaaagtccgtacagcttcaaaagacaatgcctacgcaagcgactatggggacatctccctaatcaaagactttgccgataggcattctctggcggtagtagtcgtacaccatatccgaaagcagaatgacagcgatgtgttcaacaaggtgtctgggacgacaggcttaacggggagtgcggacgctacctttgttctggaaaaggagaaacgggcatccgataccgccaagctgtatgtgacaggcagggatacgccttatcaggaatacacgctgcgtttccgtgattgcagttgggaacttgtggagaggaaaacacaggagcagcttgcgaaagaaacgataccagacgtcctttttcggttggtggattttatgagggataaggaaaaatgggcaggcacggcaacggaactgttagccgcaatgggagaaacggaaaccatacccacggtgattacgaaatggctaaatgaataccgcaccacatttttaagtgagaaccatatcgcctatcagtacagccgcaaaaaacacggcaggcagatttcgcttgcaaggcaggagggtgacagcggtgacggtggtgacagcgatattgggataccccctgttactgtcattgaagcttaaagccgtgtaaagcgggcggctctgccctgcgggtgacagcggtgacggcggtgacagtgattttaggataccctgccgctgtcatccctacgggagaacaccccgcaaacgcaaagtgcaggcgtgggatttacccgcccttttcggcgtgtaaaaccacccctgcggtcagaaaaatccttctgatttttccgactgcgtttacagggtgtaacacactacactttgccctgcaaagtcgtgtgccagacgttccctctgggctcccttaaggcagagctgtcgccctgctatcctgcgccttgcggcttcggataaaagaatgtcggggtgacggtgacggctcatgcgagggggtatcccaatatcgctgtcaccactgtcaccgctgtcacccaaagggcagttacccgccgaagaaaggaagatgatggattatgccctatgcaatcctgcgtttccagaaacgcaaagcgggcggcgttgcggcttgtgaacgccacaacgagcggaagaaagaagcctacaaaagcaatccagatatagatatggaacgctctaaaaataactatcaccttgtaaaaccaccacgctacacctacaagaaagagattaaccgtatggtagccgaagcggggtgcaggacaaggaaagacagcgtgatgatggtggaaacgcttatcacggcttcgccagaatttatgaaccagttaccgcccgaagaacagaaagcgtattttacgatggctctggacttcatttcggagcgtgtcggggagaaaaatatcctctccgcagttgtccatatggatgagagaacaccgcacatgcacctctgttttgtgccgattacgccagacaataagttgtcagcaaagtctattttaggcaaccagaaatcattatccgagtggcagaccgcctaccatgagcggatgtcctcacggtggaatcagcttgaacggggtcagtcctcaatggaaacgaaacggaaacacgtccccacatggctctataaattgggcggcaggcttgataaacagtatgaggaaatcgtgtctgccctctccgacatcaacgcctttaacgcagggaagaagcgtgacaaggcactggaactgattgcggcatggctcccaaacgtggagaaattctctaaggaaatcagtaagcagagtgcctatatcgacagactaaaggagcaaatcgggcaggaatcagattatgcggggcgtatgcgtgatgaaaagtacgagcaggaattaaaggtgcagaaagcgaatcagaagatatttgaattgcagagaaccaatgagcagatggggcggctattaaagaaaatcccgccagacgtattagaagaattgcagaaaacaggaagaaataaatcaagagaaaggtaaaaagtgaatgaagaaacaggattttaaggtgttaaagaccaaagacttgtacccgtttcccgacaatccgtttcatgtggcagaggatgaaacgctgtcagagttagcggaaagcatcaaggaatttggcattgtcacgccgataatcacacgcccgaaagaggacggggacggctatgaagtgattgcaggacagcggcgtgtccgtgcgtctgaacttgcagggataaacacaatccccgcttttgtcctgcccttagaccgtgaccgagccatcatcacccttgtagacagcaatttgcagcgtgaaaatatcctgccgagcgagcgggcgtttgcctacaagatgaaatccgaagccatgaagcggcagggtttccgcacggatttaacctcgtcacaagttgtgacgaagttgcggacggacgacaaagtggcacagggcttcggcgtgggcaggatgaccgtgcagcgtttcatccgcctgacggaactgataccgccgattttgcagatggtggacgaggggaaaatcgccctcacgcctgcggtggagctgtcctttttgaagaaagacgagcaggaaaacctctttgccacgatggagagtgaagaagcaacaccctcactttcacaggcacagcggatgaaacagttaagccagagcgggcggcttgacatggatacgatatttgcaattatgacggaggaaaagggcaaccagaaagaaaccttgaaaatcaacacaagcaagctgaaaaagtattttccgaagaacacaacgccgaagcagatggaggaaaccatcatccgacttctggaacgtgagttgcagagaaaacggggcagggacagccgctaatcttcttttttcgggaagtaaatgcaggaatttggaacaggagaaagacaggattttaaggaaaatgaggtaaggaatgaaagaaatccagtataagattgtaaaggaaatcgccgtattgtctgcgagtgacagcggctacacaaaggaaatcaatcttatctcatggaacgggagagagccgaaatatgacatccgcagcttttccccgaaccgtgggaagtgcggaaagggtatcacgttgaacgctgatgaagcggcggcactccttaaagcattacagaaagaattaaacagcggggattgatggtatctgattgacagggcggggcgtttccagacgttctctcgccctgtctggaaaggaagatttaagtatgggcgaggataagaaagaagataaaaagagaaagcgtgtcgtgccgaaagcaccagtgcagatgataatcagccgtgaatatgtcggcacacagacagtcacagaagcatttatcccgattatctccgaggatattcggaagaagattgccgagggcgacaccttcgacaatgaggggctgtccgcttagaatgtacgcaatggaacatgaaaacagataggacagatacggaggttttattatatggcaggaataagagcgaaaaatatgatttatgatgtcggcaattactgccgtctgtcaaaggatgacgggacggacaatgagagtgcaagcatcgcaacacaaaaatccatcctcacagattatgtaaaaaagcagggatggaatctggtaaaaacgtatgtggacgacgggtattctgggacaaattttcaaagaccagcttttcaggaaatgcttaaggacattgaaaacggtctgataaactgcgttatcacgaaagatttatcacgtctggggaggaactatcttgattgtgggttatatctggaagtctttttcccagagcataacgtgaggtatatagcggtcaatgacggcgtggatacgctcaataaatcagcgatggacatcacgcctttccgcaacatcctaaacgaaatgtattctgccgatgtgtcggtcaagataaaatcggcgtaccgtgcgaggtttcagcaggggaaattcatggggacgacagcaccatatggatatgtcaaagaccctgctgaccataatcacctattgattgatgataaagttgcacacgttgtaagagaaatatttgaccttgcgttagcgggcaatggaatctccaaaatccgcaagcacatcaacaaacagcatatcttacgccccgccgcttatgcggttacgcagggggcaacaggctatgagcggcactttgaagataacgaggaaaaccgttatatttggagcgagaacagtgtaaggggcattttaagaagcccgatatatgcgggaaaccttgcaggctacaagcggattgccgccaacatgaaaagcaagaaacgcccctctaagctgcctgaagaatgggaagtgataccagacacccacgaggggatagtcacgcaggaggaatttgacaccgtacagcagcttattacaagccgcagattaccagaaaacaagggcggctttgagaacatctttgcaggcgttatcaagtgtgcggactgcggctatgctatgcgggctatgagtgccaacaggaggaaacgccccgacatcatcgactgcgtgcaatattcctgcaataattatggcagatacggtaatatcatgtgtaccgcacacagcattgaagcgagggacttgttcaatgctgttcttgccgacatcaaccgatttgcggatatggcggtcaatgatgaaaaggcggtgagggcgattgaaaagcggctcacggaaacagaccagagcagggcaaaggcactggaaaaggagcagagaaagctgaacaaacgccttgcggaactggacaggctgttttcttccctttatgaagataaggtgatggagcgtattacggagcggaattttgagatgatgtcggggaaataccagaaagagcagcttgaaattgaagcaaggctgaaagaggtaacggaaacgcttaacgacagctatgagaagtcgcagggtgtccgtgacttcctctccctaatccgcaactatcaaggcattaaggaactggacgcaaccatcataaacgcactcatagacaagatacttgtttcggaacgtgagaaacttatagacggaacggtgcggcaagaaatcaagatttactataaattcatcggctttgtcggtgaattacatatcacaccgacaaagcggtggacagcgttaaagcctaagaattgtacggtgtgcggcattgaatatgttccccgctctgcaatatcaaagtattgcccagagtgcaggaaaaggataagaaaggttcaaggaacggaaacgaaacgcaggagcagggagcgaaacagacaggcatgtattgaactgtccgcaaaaaatgaccgactgaccttgcccagagaaaggggcgtatcgagcgccagggcaaccagaatcctcttgtccatgtgtaccgctatgtgaccgaaggaacctttgacgcatacctctggcagacggtggagaataagcaaaaattcatcagtcagatcatgacttctaaatcgccggtgcgttcctgcgatgatgtggacgaaacggcgctttcctttgccgagatcaaagccctgtgcgccggagatccccgcatcaaggagcgtatggatttggatgtggaggtatcccgcctgaagctgatgaaagccgaccaccagagcaagcaatatcgtctggaggaccagttgctcaaatacttcccggaggaaattgaaaagtacaaaggttttatcatgggctttgaatctgacctggaggttttggcagcgcacccgcacccggaggacggttttgctggtatggaaatccgaggtgatctgctgaccgataaggagaatgccggcgcagcacttctggatgcctgcaaggaggtcaaaacctccgatccggtgcagattggcagctaccggggttatgctatgtccgtggaattttccgcatggaaacaggaatatacgctcctgctgaaaggccagatgacccacagggcaacccttggtacagacccgcgcggaaatctcacccgtatcgacaatgctctcgcccagatgccccagcgtctggaggcggcaaaggcccagctggataacctctatcagcagcaggctgccgcaaaggaggaagtcggaaagccattcctttatgaagaagaactgcgaagcaaaaatgcccgtctggcggagctggatactttgctcaacatcgacggaaagggacaggcacacgccgaggctgttgttgccaaaagcacacggacttcggtgctggacagcctgaagcgtccggcgacgccccgcagtacagacaagaaaccaaaacagcatgaggaggtgcgataacatgaataccaataatctgaatacggctctttatgaaaagatgaccactgagcaggaaaaatatagggactggttgaaaagccagcccccggaagaaatcctgcaccacacctatgaatatactgtccgtgaggatattgtgatggcgatggaggagctggagctgaccgacacccaggctcaggcacttttggaatcttcatctccgttggcggatgtgtaccgctattttgaaaagctggagaccggctatatggatgtgatccgggacagcattgaaaaccgtgctgatgatgtgtgcagggctaaagaggaactgcgaacaacaccggtctatccccattcagctgcctatgcatccgagcatggggaaatggcacagtacaacctctcatatcaggcgaacagcacctgcaaagaagctattgagcagaccatcagcgcccactatgcagagaatcggctggatacggaggcggcggtcaaagatgtgctggaaaagttcgggacggaacgggtacagtttattcttgccaacaccatccagcgcaagaactatgacgggcgtatctctcaggacaataaagcatgggcaaaaaccattcctatgctggaggacagcggcgcttcccaccactgtgcctatctggtggtagatcaggtcaatcccggtttgaccgacctgttcaccagacagttccgaaaagtcgctcaagaacagcagaaaagttctgtcctgcaaaagctcaaacaggaaccgcctgcccataagcctgccgccccgaaaaaacgggagccggagcgataaccatggcaaagcgcaagcgggatgtgccggttttgttttgggtgtccgcagaagaactggaactgatccatcaaaagatgcatcaatacgggacagagaatttgagcgcttatctgcggaaaatggcgctggatggttatgtggtcaagctggaactgccggagctgaaggagttggtctccctgatgcgccgaagcagcaacaatttgaatcagctgactcgcaaagtgcatgagaccgggcgggtttataatgctgacttggaggatatatcccagcggcaggaacaactgtgggagggtgtgaaggaaatccttacccaactctccaaactttcataacagggatagatactccatttgcggagggaggaacggcatttcttcgccgcaccttcctccgctttttctttttgtttgtatccttgtcttttgcctgtccgtaccggataatatgagtagaataagaagcgtagcaaaggagtgaaaacagatgctgacctttgaaaaggtgctggagatttttgcggattacctgaccgcagacgagaccatagaagtttatatcagccgccatggatgtgtaagagttgaatttgaccaagattttcactattgctctggcgaggtgtgccatactcccaaggaaatgttcgacctcttagccgatgattaccggacttatctggagattgaactgaccaaaggaaaacgggaagtgacagaagatgatgagagagaagcggatgccctgtgcaaacggcatctggagcgttggagggaggaactggaatgaagattttgaaatgtctgctgatgatcgtaactgcaccggtcattttggtgttgacactttttgtctggctctgcatggggctgatctacatatccggtttggtgcttggtctgctcagcacgataattgctctgcttggcgtggctgtgctgattacctattccccgcagaatggtgtgattttgctggttatggcatttttgattagcccgatggggctgccgctggctgcaatctggctgctgggcaaggtgcagagtttgaaatttgcgatccaggattgggtgtatgggtaaatgatgtgaatataatttggaatgaaaagaagcaggacaatgggagatgagacccaatgccctgcttctctgtttattcagaacgaactgtaatatatttttgttttcgactgtttggcttatctggaatagtcattttaagctggccacttgccagtagaggattcaaatattttcttgtaaaataagtgagatttcgataaccaataaacgagcaaatttcttgtttgcttttttctgttatacaaaaatccaagactgcgtgtaggatgtcccgtgatttatcttggtcactaacttggtcacaatcttggtcactgactaagtctttctgactaagatggtaattcacatttttcaaaataactctgaaatctgtcgctgttgaggaaaattcgggcttgtatgcctctgtgtatccaggcagcttttcggtttcactgacgattttgcgtagaccacttccacggcgttccatgtacttcatgcggtggaacaggtcagcaatcacagggtttcgtcgcatcgaacgaatactgtaaatatcgtattcctgaattgagccgccgccaaacataccgcctggagatgtgatttccacccgatcatcaaacatatcaatatggatttcgctgccaagcacaatataatcacgatggataagcgcattgacaagagcctcggtcacagctcgttcagcataatccggcttgtctacacgatactgtgcttctttgacaaaacggactttggaattattgcgaataaattcactgccgcttttcagtagataaatcagattcccttcgtattctttatcgtccagcgcatcatcaaagatagagcctttttccaagccattccatcgggtacagaacatacgggagttataaactgtgtgctgatcggtcatgagctttccggcattggtcaagaacccatttttgtcagccaaaccgaaggagacataatcggatggctcaaagcggaggccggttcgttccagataggttgcctccaggagtgtgaagctgtaatcctttttcacagcttctgttgttaaggtgtcaaaggactgattggttccctttaagatcagttcattcacaatgtaatccggtgcaattacgctttcatttccaacacggatgtatgcttccattactccgtctgccttgtaatagtatggggtgctacggccaggagaaatctccagagctaacaggtttttaccatcttcctgcaaaggctttaagataaactgcggtaatggtgtgatacgttctttgattaagcggctgatcgcttcagcatccttttgaacatcggacaagccgataggctcccggtcatcagagactccgaaaaacagagtgccgccgattccattggaaaaggcactgacactttttaaccagctttttggcttttttgtttcgagagcaactttgaaatcacattctgttgcttcagcaacgagctgttctatcatagaaatccctcctttgaggttgtagaatgttcttttttattatacccagcggagaaagttattgcaacgatagaagcaaagagttcagcgaaaacaaaaatatttatgagaggagggccttctattatggcaactacaaggatcatgccgcttcatgttggcaaggggcgcacagaaagtcgggcaatcagtgacatcatcgactatgtggccaatccaaagaaaacagataacggcagactcattaccggctatgcgtgtgacagccggactgcggatgcagagtttcttctggcaaagcggcagtacattgccgttaccggacgagtgcgcggtgcagatgatgtgattgcctatcatgtgcgccagtccttccgccccggcgagatcaccccagaagaagcaaacaggctgggcgtagaatttgccaagcgttttaccaaaggcaatcatgcctttgtggtctgcactcacatagacaagtcgcacattcataatcacattatctggtcatcggtcagcttagaatatgaccggaaattccgaaacttttggggcagtaccaaggcggttcgccggttaagtgataccatctgcatcgagaatggactgtccattgtagagaatccgaatcctcatggaaagagctataacaaatggctgggcgatcaggcaaagccctctcaccgagagctgctgcgtgtggcgattgacaacgcattatcacaaagtcctgctaattttgcggaactgctgaagctgctgcaagagtccggctgtgaggtatcaaagcgcggaaaatcgtatcgtctgaagctccccggttgggagaaagcagcccgaatggacagcctgggcgaagggtatggatcggaagatttgcaggcagttctctccgggaagaaaacgcataccccacgaaagaaaacagtcacacaggcagagccgcccaaggtcaatctgctggtggacattcaggcaaaattacaggctggaaaaggcgctgggtatgcgcgctgggccaaggtttttaacctgaaacagatggcgcagactgtaaattttcttaccgaacatcagctgctggactatgcggaactggcagaaaaagcggcggcagccaccgcctaccacaatgaactgtcgatgcagatcaaggcagcggaaaagcgcatggcggagattgccgtactgcgtacccatatcatcaactatgccaagacccgcgagacctatgtggcctaccggaaagctggttactccaagaaattccgcgaggaacatgaagaagaaatcctgctccatcaggcagccaaaaatgcctttgacgagatgggtgtgaagaagctgcccaaggtcaaggacctgcaagctgagtatgccaaactgctggaggaaaagaagaaaacctacgccgagtaccggcgctcccgtgaagaaatgcgggagcttttgacggccaaagcgaatgtggaccggctactgaaaatggacgaggaacagaaaaaggaacaagaaaaagaccacggccagcggtaagctggtcctggtcaaaagcgttcgcagaacgcgcagccacagaatgaaattctgtgttcaaaggggcttgggggcgctgccctcaacaagcaagcggagaggaaaatctcaaagggattttcttctctgcgggcctgtgtgtattaacacaggcattgcttgcctctttttacccggaaatgaaatgagccagtgaggaaacagtcaaatttcactcaccggctcaattcgtttcaaatttcttggatagttctgttagttcttttgcggtctcctgcgtatggtgcaagagggtttcacgcatttctgacggacagctgcaataaagcatcttcatctgactggctccttcatcttctggagagacatctggattgatcagagtgtccagagagagcggcagcacctttgccaatgccttcaaaatcaaataagatggattcatctttcctttttcgatgtttgcaatctgttttacagatacatgactcagatccgcaagctcctgctgtgtcaggtcttttttctttcgggcttcccgcattttttgccccaaagcagtcaaatcgtcaatcggcataatcattcacctcaagtatattgtatcgttccgatttggacaaaggaataaccttattatgccggtcgataggcttgattgtgctgattttttggcaagactgaaacgctatccttgtatcactaactgaatcaaattataatagagatgggtatttttttgaaaaaactgcccgctgtaacatttcgcggacatttgcctgttatactatctgcaaaaagcaaaggaagtgaggatatgaagcagattttaattgtcgaggacgacagttttttgaataagatgttagcctataatctgaccgcagacggctacggcgtgacttctgccctaaatgcaagaaccgcagccgacgccatccgccagcgggaatttgatttagtgctgctggacatcaacctgccggacggcaacggttttgaactgtgcaagctgataaaaccccagcacccggacaccattgtaattttcctgaccgccaacgatcaggagagcgaccagatacggggctatgaggtgggcgcggtggactacatcacaaagccctttgtgatcggggccttgcagcggaaaatcaaagctatgtttgccatgctggaacaccacaaaccggccaaggacatttacgacgacgggcggctgtttctggacttctcggagcagatggcttccttaaacggcaagcctctgaccctatccccgatggagtataaaatgctgaacctgtttcgcaaaaatccccggcaagtgctgacccgtgggcagcttttggaaaagctgtgggatatagacgagaagtttgtggacgaacacaccctgacaacctccatcagccggattcgcagcaagattgaatccgacggcggcgcaccctatatcaagaccgtttacggcatgggctatcaatggacgggaggcgaggcaaaatgaaatttcaaaacctctcggtaaagcggctgtttggccgggtggcaatagggcttgtcctctctatgtccgggatcactatagccctgtttcttgtgacaaagcagacggcggtgctgctgacgggcggggtgctgctgctatgcgcccttgtggggatttttgtactgacgcaggtgtttggaaagcggctgtcgcagtttaccgctgacctgtgccagactttagaccacatgatcgccgggaatgaagcaccccagcggccagaggacagcgaaacccagcttgccagaatcggacaccggctggcaaggctttaccagatcatgcaggagaaccgtcgccgggtggacgaggaacggcaggagttgcagacccttgtatcggatatttcccatcaggtgaaaacgccggtaagcaatctgaaaatggcgacggacaccctgctggaaaagcctatgacggaggcggagcgcaccgactttatccgtggaatccgcagccagacggataagctggactttctttttcaagcccttgtgaaaacctcccgtctggaaacaggcgtgatccagttggataagaagccgggccgcctctttgataccgtggcgcaggccatgagtgggattgtgtatgcagcggagaaaaaacaaatcgccgtgtccgtagactgcccggaggatttggccgtttcccatgacagcaagtggacatccgaagccctttttaacctgttggacaatgcggtgaagtacaccccggcaggcgggaaaatcgctgtgtcggtggtgctgtgggaaatgtatgtggaaatcaaagtagccgacaccggcaagggcatttccgaaagcaatcaggccgccatattccggcgcttttatcgtgaggaagaagtacacgaacagcagggcgtgggcattggcctgtatctggcccgcgagatcgtaacgcggcagggcggctatatcaaagtagtttcggagccgggcaagggttcggaaatttccattatgctgccgacaaaatagaatgcggcggacggccatttccggctgcccgccgtaaattttttgaaatgtccgatcgttgtaacatttcaccccgattttcaatgaatttttcttgccgctgtaacatttcgcggacatttgggttttacaatacccttatcaacaggcaggaagccttgaaaggagttttgagtatgagcattttacagactatcgacctgaaaaagtattacggcacagagccgaacattacccgcgccctagatggcgtgaacttctccgtggaggaaggcgagtttgtggccgttgtgggaacctccggcagcggcaagtccaccctgcttcacatgatgggcgggctggacacccctacttccggcaatgtgattgtccgggacaaagagttgtcgaaaatgaacgacgaacagcttaccatcttccgccgccgcaacatcggctttatcttccagaactataaccttgttcccatcctgaatgtatatgagaacattgtcctgccggtggagctggacggggacgcagtggatcagaagtttttggacgagatcgttcacctgctgggactggaagataaactgaaaaatatgccgaacaatctttccggcggccagcagcagcgtgtggcgattgcccgcgccctaattactaaaccggctatcgtgctggccgacgagccgaccggcaaccttgacagcaagacaagcgccgaggtgctgggacttatcaagcgtaccagtgcggagttccggcaaaccgttgtaatgattacccacaacaacgacattgcccgccttgcagatcggattatccgcattgaggacggcaagattgtggaataaggaggtggcagactatgacatggccttttgagaatgatacaagtgccattgtaaaaaaattggcaggtaggagtatgcaagcagataagagaaacaaggcatttctgcttttgacaatcgccatctctgtctgtatggttttttcgattctcctaatatcaacaggcacacaagagaaattcaagaacacacagagaaataaagcgcagattggcattttgggagttacggacgaacaaacggctcaactgcgtcaaaacgaaaatattatgtgggttggcgaatattccgctctaggtttattttatgttgaaaataaaacaatcactgttgcttatggaaatgaagattattttttacatcaggaagaaaaaacttttcagggaagtgtgccgcagaaagcggatgagattatgctcccccagaactaccttgattttttaggaaaatcctatcaggctggcgattcaatttctattgacctgactggaacaggacaggaagcagaatatacactttcaggtgttttgaataatacgaaagaaagcaacggatattttatttatgttagtaaagagcttgccagagatttggcaaaagattcttttcaggttacagcatatacgcggttgaatacagacgctataagctccacggctattcttgattttgccggtaaagcaatacaaaatacaggcattgtcgaggaacaggtaatgcttacagattattctgctgttatgtcgggtgtgataacatcaggtattccgattccagtaccactactggcggcgttgacggctattttggcggcaacgattgtctatggtgttttttacacaaagattgtaaaaaatgttcagatgtttgggcaactgcggacagttggcatgacaaaaagacagattaaacggatggcaagtaaagagggacgtttatatgccttagctggcattcctttggggcttgtcattggtgtactgattggatttattggctgtcctgatggattccggctaaaaacaacagttatttatgctgtattgattgccgcagtagcctttgtaatagtgaatattgccatttttaagcctgtccgagtagcaatgaatacttccccggtagagggtgctaaataccttgcgtatgctggaaaggcaaaaagcagctcaaaactgcatcggaaacttacgccgtttaatctggcgaaaataaatatacaaagaaacaaacaaaaggcagtcctaacgcttttaatgcttggagtaagcggggctcttttattggttacttctacggttgctggttctattgatccggcaaaacaggcaagtttcaaatattatcctgccggtaacattcttatacaaataagaaatacagtgggtagctctttcgataacgaagcggagccatacggaagcgcaaaattgcaactggaagaaaatccacttgaagatcaggcattgatgcaggaattagaaaaggtagatgggatagaaaaaattaccgcatttgacagcgtttatatgacagctactttttcgggcggaagtggttctatcacgagcatttcaagtttctttccaaccttaaatcgggaacagacagaagaaaagcaggcggtgttatcctccggaacagcagattacgacgatatggttgagaaaaatggaatattggttgcagaagatatagcagaagttggcgatactttgaagattgagggcagagcttttgatggtagaacctttgatgtggaagccgttgttgtaggcacatacaataggtctgatttaatggaggatagcccggttgttcccggaagtccctacttcattatggcttatgacacagcaaagaaactgacagggataacggaacagacggggattctggcagttaaaaattcagagggacgttttgatgaagttttggccgcagttcagaagattgcggataaaaatggaaaaatagaagtaaatacgattgaacaaacgattaaaaatattcagtatcgatacagtgcatctatacatgctctgtatatgacttctgctattctgttcgtctttggaagtatcagccttatgaatatgcttatggttaattttcagaatagaaagcgtgaattcggtttgcttgaagctgttggaacaacacggcaacagttgaaagcaatgctagatagggagatgggaatttacctcggaggttcattggtaatagctcttgtatttggaagcattttaagtgtaattgtttgtagacgattggatgcggtgaaccactgcattacattggtattgccgtggctgtttctattggcgttagtcgttgttttagcagttatatatttgatattcactgcatacgcaaaatccgagttgaagaaaacaagcatcttgtctgccataagggaggaatgatcttttgtatagacatcacttaaaagatagttaatggcacggggttgggtttgcttgaaaaaatccgacataaaggtttgagaacgccttttctgctaatgtctggcgatgacagtagaacattagagcaaaaagccaaactgtactatggtggtttctgctgcaaaacggattttgatttaatccgtaaaattaaagccttagtcagcaactaaataaagataccatctgccggacgacggcaaaagaaaaaaagccgtcgtagagcagacaatttgacacgcccatttgaaacggcggctttgattttcagagccgccgtttctttgcgtttgcacaaaccaatgacgacttgcagggacacggtagccgattggaggttaatttaccgtgtcccgtttgctttttcaaagctcacatgatctacatcagttaaaaaaagcattgctcctcctccgggcaagtataatattgtatcggcattatcgttctatgtaattcggcataatagtggttgtttttggcgcgccagttttccatcgcggaaatctggcgttttttgttgccattttttcagagatgatccggttgtttgccgatgccgttccccacctcctttcgattcacttgtcaatcacccgtgaatcgaaatggaggtacagaatgaagaaaattaaccttcgagaactttatcctgatgtttatacaacagactttttggtagatgtgacagaggaagtaatggaggctattcgagctgctgagcgtgcagaagctgcctatgaccggaggatgtatcgctataaggcgcattactccctggactgtgacaacggcattgaaaatgcggtgctgttgaagccgcaaacaccggagatggttttggaggaaaaacagtttcaggagcaggtctatgctgctgtgatgaagctgccggagaaacaggcaaagaggatttatgccagatactacctgggaatgacggtaaatgaaattgctgaagtagaaggtgtagacccaagccgtgtccgggacagcatccggcgtggtttaaagcagctcggaaaatatttttgataaagtttcatttgatgcgcctgttttttgccttttttgtcagtgttaataagaaggacaagttttcctccttcatcagtacattgacaatcgaatagacagcacaacaggtacataacccatgtatgagcgaatatgaaacgccgcgaagatggagcagtcagggaggtgatgaaagaactgcttcggagcgatctacgatttcataaaacggattgtggcagattcggcgcgatgactgcatgggggcttaaagatacttcctcacggcccgccaaagacttggggggaaccctgcggcacacgatacgaacgatgctgcggagttatgacagccgcgccagcggagacctgttgtgttcccatcgtcaggggggcgtggcaaatgtgacgagaattgagtcatattaaaataggaagcgactgctcttttgggtggccgctttctattcaaaatcagataccatgcgctggcagtttcggctgccagcgtattcatgtgattttgaaagcacgatgataaccttgacagataggagggagtatagtctatggaaaagctcattacacgaaaagaagctgctgaaatcttaggaatcagcatagcaacgctggatgccgcccgtaacaacggcttgatctcttatgtgcagtatgttcagaatggctgtgtgtattttactgcggcaggtcttcaggagtatatcgcaaaatgcacgcacagagcaaaaccagttgagagaagcgcaacttaccgtaaacctcgaagcggaagatcgtgagccggtccgtatccttgatggaatcagagaggtctgataaaacaaaggtacagcgctggagattattcttaggaggtggagaaattggcaaatagaaaaataatacttcctcaatatggcacagtcatgaaaagaggtgtcctatattataggaccagaatcaaagatgcgaatggtaagctcatagctatctacgcaaaaacacctgaagaactatataacaaagaaacgcttgcgttggaacagattgagaatgctacttttcatcggaaaacgcccacagttgcagagtattgtgaaaagtggctgctgatgcagtcggttcatgtacgagccactaccttgacggattacacctcaaaggtcaggcggcatattatagcggaattgggagataaacggataggcgaggttagcctggatgatattcagcttgctcttgttccggtttccaagaaatccgcatcggtttataaatctgtggtaattctctataagtctatctttcgcgcagcgatggaaagcaggatcattgaccataacccgacgatttatctgacgacaaaaggtggcggagttccacaagaggagcgtcaggctttgacagatgaacaggcagagcgccttttggatgctatccgggatttaccgccgtatgtgtttgtcatgattggtttgtatgcgggattacggcgggaagaaattcttgcactgcaatgggattcagtatatctggatacggatactccatatctgacggtaaggcgggcatggcataccgaacataacagaccggtgatttcagatgaattgaaaaccaaggctgcggagagaaatatccccctccctgtttgtttggccgagtgcctgaaggcagcaaaggaaacttcgacttcggaatatgtagtttcaaaccgggatggagatccgctatcttacacgcagtttaagcggctgtggcagtatattgttacgagaacggtcaaggaacggagctattatcggtatgaagatggaaaaagagtaaagcatactgtcacacctatcttgggagaaaaggccgctcataacggaaaagtggtttacagcctggactttgaggtaacaccccatcagttgcggcatacttacattaccaatcttattcatgcgtcggtagatcccaaaacggttcaatacttggcaggccatgagagcagcaagattaccatggacatctatgcaaaggttaagtataacaggccggatgagctggtcagaccaatgagctgcgcgtttgcaagctgggacgcagcacagtaataataaaattaggaagtaaagcaggagcgaggcaaggatgtctcgctctttgttttgcatcagccgtatctttgattaaatcgaggctttctgatagaaagagagtgtagatacggagactacacattatcaagaaaggacgatcaaagatggcaaaaaagaaaacacagatcccgaagtacgggaccattacattgaaaggaatccagtattacagaaccaggattacggatgcagatggcaaagagttgagtttgtatgccgctacttgtgaagaattgtatgagaagcagttagaggcccggaagcaggtggaagaaattatctttcaccggcagcacccgacagtagccgagtatggcgagaagtggctgatgatgcagtcggcaaaggtgtctgcgtctacacttagaggttatacgagggatatgacaaactatatcataaaacctctgggagagatgtatatggaagaagtgactgctgacgatattcggttggctcttgttccattgtcaaagaaatcggaaggcttatataataaggtcaatatgctgctcaagtgcattttttatacggcagagcgaaacaaaatccttgaacacaacccctgtgcaggaatatccggtaaaggcggaaaaccgacaaaaaagaaggaggcattgacagatcagcaggtagccgtgcttctggataccgtcaagggacttcctccatatttgtttattatgctcggtttgtattccggtctgcgcagggaagaaattcttgcactgcaatgggattgtgtatttctggatgagaccaccccgtatctatcggtaaggcgggcatggcgtacagagcataacaggcccgtagtctctacggtgttaaagactccggcagcaaaaagggatattccgataccgaagtgcttggtggattgtctaagagaaacgaaagaaaattccatatcagattatgtgatcgctgacagcaaaggagaaccactggctgcttcgcagtttcaaagagtatggcagtatgtagttgtccgctccactaagccccgaaactattataagtatgtaaatggggagagtatcaaatatacggttactccaacgctgggcatgacccaaaagaatcaacccaaaatcaaatatacgctggacttcgatgtgacgccccatcagctgaggcacacttacatcaccaatcttctttacgcgggtgtcgatccaaagacagtgcagtaccttgccggacacgaaaacagcaaaacaactatggacatctatgcaaaagtgaagtacaataaaccagaggagctgtttggggtagtaaatggtgcgtttcatcaggctatcgctgaatgaaaaagggccgttttttatggtccgcacaccggataactaagaagcagaaagccggaaaagcccggaatatcaaggaaaaacagctcaaaaactcgcgcaaccaggtctcaaagcagctcgtagagcaccacagttctcaaagagataattatctcgcaagagaaatacaattcaaagagatcacaaacctcagaacttcggttctggggtttttctttaccctttgattcagtgagacgtctagaaacgtgatgaaaattggtggatatgtagcaagtatgcagcaaaaatcacagcaactatgaggtcagatttaccgatgaagcatgggggaaaggcgcagaccagtttattattgtcaagggtacctggtttgaaaaattgatggcggaataataagatgctgtgatagaatgaagaaaatgattggatgtgcaaactggaagtttcacatgagacgttagaagaagtgattacggaatactgtaatgcaattttcagcagtggaggggaactaaaggatgaagaatgaaattgtattatttacagatggtgatgttaatatagaagttcaaatcaatcctgagcaggagacagtttggctgacgcaaaaacaaatggaagtgttgtttgatgttaagcacgctacagtaagcgaacatatttcaaatattcttgcttcaggagaactggatgagacttctgtcggtttttccgacagaagtacagggggacgaaaaccccaaatttataatttggatatgattttgtctgtcagatatcgagttaattctaaaagaggtatagctttcagaaaatgggcaaataatgtccttaaacagtttattttgcaaggctatgcaatcaatgaaaaacgtcttcagacgcttaagaaaacagttgatattcagtcaaggatgcttgcagatgcacttgatatagaggagaaagtgtagcctgcttcatatttttattagtgcattacataaaaatatgcatatacacataaacaaggaatgaatattgaaacgtattttgttttacgatagaatatcattactaaaaagagtgcaaatgcggaaaatctttttttgccgtttaccatctttaagagatatttactggagaatggcgttggctctgatcatattgttgaaattgcattggacggtatagagaacgaggaattaagagatcccaagatgcttttttgatttccaaggcaagccgttacgacattaagggagggatttgcatgaaaagaaattactgggcgttattagtttttgcgttaataatagtattgcagtggatcggattaggattttacggtcaaataaggtttatttttttgataattatattagttctaattgttttattggcaatattattacggaaatagtaaaagtgaatagcgaggtgtttgtatgaaaaagttaattgcatcagttttgacattagtttgtattcttactttggcaaggtgtggaaaatcagatagtggtgactatcctgcaactataatggtaaatggtactaactactattccactgatcatgctgttcctgttgaagtggacgagagtgttattcgatatactacttcttatgcagaaaacggcatacctcaaaaagatggcgaagtcaatttcaacagagatttaggaacaccttatgcagttattgaggatgacagggtagttgtccttatagataacgagtggatagagttcaaagcgaagtaagataacttcaagtctgatgaagagcgcgaaggtgtgatcggctatgtaagagaattagaaggaacaaaacttgttgtgctgtgcaatttatgtgaggaagaaaataaagttgtatggcagagtgagtgggattcatatgaattgttgcttggaaattactctgatggaaaagtagatggaacgttgagaccatacgagtgcaaggtgatgcgttccatctagagagtataaattatgtagagaaagaatcgattgaggttaggataagaaattcaacttcaactgaaattaaactgtatgaagcgattcctgcgtcttcttccccttgcaaagaataaataacatgactaagagaacaagtggaaagataagaccaattcccattccaacacggatattattatcagaattttgtgtgacataacctacaataccaggtccaatgctgcctcccaaatcgccggccatggcgagcaatgcaaacattgcggttccaccggccggcatttttttagatgtaatactaatcgttccaggccacatgattccaaccgaaaaaccacatacaatacaaccggttaacccgattaccggattcgatgataaggtggttaaaagataacagatcacacagaggattccggaacctgtcataaacttcatcaaattcattttttcaccatattttccaaaaatcaggcgacttattcccattgtaattgcaaacatgcaaggtccaatcaaatccccaaaagttttagaaagtcccagtgcagcttcggcataggctgatgcccattgtgccatagccaattcagatgctcctgaacaaatcatcaggcagattgccagccagacaacaggagttcggaataactgtctgacgcccattccatttccgtcatttactaaatgttctatcggacaagttgcgaaattatatatattaatcgccggaataagtgcccacatgactgccagccatttccaactattcatcccgaacaggaagaaaaataagctcgaaatcagtatggtggctgccgcaccccaacagtaaaaggagtgaagtaggctcatagttgcttctttatttttaaacgggcatgcttcgatgataggactgcagagaacttcgatcaatccactccccacagcatagataattacacttagaataattccggtaaaaggattcggtaacagatcaggaagaaatgcaagtccaactaatccggcagcagcgcatatttcagaagttacgatacatacacgataaccgattcgatctacaaacttcgcacaaaataagtcgactaaaagctgtgtgaagaaaaagaatgtagatattaaagcaatgttacccaatgaaatatcataatcattgtgaaattttaaaaataatagtggtgagaaatttgcggatatcgcctgagtgacgaatcccagataacatgccacttttgttttttgataatcttgcataacagaaaactcctttgttctttttataccgtattatatattagataacaagaaaaaacattgacttatattgcataaatattgtattatatcgtaaatccaataaaaaggttgttgtgaggaaagatatggcacaaaataaaattgtaacagatgagaatttaatggaatcagcaaaacatgggacggacagttatccgtttaaatgctattttgaaaagttatcacaatttgattttcattgcattgactggcattggcatacagaatgggaatttgtatatgttgaatccggaaacatgacggtatgtgttggtgaatcgatgttttcactatcagaggggaatggtatttttataaattcaaagattttgcacaaattttattccagtgatgaaactgtcatccccaatttcctttgtatgccgtcctttcttgcgtcggaaaatagtttgatctatcaaaaatatattcaaccgattgtttcatcatcgttgtcatacttgatcttaaacggggagaatttatggcaaggagaggcattagaaattatgaagcaaatattttctgcacaggatagagaaggtgatggtaagttgcttacatcagttcttatgcagaaattatggctgattatttatgaaaatattgacaaaacatgtatggaagagcaaacggacgattccggctcagctcaggcacgcttgcagcttatgatgcagtttttgtaccagaattatgcaaaagatatttctttggaagaaattgcctgttatgctaatattagtaaaagtacggtgttgaatctttttaatagatttttacatattactccgattaattatttgatcggctatcggctgaagaaagcagcattgttgattaaaaatacagagaaaaaaatcaatacgatttcttatgaaacagggttccataatgtagattatttttgtagagcatttaaaaagagttataaaatgactccaacagaatatcgaaaaagtaaaaattcaacagtacaataaagttagactagaagaggagaatgatattatgataattagaaagtacacagaaaaagacatttccgagatggttcgtatctggaatgaagtagtagaagatggcgaggccttcccacaggaagagtttttggatgataagacaggggcagaattctttgcatcacagacttattgcggtgttgcggataacgatgggggaattgtaggactttatatcttgcatccgaataacattggccgctgtggtcaccttgcaaatgcaagttatgcagtggattcaacttgccgtggaaagcatatcggtgagaaacttgtaagtgactgccttgtacaggcaaagctgcatgatttcaaaatcctgcagttcaatgcagtggtagaaaataatgttcacgcacgtcatttgtacgagagattaggatttgtgcagattggaactgtaccgaatggattccgtatgaaagatgggacatatcagaatatttgtttgtattataaggaagtgtaataataaaccaatattgacaatataaagatacgaggaaaatgaaatgaacatacagatttttggaactaagaaatgcaataacaccaagaaagcagagcggtttttcaaagaacgtggaatcaaattccagttcattgatatgaaagaaaaaggtatgagtaagggtgaattcaattcagttgctcaggtgaatggtggattagaaaatatgatcaactgggaaggaaaagacaaagatcttcttgctctcattaagtatattgcagatgaagataagctggaaaaggtgcttgaaaatccgcaggtaataaaaactccggttgtaagaaatggaaagcaatcaacattagggtatcagccggatgtctggaaagcatggaaataagaaagggaaaggataaattattatgatttatacagtaaagagaatcgatgaagatttagattttggttgcgaagaacgagctaaagacgctccggttatggcagtggttacacttgtagattcatccggagaagaattgagggtgaaagcagaggatgccctgctttataaaaacaatatcaatgaaggagacaaggtttgttatgataaaaatgatccggattttgttattagtcagatagaagcaaagaatagcgattgttcagtgtttcggatgaattaagataaaaaataaattgtttttttgaggaagaacttatctacagtttcttcctcttttttgagctttttgtaaacaaaatctgtgcaggaagcatagaaaatatcaagcagattcagatgtttgttaataagataacaatacaagtgttgaggagaacgaagttgtactatcaactaatctaaaaattacacataacgcacaaaaactgtgtttataatgtgaaaaacatgtgaagattaagacaaaatgcataaaagaatacagaaataaacaatacaactagtaaaagtgttggaaaatagtacaactttaaaagataactttcttgtattttattgaaaaaaaaggaggtataggaatataatcaaaccatcaagaaaaacttagatggaggagaaaaatatgagaaaagttttcaaaaaagcgttagcagtcacaatggcagccacaatggtagtcggacttgctgcatgcggaagcagcgaatcctcagacaagggtgcttccaaatcagatcagattaaaatcggagtttcaatctggtcatcaacagatgtacttggatcacagtgtaaaaagatgctggacgaagcagcaaaggcattggacgtaaaattacagtatgtggaccagggacatgtttcagagaaagttacagcttctgtagaaacacttgcagcagcaggatgtcagggaatcatcatctgtaactcatctgatacagagatgacatctgcaatcaaaacatgtaacgataacaaagtttatctgtcacagttcttccgtgtaatcagtgaagaaaacagcccggacatctatcaggcagcaaaggattcagagtactacatcggagcagtacatgaagatgagccagcaaatggtgaagagcttgtgaatattcttcttgaaaaaggagatcgtaacatcggtctgatcggctgggagcagggagatgctacatggcttggaagatgggaaggttacaaagcaggcgttgaaaaatggaacaaagaacatccggatgacaaagcaaacctttcagaaccacagtatgcaggtactacatcagaaggtggatcaaaagcagcagaagccttaatggcagcagatccgaaccttgacgcactgattccggcaggtggcggcggagacccacttcagggagcaatcgcagcagtagaacgtgcaggaaaaacagacagcattgacattgtttcaacagacttccttccagaccttggagaaagacttgagaatggatcaatggcaggtgaatccggtggacacttctgtgatcctctgatttccttcatgatggtttacaatgcaatcaaaggtgactatgcagactttggcggaaaatttgaagatgttccattcccatatctgtatgtatcatcaccggaagactacaaagcatatgaagaatattttgtagatcagcttccatatacagatgaagaattagttgaaatgtcaaaacttagtcttgacgacttaaaagcaacagcggctaaggtatctattgaagatgcagcagaacgtgctggaaaataagacagataataataacgacgattaacttgtaaagggtgatgtcgcaaaggcgatgccaccctttctaaatcagaaatgataattataaagaggtagataatatgggcactactaaaaaaatatcagggaaagcgatgggatatgtgatcttaataggtctggtcatactttcctgggctatctttaaaattttaacaccacataacttcggttctttttccaatatgctcaattactttcaggccagcctgatcgctaccgtgggtgcagttggtttttactttgtaatggtaatgggaatgttcgatttctcaattggtgcaaatatcatgctttcagcaatcgttggatgcgtatttgcaactagatttaacctgggttattttggacttatcgcaggatgtattattacaggtgcgatcgtaggaacattaaacggagtattctatgtaaagcttcgtattccatcgatgatcgtaacaacaggtctggctcttatttatgagtcggttgcaaactatattgcaggtggtgttgagcagacacttccatcaaatcttcgtgcatttggtcagatgcctggagatatcattcttgcattagtggcttgcgcagtagcttacatttttttgaattatactaaaatcggaacttatacctacgcaatcggaagtgacgagttcgttgcaaagaacatgggtattaatgtaaataaatataaagtacttgcatttattttgagtggtgcttttctgggagttatggcgattttaacaatcagttatggttcctctatggtagctgttacaggaatggcgtccatgagccgaaactttattccgactatgggatgtttctttggtctggcatttaagaaatacggaatgccgcttccggcaatcattatcggtgagttcgtaatcaacatcattttctttggtttcattgcacttggagcaccgactgcaatccaggatgttatcacaggacttgcactgcttataatcattacagtgacaacaaaggctactaagggcgaaatcgtcaagtaatgaaggagggagacagcaatgagtgaagtaagattacaggtaaaaaatctttgtaaaaacttcggtattacaaaagcagttcagaatgtatccttcaatgtgaataaaggagaggttcatgcgctgatcggagaaaatggttccggtaagtcaactctgacaaatatgctgacaggtatttacagtatcggaagcggaacatttattctggacggaaaagagattcatccaaagaaccaggtagaagcaaacaacgaaggagtatccattattgtgcaggaacttggaactctgtcaggacttactgttgcagagaatattttccttggacatgaagatcagttcgtacatttcggaattaaaaatacaaatgcaatgaacaaaaaagcaacagagcttttgaaaaaatatggctttgacagaatcaaagcagcagatatgatcgataactacaatttcgaggatcgtaaattggttgagattgtaaaagctacttattttgatccaaaggttgttgtgatcgatgagacaacaacagcgctttcacaggaaggacgtgaagagctttacaaacatatggaaagaatcagaaagagtggaaatacagttatttttatttcccatgaccttccggaaatcctggataagtctgatacaattacaattcttcgagatggtgtttacattgatacagttaagagtaaagatgtgacagaagaagacttgaaaaagctgatggtaggacgtgaagtgacaggtgattattatcgttctgattatggcgaaaaagtatctgatgaagtcgtgttatcagtgaaaaatgttacagttccaggattgattgaaaatgtatcctttgatcttcataagggagagattcttggctttggaggactttccgaatcaggtatgcatgaaatcggaaaagctgtttttggagcatcttatgatcgtgaaggtgcggtgacactggcagacggaactcagatcaacagcattcctactgcgattaaaaacagtattgcatatacatctaaggatcgtgataatgaatcagttgtccttaaccagagtattggagataacatttgccttccgtcactggatgagctggcaggaaaatcacatattttaagagataaaaaacgaaaagagtttgcagataagtatgcaaaacaaatgtctgtaaaaatggtggatgtaaaccagtttgtatcaaatctttcaggcggtaataagcagaaggttgttcttgcaagatggatcggtaaagattctgatatcgttgttttggacagtccgactcgtggtattgatatcaaggtaaaacaggatatctaccagctgatgaatcaaatgagaaagaatggaaaatctatcattatgatttcagaagagctgatggagctgatcggtatgtgtgaccgcattataatcatgaaagatggaaaagttagtggtcagcttgatagaaataaggatctgaatgaaaacagtcttatttctatgatggtataaggaggcaactatgggaagtcaagtgagtgtaaaaacaaatgataaagagcagcagctgaaaaaagcatcaaaaatgtctttgatccgttcgctcttaccgatcgttggattggttgttattttcctgttatttaacgttttgacagatttcagaatgatgggaaatctgtcgctggtattttcacaaatatatgtaacaatgattgcagcaatgggagttttcttcattatgacaatgggaggacttgatttctcccagggatccattctcggtatttcttctattgttgtatgtatgctttcacagaagagcattccgcttgcaattatcggaggtattgtaagcggtgctgcaatcggagcgttgaacggttacttttatgtatttcgtaagatcaaatcatttattgtaacaatctgtacaatgttcttgttccgtggatttatcaaataccttacaacaaatgcgccggttgcgggttctgcaaaactgatcaactacgatagtacagagcttaagattgcttgtacagtagtgatccttcttattggatttgttgcatttcgttatacgaaatttggaacttatctgaaagcaatcggagcaggagagaaagcagcgatgttttcaggtatccgtacagataagatgaaattccttatctatgtacttgcaggagcaattacaggatttgctgcatttatcaatgtaatcaaagttggatcagttacttcttcaggaggtaatcagctcgaaacacagattcttatcgcgttggtattaggcggaatgcctatttccggtggtgcaaaggttcgttttgaaaatattattgttggatcattactgtatgttgtactgaatagtggactgacaatgatgggattctcaacacagatgatgcagttgattcagggaattgtattcttaattttcgttgcagtatttgcggatcgtgaatctattcaggtaatcaaataatatagaataaactatacgtgattggggaatgctcttgtcagaagcacttccccggaagtataatataaagatcagaatctttaccataaagcgcggttagagagtctggtctttattttatgggaaaggcagaagttatgagtaacatggatcaagaatgtttgaaatatcaaaaattatataattgggctcatacacttatcaccagtggtgtgataaaaaatatggataaatttccgtcagaaccaagtcttcaaaagaaatttgggtattccaggcagacagtaagaactgcgatgcgaaaattagaagaagaaggattgattacccgcgtgagaggaagcggaacctatgtgtcttatgactgcagtaaggtaaatgaagaacgaccgcaggtcggacttcttttgagttattattcggattatctttttccaagagtatatgatgggattgaatcttgtcttacggaaaaaggatatgctatagaggtggctgtgacaaagaatcgattgaatgatgaagctatctatttggaagggattctgaaaggggatgtcagtggtttgatcatagaaggctcaagatctgcatttccgaatccaaatatccgactttataaagaaattaaaagaaggaatattccgacactttttattcataatcattatgaaaatatggtgtttgacagtgtggaaatgtcagataagaagtgttcgtacgaattgacaaaacttttaattgaaaatggacatcgcaggataggcgggatttttaaatatgatgatatgcaggggattgagagatataaaggctttattcagtgtttatcagattatggagtaaaatttgatgatgattatattcgttggtattcaacaaaagatatggaagaaaagctgagcaaaaaaggtttactccgaatgtatagacgtacgaaagactgtacggcaatgattgtatataatgatgaagttgcgaattattacatggatttcttggaggagaggggattacatgtgccagaggatgtttcgctggtatcatttgatgatgcggagcttttagatgcaaacaacggggctcagctggtttctgcaattcatccgaaatatcagcttggacgtattacagcaaagaatcttcttagaatgatggaagatgaaaagtggcaggaaaagaattattcgtaccgatttccggtgaagataaaagaaggtaattctatacaaaaaataggcagatagaaatttggtgacgaaaaggaggcaatcacgatggatttctacaagagagcacttgaattaaaagacgaaacagtagcagacagaagatacattcatcagaatgcagagacaggacttgagcttccgaagacgaaagcttatgtgatggataagttgaaagagtatggtctgaatccggttgaatgcggagagggagttacggcaacgcttggaaatggcggtagggttcttctcctgcgtgcagatatggatggacttccgatgccggaggaaagtggtgaagcatttgcttgtccaacaggaaaaacagcacatacttgtggacatgattttcatgcggcaatgcttttgagtgcggcaagaatcttaaaagaacaggaaagcaagttgaaaggaactgtgaaattcatgttccagccggcggaagagacatttcagggaagtaagaatatgattgagcatgggattcttgagaatccgaaggtagatgcagcacttgcgtatcatgtatctccgggaaagatgccggtcggactttttatgtataatgataaaggcacaatgatgtattctgttgatggatttaaaatcacggtcaaagggaaaggttctcacggagcctatcctcatgcgggtgtggatccgattaatatcggagtacacattcatcttgcattgcaggagttgattgcaagagagactgatccggcgcacgcatgcgttctgacaattggacagtttaaggccggcgaggcggcaaatattatcccagagacagcagttcttcagggaacaattcgtacaaataatacaaaagagcgcgaacttcttgttcgtcgaatgaaagaagtggcagagaagactgcagctgtgtataatggcagtgtagaaatcgagatgatctctgaagtcccgccgctgatctgcaatccggcattgacggacgaaatgattggatatatgaaagagatggatattccgggccttactccggttccggatgtgagtgcaagtgcatcggaagattttgcagtgatcgcagagaaagttccgagtacatttatgtatctctcagcaggttatacggatgagcggggaacttatccggcacacaatccgaaggtacagtttaatgaagatgtctgcccgatcggtgtggcatgtctggcacagtgtgcggtgaaatggctggagagtcatcaggaataagaagtaaaatacaaaatcaagagaagaaacaagaatacgattggagagcgatatgagcatattaaatgtagaacacctgacacatggatttggagaccgtgcaatcttcaatgatgtgtcattccgacttttgaaaggagagcacattggtcttgtcggggccaacggagaaggaaaatccacttttatgagtattgttacagggaaaatgttaccggatgaagggaaggttgagtggtcaaagaatgtgcatgcaggttatctggatcagcatgcagttcttgagaaaggaatgacgatccgtcaggctttgaaatctgcatttgatccactccttcagaaggagcagagaatgaatgaaatctgtgatatgcttggaacagcagatgaggaagaaatgaatgcgttgatggaagaacttggtacgatccaggatgaactgacactgcatgatttttatacgattgatgcgaaggtagaagaggttgcgcgtgcacttggattacttgatcttggattggacagagatgtgacagacttaagtggtggacagagaacaaaagttcttcttgcaaaacttcttcttgagaaaccggatatcctgcttcttgacgagccgacaaactatctggatgaggagcatattgcatggctgaagcgttatcttctggactacgagaatgcatttatccttatttcacatgatattccgttcttaaatgaagtcgtgaatattatttatcatatggaaaatcaggaattgaaccgttatgtgggcgattatgatcattttcaggaagtttatgcagtgaagaaagcacagttggaagcggcttaccgtcgtcagcagcaggaaatcagcgagctgaaggatttcgttgcaagaaataaagctcgtgtgtctacaagaaatatggcgatgtcccgtcagaaaaagctggataagatggatgtgatcgagcttgcggcagaaagaccaaagccggaattccatttcaaatatggaagaactcctggtaagatgctttttgagacgaaggatcttgtgacaggatatgatgaaccattatctaaaccgttgaatttctctatggaacgtggacagaaaatcgcacttgttggaacaaatggaattggaaaaaccacattgctaaagagtattcttggattgattccttctttatcaggaagtgttgaacttggtgataaccttgaacttggttattttgagcaggaagtaaaaggagaaaatcgtaatagttgtattgaggaactgtggcaggaatttccttcttatacacagtatcaggtgcgttccgcgcttgcaaaatgcggacttacaacgaagcatatcgaaagtcaggtgcgtgtactcagcggtggagagcaggcaaaggtgcgtctctgtaagttgttaaacagagatacgaatttccttctccttgacgagccgacgaatcatcttgatgtggatgcaaaggactctctcaagcaggcattacaggagtacaagggaagtatccttctgatctgccacgaacctgaattttatcaggatgtggttgatgaagtgtgggatatgagccagtggacaacaaaagtattctaaaaattgcacaaatagagctgcatgtgaattatgcaataatcacgaaaatgtttgaaaatttaaaaatctcttaaaataatactgaaaaaatgttatactacacacgtagagtctgttataaaaagggcagtacattgtggacaacaacagtgtaaatgaaaagaacaggaggttttgaaaatgctcagcagaggagacgcagttgtatataagtgcagaggagtgtacaaggtagaagaagtaggaaaactggatttttcatttgtggatggcaagaaagattattatacattacaatccatagacaatcagagagataaggcgtatgttccgattgatgatgagaagaacatccgtcgtccggtgagtgagcagaaggcgaaggaactgttggataatcttacagaggttggtatactgaatgtaaagaatgaaaagtacagagaacaggaatacaaggattgtatctcaagcttctgtcctgagaactgggtcaaagtgctgaagacattgtatagccgaacaaaacgaagaggcagcatgacaagcatggataagaaatatcagctgcttctggaacatgctctttcgagtgaaatgaattatgttcttggaattccggcaggcgagatgacagaactgatcaaaaagagtgaatagttactagaatttaatagaaagaggtccgaagctacggaaaatcaggatttttcattcaatagctgccgggcctggacttgcgaaaaaagcatgtgcatgatatacttctcctgaatctattattttaggagaagtttttcgtttttttctagtagattgtcaagaaagcgaacgtaccgaaaggagaacaacaatgaagatgctgtcgattgagcaggaacttaagagtaactcttatccaggaagaggaattattattggtaaaagcccggatggaaagaaggctgtcactgcctattttattatgggacgcagtgagaacagtagaaaccgtgtgtttgtagaggacggagagggaatccgtacacaggcatttgatccatcgaagcttacagacccaagtctgattatttacgcaccggtcagagtattggggaataagacgatcgtaacaaacggagatcagacagatacgatttatgaaggaatggataagcagcttacttttgagcagtctcttcgttctagagaattcgagccggatggtccgaactacacaccacgtatttctggtgtgatgcatattgagaatggcaattttaattatgcaatgtcaatcctgaagagcaataacggaaacccggacagttgcaacagatatacttttgcatacgagaatccggcagccggtgaagctcattttattcacacttatatgcatgatggcaacccgcttccaagctttgagggagaaccgaagctggtagaggtgctggacaacatggaagagtttgcagaccttctgtggaacagcctgaatgaggaaaataaagtgtcattatttgtccgttacattgatatcgagacaggtaactatgagacaaagatcgtgaataagaacaaataaggagcgtaaagacagatgaaagaattagaattgaaatacggatgtaacccaaaccagaaaccttcaagaatttacatgaacgacgacagagagcttccaatcaaggtgctcagcggacgtccaggatatattaacttcctggatgcgttcaatggatggcagttggtatcagaactgaagaaagcaacaggacttccggctgcaacttcattcaagcatgtatcaccggccggagcggctgttggtcttccactgtcagagacactggcgaagatttactgggtagatgatcttggagaactttctccacttgcatgtgcttatgcaagagcgcgtggcgcagaccgtatgtcttctttcggtgactttatttctctgtctgacgtctgtgacgttgatacagcgcgcctgatcaagagagaggtatctgatggagtgatcgcaccgggatatgagccggaagcacttgaacttctgaaacagaagaaaaaaggaaattacaatattattcagatcgatccggattatgtgcctgcaccgttagagcacaaggaagtattcggaattacatttgagcagggaagaaatgaactgaatatcgataaagatttcttttcaaatgttgtgacagatgtgaaagagatcccggatgcagcgaagatcgatcttgctatttccatgattacactgaaatatacacagtctaactctgtatgttatgtaaaagatggacaggcaatcggaatcggtgccggacagcagtcaagaatccactgtacacgtcttgccggacagaaggcagataactggtggttacgtcagaatccgaaggtacttggacttcagttcaaggatggaatcggacgtgcagacagagataatgcgatcgatctttacatcggagaggaatatatggatgttctcgcagatggtgtctgggagaatacatttaaggtaaaaccggaagtatttacaagagaagagaagagagcatggctggaccagctgacagatgttgcgcttggttctgatgcattcttcccattcggtgataatattgagcgtgcacataagagtggtgtaacttatattgcacagccaggtggatctgtgcgtgatgataatgtaattgctacatgtaacaaatacggcatggcaatggcatttacaggaatccgtctgttccatcattagaaacttaagataagatgataaaagaaccgggacttttggtgaagaaccggcggtatagaaaggctgaaatattatggtaatagagacaagaagcccggaagagacatttgcagtcggtaaaagtcttggtgaaaaagcattcccaggtcaggtgttaaccctgaccggggatcttggagttgggaaaacggtctttactcagggactcgcagaaggacttgggattgaagaaccggtgaatagtccgacatttaccatcgttcaggtttatgaagaagggcgtctgcccttctatcattttgatgtctacagaatcggtgacattgaagagatggacgaggtgggatttgaagaatacgtgatgggagaaggtgtctcactgatcgagtgggcgaatctgatagaagagattcttccggaacgtcggacaaatattctgatcgagaaggatctgacacagggatttgattatcgtcggatcacaatcgaggaacaataacgataaaaaattagaagaatggaacaaagagaaggctgttgatacagagaacattcttacagcagctgacagaggaaggaagcaagaccatgagagtattggcgatagacagctcaggactgacagcaacggttgcagtcgttgaggatgaacagacaattgcggagtataccgtgaattataagaagacacattcgcagacacttctgccgatgattgatgaggtaaagaagatgatcgatctggatttgtccagcattgatgccattgctgtgtcaggaggaccgggctcttttaccgggcttagaatcggatctgctactgcgaaaggactgggacttgctcttggaaaacctctgatccatgttccaacagtggatgcactggcctataatgtttatggatgtggcgacttgatctgcccaatcatggatgccagaagaaaacaggtttatacaggattgtattcattttcacatgaagtgaaagatggaacacatctgacagaggcagcatttcatgtggaagaacagcagatggcgattgcagtagaagagttgatcggtaagctgaatgcgtataaacgtccggttgtatttttgggagacggagtaccagtgtatcgtcagatgcttgaagagggacttgaagtcccgtattcatttgccccatcatacatgaaccgtcagagagcggctgtagtaggagcacttggtattgcgtattattatgcaggaaaatatgagacagcaaaggcgcataagccggattatctgcgtgtgtctcaggcagagcgcgaacgtgcgcagcgtgaaaaggaagcaaagacagaagtgcgtgagatgacgattgaagacggtgctgtagttgctgagattgagcaccagtcattttctgatgcctggagcgagaaggcgattctagagacgctggaacagaacaatagtgtctgctttgttgcggaaaaagcagggaaaagagtaggatatctgcttggttatactgcagttgatgaagtggagattgcaagaatcgcagtgattgatgagatgaaacgtcagggagttggtcatgcattaatgctagctttgaaggcgtggagtaaagagcatcagattgcaaaggttctgttggatgtaagagaaagtaatcaggcagcaggagcattttatgcgagagaaggattcataaatgatggagtccgcaaagcattctatcaggatccgaaggaagatgcagtactgatgagtctggaaatagataaataaccagcagtttccagtggaaattgcgaaaactgttttgtataattgaggcgtaacaaaggaagaaaacaggaatattccgtttttgtaaattacaatgatgagtaacaacataattgctgctcacaggaggaaaacgtatgcgccagtatcagttgaaagaaacaaaagaaattacgaaaattatttgtaaccggtgtggaaaagaaacaaaagttgtgagtgggattccgaaaagagagatgcttcatgtagagcatacctggggctatttttctggaaaagatggagaaagctgcagttttgatctgtgtgaggagtgttttgatgaaattacaaaggggttcctcattccaaccgaatgtaaagatgaatgaaagagtctggtttgcagtttcgggcaaaccgtaatggacaagaagatagaggaatattatgttagatgtatgtttgcttggaagtggtgggatgatgccgcttccttatcgtttccttacttccttaatgacaaggtttaacggaagcagtctgatgattgactgcggagaaggaacacaggtagctgtaaaagagaagggctggagttttaaaccaatcgatgtgatctgttttactcattatcatggggatcatatcagtggacttccgggtcttctacttacaatgggaaatgcagaccgtagggaaccgttgacactgatcggaccgaaaggtcttgaaagggttgtcagttgcctgcgcgtaattgcgccggaactgccatttccaatcatttatcaggagattcagggagcggagcagacatttgagttaaatggataccggttgaaagcatttcgtgtgaaccataatgtactttgctatggttatacgattgaaattgaccgcgccggtaagtttgatgtggagcgtgcccgtgcaaatgagattccgcagaaatactggagtcgcttacagaacggagaaactgtagaaagtgaaatgggaattttgacaccggatatggtgctcggtccacagagaaaaggaattaagctgacttatacaacagatacaaggccgacagattcgattcgtgagaatgcgaaagattctgatcttttcatctgtgaaggcatgtatggagagaaagagaaagcagcgaaggcagtagagtataagcatatgacattttatgaagcggcggaactggcgaaagaagcgaatgttggcgagatgtggctgacacattatagcccgtcacttacaaagccggaacattatatgaatgatgtgaaaaagatattccctcgggcgaaagctggaaaggatggaatgtctgttgatctgatgtttgaagattgagagggatagaaaatgagtgaaagcaaagagattaatatactggcgatcgaaagttcctgtgatgagacagcggcagcagtagtacgaaacgggcgagaagtgcgctcaaatatcatttcttctcagattgatctgcacaaattatacggtggtgttgtgccggaaattgcatcaagaaagcatattgagaagattaatcaggtgattgaagaggcgcttagtgaagcagggacaacattagatgagattgacgcaatcggtgtaacttatggaccggggcttgtaggagccctgcttgttggcgtggctgaagcaaaagcaatcgcatgggcaaaagatattccactggttggagtgcatcatattgagggacatatttctgcaaattatatcgaacatccggatcttgaaccaccgtttgtatgccttgttgcatctggtggacacacacatcttgtgtgcgtgaaagaatatggaaaatatgagatcctcggaagaactagagatgatgcagcgggtgaagcttatgataaagtggctcgtgcaatcggactcggttatccgggcggtccaaagattgaccgtattgccaaagaggggaatccggatgcaatccagttcccaaaggcaaaggtaaatgatgcagagtatgattttagtttcagtggactgaaatcagcggtattgaattatattaatggctgtaagatgaaaggtgagacatttgatcctgcagatcttgcggcatctttccagaaggcagtagtagaagttcttgtgggtaattcaatgcgtgcggcagaaaaactcggcatgaagaaattcgcgatcgcgggaggagttgcgtctaattcagcgcttcgtgaagcgatggaagaagcctgtgaaaaacgtggaatgaaattctaccgtccgtcaccgatttactgtacagataatgcggcaatgatcggagcggcggcttattatgaataccttgccggaactcgttcgggatgggatttgaatgctgtaccgaacctgaagcttggagagagatagaaatattttgtgtatcgaggcatgattttgtcatatggtataggtaccgtgagtatgaatggaataagtgggaaacgaaaagttatccacacgattctttaaattgtaattagatatgaacaggattttgtgatgagttgtgaataactttgcaaaatcctgtatttaatgtgaataacaggagagaaaaatggagaagaaatattgtacagcggttgttcttgctggcggaagtggaaaaagaatggggacaaaagttcataaacagtacttgatgctgaaaggttatcctgtactttattattctctgaaagcatttcaggattcctcatggattgatgaaatcgttcttgtcagcggtacaggtgaagaagaatattgtcaaaaagaaatcgtagaaaaatatggtttttcaaaagtacgcaaaattgtatctggaggagcagagcgatataattctgtttggaatggtcttcagcaaataacagaagaagatgggttcgtatatattcatgacggggcgagaccttttgtggatgatactatgattgaacgcgcctattcttgcgtggaagaaacaaatgcatgtgttgccggcatgcctgtaaaggatacaatcaaagttgtggacgaaaagaattatgtgaaaggcacaccggagcgaaaaacactctggcttgttcagacaccacaggtttttaatatccagctgatcaaagaagcttatcagaaattaatcaacgagaaaatcgaaaatgcgacagatgatgcgatggtagtcgagcagatgatgggacatactgttaaattatatcccggagcatatgaaaatataaaaatcacaacaccggaagatcttcttgtggcggaagcgtttctgtaggaatatacaagggaattcaagaaaagagggggattttccgatgttgtaaagtgtggaaaaagccccaaaaatcaaggaaaacaaagaaagttaaaaaaatgtgaaaaaaatgaaaaaaaggtgttgacatttaggtccaccttatgataagattatcagcgtcgcaagtgaaacgacaacaacttaataagaattgctaatcggcaatgattaggtattatggagaggtatcgaagtggtcataacgaggcggtcttgaaaaccgtttgtccgaaagggcgcgtgggttcgaatcccaccctctccgttttttatggagaagtacccaagctggccgaaggggctcccctggaaagggagtaggtcgttagtagcggcgcgagggttcaaatccctccttctccgtttgttttatgaaaactcataaaactttttaaaaaagttcttgacaaacaaaaacagctatgttaatataaacaagctgtcgcttgaaaagaacgacacaaacaaagaaccttgataactgaacaatatcgcatacctttacgaatttcaaatttttctacttttaatcctgcttttttgcaacattttatgaccacatctcttgttggcacctggacatctccatgtccgcatatatttgccaacggcatttccaatgtattcattagccataccaatactttgttgtcactggtcatatctctaagaaccaaccttccatttgggcgaagacatctcttcacactgtcaaaaaatgcctgtggattcggataatgatggaaactcatagaacaaataattgcatcaaatgaatcattttcaaaaggaaagttctcacaatctcctacaacaaatgttgcatttgaaatatttttcttttttgcctgttcaatcatggccggagtcagatccagtcctgtataatgtcggtctggatatttttctgctaataaagaaatcatcggagcaggcccacagcctgcatctaataaatctctaaaaggctccttctctaattcttccagaatatccggataatctttcttgcacatttcgtaaataccagcatggctactttcatatcttcctgctgcttttgtaaattctttaattgacaattttttatattcttcatttttcatgctttttctccaatcacagtacctttttcgtcttgcatccgcatttcttcattgatatgttcgaaaaaattcattggcaaaaataattatcttcagcggtatagtattagttctatagcttattgattatattacctaatatctgttattctataatctttcactgtgttagttttaactaactatctagtataaagaaaaccgtgcaaaaagtaaactgtaatttcacacggttttcttatgcttaagtatatcacttgcgtaatcatataacaatatatttctttcaacaatttacaaaactaggcggtggaatttactctttcacacaagtattactttttattattttctcttgccataattcctgtaaattgttcgacaccgaaacgtctcataaacatttcacatttacacaggaataaatagtaaatatttaatccgcatccacttagtccttcataatttccctgtcccttagaaatcaacagatcagcattctcaacctcatccattgattccttagagattgctccaaccacattacctggtaatccggtaccgtttccaagtaccttttgtgcaacatcttccatgtgaatgtattttgcatcttccaatgtagcatcatttaaaactggtttgcctcttacaatcacagttatatgtaaattaggattaatatcgcgaagcgttgaaatcaataacttatctgttacaatttctccgcagttatccgtaaaataaaccagccttttcgcattgaccaaatcgtttttaaaaacatccaacagcttagaatctatatttatatttattgcttcatctaattgagctttcagctcaccttcatttacattttctaaagctccaaaatcaatatagtttccaaccattgcatactgtattgctgtttttaaatgattttcagatgtatcaactttatttttcatatacggaaagtgatcaaacattaattgattgtaatgctgtttgatttctgtataatccatcacatttccaaaaagttcctgacgaagattatccattttttctgcaacctgtggtgtagataacccatcactattctttacaatctctttcaccttatattgatattctgttatctttccttctgttgcatcaataggatatttattaatatttcgttttatctgacattttttacattcttcatttattaccataacttccgttaataacctccacttttctaacgctaaatcaagttaatcctttgcgtccgtcaaattttccattttaaacacataataaccttcatagtaataactgtgatcgatacccttcatataaatttctcgatcatttacattatccataagtgcatttttcagaagaaactttatttcgatatcttacttttgttttgccgtatttaaatgctgctttatcttcacagctggtctaaatattcgtctgattatcaactgcaaaaatcaaacatctccctgcaaatcattttcccgcatgttgttttgaaaatactttcataagcttttaaagcagcttctttcgataaaccatcctccataatattaaccaggaaatcagcctctaccaatatctgataatcaatttcatcaatattattatatgtatggtgatgtgcaatcaaatactggacacgatcagatacatcttgatcaaagcctaattctttgagcatcttttctgcaattgcagggccttctttttcttgtaattttccattgcagtttccatatttttcttcgcagaaatgaattccaatatcatgtgtcaaagctgctgcttcaatgataaacaagcattccttatctacattttctgtttctgcgatcaattttgcataactatgcactttacaaaaatgttgaatcctctttgcatctcctctgtataattcaatcattgccaaatgtaatttatttatcattttaatgcttcctcctcttgcactatataatagcttttgaattgattctatattttctgtgacacatgtcacatttttattcctgaatctgtgtcattagaaacggtcaattcaaaatgttttctatttgtttttagatagccttctttttgtaactttgatatctctgtagacattgctgcacgatctatacaaagataatctgccagctgctgccggtcaaaaggaatatcaaaagataacgacgaatgtctgatagattctgctgacagatacgacaatagtttatctctggttgttcgtttcccgacatgggtgatcttatcgttcaggatcagtatcttattcgccaggacactgacaaggttacggatcagtttctgatgatgctcgcatgccgtcgggcaggaaacaaggagtctctggacattcagggaaataatttcacaatcctcatctgctatcacactgatatttaaaacagctcccgggcttgctgcatatggctcaccaaagaaatcaccggtatggcattttgacagaatatttcgatgtccccagagatcttcctgaatcacaagaacacagcctgacagcacaagtcccattacctcggtagaatctcccgctctgaaaatataagaatttcgttctttggaagttattgttgcatttacacaatgcaatatggataatatctcgttatctgtaaggcctttgaagaatggactgtttcttagaataggcaaatattttttcaaaatcgttcctcctgttggaaatcaaacatacaagttgtatttattatactatgattctagcagaaacaaaagtgaaatgttataaatggagggtaaaaatgataagaaagattattcgaatcgataaagaaaaatgtaatggatgcggtgcctgtgcgaatgcctgtcatgaaggtgccattgacatcattaacggaaaagcagaattggtgagagaacatttctgtgacggacttggtgattgtctcccggaatgtcctacaggtgccatttcttttgaagaaagggaagctcctgcatatgatgaagaagccgtaaaagaagctcagaataagaaaattgctcgaaatcaggcaatgtctacgcacaccggttgtcctggttctaaaatcatgcagattcggcggacagaaacacctgagtctgtaaaatcatcttcaaccgtagattctgtatcaaaacttcagaactggccagtccagattaaacttgcaccagtcagtgcaccatattttgacggtgcaaagcttttaatcgcagccgattgcactgcttacgcttatgcaagttttcataaggattttattcagaataaggtaacattaatcggttgccctaaattagatcaggtggattatagtgagaaattaactgcaatcattcaaaataacaacatccaaagcgtaacgatcgtaaggatggaagttccttgctgtggtggtctggagatggcagcaaaaaaggctcttcaaaatagtggaaaattcttaccatggcaggttataacaataggtattgatgggaaaactatagaataaaaaaggagaatgcaataatggataagaaaatgttttgttttcagtgtgaacagacagtcggatgtaccggctgcacaggaaatgccggcgcctgtgggaaaaaagcagatacagccagattacaggatgaactgacaggtgcgttgatcagccttgcaagagctgttgacggttcaactgctatttctaaaagaaccgggcaaatcataattgaaggattgtttactacagttacaaatgtgaattttgacgatgcatcaattgaaaacatgatacaaaaagtcagagctgaaaaagaaagactggttcctgactgcagcaaatgtcagtcaccatgcggtaaaacagatgaatacgatatgcagcagctgtgggatgccaacgaagatatccgttctctgaagtctcttattcttttcgggattcgtgggatggcagcctatgcctatcatgcaaatgttctgaattatgaagatgccgaggtaaatcgattcttctgcgaagcattgtttatgattggttatggagagagtgtggaaactctgcttcccacagtgctcaaagtaggagaaatcaatctgaagtgtatggcacttcttgacaaggcaaatacagaaacctatggaataccagaaccaaccgatgtgacacttacaatagaaaaggggccttttattgtcgtgaccggacatgatctgagagacctgcagcttttgcttgaacaaacagagggaaaaggaatcaacatctatactcatggtgaaatgctccctgcccatgcatatccgttcttaaaaaaattctctcacttaaaagggaattttggaaccgcatggcagaatcagcagaaagagttcgatcatcttccagctccgattctctacactaccaactgtctgatgccgccaaaaagcagctatgctgacagagtatttacaacagaagtggttgctttcccaggtgctgttcatatcgatgaaaagaaagattttacgccggttattgaaaaggcactggaactgggtggttacaaggaagatcagatactcacaggcatcaatggcggtacaaaagtgacaaccggttttggtcatgcggctatcctgtctcatgcaggtactatagtagaagctgtaaaatcaggagcaatccgtcatttcttcctggttgccggctgtgatggtgccaaaccgggccgaaactattacacagaattcgtaaaacagacaccttctgacagtattgtcctcaccctggcatgtggaaaatttcgttttaatgatcttgagctgggagaaatcggtggtctgccacggctgatggatatggggcagtgcaatgatgcttatggtgcgattcaggttgctgtggcacttgcagatgcatttggatgttccgtaaatgaacttccactctcctttgttctctcctggtacgaacagaaggctgtctgcatcttgttaacacttctgcatttaggtatcaaaaacattcgtcttggtccttctcttccggcgtttttgtctcctaatattctgaattttctagtggagaattatggcattgcacctattaccacaccggaagaagacattaaagcactgctgaaccatagcaaataaagttttaacggttcagcacctttacagttgcataagctttcgagttatctataaattcaacaaagccgatgcgggattcaaaatcctccaccggctttattgattgtaatcccagaagtgaaaactatcttataatatgtactccatttgtctttcttttgttcgcattcccattttttcataaaatttctcagcaggagtatttcctgcccatacatttaatgttacttcataacatcccagctgtttcgcttcactttttacatattcaaacagactttcgccaatatgctggcctcgagcctcttgatcgacacatagatcatcaataaaaagagacttaaactgcaccatattatttgaaaagggctgctcctgtaattgacaaaatgcatatcccctgcaaacatcattctcatctactgcaacatatatcggcttttctttatttttcagaagctctgccaattcatctatagtatattttgtcgtacccggaataaaaatatcaggtcttatgtctgcatgaatttgtaatacctgttttaatagctctaaaattcttggaatatctttttcttctgcttttctgataatcatttttactctcccattatcatatttgttttctccatctacttgtgaaaaaacaacgtcaatctattgtccagtataccatatcactgttaagaataccattcttcctatacgaataaaaacatattttttcagatttcaaatatacacttcctgccaaatatgatacgatatacccaacaaattacattttaaggagattttatatgaaagcctatgaacgtttactaaaatatgcagttataaaaacaccttctgatgaatccagcgattcaacaccttcttctgcatgccagtttgatctggctaatcttttaaagaaagaaatggaagaacttgtggtttcaaatattcagctgactgataattgtttcctctacgggaaacttcccgcaacaaaaggatatgagaatgcacctgctattggctttatcgcacatatggacactgtagccgattactgtgagcagccgattcgtccgattatcacagaacattatgatggtaaagaacttgctcttggcaatagtgggttaattttaagcccggaaatgttcccgcatttggaatcattaaaaggacatacacttattaccacagatggaaatacaatcttaggagctgatgacaaagccggaattgcagaaatccttactatggttgaacatctgcaggcggaatccattcctcatggtccgatttgtatcgcctttactcctgatgaagaaattggtaccggtgcttctcattttgatgtggagttgtttggcgcagattttgcctatacattggacggttctacagagggagaactggagtatgaaaactttaatgcatgcagtgcttcttttgatattcatggggtaagtgtgcatccgggctctgccaaagatacaatggtcaatgcatgccttcttgctatggaaatcaacaatcttctaccttcaaacgagattccacgcgatacagaaggatatgaaggtttctatcatttgatacatatgagtggagattgtggacatgctactctaaattatatcgtccgagaccatgacacaaacaattttcaacgcagaaaagacaaactcgctgatatcactaacgagttgaataaaaaatggggagaaaatacagttgaactgcatataaaagatcagtactttaatatgaaaaatattattgaagaacatatgcacctgatcgataatgcaaagcttgcctgtgaaagaaccggactcactccaattgtctcaccgatccgaggcggtactgacggatgccagctgagttttcgtggtcttccatgcccggatattggtacaggaggtcatggatatcatggcccttatgaacacatttctgttcagagtatggataaagtagttgatatgatgattgaacttgtaaagatatattctacattttcagtataatggtgaatccgatttataggttctagatgtaaaaagcacaagggataattgatgtccagcttgtgctttttactttagcaatttatttctcttttaacttttacgctcttctcttctgcttattttatacatgcagatttttctgcatctcttctttaaattctcttcccttgaacaaaatcactgctacaaggaataagaaacacgtcaatgctccaaacatactcactgttggatttttcaccaccccgcataaaagcaagattaccggaaggattaatccatatccagcggccataatttcataaataagatactctcgcaccggacttttctgcactttagcggttacaaacattgctgcaagtgtagatacactcatgatcggcaacacaagatctacagaccagctgtgccatccggtcagtgcatcccatataaaacagatgattgtaccgataataagctgccacatcgcatttttcagcagattataacgtttgaaaaatccgattgacgaggcaatccacatcgtcacaacgcctcctgctgtaaataaagtccatcgaattcttgggtggaaattcaaatccgtaacaagcattgccgcaacaatcgcaatacacagaaagctatagatcttatagactttcatttcctgttcgcttggcttacctgtctttggaaattcaggctttactttttcagatgtgattccctgttcttttaacaagcgataaaagttgcgttcaatgttcactgtgtcgtatctggatgtaaatgcaaatgataatttatcctggaaggaacacaaacataattcaagcttcggggtatttgtatatacgccaaatcgttcaatataaggtacataacttgcaggcattttaactgcgctcatattagaaaagattgctgttgtattcttctccgaatattttgcgcctgcctgaatacaaaggtttttaagttccaatggcgcaagtctcaaaatcggatgcaattccagtgctagtaactcgctgatatgtgctgacattttttctttcgttaattctgtctcaaaaaattctttcgtatatttcagaactgcttcaaagctttgatcctgtgttgtaaaattatatcccggttcgatccagttaaaaaaattcaacatcgatgaagacgggaaaaactttcttaggttaaccggaaccattaacacaaccggctttttcttctgcatcttagacatttcttcgtttattgccatcataaataatgctgtcaaaaagatcgtcatggatactccgagttctctgcttcgctttaatactgcctgtactgagacaacagattcatggacatgcagatgatttccatctttctttttccttcgtatctgaaaagcatttagttttctttttttcggtcgtttttgattttttgaataatattttaagaaactgtcatcttcctgatcttgtacagtcatatcttccggcagtaatgtaatctgttctaatccttcttctttatgcacaaggtataaataattctttaccagttcttttaagaattctgttgcccctgtaccgtctgtcaacacatgaaacacttcaaaattgattcgttttttataataagttacttcaaatagtagggtcttcttatctcttatataaagtctgctgcatggctctttatattcttctttaacaatcggccgtagattacacggttcaagataatgccaaaataatcccttacgaagtaccattaaaaacgtaggaaatgtttctatcgtctgattcagtgcttcctgtaaagctttaggatttacattttcttttagttcacagtaaaatcgaaatactctcgtatcttttttgttactggcagcagaatacaatttcgctgcgttgtctaatttcctccagcgtgcgtttttcttactcactgtgtttcccctttcaaaaattcattaatataggtgaaactttcctgtacatgaagctgcttgatccccaacgcgaagtatccatgtaatgcatctttaatccgatgtatctccacatgatttccagcctctttcaagcgttccccatacgcttccccttcatctcgaagtggatcaaattcacatgtaaggatcaatgtatccggctgattcgttaaatcttcagctatatatggtgcaaaataaggattcttcttatcctcctcatttctcgcataaagatcaatataatcctgcatttttccggccgtcaaaagataatcggatccattttccttaacagatacaaatggtgaattctctgtataatcattataggtagccggatagatcagaatctgtctgtttggcataaattctccgcggtctcttgccatcaaagataatgctgcgcagagatttcccccggcactgtctccgatcaaagtaatgttttctggtcttatatttaacataaaatctccagaatataccgcttttgcaacagcataacaatcttccagacctgctgggaatttatcttccggtgccagtctgtattcaactgcaactacatattgtccggttgcattcgcaagccgagcgcaaattctttcataattatcaatactttctgtaacccatccaccgccatgtatgaacaaaagcaattttttatcctgaatatcatgcttcttttcttcaatttctcgaaagcttttctcgcttggaaaaaatattcgaatcggaactgcatgacttccgttatatattttctcgtctactttcttataaaaaatcttcattggatccagtcgttttaaatccgccatatgacgaaatgcttccacttctactccatcaaaagataatgctttcaaaattttctttgctgtctgattgatcaatagtacattctccttatatccgttcttatatctgtaaaagactacgagtccattatatcataaagtgctctgaaaaataaatttaatgttgaaaaaagcaccagccaactgaatgactgatgcttctgacatcaagatactttactttttataaactgtgttgccttttgcaatcacttcaacaagctgaagttcctgatcaagaatacaaagatccgcatcatagccttcttcaatcttaccttttcctttgaggcgaagaatctctgccggattagatgtaatcgtagaaatagctatttctaatggaatttttgttttgaatacacattcctttacttctttcagaaggcagctggactgtccaacgcccattccaaggaattcaccatcactactgtacatcggaaggcttccctgtccatcggaggaaattgtcatacgatcaggatttactcctgcatccaacatacgtttgataccattgcatacacgtacttcatcacagatagtttcccaatagtcaatatcttcatttccggtaaaatctactgctccacccttcagcgcatactcaattgacttacagaaaagcatctcattccggttgatatgtgttggaagtatttgagaagccggtatctctgtctcatctaccacccgttcaataagatctaagcatctcggactgtcgccaagatgaacatttacaataccagctttcccggaaagaacgccaccaagtcttgtatcagcaacgacacgtgcaaattcttcaaaagtcggctgtgaagaacgatgatcagaaattgcgatttctcctgttccaacaatttcctgaatcatcataatgtcttttacaatactgtccgtcagtgtgcggaccggaatctgataactacctgtatagcaatatgcagacatcccctgctcattcaagccttttgtctttgcaaccagtgcacacatatcacgaccgattccatctgttccaaggcagccaacaactgttgttactccaaacttcgtaagtccttctatagttgcttctggagtacggttggcgaatccaccttcgccaccgcctccgagtacatgaacatgactatcaatgaatcccggagttaaaagtaacccctctccatcgatcacttctgcatcagaaagaaatccgtctgctgacatagaacctgcatctttaatcttgacaatcttgtcattgatcgtcaatacatcttttttccccagatgctgtggggcataaacatcaatactctgaattaatttcatcttaaatcactttcaattatcaaatgcctgttttagaatccaattccgacagcaatcagaactgtaataattgcaccaatcatcaatacgccgaggaatttccacatgaatttgatccagttagaccactcgatcttagcaattgcaagagatccgatcagacatcctgatgtaggaacgatcaggtttgtaaatgcatcaccaagctggaatgcaactacagctgtctgacgtgatacacctaacagatctgacagtggagccataatcggcattgtgatcgcagcctgtcctgttccggatacaacgaaaaagttgaatacggactggaacagatacataagtactgctgcaactgctccggatactcctgacagtgcatttgaaatattatacataattgtgttgataactgtaggtgtagtcggatcagatccaccaagaacctgcatgataccctgagccatagcaacaacaagtgctgcaccgatcagatcttttgctccatctttgaaagaagttgcaatatcattcaatctcatatcgttcagcttaaagataactccgatcacaccggaaacaattcccataataaagaactgtgtcgcgatctccggcatgtaatatccctgggtcataacaccccaaactacccatactacggtagcagccagtgtcagaagaactaaaatgtgtccaagaccaaaggaatgtccttcgtcaatacctgttttttcgttctgctcacggaaatatgcatccgtctcatatgcgattgagattgtcggagtccttttgatctttgacgcatagaacatcgtcattccacagccaagagctgtaaatacaacccacatcaccatacggaatcctgctccggagaatacatcaatccctgcaataccctgtgcaatacctacagagaacggattcatccaggatgaaccgaaaccgatctgtgttgcaacataagtaacaagaactgcgataacggagtcatatccaactgctacaaacaacggacaaagaatcatagtaaatggaagtgcttcttctcccattccgaaaactgctccaccaagagaaaacagtacaaaaagtactggaatcagcagtttctcggcgccttttgccttacggatcaatccgatcagtccggattcgatcgcaccggtacggatcatgataccaaatgcgccacctacaaccataaggaatgcgatgatctcaattgcagaactgcttacgattccgttatacatatagttgaagaatcctgttccgccatctccgctaaagagtgctactccttccgttactacgttccctgcatcatctgtcagatactggaaacttccgtctttgattactgtacgggttttctcaacaccattgatcatgtatgaaatgtcctgtgtttcgtaaaatccctttggtacaagaaatgtcagaagtgctgctacaacaactactaaaaagataatgatgtaggtgtcaggcacttgaaatcccttgttaaaagactttaacccttttccttcttttttgctcatttttgagtctcctcccacattttttgatataccacattagtttaccacagaatgtttgaaaagtaaccaaaaatttacatattttgtcggtatttttgtcgattttatggctgactgttattttctttctctttttgcctcgctttgatcttccgaattgcctcttctactgctgcttcttcttcctctttcgcaatctgctttgccatgcgataggtttcaaataaattactgaataagataatgatgagaggaatcaaaataataggtataaaaatcaaagggttcgcaacgagccttgaaaacttacctaacttattggaagaagctacaactttaccgatcaaatattcgcccggcacatcatagctgtctacaacattattattatcaccttttgtgacaaagacaattgtattattttcctgtctgatctctacaaccctgtgtgtatttactgcactatcaagtgccggatcctgagaataaaaggaaatcacatcattttcttttatttgagccggatctgtcttttttactgtttttacgatcccgccgctcctggagtacctggacaatgtaatgagacagactatttgcttcagcttttgcctgagctttttctcttgccttctcggaagctttcaattgtttttccgattctttcttaagtgcattattttcttcttcagctttctttttaatagcagcaacttctgcctgtgctttttctatctcaatccatgccgcttttttcacagagtccacttcctcttgcgctgctttttttgctgctgctgtttccgcctgcgcagcttcctctatcctcgtaactgtatctgcagcttcctttttcgcagacgttattttctgttctgcatccttctgggcaacctctattttctgttttgcatccttctgggcagcatttaccttctgttctgcatctttctgggcagcctctattttctgcgccgcatccttattaacagcctctagtttctgttcggattctttctggacagattctaatttctgctttgcttcaacatcagcatcctctcttgctttcttttcctgcgcaagcaggttttcataagatactctttcttcgtccatctgcctgtgcaaaatatcctgctgttcttccatctgtttttgcaaagcatcctgctgttcttcaagctgttgtcttgtctgctccaaaaaatctatctgctggttcaaagattccatctgccattgaagagctgaaatagaactttcaagttcttcggttctggccatttcttcttttaacttttcttctgcatccaactgagcctgagtaacttcatctacaaagactctgcgaatctcaacatccgggatattacggtcttctacaatctcttcctggatctcttttatgaactttggtcttaccggttccagtttctttgtctcaatttcactcatccgctgaaaaggattataaatctgcaaatacgattacctttgatgctatagaacaaggaacggcactctttgggaaagcaacctttgcaatggatcgtgggtacgacgataacaagatgttcctaaaacttgacaaattaggacaagaatacgttatccgtcttacatccaaaagaaagcttctttatcacaacaagtggactcctgccactgaacttcgtgaccgtagaaaaggcaaaatcaaaactagcgtattctataaaggaaaagaccatgaagcttatctttcccacgtgaaagtccaaatcacggcatccagaaaaaatatatatctggtcctggtttacggcattactgagcatccaatgatgcttgctaccaataaagaaataaagtctaaagaagatgtaatcaaggtggcaaggacctatttttccagatggaaaattgaagaatacttccgttgtaaaaagcagatgttccaattcgaaaacttccgtgtgaggaaactttgtgcaatcaatgcacttaacttttatatcaccttatgcatggcatttttgacaatgatttcaatggaatcagaatcaaatgcattaaaggttgcaatcataaaaacagcagatcctgtaaaggaaaaagttttcttctgctattaccgactggctaaaggcatctccggcatactttcatatgcaaaagaaggcgtcagactctagttccggacgaaacgtccggcttaccgtcaactctgccttaagctggttgcttaaatagataaaagaatagttctcccaaagtccggttcaggcggggcttatttcagtgcctctaatcccaaacctgtcactctatcttattcaaaaatttgacagattggcactttggggaaatttaactattttagaattacattttgcggaaactcaagttgtaaaatatttagcatactgtatttttctattcagataccatcttaatttgcactatctatgctaaccgaaacaacaaagtgcttgacattcacaagtttttgcttcttgattacttaacggcggaaaaagaatgttttcacatagggctgttgtttacatgtcatttttttgtttttttaattctatacccaccagtacaacagatagcacaaacgctgaaaaatcagcaacaggtcccgcaagcaatactcccataattccgaaacgaagcgggagcagcagggtaaacggaatcaacaaaaaggtctgccttgttaatgccaacaaagcacctcttaacgattttcctattgcggtaaaaaagctggaagaaagcaactgcacaccatttaccaacaccatgaaaagataggtacgcatgaacaaaacagcaaattcaaaatacagctcgtccccgtctccgaatagtgaaatgatagattgcgggaaaaattgaaatgcgataaaagcaatagtggaaacaacaagattccactttactgcaagcatgtaagcctcccgtacccgatgatattgccttgctccatagttgaaaccgataatcggctgtgttccctgcgagattcctacaacaatcgcaaggattatggcatttgttttcataactattccgcaagcagctaagggaatatctgttccatattttgttaatgcgccgtaataagtcaacgaattgtactgaatgatttgaatcacggtaactgcaatctggtttgagctgctgctgattcccatgttgcaaattttcatgctttctttgatgtccaataaaaacgactctttttcaaaatggattgtttggaaacgccatagataacggagtgcgagtatgaaggaaaaaatttgcccaataactgttgcccaagctgcgccggcaattccccaatcgcaaacaaaaataaaaatggggtcaagaatggtattgataatagctcccacaaccatgcagaccattgaatactttggttttccatctgctcgaatcaaattgctcataccattcgttacaatgagaaacggcattccaatcaatgttatgctggcatactgctttgcatatggaaatacatctgtcgttgccccaaatgcctttaggagcaaagacagaaaagtttctccaaccagcaaataaataattccgaaaattcccatcagaacaataccatttcccgctgctttggcggcagctttcggctctttgcgtccaagacagagggaaacatgggaagcactgccaattccgaccagtagtgcaatggcaaggcagatggtagaaaatgggtaggcaacattggttgctgcatttcccaaataaccgaccccttgaccaataaaaatctgatccacaatattgtagattgagccgacaagagacgccacaatactgggaatggcaaaatctttcaacagctttgaaattttttcatagcccagaggattttcagtcattgaactcctccccctttctctctatatggagttccgatgtgatatttctgcccgcctgtattaagaaatccataaaaaggttctgctcggattcgctcataccctgcaataaaagagcttctgtcttttcgcatatcatctgtatctcgtcaataatagacaatgctctttctgtaggatacaatttacatgtccgcttatccttatcattgggagaacgtgtaatcattccctgcttttccaatgtcgcaaccgtccgtacaatattgcttggatgaacatagaacatattcaacaaagaatcttgtagaataccgggcgaacgacagattttgattaagaacatatattgactgttgttgattccatagggggcaagttgcttgtccaaatagattttgtaaaatcggtctgttacggaaagccattttaatagttgcatagatatatacctccaatcagagcgtattatacatcaatatgcgtgcgcacgcaactacttttaacattatatctgccgctttgtcctcctaaacacaaatcaattctacatctataatctctactgctctgctacgaatattattcatttatctgctcacatctggcattaagtcgctcctgtgcttctgacaatgcctttttagcattattgacaagcgtatcttcctgcatttctttgatctggttctgcatgttagtaagttcttccgtcatggaatcaatctttttctccagtccatccacatagctgcatatctcaaatacatcgtttgcctgctctttcatggcatggtgctagaatacctaatctaagcacacagattcactctcagactgattgcggacatctgtgatactgacttggattttcggttttgatataacagcgctgccttaatctaccgctaaattggtataaaaataaggactaaattaggcataaccccttgattttactgggtttcatctaacttggtcctattataactcaaacacctgtttcccattttgaaacagcagctttagagacacccatatatgaggccaattcgtcctgtgtaattcctcgcttgtggcggttttcaatcaaaatatggccgagattgatttctttcatgctctttacctcctaacagtagtataaaaaaatggggcattaaaatcaatagagctacttttaacttcttgagaagaagtaaaccaataggaaacctcctactcatgtaaaaaccctttcgctgcataaattttcctataagtggcttattaaactggttgtggttaatttttcccgttcctaattggttattttaatttgactctaggtgtctgattctgcccgcccctgacactacctatttatcagtatccgcagtgctggattttcgtccacaattctcattgcttttgcctggagttcacgatattctgagtgattcttttaaaggaacgctatcgactgaacctgagtctatcttctcgtttacgtgcaacaaatcaaaacttgtatgaagtctttcagattcgtcccgttaagcaaacacttctgtttggaataaagaagcgaggatggtgctatattgttgaggacacatgttaggcaggagcgttccgaatacaccttgttcagtatgttagtaagagccagacaggcaccactcacggtaactgttctggctcttacgttacatactttcaaggggatgaggtagagcgggccggtgtccgatgcaatatagcatcatccttgcggccttattcaccaccaaatcctttgcttcaatatggagaatcagacagacaaatacaaatttatttcgacttcacttctctccacaattcgttatacagcgcctcattttcatctccgaggaaattaaatgtctcacagtttttcaactgatcaatatcagggaatgcaatcgtgctgtttctcatgtagtcatcctcgatcaatgcctgcccggcagagttagggatggagtaagtgatgtattcaaaattcatttttgcaatatccggtctacagaggaagttgatgaattcttctgcatgttccttattctctgcattttttggaataacccaggaatcaatccaaagattagaaccttccttaggaatcacgtaatcgagatttggattctcctgctggcagtagagtgcttcgccggaataaattactccgagagctgcttcatttccaatcattttatcacgtacctggtcgataacatatgcctgcacaagaggtttctgttcaatcagcagatttttggcagcctgaagttcatctaagtctgttgaatttaatgaatagcccaggtattttaaagcgacaccaaaggcatctcttacactgtcctgcataaggatgctatctttatatttttcatcccacagaacaccccagctgtcaattggttcatctaccattttcttgttataaaggattccgacagtcccccaaagataagggacagaatatttattatcaggatcaaatcctttggcaagatccatatatttctgatcgatatatttcaaatttgggatgttgtcataattaatctcttccaaaagattattctcaatcattctctgaatcatataatcagatggacatacgacatcgtatgcaatcgctcccgactgaatttttggatacatgatctcgtttgtctcaaattcttcatatactacatcaataccggtttcttcttcaaacatatcaataacatcaggatcaatataatcaccccagttataaacaattacctggccttgtgaggagataacatcgttctttccataaataaaaccaccgatgataataagcacagccatagcaacaggtaccagacgttggaagaaaaatcttccaaatttttgtgcttttccgaaacgctttatttttactacttttttcttttcggcaggtgacatattgatcaggatcaaaagtaacagcactgtaacaaacataatggttgaaagtgcatacatttcaggcttgattcctttacggacttcactgtaaatcttggttgagagtgtatcaataccaggaccttttgtgaaatgcgtgatcacaaagtcatccagagacattgtaaaggaaagcaggaaaccggagaaaattccaggcataatatctggaagtactactttgaagaatgcgtaggccggagaagctccaaggtccagtgcagcttcataagttctacggttcgtctgttttaattttggcattacacttaagatgacataaggtatgttgaatgtaatatgtgccaaaaggattgttttgaatccaagtgtgaagcggaatgcaatgaagagaagcatcagggatactcctgttacgatatcggcattcagcatagggatgtttgtaactcccataaaaagggtacgcattcttgaattcattgcctgcatgccaagtgcggcacaagtaccgatcaatgttgcaatcagtgcagagagcaatgcaatgatcagtgttgtgtacaatgcattcataatctctttgttttggaaaagagacacataccattttccggtgaatccgccccatttggaacgtgttttagtattgttaaaggagaggaccatcaaagtcacgatcggtgcatacagaataatgcagatcagtgccagatagatcttttttgctatagttttcattaaaatgctgtcccctccccgtttttatcatatttggcgatcacagccatacttgcgatgatgaagatcatcagcaccagggataaaccggaaccggtatgccagttgctcccctgtttgaattcctgctcgatcacgtttccaatcagaagaatcttgcttccaccgagaaggtcggaaataacaaaggtcgtcagcgcaggtacgaagaccatagtgataccactgataattccaggaatgctcaaaggaaagatgatctgtgtaaatgtctgaaattcattggctccaagatctcttgctgcgtaaatgacatctttatcaatctttgccaatacattataaataggaagcaccataaaaggcaggaagttatataccatacctaatacaatagcccccggtgtattgatgatagactgctgtggcagacggaagaatgcaagaatgctgttgatcacaccatttttttcaagcagtgtctgccaggcgagtgtacgcagaagaaagttcatccacataggaagaataaaaatcagtacgataagacttgtctggttcatgtttttttcagataaaatcattgcaagaggatatgcaagaaccaggcagatcagtgtgctgatcagggaaagcagcagtgcaagtccgagtgctttcagattctcaggcgaagccatcattgcaatgttagaccaggtaaaagtcccttctttatctgtcagaccataataaaagatcatgagcagtgggataataataaatgacacggaccagaaaagataaggcccggcaagtaattttctattcttcaacagcaggtgcctcctcatcttcagattctggttttttcataatctggatgtcaaaaggatccactttgattccgacttcagttcctacagggaacatatctgtgctatgtacgagaagttcatagttgttggcaagaacttccatctcgtagtgaacgcccttaaagatcaaatttgttacaattccgtcaataacaccttctccaggcttgacaagatcaatatcttccggacggattacagcatcgaccggacggttatgaccaaatcctacgtctacacatttccagacagcaccgagcatacggacaactttgtcttcgagcatggttgcagcaataatattactgtctccgataaaatcagctacgaatgcattttgcggttcgttataaatatcttccggggtgccgatctgctggatgtatccctgattcataacgacaatcgtatcagacattgtaagagcttcttcctgatcgtgtgttacatagacaaatgtaattccaagttcattttttaatcggatcagctcatattgcatatcctggcgaagttttaaatccaatgcaccaagtggttcatcaagaagaagaacctttggttcatttacaatcgcacgtgcgattgcgattcgttgctgctgaccaccacttaaggagtcaggagaacgatccccgtatccttccagattgacaagttttaaggcataatgaattttatcgcggatatagcctttagatttacctttgatcctcaatccgaaagcaatattttctgcaatggacatatgagagaagagtgcatatttctggaatacggtattcagctgacgacggtttggcggaagactattgatattttttccatcaaaaataatattaccggagtccggtgtctcaaatccaccgagaatacgtaatagtgttgtttttccacatccactaggaccaaggagtgtgagaaattcgttctcacggatataaagatttaatttatccagaattacattttcgtcataggatttggtaatatctatgatatcgatcagtttattagacatttttatcctccgtatataattgttttatctgattcatccggctaactgcattacgcaagagcagatcagcgagagtgagtgcggtcattgcttccacaacaacaactgcgcgcggtacgatgattggatcatgacgtccgtgaatagacagttcgatttcttcgcctgaattagttacagtgtgctgcatctgagagatcgaaggtgttggcttgatcgcagctcttaagattaattgagaaccatcactcatgccacccaaagttccgccggaatgattcgaagttttcataacctctccttgttgcatgcagaaaggatcattgtttgtgcttccggtagaagaggcactctgaaagccatcgccgatttcgacaccttttacggctccgatagacatgattgcctgtgcaagtaaagcgtccagtttatcgaagaccggttcaccgagaccggctggaagatggtcaacacggcattcaatcagaccgccgcaggaatccatctgctccataagagtagaaacatattcagcagcctttttggcagcatctttattcggcagataaaaactgttatttgtaatctcagtaaaatcataatcagcttcatctacagtgacaggaccgatggattttgcataagttgtcagcacaatccctaattcgccaagtaattttgaagcaattgcaccggcagcaacacggccgatcgtctcacggccggaagaacgtccaccgccacggtaatcacggaaaccatatttctgatcaaagcagtaatctgcgtgtcccggacgataagatgtcgcaatattcccataatctctggaacgctgatcttgattccgcacgagaagagaaataggagttccggttgtagttccttcaaagactccggacagaatctcgacagagtcagattcattccgcttcgttgtatatttactctgtcccggtttgcggcgatctaaaaattgttgaatatcctgttcagataaagggatgccggcagggcatccatctataactacaccaactccgggaccgtgggactcgccccaggtagtgactcgaaataaagtgccaaatgttgaaccgctcataatatatctaaaactcctttcgtttgtatcaataaggtatacaaaaagtgcgtataaaatgctcttttgtatatcatatatcattcttttccgtatcatacccccagatacgaaacatattgttgtgtttcataactgagggtacagtgcaattatataggaagaaagaggtgtacgcaagttaaaatgttatagaattcaacagaatttcaaaaataaattacaaaagtatttctaaaagatttcgttcgaattaacaattcaacatcggtttaatttgtgcgtatttcatgaaagtttggggtgtacattttggaaaaagcgtaatataatgaagtctgaatcaaaaagaagtattaatccaaaagacgagggtgagaattagaatgtctgaaaagaaagtagttagaagacgcaaagtaagaagaaagaaaaagcagaagacaattgacaagaagatttggatgattatcggtggtattattgctggtcttgttattgtctatcttgcaatatcagtcttttttatgagtcatttctatattaatacgcagattaacggaaagaacttttctggtaagaatgcggcggcggtagagaattatattaaaaatcaggtggcagattataaactgacaattgtagaacagaataatatgacagatgcaatcgaaggatcggatatttcacttgtatataaggaaaattcagatatagaggatgcgctgaagaagcagaatgcatttttgtggccacaggcatttttctcaaaaagttcagctgaagtcacaattgaggtcggatatgatgaagcggcgttggagtcaaagattgaatccgtacaggctctgaatcaggagcagacagatccacagtctgcttatccaaagtatgatgggaacagttttgttgttgaacctgaagtttatggtacgaaagtagatgtggatacatttaaggcaaaagtgaaggatgcgatcacaaactttaagagtgaattaaatatgatggatgagaagtgctatgctatgccaaagtacacttcagagtctccggaagttcagaaagcctgtgatgcgatgaataattatctgaaagccagcatcacttataagatgacaaaccagaatgtggttgtaaacaaggatctgatttcaggctgggtaacatatgacgataatatgaatgcaacgcttgatgagtcaaaggtgaaagagtggcttcgcgaatttggaaagacttatgatacggttggaacgacaagaagtattacaactccgggaggaaaaatagtagacgtttcaggaggtacttacggctggtcagttgacgaggcagcagaactgactgcgcttgttgacagcattaagaaaggtgaggttgtcgagaaagaacctgcttatgcacagacggcagctacacatgacgcgcaggattggggaacgacttatctggaagtagatatcccggctcagcacatgtggtatgtggttaacggagctgtacaattagagacagacgttgttacaggacttcctacaccggagcgagagacaccgacaggagtttattcgatccttgagatgaagagggataaagttcttacaggaacaatagatccttcaacaggaaagccaatttatcagacgccggtagcatactggatgcgtgtgacctggacaggagtcggattccacgatgcgacatggaatccaagttttggcggaagccgttatcagacgaatggttctcatggatgtatcaatatgccattagaccaggcggcaagtctttacggaatgcttagtatgggaacacctgttataatacataattaaaggaaatgcaaagataaatatagcctgccataactattggcaggctttgatagtctgaaaatcaaaaagaaaagaagaggaaaaaagcttatgtatgaacttttaaagaaggacgggcgtgcgaaaagaggacgctttacaacagttcacggagtaattgaaactccggtttttatgaatgttggaacagcagcagcaatcaaaggagcagtatctacagatgatctgagagggattaagacgcaggtggagttgtctaatacatatcatcttcatgttcgtccgggagatgaagttgtgaagaaactcggaggacttcataaatttatgaactgggataaaccgattctgacagattccggcggatttcaggtattttctcttgcaaagttgagaaagatcaaggaagaaggagttcattttaattcacatattgatggtcataagatatttatgggaccggaacagagcatgcagattcagtctaatcttgcatccacgattgcgatggcatttgatgagtgcccgtccagtgtggcagacagaaagtatatgacgaattctgtagagcgtacgacacgctggctgaagcgctgtaaggaggagatggcaagactgaattctctgccagatacgatcaatccacatcagatgctgtttggaattaatcagggtggaatttatgaggatatccgaattgcacatgcacagcagatcgcagaactgaatctggatggttatgcagtgggtggacttgcagtaggagagagccacgaagagatgtaccgtattcttgatgcagtggttccgcatcttccggaaaacaagccgacttatctgatgggtgttggtacaccggctaatattctggaggcagtagatcgaggagtggatttctttgactgtgtatatccgtcaagaaacggacgccatgggcatgtatatacaaatcatggaaagatgaatctgtttaatgccaaatatgaactggatgaccgtccgatcgaggaaggatgtaactgtccggcatgtagaagctacagcagagcgtacatcagacatcttttgaaagcaaaagagatgctcggaatgcgtctgtgtgtacttcataatctgtatttctataatacaatgatggaagaaatccgtgatgcgattgatgcaggggaattccaggcatacaagaagagaaaattggaaggcatggaacagaaatagtgtttctgatttaattttatagaaaatgtataaaaataaacttaaatatacatggaatattagaaaaacacttgaattagaagctgtttttgtgtatagtagatttattgtctattagtacttaaaaagtactggacagataggtttaagaaatagtcaggaggaaatttcaatgggaacagtaggtattattgttgtttatgctgttatcctcggtggtatgtggtttcttctgatgcgtcctcagaaaaaggagcagaagagaatccaggcaatgctcgctgatatggagattggagatacagcgcttactacaagtggattttatggtgttatcatcgatattactgatgatgacgtgattgttgagttcggtaataataagaattgccgtattcctatgcagaaggctgcgatcgctcagattgagaagccaggtgctgaataagaggaaaaatgagaccggaaggagtgtgactctttctggtcttttactttatataaaaacgtgcccgaaaagtacaattatcgataaaatacagagcgccctctattttttcactcgaaatacttgaaacagtgaaaaaaatgcggtatgataaaaaaagatttttacattttggaaggatgagttagatatggaaatgaaaattggagtaatcaaaggagatgggatcggtcctgagatcgtagatgaggcaatgaaggtgctggaccagacagcgaaagtttatggtcattctatttcctacacgcagcttctgatgggaggagcatcaattgatgtgaatggggtgccgcttacagaagagactcttcagctggcaaaggacagtgatgcagttcttatgggttccattggtggtgatgcgaagacttctccatggtatcagctcgaaccatcaaaacgtccggaagcaggtttgttacagcttagaaagggacttaatctttttgcaaacttaaggccggcagttctctacgatgaactgaaaggtgcgtgtccactgaagaaagagatcgcggacagaggatttgatctaatgatcatgcgtgaattgacaggtggtctttatttcggaaaacgaagcacagaagagattgatggtgtccttaccgcaaaagacgaacttacttataatgaaaatgaaatccgcagaattgcaaaacgtggctttgatattgcaatgaagagaaacaagaaggtcacaagtgttgacaaagcgaatgtacttgactcttccagactttggagaaaagttgttgaggaagtagcgaaggactatccggaagttacattagaacatatgcttgttgacaactgtgcaatgcagcttgtgaaggatccggcacagtttgacgttgtcctgacagagaacatgtttggagatattttatccgatgaagcaagtatggtgacaggttctatcggaatgcttgcaagtgcaagtctgaacgatacaaaattcggtctgtatgaaccaagtggcggttcagcaccggatatcgccggaaagggaatcgcaaacccgatcgcaacaattctttcagcagcaatgatgctgagattttcatttgatcttgataaagaggcagatgcgattgaaaatgctgttgcagcagtattaaaagacggataccgtacaatcgacattatgtctgaaggaaaagaacagatcggaacagcccagatgggagataagatctgcggatatattaagtaattagcagttgttacagaaagagaggattttaaaatgagaagtgatacagttaaaaaaggaattcagcaagcaccacatcgttctctgtttaatgcactgggacttacagaagaggaattagatcgtccactgatcggtgttgtaagttcttataatgagattgtaccggggcacatgaatctggataagatcacagaagcagttaaacttggcgtggcaatggccggaggaacaccaatcatggttcctgcaattgctgtctgtgatggtattgctatgggacatatcggtatgaaatattctctcgtaacaagagatctgatcgcagattctacagaagctcttgctatggcacatcagtttgacggacttgtaatgattccaaactgtgacaagaatgtaccgggacttctgatggcagctgcccgtgtgaatgtaccgacagtatttgtaagcggcggaccgatgcttgcaggacatgtaaagggaagtaaaacaagtctttccagtatgtttgaggcagtaggttcttatgcagccggaaagatgaatgacgaagacatttgtgaatttgagaataaagcatgtccgacttgcggatcctgttccggtatgtatacggcaaacagtatgaactgtctgacagaggctcttggtatggggctgaaaggaaatggaacaatcccagctgtttattctgcaagaatccagcttgcaaagcatgcaggtatgcaggtgatggagcttgtaagaaagaatatccgcccgagagatattatgacagaagatgcaatcctcaatgcacttacagttgatatggcacttggatgctctacaaacagcatgcttcaccttccggcaatcgcacatgagattggtatggatttcgagattgattttgcaaatgcgatcagcgagaagactccaaacctttgtcatcttgcaccggcaggtcatacttatattgaagatctgaacgaagcaggcggggtttatgcagttatgaatgagctgaataagaagggacttcttcacacagactgcatgactgtaacaggaaagacagtaggagagaatattgccggatgtgagaataagaatccggaagttatccgtccaattgacaacccatatactcagacaggcggacttgctgtattgaaaggaaatcttgcaccggacggaagtgttgtaaaacgttctgcagtatgtgatgagatgcttgtacatgaaggaccggcaagaatcttcgaaagtgatgaagaagcgacagaagcaatcaagacaggaaagattaatcctggagatgttattgtaatccgttacgagggaccaaaaggcggccctggaatgagagagatgctcaatcctacatctgcgattgcaggatacggacttggatctacagtagctcttatcacagatggaagattcagcggagcatccagaggtgcttctatcggacacgtatcaccggaggcagcagttggcggaccgatcgcactggtagaagagggagatattatcaagatcaatattccggaactgaaattagagctggatgtatcggatgaagaactggcagcaagaaaagcaaagtggcagccaagagaacctaaggttaagacaggatacctcgcaagatatgcttctatggtaacatcaggtaaccgcggagcaattctcgaagtaccgaaggcaaaataaaataaagaaccaggaggagagtacgtcatgcagttaaatggagcagaaatcgtgatcgaatgtctgaaagaacaaggcgttgacactgtatttggctatccgggtggagcaattttaaatgtatatgatgaactttataaacaccgtgatgagatccgtcacatcctgacttctcatgagcagggggcagcacatgcggctgacggatatgcgagagctacaggaaaagtgggggtctgccttgcaacaagcggaccgggcgcaacaaatcttgtaacaggaatcgcaacagcatatatggattctataccgattgttgcaattacatgtaatgtcggtgtcccattacttggaaaagacagttttcaggagatcgacattgctggagtaacaatgccaattacaaaatacagttatatcgttaaggatgtaacaaagcttgcagaaacaatcagaaaggcttttcgtattgctaagactggaagaccggggcctgtgctgatcgatattccgaaggatgttactgcaaaagttacagagtatgagaaggaatatccaggtgtatataaccgagaggtgatccattcagaagaagaggatctcaagaaagctgttgagatgatcaaagaagcgcagagaccatatattttcgtaggcggtggagctgttctttctgaggcaagtaaagaactttatgaatttgcacagaaggtagatgcaccggtaacagattctctgatggggaaaggagctttcccgggaactgatgagagatataccggaatgctcggaatgcatggaacaaaggcgtcgaactttggagtaagtgaatgcgatcttctgatcgtaacaggagcaagattcagtgaccgtgtaaccggaaatactgcaacatttgcaaaagatgcgaagattcttcagattgacattgatccggcagagatggataagaatgtcatgatcgatcttggggtggtaggtgatattaaagcagtcctgaagaaaataaatgagcatcttccacagcagtctcatccggaatggatgaataagattaaagattacaaggcgaaatatccattaacatatcataaggatgtacttacaggtccatttgcagtagaagaaatttatcgtcagacaaatggagaagcaattatcacaacagaagtcggacagcatcagatgtgggcagcacagtattataaatatacgaaaccaagaacacttttaacatcaggtggtcttggaacaatgggatatggtcttggagcagcaatcggtgcgaagacaggatgtccggataaaattgttgtaaatattgccggagacggatgtttccgtatgaatatgaatgagattgcaacagctgtaagacatgatgttccgattatccaggttgtagttaataaccatgtactcggtatggttcgtcaatggcaggatcttttctatgatgaaagatattctgcgacagttctccgtgatgcagttgactatgtgaagcttgcagaagcgatgggagcagtaggacttcgagctacaacacaggaggagtttaaagagtgctttgcgaaagcattgacatgtggaaaaccggttctgatcgattgtatgatcgactgtgatgataaggtatggcctatggttgcgccgggagcaccgatcagcgaagcatttgatgagcaggatctgaaagcaaaagaaaactaaaaataataagtttcagccacatagttgtatggctgataaataaaggaatattttatttttatgtgagaaaatctgtgaaaacggagtttctatagatacacaataacaggaggtaattaaaaatgagtagagtgtataatttttcagcgggaccggcggttctgccagaagaagtactgaaggaagcggcagcagagatgctggactacaagggaacaggaatgtctgttatggaaatgagtcatcgttccaaagctttcgaggaaattatcacagaagctgagcaggatctcagagatctgatgaatattccggataactataaagtactgtttcttcagggtggagcgtcacagcagtttgctatgatccctatgaatctgatgaagaataaggttgctgattacattgtcacaggacagtgggctaagaaagcagctaaggaagcagaaaaatatggaaaggtaaatgttgttgcatcctcagcggataagacattttcatacattccagactgctccgatcttccgatttcagaagatgcagactacgtatatatctgtgaaaacaacactatttacggaacaaaatttaaaacactgccaaacacaaaaggaaaagatcttgtggcagatgtctcctcctgttttctttccgaacctgtagatgtaacaaaatatgcaatgatttatggtggagttcagaaaaatatcggacctgctggtgtagtgatcgcaatcatccgtgaagatctgatcacagaggatgttctcccgggaacacctacaatgcttacatataagacacatgcagatgcaaaatctctttataatacaccaccggcatacggaatctatatctgtggtaaagtcttcaaatggcttaagaagatgggcggacttgaagtaatgaaagaacgcaacgaaaagaaagcaaaagttctttatgatttccttgatcagagcaaactgttcaaaggaactgttgtcccggaagatcgttctcttatgaatgtaccattcgtgacaggcgatgcagatctggatgcaaaattcgttaaggaagcaaaagaagctggatttgagaatctgaaaggacatagaactgtaggtggaatgcgtgccagcatttacaacgcaatgccatatgagggtgttgttgcacttgtagactttatgaagaaatttgaagaggagaatctgtaagatgtttaaatatcattgcctgaatccaatttctgccgttggcatgaataagttggatgaaaattatgtaaagacagaaaatgcggatgaagctgacgtgattcttgtccgcagtgcaaaaatgcatgagatggaattcggaaagaacctgaaagcaatcgctcgtgcgggagccggagtgaataatattccgcttgataaatgtgcagaggaaggaattgttgtattcaatacacctggagcaaatgcgaatggtgtaaaagaacttgtgattgcaggaatgcttctcgcagccagagatgtcgttggtggaattcagtgggtacaggaattcgaggaagatggagatatcgcaaagattgctgagaagaagaaaaaagcatttgcaggaacagagctttccggaaagaaacttggtgtgatcggacttggagcaatcggagttcttgttgcgaatgtagcaacacatcttggaatggaagtttatggatatgatccatatgtttccgtagattctgcgtggagactttccagaagtatccatcacgcaacaacagtagatgaaatctataaagagtgcgattatatcacaatccatgtacctgcacttgacagtacaaagggaatgattgacaagaatgcaatcagtctgatgaaagagggcgttgtaattctgaacttcgccagagatgttcttgtaaatcaggaagatatcgttgatgcacttgtagcaggtaaagtacaccgttatgtaacagatttcccaacaaaggaaattgtaggtgtaaaaggcgcaattgtaattccgcatcttggagcatctacagaagagtcagaagacaactgtgcacagatggctgttgctgagatccgtgatttccttgagaacggaaatattacacattccgttaattatccggattgcaacgtgggaacaaaagctgacggagacagaattacaattcttcaccgtaatgtgccgaatatgatcggtcagtttacaacacttcttgcgcaggagaatcagaatatcgcacttatgacaaataagagcaagaaagagtatgcatacacagtaattgatgtagacggaagcgtatctgatgatgttgtaaacaaactggaatcaatcgcagatgtacttggtgtacgtgtgatcaaataaaaagtaaatgaagtgtaatttggctaagctgattttgaaagctaatttataacgaaaagaacagggtggtttttctatgtgagagaccacctttttgtatacaataagttgataaatacgatatggtacaaagcatataaaaatgaacagatagtatggagaagtattatgcaaaaatggatacattttaatacaatggtatcggcatgaaatcatcttgacaatatttgtataatcgtatacaatcatacaaaaagagaataggaggaaatcatggaagaatatcaggaccgttctctgggaggacgtgtttttaagagactccgtgaagatatcctcaaaggcagatacaaacaacaggatgaactcagagaggctaccatcgggaaagaactcggggttagcagaactccagtaagggaagcgttaagacagcttgaattagaaggtcttgtgacgattgtaccgaataaaggtgcttatgttaccggaatcagccagaaggatatctgggatatctatcagatgcgtaagtatctggaaggaatgtgcgccagatgggcggcggaacatattacagaagaccagttagaagaattagaagagactattttactttcagaatttcagatgaagaaagaaaatggatacaataaagaacaagtgacaggattagacggaaggtttcatacgatattatatgaggcttccggaagcaggatgctgtgtcatgttcttacagattttcaccgatatgttcaaatggcaagaaagtcctcgatcaatgtgaaggcaagagccgagaagtcaattgaggagcataaagcgattcttcaggcaatcagggacagaaacccggatctggcagaacagcttgcaaaggaacatattgttcatgtcatgcagaatctaaagaaaatagaagaaaaacataatcaggaggaagcaaaagatggaaaaaattaagatgacaacaccactggtagagatggatggagatgagatgacaagaattctctggaagatgatcaaggataatcttcttgagccatatattgatctcaagacagaatattatgatctcggcctggaacacagaaacgagacagatgaccaggtaacagttgattccgcactcgcaacaaagaaatacaaagttgccgtaaaatgtgcaacaatcactccgaatgcagcacgtatggatgagtatgatctgaaagaaatgtggaagagcccgaacggaacaatccgtgcgatccttgatggaacagtgttccgcgctccaatcgttgtaaaaggaattgagccatgtgtaaagaactggaagaaaccaattacaattgcaagacatgcttatggagatgtatataaaggatccgagatgaagattccgggagcgggaaaggttgaacttgtatacacagcagaagatggaagccagacaaaagaactggttcatgagtttgacggaccgggaatcgtacagggaatgcataatatcaataaatccatcgaaagctttgcaagaagctgcttctcctacgctttggatacaaaacaggatctgtggtttgcaacaaaggatacaatttctaagaaatatgatcatacattcaaagatatcttccaggaaatctttgatgcagaatatgctgatcagttcaaagaagcaggaattgagtatttctacacactgatcgatgatgctgttgcccgtgttatgaaatcagaaggtggatatatctgggcatgtaagaactacgatggagatgtaatgagcgacatggtatcttccgcattcggttcacttgctatgatgacatccgtacttgtttctccggacggatattatgaatatgaagctgctcatggaactgtacagcgtcactattataagcacctgaaaggtgaagagacatctacaaactcagttgcaacaatcttcgcatggacaggagctctcagaaaacgcggcgagctggatggaaacaaagatctgatggacttcgcagataaacttgagaaagcaacaatcgacacaatcgaagcaggagagatgacaaaagacctcgctttgatcacaacaatcgagaatccgacagtactcaatagtgaggagtttattaaagcaatagcgaagagactgtaatttatcgagggaatttatacaatgggctaagtttttgacagaatggtcgcaagaatgggtctactattaccatgggcaccggcccgctctacctcatccctttgaaagtatgtaagcgaatgcccttaaccgaaaggacgtcagttctttcggttgttgcagatgcgtaacatacatttcaaaacacgacagctattgcaagcctgcttgtataatatactcatttcatgttaagatagtatcagctttatatatgaaaggattttctcatgcctggttttattttacatttaactgcagcccagatgctgcgaagccatcttcacgagtaccctgattttccttatccgattcaatctgtaaatgattttctgattgggaatcttctaccggacgcgacagaccaaaaagagctttcacatttccggaatcctgtttatcgtgataagatgatggtatttccggatttaacacgttttattgctaaatacagctctcttctttctgattccagtgttttgggatattattttcatttatatatcgaccgtcggtttttcaaggattttattccggaaattgttgatttttatgatgaaaccggacagattacagatataaaagaagagattgcgaccgtttatatcagaaatttccagacttatatcccttttgaaaaatatcttactgaggaatattattatggggactatacaaagatgaatacttatcttgtaaatcgttatcagattccactcgatctgaacgcacagataataaatccagggatcaatgaaatgcaggatggaaatgtacagcaagtcctggattcattgcatggatatctcagtgttaccgtggatgcagtaaatgatcttaaggtatttccacttgataagcttcttgcttcacttgaacaatatacgattgaatttttagctaatcctttatagaaaaaactctattatccctgccatattctaatccggaagagataatagagtttcttatttaaatctatattttttttgcaactgttcagagccaaccttcaaaatgctacgcatttcatacctgtttttttgaaattttgcttggctctgaacagttacaaatttcaaattattttacgcgatctctgtcgtactttcgaactgagaattatacagatctgcatagaaaccgcctcttgcaagaagttcctcatgatttccctgctcaatgatatctccgtccttcataacaaggatcagatcggcatcacgaatggttgacaaacggtgggcaataacaaagcttgttcttcccttcatcagattatccatcgctttctggatcatttcttctgtacgggtatcaactgaacttgtcgcctcatccaaaatcaggatcttcggatctgcaaggattgcccttgcaattgtgaggagctgtttctgtccctgggatacattacttgcttcttcattcagttccatattgtatccacccggaagtgtctggatgaaacgatgcacatgtgccgccttcgctgcctgaatcacttcttcctctgtcgcattcagttttccgtaacggatattgtcactaatcgtaccatggaacagccaggtatcctgcagaaccattccgaacatttcacggagttcacttctattgaagtcccggacatcgtgtccgtcaatcttgatcgaacctccattcacatcatagaaacgcatgagcaatttgatcattgttgtctttccggctcctgtcggaccaacaattgcgatcttctggccttctttcacatccgctgagaagtcattaatgatgatcttatcttcattatatccaaaacgtacatgctcaaattcaacatttccctgaagattctctacagaaaccggattctctactgtctgatcttcttccggtccttccaggaactcgaagacacgctctgatgctgcagctgttgactgaagcatattcgccacctgtgcgatctgctgcaatggctgtgtaaagttacgtacatactgaataaaggactggatatctccaacctcgatcacatccttaattgtcagatatcccccaaggattgccactgccacgtaacccaagtttcctacaaactgcattacaggcatcatcaaaccggaaaagaactgggatttccatgcggaatcatacagcttatcatttgtttcattgaatacttcaattacttcctcttctttattaaatgccttgatgatgttatgaccaccatagatttcttctacctgtccattcacatttccaaggtatgtctgctgccctacaaaatatttctgtgaatgcttcattacgaatccgatcaatccggcagaaagcggaagaatcaaaactgcaatcactgtcatcagtgggctgattgacaacatcatgataaatacaccaatcagagttgtaaccgatgtgatcatctgagtcgcactctggttcaggctctgtccaagtgtgtcaacatcatttgtcacacgggaaagcacttcacctaccggctttgtgtcaaaatagctcatcggcatgcggttgatcttctcggagatttctcttctcaaacggtaggttgtcttctgagacactcccgtcatcaaatatccctgcacaaaactgcagattgcgctgatcacatacaggcaaagaacagtcagcagaatctgtccgattttaccgaaattcattccgtctccaccggaaactttacttacaagtccattgaaaatctccgtcgttgcttttcctaaaatcttcggtccgacaatattgaatattgttccacagatagcaaacacggctacgaaaaatacctgtactttgtaaattgccatgtagcggatcagtttcttcattgttcttttgaagtcttttgctttttcattcggtcttcgaccgccatgcattctagccatgaatctgatcctcctttccatctgtctgctcatttaacgctgcttctaactctttcctggacagctgggattctgcgatttcacggtataccggacagttcttgagaagctccgcatgagttcccttacctgccactttgccttcgtccaatactatgatttgctctgcatgcaggatcgtgctgattctctgtgcaacgatcagcaccgtacttccgcttgtcttttcagccagcgcacggcggagtgttacatccgtcttatagtcaagggcagaaaaactgtcgtcaaaaataaatacctgcgggtgctttgcgattgctcttgcaatagaaagtctctgcttctgtccaccggatacattcgaacctccctgtgagatcgggctcttatatttctccggttttgtgtcaataaattctgttgtctgtgcaatctctgccgcctcgatcatctcatcatcgcttccatgtgaattaccaaacatgatattagatgcgatatctcccgagaacaaaactcccttctgcggaacatatccaagcttctcacgaagttcatgctgtttcacttcacggatatctacaccatccagcgtaatatctccggatgtcacatcatagaaacgtggaatcagatttaccagcgtagacttaccacttccggtacttccgataatcgctgttgtctcccccggcttcgctgtaaatgtaatatcttccagaacatcttcatctgcacctggataacggaaagatacatgatcgaaagtaagtactccttttccgtcttctgggaaatgtttttcttgctttggatcgtggatcattgtctcactcttcaatacttcctcaacacggtctgctgccacagctgctcttggaagcataattgaaatcatacaaagcattaagaatcccataatgatctgcatcgtatattggataaatgccatcatatctccaacctgcatctgtccatcactgattccatgtgctcctgtccatacgatcagaacagatacaccgttcatgactaacatcatcactggcatcataaatgtcatcgcacggttgacgaaaaggttcgtctttgtcagtgtgcggtttgcatcatcaaatctctcttcctcatgcttctctgtgctgaaggcacggataaccggaagtcctgtcagaatctctcttgttacaaggttcaacttgtcaacaagattctgcagcactttgaactttggcataacaacaaggaacaacaacaaaactacaaatgcaatgataataaccgcaagtccgatgatccaggacatggatacattcgtcttcataacctgcagcactccaccgattgcaaggattggcgcatacagaaccatacgaagcagcataacgatcaacatctgaatctgctggatatcattcgtacttctcgtgatcaaagatgctgttgagaagtgattgaactcgttgtttgaaaatccaacaaccttatggaatactccacttctcagatcacgtcctgcacttgctccaactcttgatgccagaaatgcaaccataatacttgctagcattccaagaagagcaagtgcagccatctgacctcctgtttttaacagataatgaatctgtgtctgatccatgtccattccaaggtctttatatgcactcctgcagaagctcactgatgtctgatcaagaattgtatccggcatctctgacatctgctcttcaatcttctcaaccattgttgctctctgctcagccggaagcattttcagaagatcaaacatagacatgtcatccagtgacactgcctgggattccgcctgagattcaccttgtggcattccttccggcattgtccggtctgccccttgtggcatgctctgcgccattccctgggacatctgctctttcagcttgtcttccatctgttttgttgtatcacttccggactcgattccggatgtcatcatcattggaatctgaagaatatctttcagattctccatcgtattttcctcttcagcaacagaatctttcaagacataagcttctttttcataagaagtattatcttctgtatatgcatccatcaccgtctgttgatcgtcttccgatacaaacaaaagcaatttttccatttcttctgttgcaatctgtctcggtacttcatcttcaataccgccctgctggattcctacatttacaatatctgatgtgtaggccggcaaggacagatcacaatacgcctgcacaaccagaatcagcacgatcgcaatcatagctttccagtacgatgcagcgtatttgaataagttcttcataatctgcgtatttcctttcctggtaattctcttcaagttacacaatctattataaatcactgattttcagtgacagtaatctacttcattcactactccagattctctaagatttgcaagagcagccgacgaaaaagcatcttctcttccgcagtcattccttcaaatacgatttcttccagtttctcagctgtcttgatcacataatctatgcaatctttccctttctgtgcaagggtaaggcgcatcactctttgatcctgctcatcagcttttcttgtaatgtaaccttcctgttccatcttcttgatcatcgatgtaattgacggcggcgttacattcaggcgctttgcaagttctttctgagacatggaatcttcctgatgaagggcaaataagatccctgactgggctctgttcaaatcgtattctgcatacaattcctgtgctctctttccgatcaggcgcatactctgtcccatcaatccaagtaatggggcatcctctttatgacacttcacgttcttttccctccttgattattgatacattctacaaaaaaattctgactatcactttttccacagaatgaatagtgaaaattagttagttaattaactaaatgaaaatatagtacttttcacaaagtaagtcaatattatttctattttttcacactttcttaatactttttgcacacaaacaagttagatagttaattaaattcaatatataaaaatgatgaaaccaaatggctgacaccatctgatttcatcactccatcttaaaaagtgaacaataactaaaactctttctttttcatgactctcatactgtaaatataagaaatgaaccatacaagcagactcagcacgataagtgcaatcgcaatttcaaaatcgcctatcccttctatcatatacaaaatactttcttttaatcccaggttatccatcacaaaagagccaattgcataacaaattgcaaaaacaattaaaattgcaattggtagcactaatcgtcctttctctccttcaaaccttaaccgaattgcaatcgtaattcccgcaattgcctgaaatacaaagattgtgatcaattccattgccagcgtttccggatcaaacacttcttctggctttatgagtacagtgattcctgcacagattactccaatacaccatccacacgctgtcataataaaggaaaaaatatatttttctctaacatatacttttctatttacaggtaaagaaaataaatacatatatccatgattgttttcatcataactaattgtattccccgcatatactgctataacagatgggatatagattgcaataaaagtagctgtctccttttccgtcagcgtaaaaaataacgccacaaacgctaacacaaaaaaaagattgccaccttgccgaaaaaacaaccgaaaatccttttccaaaagtcctctgattcctttcatcacatcccgcctcctgtcaacatcagaatcacctgatcgagtgatccgctttccactacaatttccggataattctctgtataatactgcttctcatttgtcagacaggcaattccgaaattttcttttctctctttcaggatatagtttttatctaaagcctgatactgttcctcgctgactttcaacatggcatacttttcaagaattctatccatctcttcatgaagtacgatctttcctttatgaatcacataaatatcatcacacagatgctctaagtctgaagatatatgtgaactgatcagaatacttctctccggttcttcttccatatatgttctcaaaatatccagcatctcttctcttgctccgacatcaagaccggctgtcggctcatccagcatcaggaaatctgcctgatgcgtcaatgcaatgatcagattcagctttgctttcattccagttgaatactcttttaagaatttatccagtggaatctgatatctttcacacatctgaagaaatttttcttcttcaaactttggatacaatttagcaagaactgcctcaacatcttttccttttaaatatccgctgaaccctgcttctgccaggactactcccatctgttctttctctttctcgtttaactcttgcggtttttttccaagaatctttatctcgccaccatcataggaaatgagtcctaacactgccttgaacacggtactcttaccggctccgttctctccgaccagacctgtgatccttcctttttctacatttagcgaacagtctaactgaaattcgccgtagcttttctttacccctttgatatctaacataattattcgtcctccatgatgagttcaaacaaggagcggatctcttcctctttcattccgcagcgtcttcccttctgaatcgccgcttccagatccgcctcaacttcttttctgcgctcttcttccatcaactgtgtattcgaagctgcaacataagttccttttccatgaaccgtgaccgtcatgccctccgcttccagattgtcatatgccttctttacggtaagtgcactgatcttcagttcctttgccatcgttcttactgacggcagtatatcattttcttttaattctccggagatgatctgcgctttgatctgctccatgatctgttcatagattggtaccatcgatgaattattgattataatcttcataagcaacctcctgttgtaaacagtatataacagtatatcactgttgtcaactgttatatactgtttgtttttttattttttagagcaaaggtttattatattactccgttatccattatttttcagcgtgttgtaaaccaaaacacatcttaaaatataaaaaagaagtttctaacgtaaaattttcatcttatatcagaaacttctttcttcatttgctctatttcattataaccttgcaatgtttcttattactaaaaaatcgccacagcctcattcacactcttcacacccagcagcttgattcccttaacatccttcaccgtcttcatgcacacttctggaaggatacacgtctcgaatccaagcttcttcgcctcagccacacgctgctccggcatattcaccgcacgtacctcaccactcagaccaacctcaccgaacacgatcgttttttcatcgatcggacgattccggtaacttgacacaagtgccatcacgattccgagatcgattgccggctcattcatcttgattccgcccgcaatatttacataagcatcgcaatttccaagattcataccaagtcgtttttcaagtactgccatcagaagattcaccctgttataatctgttcctgctgcagttcttcttggcataccaaagttcgttcttgcaactagtgcctgaatctccagaagaattgggcgtgttccctccatcgaacaggctacaactgaaccggatgcattctccggttttccactcagcatatattcggatggattctctacttctacaagtccattctgtctcatctcaaagacaccgatctcattcgtagagccaaaacgattcttcacagctctgaggattcggtaagatgcatgacgatctccttcaaaataaagtaccgtatccaccatatgttccagcacacgcggaccagccacggttccttcttttgtcacatggccaacaatgaagattgggatacatagtcccttcgccaactgcataaatacattcgtagactcacggacctgggagacacttcccggtgcggaattcacatcttcactgtacatcgtctggatggaatcaatgatcacaagctccggcttctctttctcgatcacgctgcggataatccccagattcgtctcacacaaaagcaacagattctggctgaattcacccatacggtttgcacgaagcttaatctgagtctgagactcttcacctgaaatatataaaatcttctgctgcttcgccatcctctggcagacttgcaagagcaaagttgattttccaattcccggatctcctcctaccagaacgagtgaccccggcacgatcccaccaccaagaaccctgtctaattctttaattccagtcttattccttgtatcatcatccgcggaaacgtctgtgattggaaccactttcacttcattcaccgctctggctgctacagtcgttcctttcgtgatgccactgtcaatcctctcctcgacaaatgtattccattccttacacattggacactgaccgagccacttcgcttcctcatgcccgcaattctgacagaagtaaactgttttctttccttttgccattcataatttcctttctgttcgaagcaagcataatacagcttgccaggtttatagattagaaaagggaaaggcgcatcttgcaattcctttccctctgttttcacactactcttgtttctatccgaatctgactgattagcatttgacaactttgattgcagcactctgatctgcgttaagttcaacacttacacttaattttccgcttaagtttgttcccatcttacctgcagactctccggcgataaatacttcatattcgctctctggctcaagttccaatgtaaactgtacgtcttccggtgcggaaactgtgaactcaacttctgtttctgtctctttgaagttctctactgtacttcccggaacagactcataaacgaacattccatttttctccagctttgtaatctccgcaaatgtctttaccttataaagatctcctttaaattcaaatccgtccttctttgtcttggatgcaagagtgtaatctccaaagcttaatgttccgtcgttctctgcacgcaataattctttcactgttgccatttttaatttcctcctgggtatatatatgttcctattatatactacttaaaatagtttttctatagattttatttattcttcacatttacaattcgatgtgattttaagattctgtcttcacaaaatgaattccctttttggatgctcctgctgccacatgatccccttcctgaatctctccgttcaggatcgcatctgccagcttatcctccagttctgtctgcaatgcacggcgcagtggtcttgctccgtacttcgcatccgttcctttctccacaatgagagccttcgcagattcacgcagtttcagatgaatattcatctgtgattccagacgtttagtaaactgattgcataacaaagaaacgattttcttcatctcttctttgccgagtgaatggaatacaataatctcatcaattcggttcaggaattccggacggaagatctgtttcacttcgtccatcacattctgcttcatcttcttataatcactcgccggatcttcttttgtcgcaaatcctagcttcttcggttcaacaattgctttcgcacctgcatttgatgtcataataattacagtattagaaaagtcaacctttctcccctgagaatctgtaatatgcccatcgtccagcacctgaagaagtacattgaacacatccggatgtgctttctcaatctcatcaaacagaatcacggaatatggatgtgtacgcacctggtcactgagttgtccaccttcttcatgaccgacatatcccggaggagatccgatcatcttggaaacggaatgtttctccatatattctgacatatcaacacggatcattgcatcttctttcccaaataacgcttctgccagtgcttttgataattctgtcttaccaacaccggttggtcccagaaacaggaaggaaccgatcgggcgcttcggatctttcagtccgactcttcctctcttcacagcccttgcaactgcgccgacagcctcgtcctgtccgatcactctcttctgaaggacatgctccagattcttcagacgctgggcatcactctctgcgagcttactcaccggtacttttgtccaggcagacaccacttctgcaaccgcatctacagttaccggtgggttggccttcgcctgtttcttctcaaagcgtttcttcactgagtctaatttcttctgcactgcatcctgttctttctgaatcagggacgcttctgcaaaatctccccgttcaatgctctcttccttctgcgaagcaagttctttcactgcctgttctaactgcttcagattctctggaacctcatatcccttcagactcacctttgagcatgcttcatctaaaacatcaatcgccttatccggaagattccggtctgtgatgtaacgctctgacagctgtactgctgactccagtgcctgttcttcgatcacaactttatgatgcgcttcgtatttctctttcagtccttttaagatctcaatacactgatcctgtgtcggctcttcaatcgtcaccggttggaatcttcgctcaagtgctgcatctttctcaatgtatttccgatattctgcaatcgtagttgcaccgatcagctgcatctcacctctcgccagtgaaggttttagaatgctggatgcatcaatcgctccttctgcgcctccggcaccgatcatcgtatggatctcatcaaggaacagaatcacattcccacaggcttctacttctgagatcaggcctttcatacgctcttcaaactcaccacggtactttgaaccagcgatcagtcctggaagatccagactgtaaatcttcttatctttcatcttctccggaaccacaccggatgcgattctctgtgctaaaccttcaataattgctgtcttaccaactcccggttctccaaccagacatgggttgttctttgttcttcggcttaaaatctccatcagacggtaaatttcctggtttcttcccacaaccggatccatttttccttctgccgcacgttctgtcagatctgtacagtactgctccatcatcgcaccgcttccgcgattatcctcctgaagttcttcctgatagatcttcggatcgatccctgctgcattcataatgctctggaataatttctgaagattcacattcaatgtgatcagaatctttgctgccacacaatccacatcacgtatcatcgcaagaaggagatgttctgttccgatttccgttgtacggagtcttttacactctttcgcgctgttctctaacagatactggagtctcggactctcttctaatctctttcctttcgctgccggatgttcttctgccggagtgatcagctcatccatcagcttcaggatcttctccgactctactccactgttcgcaagtacctgtcctgccactcctgtatattcttctctcaatgccagaagcaaatgttctgttccgatatacggatgcttcatctctctggcagctctagccgcatacttaagcgcatgctgcgccgactttgtatatgaaatctgcatatatatctcccttatgtctttctacttctctgctaccggttctcgtgcagctcatactcgtcaaatatctcatctaccagcccatgaacctcctgccgtgagatattcttgcaacgccctcgcgcaagtacgatccttaactgctctttcatcgcttcgagctgctgaagtttatctacatcaactgcgatcactgcacctctgcgtttatccagactgatatatccttcctgtttcaacacatgatacgctttgttcacagtatgcatattcactccaaccgtatccgcaagctgcctgacagatgggagtgaatccccttcctgaatatctgacatagcaataccaagaatgatctggttacacaattgaatgtaaatcgcctcatcactgttgaaatcaacttctatcagcatacgcgtagcccctttctctttcgtgtaaaacagatctcctgctgtcttctgtaaaatcgttactgctcacacgatgtgcgaccagcaacgcatctcgccattttaaatcgcctttggcgatgcgaatgcccttaaccgaaaggacgtcagttctttcggttgttgcagatgcgtaatctgcgtttccaaatgctacgaatattgcatgcttacttatttgtcacaaacagcatactcagtaatgcaattccgaccacctcaaccactgctccgattccattgatcatgctcattctcttctttggcaatatttttccaagaaatgcaaagagcactgctcccatcccactgccaagtgtatttccgattaaatctgtaatatcacttacgccaatagagaatatccactgtactgtctcaaatgtcaggctcacaaaaaatgatgctccgatccccagccaccattttcttttaccaagaaatgcagtgaagtaaactcctgccggaacaaatatcagtatattgtatataacctctttcatatgtgttatatacgcaacacttgtttcgtaatgaaatgggattagatttagttgtcttaaatgtgggatttcttctatagcaaatgcaaacttaaacagcacaagccatgtcagtaagaagagatatgctccaaatacaatatatgatatcattttacttctattattttcccatcgtttttctattttcatttttcctccaatatcttccttgaactatcctcttttataaaagaataatagcaggcttttcttaatcaaagcctgctattatccttaagtattcttgaacttcttgtaatccagaagaatgttgctacaaagataataccttttacaatggatgttgatgaaactgcacaccaaattccattaagtccgagtgctgttctgcaaaggagaattgccaatggaattctcgctcctgtaaatataattgaaatcacactgcacagatgtgtctttccaagtccggacaatgccccaaccgtcataagctctacgcacataaatgcttcactgagtcctacgattataaggtaatccactgcgatttcaattgctgttgcttcatggaaaaaaattcttgcgattggttttggaacaaatacaaatattgctgtaattatcaatccccaaataccaactgtccataaagatgctctgtatcctttcttgacacgatccatcttgttggctccatagttctgtccaacaaatgcattcagcgccgcagcgaatccatccgccgtattccatgagagcgattcaatctgaccaccgactctctgtactgcaactgcctcagcaccaaagacggataccatacgtgcaagtaccattgagattacacaataagccattccctgaagtgctgtcggaattccgatcttgcagattccacttacatattccatcggaattcttgcaaacagacgaattccttttaatacattatccttcttctgcacaaagattccgataatcatcacactcattacaattccctgcgctgttacagtcgcaatcgctgcacctgccacacctaattcaggaagtggccccggtccaaggatcagtaccggatccagaatcatattgattaccaggccgatcagattcgcaataaatggagtctttgaatctccctgtgcagtataaatacctgtcaacgtaaatgtcagaaatgaaaatacgatcaaaccacaggcaattcttgtataagaaaatgcagccgcaattgcttctgcatcatccaactgaaagaagccgatcagtcgatgtaaaaaaagcaatacaattgccgcatatactaatcccatcaatgtagctaactgtactgcggtctgcgcatatttattcgcctcgtctctgtttccttttccaatatgctgcgccacttgaacctgtccacccattcgagccatagatgccaacccctgtgacagccaggtatacattcctccgacaccaactccggcaactgccttcgaaccaagcagaccgatccatgccatatccgtaagattatacaatgttcctaaaaatgacgatgccataatcggtatcgccaactttgtcaaagtctttagaataggaccctttgttaaatttccttccatatcttccccacataccataatttctactacaacttgttctactgtgcattcaatagcatctctatagacagactactatataatggtattttttgcaatcctttcttgtgatggcaagatgcgttgctagtctcacatcgtgtgaacagtaacaaaacggagaaatcctggtcggggatttctccgtttttcctatattatagagatgatacgatttactcgattgcttctgtctcgattacgaatttcacgcttccttccattccgctgtcttttccactgaatgttgtataagtacaatcatccgatgtaagtgcatcgaaacggtcaagtacatcaccgagttcgtcttctactgtgctctttaatttgcttgttccttcacggtcgaacttctccataccgtctgcgagttctcttgctcctgactgaagagttgctgcaccttcacgaagggctgcgctgttcagtgaaagttttgccgctccggatgacatctggcttcccagtgtattcagtccgcttgccagctggtttgttccgctctgaagtgtctgaactcctgctaccagtgttgaactgttagctttcagtttgttggctcctgctaaaagtgcatcattatttgcactcagctgtgagaatccgccgttcagttcaagaattcctgtaactgctgccgggaactgtgcctgtacagactcatttaatgttccgagattagatgagaaggatccgattgctgcattcaatccctgcattcctgcattcaactggtctactgatgcggacagctgtccaagtgcctctgtcggaagctgtgacttcatagctgtaatagactctaacttctctttcatttccggtaattgagcgttcagatcatttgcagtctttttaaatgtttccatggatgctgcaatctctcccatttccttctgaattggagttgtgtcaattgacggaagtgacactgacacttcacttgccttctccagtccaagcagtccatccgctgcatttgatgccgcattcagcttatcaattgctgcctgaagatctgcctttgctgtctcatctgttgtctgatctttctttgtctgtaattcactgattgctgaattgatagttgctttgctgcatgttgctgcactctgcgctgcatctactttattattgtaatctgcaatcttcgcattcagatcatctactgcactctgacaagttgtgtccaaagtagcaagctgctgattaattgctccaagctgctgactcagactctgtaaattacccgctatattctgaaccggtactgcaattccatcattcaatgctgtttcaagctgctctgtctgctcgatcatttcatttccggttgtaagcatgttttcaacctgacccaaaagtgcctgcacttcctggcttccaagggatgccttaagctgtgctgtacctgctgccaattgtcttgacgctgactgaatatcttctgtcgcactgccttctccatcaattgctgcattcagctgactgatcgctccctgtactgttttcagtccgctgctgagctggctcagtttcgcggcacctgctgccagctgctgttcaccgccaatataagctgtaactccgtcagccagtgcatttgttccgtctgtataatcctgcactcctttgactactttattgacaccattcacatactctgtcacgcttccgttcagttctccattgcttccaaggtacttctgaattgcatcattcaaagtatccgcaccttctgtatagctgttgacaccgtctgcaagtgttccggctccgtctgcaagtgtgtcagatccacttactaactgaagtgctgcatcttccagttcatctaaggaactcttcagtgaatcaacatctacgatattatcaaaatcaatgtcatcaagaagatcggtaagtgccactgtaaatgtagaagacattgtgaaatctgtcacatcagcttccacgcagagactttccgggattgtcagatcttctgttttgctttcgtccagattcaaactttctttcatgccaggcattccaaatccgactacgatattcttgcttccatcagaaataacttttccgttatcaatcgtaacattgctaaatgtttcattcggaaggatcattcccgtcatcatgacaaatggtgtgtaaacttcttcttgttttccatctacactgactgttttcttctctttatttgtataatccacctgaatcttcagatgtccgctttttcctttcagatctgccggtttgatttcttttccgtccagatagtaagtaagctttacggaaaccggaagattctgatctgttgttccctgataataaatatcttcaccgtctgtattccatgtcaatgtatctccggatgctttgaatgtttcatcaccttttacattcttaatatctttcagagtacttgcatctgtcaggcttcctgatacactgcctgaattcttcagccagttagatactgttacttcatcaattgttcctgttgcgtctgcatttacataaactgtctcttccttataaactgcatctgcgtcagaacttgttcctgcagcaaagaccggcacagcgcccatcattactgacattccaacggcaagagaagttgtgagtccacgtttgatttttctgtttttgttcatgattcttacatcctttctacttttttccaccgaggaatccgatggacgtcttacatattactttgtcaaatatcataaacatcgccggcaatatcaggattacaacaaccatactgataatcgcgcctcgcgcaagcaaagtgcaaatagaaccgatcatttcaacctgtgagtagcaggctactccaaatgttgccgcgaagaaacttaatccgctgctgataattgacggcatactggttttatgggcaatactgattgcttccatcttatctcgtccacgctgacgctctttctgatagcgggtcgtcattagaattgcataatctacagttgctcccaactgaattgctccaattactatacttgcaacaaatggaaggcttattccctgataaaacgggattgccatattaaccataattgcaaattcaataactgccaccaatatgattggcagtgatattgatttgaagataatcataataatgataaatatcgctgcaattgaaagtgcatttacatttaccagatccacattggttacatcctccaagtctttcatcaaaggagcttctccaattaccatcgcatttttatcataagattttacaatcttatcgatcgatgcaatctgtgtattgacttcctctgttgctgattcatattccgagcatacaaatgcaagctcgtaatcatcgctttgcagcatttctttgatatcatttggtatcatagagtccggcactgccggtccaatcagcgaattcatactgatcgtccacttgacacccttcacagaatcaatctcatcgaacattttcgacttctgttttgcatccatacttctatctaacataaccatatgaatattactcatatcgaagtctttcttaagttctgcattcgccacattactgtccagtgtggacgggagtgaatctgcaatgtcgtagtaaatctttgtgtgattatttccataaatagccgggaataaaagtaccaggaaaacaacgatccaaactttatagtgctttgtaataaaagctgatggcttatccatgttgctgagcaacagtttatgttttgtcttctcaattggtttatcaaatacaagaaccagagaaggtaaaactgttacgcaacagatcacaccgattaatacgccttttgccataacgataccaagatctcggccaagtgcaaatgtcataacacacaacgctacgaatccggctactgtcgtaacagagcttcctgccacagacttaaatgtattagaaatcgcatgtcccatggcacgttctttctctcccggaaaacgcttcttgttttcctcgtagctgttcaagaggaaaatggaataatccattgtcacacccagctgcaataccgcagtcaatgcctttgtgatatacgaagtctctccaaggaaaatgttgcttccaagattgtagagaatcgcaagcccaatactgatcagaaataaaatcggtactacgaaagatccgcttgtcagttcaagtacgaccagacttaaaagtgctgcaatcaccacataaaccggaagttctttaagtgccagattcttaatatctgtaacaactcctgtcataccgctgataaagcactgatcattcgccagcttcctcatctgtccgacagcatccatagcttcatcagaagatgttgtattatcaaacaatacaagcatcatcgtggcatcgcctttgaaaaacgcctcctttaaatcctttgggatcatctccaccggaagactgatatcagctacatcgtcataccagagcacatcttttacatgcggtacttcactgaactgatcttcaagcttctgaacatccttcatgtccatgttctctaccacaaccatggagaaagcgcccattccatactcatccaccagaatatcctgaccctttactgtctccagatgctccggcagataactgagcaaatcatagtttacacgtgtctttgccatcccgatgaccgacgggataatcagaagaaatccgatgatcaacatcagaactctgtgtttggcaatccatttgccaactttaaccatttgtatcatctcctatactgtctcactactcaagtctcttatagtatagcgcgaaatgaccattagtcaatatttttttgttaaaaaatgaaaaatggtcatttttattgacttttgggaattttgtgccatactagtaaaaagacaataggaatttttcacagaatgtatttttatgaaaacctcttattggcaaagtttgtattatatattacaatcactaaagacacacaaaggaggtcattgagattatgggaaaagtagatgataataaaaaacagaaaatgaatacactgctccagactgcatttgacctgttcaccggaaaaggctttgccaaaacaactgtatccgacatcgtgaatcaggccggtctggcaaaggggacattctatctttatttcaaagacaagtatgatttaagagataaattgatcgcacacaaagcctgtcagctttttgatgatgcacacaagcagcttgaaggagctgagattaattctttagaagaagagattctttttttaacagactatattattgaccgtttccagaaacagcagtccttgttaaaatttttgtcaaagaatctctcctggggagttttccaggatgctgtcggaacaggttctgtagtgtccaggcaattttatgatcactacagaaattcacttgtaaaatataatgtaaactgtaagaatccggatctcttactttttacactaattgaattgatcagttcaacaagttacaactgtatccttcatgagaaacctgtttctatggaagagtacaaaccttatcttcataaatcactcaagaaggtctatgaagtgtttgtaagcgttcaggattaagtttattttatttaatttatttttcttttaatgtttgaacataattttgacacattttctgtctatactaaagctcagatagttgataaacaactatctcccccctcataaagtaatggcatcccggtgtgccgggatgtcgactttactctcattcctttagataataaaaagaagacccgattgccaatctgctgaagcagtgaggtgctcgggtcttactttttgtgttttcatatgatgtcgtgcaggattgttttatatataacaccacctatattctggcatcatctaagttatcactgcaacgcgaaagcccgctaacctttcggctaacgggcttcgttgtgtttatagttatctaaaggaatgagagtaaagtgttgacactttcctgtgtcacaactttatgaggggggaagataattgattttctcttatcaactatcttgatattagtatatccggaaaatgtgtcaaaagtatgagtgctttcttaaagaatacgaaaaaatataaacagattatgaaaaaatataaactaataatttatttttctacgttcttccatccactcgagaagatcttcatatacctgctcccgatctgtctcgttgagcagttcatgacgatcaccggcatacagtcttagactgatgtcctggattccggccgctttgtatttctcataaaccttccttacgccttttccgaatcctccaaccggatcttcggcaccggctgcgaaaagaattggaagctgcttcggaatcatatagatactttcttttttctccattataagcatcccggtaaacatgctataatacgcgttcactgtaaagacaaaggagcacagtggatctgaaatatatttttccagatgttcgtcatcactggttacccagtccgcgcgtgtctttggattcttgaatttcctattataggcaccgactgccattctatccaccagtttacttttataatgccagccacggaacatcgccagtgtcctacacaatcttcttccaaactgaagtgtcgctctctgctgatctgctacaactccgataaacattgctcccgccagcccatttccatacatctgtacatactggcgcaaaagacttgagcccatgctatgtcctaacataaagtaaggtacatccggatatttcttcatcgtccgctgacgaagtgtatgcatatctccgatcacgcatgcatttccatatttttcattaaaaaatccatactccgacttgctctgcacagattttccatgtcctaaatgatcgtttccaacgacataatatccatgactacacatgaattctgcaaattcatcgtatctcttaatatattccaccattccatggcttaactgcaggacagctttcacttctccttccggtttccactcaatcgtgtggatctccgtattgccatcctttgaagggaaataaaactcatctctcatcgttcattcactacctgtcatctaatttgatataatcacgatatggtgcaagcggcttataagccggacgtatgatcttatctacattcttcaactcttccagtctgtgtgcactccatccaacgatacgtgctgccgcaaaaattggagtatataatgccggtggaagatcaagcatgctataaacaagtccactgtagaaatctacgttcgcattaacacctttatacatcttacgtctctcgctaatgatctccggtgccatcttctctactttctcatacagtgcatattctgcctcgtggcccttttcatatgcaagctgctttacaaacttcttgaagatctccgctcttgggtcggatacagaataaatcgcatgtcccattccatagatcagacctctcttatcaaacgctctcttctccagcagtgcctcaaggtaagctctgatctgatcatcatcctgccagtctgtcagctgcgtcttcatatcttcaaacatctgtgttacttttacgttcgcaccaccatgttttggccctttcaaggacgccatagctgctgcaattgtagaataagtatctgttcctgaagatgtaacaacatgcgttgtaaatgttgagttgttaccaccgccgtgatccatatgaagaacaagagccatatcaaggatcttcgcctcaagttctgtatactgacgatcttctctgagcatcatcagaatattctctgccatagacagttctttcttcggtgcataaatatacaggtcttcacccattctataattgtaagcaagatagctgtaaaccataagcattgggaactggctgatcagattcagactctggcgcagtacattcggaatgcttgtatcatccgctttgtcgtcgtaagaataaagctgaagaatacttcttgtaatactgttcatcatatcacggctcggagccttcatgatcacgtcacgtacaaaattcggtggaagcatccggcggtcagctatcatatccttaaaattctcaagttccttctgattaggaagctctccaaaaagaagcagatatgcaatctcctcaaatccaaaatgtttcgcctcaaggaacccgcttacaagatctttaatattgtaacctctgtaataaagattacctgcacacggtacagatacaccgtctacaatctttgttgcacacacatcggatatattcgtcaatccggcaagtacacctttaccgttcagatctcgaagtcctctttttacttcgtatttggtatagagttctttgtcaattgcattgttcgtttcacatttcagagcaagttcttcaatctccggagtgatgtcaaaaaatatgctgttaatatctttggccatgggctcttcctccttctcttgtttcttctaatgtcttttatcttttaattatactagatatccgtctagtaaacaattaactgaatattaaatctttatgaatcaaaaagtgaagaagaataaagttgctgtccactacatttttgtaaacagcaactttgtaaattcctttaatattattttatctgcaatcataaagaaaatctgccagctttgcaaattcttccagcgtaagggcttcccctcgaatagatgctcctcttccgagtgcttcaatcgctgcctcgatttcttccttcgtgtagtcaagttctgtcgaattcttcagtccatttgccaaagtctttcttctctggttaaaggaggcacggataatacggaacataagcttttcatcctttaccttcaccggtggttcttcataacgttccagacggattaccgcagatccaaccttcggacgaggcataaagcagttcggtggtacatttgccacaatatatggtttcgcataatattgcacagccagagacagtgcaccatagtccttcgttcccggtcccacctgcatacggtctgcaacttctttctggaccataactgtaatactcttgatcggaacatgattctcaaaaagtcccataatgatcggcgttgtaatgtaatatggcaggttggccacaaccttgatcggttttcctccattttcctcttctgcaagctttgcaatatctactttcagaacgtcattgttaataacacgggcattgtcataatctgaaagcgtatcttccagaatcggaatcagtgccttgtcaatctcaactgcaacaacttttctcgctacacatgccagatactgtgtcatcgttccgattcccggtccgatttccaatacaaaatcatcttttgtaatctctgctgccgcaataattttgtccagtacatgtgtatcgatcagaaagttctgaccgaactttttctggaatacgaaattatatttctgtaatacttctatcgtattctgtggatttccaagtgttggttctttcatctcatctctccatttcttataattgatataaatcccttgcattcttctctgtctgttcgatcacctgctccgcagaaatgccttttagctctgcaatcgcttctacaacatatggcaggtacaaggatgaatttctcttccctctgaacggtgtcggtgccagatacggacagtctgtctcaagaacaattgactccagtggaatttcttctacaatctcttttaacttctttgagttcttgaatgtcacaacaccgccgactccgatgtaatatcccatctttacatattctcgcgccatctcaaggctgtaagaataacagtgtatcacacctttgagtccttttccatgttctttcataatttccatcgtatcagctgccgcctcacggctatggatcatcacaggtttgttcatctctcgtgcaagatccagctgtctgatgaaccagtgtttctgcagatcatgcccttctttatcccaataataatcaagtccgatctcgccaaccgcaacgatcttttctttctttaataattctctcattcgagcgaaattctcttcattcagtgcaccgacttcgtccggatgtacacctactgatccatatataaatgaatatttctctgcgagttctactatcttatcccaggactctactgtcgccgctgcatccacaattgttccaacgccgcctgctgccatactgcttagtagctcatctctgtctgtgtcaaactgctcatcatcataatgcgcatgtgtatcaaatatcattttatttaccgcctgttttcaatatttctaatcttgtgctttattttaccacaaataattctttccgtcttcatataatacatccatcgccccaatgtccaaggttctcaagttccgcacaactaactaaatcagacatttcataagcagattttttcattcttataccttaacgtgttacattttatttcgttttaatactagcatgtgaaaatttaattagcaagataaaaacagcgagatacaggtcatttcccatatctcgccgcttttctttcattttatcatatccaataattgattcatgattttcaatgatgactaatgatttctatagtaattgatcagacatccgtcaagaatgatctcacgctctgcgtctgtcagatctcccagcttaaggttcagttctttgagttcatcacctacaacataagctttgatcacatccgctttctcttctactgcttttctcacattaggaacaaagatgtaatctccgttcttgaaggaaagtgcttcatgatcttcttctgtcaagaatgggagcattccccagttgatcaggttagaacggtaacgctttgttgcatactctgttgcgatgtttgcccatccgccaagtaccttctgacaggaagctgcctgctcacgagcagatccgtctcctggttttactgcgaagattgtacttccgacaccaaggttacccttgccaacttctggatatgtctcgtgaatcttatccatcaccggtttcagttctgcaagtgcatctaccggacattcatctgcttcaattgctttctgagctttctgtacttcttttgcacgtccaacgtatgcagggtcttttcttgaaagagcgaactctgcaagtcccagtggattagaacggtaagaagatgtctctccggacggaatcagctcatctgttgttgtaacaggatcatggatctcagatacaaccttcacaagcaggttctgtggaagtgctgacattgccggccagtccttaatgtttggtccaaatttaatctcaacgcttggatcagcaacacccttgctgtcaaatacacggtttgcataaatgttcttatcaaagtgatatttctgtcctttatactctacatccattgctgttgccggtgttaagaatcccttgtttgctgctgttgctgcgatagaacgagcatccatcagtgctacagaagagatctgtccgttctgcagcttacttccttcacggttcgggaagtttcttgttgtatgacggatagagaatgcgttattcgccggagtatctcctgctccgaagcacggtccacagaatgctgtcttcacaacagttcctgcttccataagatctgcaattgcaccgttcttaacaagttccatataaatcggtgtacttgccgggtaaacgctgaatgtaaattcatctgctccgatgttctttcctttgatgatatctgcagctgcacagatattttcaaatccaccacctgcacatcctgcgatgattccctgctctacatagaacttaccgtttctgatcttgtcctgcagagagtaatcaactgcaccgtcaagacttacaagtgctttctgctctacatcatgaaggatgtctgccagatttgcgttcagttcatcaattgtataaacattgcttggatggaatggcattgcgatcattggcttgatctcgcttaagttcacataaaccataccgtcataatatgtaactgctccaggattcagttctttgtaatcttcacttcttccgtgaatatcatagaactcctgaatcttctcatctgttttccagatagaagacagacaagttgtctctgttgtcataacgtcgattccgatacggaaatctgcactaagcttgctgactccaggtccaacaaactccataaccttgttattcacatagccgttcttgaatgtagctccgatgattgcaagagcaacgtcctgcggtcctacacctttcatcggctctccgtctaagtagattccgatcacgcccggcatcttaatatcataagtcttattcagaagctgtttcacaagctctggtccaccttcacccatagccatcgttccgagtgctccgtaacgtgtatggctgtcagatccaaggatcatctttcctccgcctgcaagcatctcacgggcaaactgatggataactgcctgatgcggtggtacatacataccgccgtacttcttcgcacaagttagtccaaacatatgatcatcttcattgattgttccaccaactgcacaaagactgttatgacaatttgtaagtacatacggcatcgggaacttctcaagtcctgacgcacgtgctgtctggataattccaacaaatgtaatatcatgggatgtcagcttatcaaaacggatctgcagacgctccatgttctcggatgtattgtgtgcctttaaaataccatatgccattgtgttctgagcggcttcttccttcgtcagcggaacctgcacatttcctgtgtcttctactatctctgttccattgagaagatatacgccattctcgtacaatttaatcatgtaaagacctccttcaatctgatctatagttttgaaataactgctaccatattaacatatttcagtgtttcggtaaatctaaattttcgcaattcagcattgtaactcaataaagtgcaatttttactgattttttagatagaaagcggaaatctcatctcaataataaactcatttttctctgtctttgcgctgatttctccattcatacgtttcacaagttcctttgcaatagatagtcccaatccggtagatgttttgctccttgccacatccgctttataaaatctgtcaaatacatgttctatatcgatctgctccgaatgtatcacctgattcctgattcgcaatactgcatgctcctgcttgcgctctaacacaatacttatcttcttttctccatgatccaggccatttttaattacattctgaataacacggtggagtccttgtttatttccggctatagatagcagttcttctgtaatctgaatatccggctggattccccttcttacccagtcatcataataggaaaagaccgtttctttcagaatccggttgatacagcaaggcgtcagttccagactataggattcattttttaactttgtgaacataaaaagttcttccagcatttcattcagactgtgtattctttcatgaataatattcagataacgtctctggtcttcgacattttcgcattcttccataagctgaaaatatccatccagagatgtcagcggtgtccggatatcatgggaaaggttcgtataagtatccgcgatcaaagcttctttctcctgataacgctgcttctcttttctttgtaattccagaagttcattcaatctgtctgaaagcgttccgattccacccaaatcaaactcgcgttgaatcaacatgttactgtcatgtttcatcaagaacgccaattggcggcagatgtccttcacctgccgctgatatttccacataataataaattgtaaaatgataattcctgctaatattccaattacgatatacatccgctaaatatccctcttttgaaaaacagcactgcttgcagctatcattatgacagcaaacacaatcgccacgccgaatgctgccagacactcatttccacttggattcataggaagcagtgataatttcccggttatcgtatacttataaatctggaaattctggattcccattttccgaacagcactgtttatcaatccgtatacgatactcattatattcattgtaagacaaatcgcgatgaccatgctgatcacattatttttcagaataattgcaatcgccatgcagatcaatacgagggcgcaatgaagtgccagctccgtcaggaaataagacagaacagcttttgaacttccccatgtcagttctctgaagacaatataattcgccactgcctggagcaagaatgctcctgccattgtcagcaccgtaaagaccgccaacgcaatagatctggaaaaaatcagtgttcctcttttttgaacctggccgccaatatttttaatataaccgcttccgatatccgctgttgaaaacatcacagcaaaaatcaccagaaacaacgcataaaatttcccctgagaatttgcaaagaaaatgtcatacaccgtaaccttttctcccggttctgtcggcagtgtcaccatcattcccacattaatattctctgcagtcggttccgcaaactgctcctgccgcacggtatcttctttacttaatgaatcataatctattttacacataaatgttgtaaacagtactgacacagccagcacgatccatactacatacatacttttggtgcgaaacatccggtacaaatccatttttatcatattaagcatggctggcacctcctgtcagattcaggaaatacgtttccagttcttcactcgttatagaaagcccttttaccggaattcctgcctttgcaagctccatattcaacgctgcgctttcattcagacgttcaaaaatgtgaatatgttctttgtctgttacctgataattcgtaaatcccatagcatccagcaccggaattgccagcttcggatcagccagtgttaattccatccgctcactgcatcttcgcattaattcttctctcgtaagctcctgcaataaacttccattgtgaatgattccataatcggtagcaatcttcgataattcctccagtatatgactggaaatgcaaatcgtcatattcctctctttctgaagtctctgaatcgtgtcacggacctcagcaattccctgtggatccaacccattgatcggttcatcaaggattaacagatccggttctccaaccaacgcaagaccaattcccagacgctgtttcattccaagagaaaagtgttttgtctttttccgtcccacatgctccagacctactgttttcaatatctcatcaatgtaacctgctttctttatcccaaacagcttgcatttgatattcagattttcatatgcggtcatatttccatataatcccggtgcttcaatcagacatcccactcgggagcggactttctgtaaatcctttcccttgtatccgaagatctcaatctctccactcgttggcctggaaagtccactgatcatcttcaggcaagtcgtcttcccggctccatttcgtccgataaatccatagatagcgccctttttaatatgcatgctgacactgtccacagctttatgatgtccataccgcttcgtcagtcctcgtgtttccaataacatctcactcaaatttttcatctcctttttcttatctgcatttatcataaaagatgaatcctaatcaaacgcaaataaatagtaaaaaaagagtaaagattacgcatgaagacgataaccgattccccatactgtctcaatgtattcctccgaagtcacttgtttgatcttcttgcggatattgctgatatgtacgtccaatgtctttgtctcacccatataaggttcgtcccaggcatattcgaaaatatcctctttactgaaaacctgttttggattcctgagcagtaattctaaaatcgcaaactcctgttttgtgatcttcggaagtatctttccagcaatttcaacctgaaatgtatttctgtttaataccatatctttaaatgaaagcgtatgctgttcctctgcttccttttcttctttatgccggagttgtacctgaactcttgccaacacttccctgatttcaaatggtttcgttatataatcatccgctccgctcgttaaaacttctaccttttcatccaggctgtcttttgcagtcaacacaataaccggaagatttccctttttccgtatttcctctagaactgcctctccggaaattccaggcagcatcaaatccagcagcaccagtgcataaccgtgctcctgcatatttaagagcagctttgcttcggttccggaaaatgcctgctcacaagaatagccttctttagataatgcctcctgaagcaaattattgatatttgtatcatcttctacgatcagtattttctgcatgatattgctcctttatcttcctcaatactcggccatgattttctgagtgctgcataagaaatcaagaagtttgcaagccatccggccggtactgcaagccagacaaatgcaattccaaaccgcggtgcacaaatcaaagcaacagacaaacggattgcaagatttaccatattcgcaatgagaaacggacgcatgattccaagtccgcgaagaacaccatcggttgccatcttgatacccataaagatgaaaaaataccccagccatctcatataatcaccggatacctgatacgctaaagctgttccatcttttccaaggaataaggaagaaatctgattgtgcagtgattcaataaccagaaaagcaaggactgcaaaacctagatctaacaccagtgccgcatgatagccttttttaagccgttcgattttctttgcaccaagattctgggatatatacggcgaaatcgcattgccgatggatacaaaaatcagtgaaaaaacattttccactcgcatcgttgccgaataacctgcgagcgcctgtgtgccaaatggatttacaactgcctgtacgatcatcataccgatcgacactgtagactgctggagaactgacggtatggcaatttgaagcatcgaatataactcctgtccgtcaaaccattcaaactgacatttatatcgcctcattctataaaggaaaatcagaaatgaaaagaccgcagaaatcccctgtgcaataagcgttgccagagccgcaccaaacacgccgagaccaagtccggctaccatccaaagatccataaaaatatttaatacagatgaaaaaatcagaagaaccaatggaattctggattcaccgatagaagtaaacatcgttgagaggatgttgtacataaacagaaatgggaatcccacaaaataaacccgcagatacagtactgcttcatccagtatatccgcaggtgtttgtaataagctcatcattgaatgtgaaaagcaaaaaccaaagattccaagtagtatgctcagtactaaaaagctgatcagcgatgtcgacacaattgttttcattttaccataatctctggctccaaaataacggcttacgagtacacctgcgcctacaccggcgcccagagctacacaaatgaaaacattcgtaagtgcagcacaggcaccgacagccgcaagtgccgaagaaccaacaaactgaccgacaatgatcgaatcagccatattatatatctgctgaaaaaaactgcctaagatcataggcattgcaaaaacagttaacgctttcaggggcgcatctgtgattagatattcatcttttgacatgattatacttctcctcaatcaaaatctctggtaatatttgtaagccatttctttctgaaatagtgaataaataccacgggcattttctcgaactcatctaaagtcattacaaagtaaacccagacaggcggtaatttaaaaacatatgctgcaaggaaagttgccggaactgcaacaagccacataaatatggaatctacgatcattccaaatctggaatcgccgccacctctgaaacaaccgcatataaggcaggtattaatcccttctcccacaagacgccaggttgtcataattataaaaatgctaagataagaaagggcagtctcggtcaatttatcccgatagaagtccagtatcagaggacgaatcgccagaatgataacgcatccgatcaggcttacagcaagtgttatcctaagcatccgtttcccgtattctccggctgtatcaatttgatctttccctaactcctggctgataatgatagtcgtagcgttggcaaaaccgcggcaggcaatagcaccaatatttaccaccataacagcaaccgcatttgcggcaaccatgtcatctccgatatgcccaagaattgctgcaaatgctgaagtggcaaaactccagacaacatcatttatcacggctggagtggcaattttcataaagtcatgaaacaagattcctgattttgcaaagaaatgttttatcctgaatctgacatctgaactgtttaatgaatagatgagacaaattaatacctctgtaattcttgcaatcacagtaccaagtgcaacacctgtaacgccaagctttggaaatccaaacagaccaaagataaatgtggcattacaaagtacattgacacaaagagaaacaatgtatgtaacggaaggcaacattatttttccaatacttcgaagagcgctcataaaaacctgtgagaaccccataaacataaatgaaaatgaaatcaccttcaaatactcacttccggcagcaatcgtatccggactatttgtgaaaatcttcataaccgtaaccggcatagtaaaggaaataacgaaaaatataagcgagacgatcagtgaaatcctttccgccagaccgagaatcttttctactgtctttttatccccttttccccagtactgggcacacagaaccgaagttcctgtagccataccgtaatataagcagaaaagaataaacgtatactggttcgcaagtgatgaagctgacatcgccgtctggcttacgtatccaagcattaccgtatcggcaatgtttaccaatgttccaatcaaattttgaatcatgatcggaaaggctaattttgatgcgtattttaagaaatcttttttatttaacatacaactgttcttcctaaattctataaatgtttaatctacagtactgtttttgcagcatcatcagccttcctcttctccgtaatgtttactcaaagaaaagcctcttcctcgtacctctgtaactctgctgatgatcataaatgcctccgggtcaatctgtctgatcaatttctcaacttgtggaagttctcgattagacacaatactcaatacaatctgcttttgttcttgtttgtaaccgccttccccatacagcatcgtcacgcctctgtctacctgcgcaagaattgcctgacgtacttcttccacatgtttgctgataatcttcacttccgtcttggtatttcccatcactaacactttgtccagcactgtcgtgtagattattaccagtaaaattccgtataaaacgcgttccggaggattatatagaatctgcggtaacagaatcaatatatcaaatacattcagactcactgacaccggaattcgaaaatacttattcaaaatcaacggtggaatatccatacctccggtagaagctcccgttcgaattacaataccaagtccaatcccgattccaagtccggcaaaaatcgtattcagcattggattatccgtgatcaccagatccccaaaaatatgattggccgcttccaatgcaattggatatgtgaaagaactgagaattgtcgtcagtgcaaatttcttaccaagaaaaatcactccaactatcagcatcacaatattaaatgctaagacaaatccagaaattgatgctcccgtaaaatgcttcactaccagaccaataccggttgttcctcctgtcatcagattccccggtaaaagaaaaagtttgattacaaacgcatagaaaacgtttccaaaaatgacctttgcaacggtacttgcccgctttaaatatgccttatccataaattcctcccattagccatatgattttgattatccccaaaaacgtccgttagagaatcttccctaacagacgtttttcaaagtatttcctaatacagtgatattatactgagaaatgcgggcagtttcaacaggatttttcaaggcacaacatatttaagataatatttttttgtatatttgcgcactaatagaaaagcccgcagaaccgaagtcctgcgggcatatttcattttaagtatcgatattaaatctatctagatattaattactcgatgattgaagcaactgtacctgatcctactgtacgtccaccttcacggatagcgaaacgaagaccttcctccatagctactggatggatcagttcaactgtcatctctacgttatctccaggcatacacatctcgattccttctggaagctcgcaaacacctgttacgtctgttgttctgaagtagaactgtggacggtagttgttgaagaatggagtatgacgtccaccctcgtcttttgtcagtacgtaaacctggcatgtaaatttcttatggcagcttactgtacctggtttgataagaacctgtcctctttcgatctctgttctctgaataccacgaagaagtgctccgatgttatctccagcctgagcctcatcaagaagcttacggaacatctcgattcctgttacaacagtcttcttaacgtcctcgtggataccgatgatttcaacttcgtcagatacgtgaagtgttccacgctctactctaccagttgcaactgttccacgtcctgtgatagagaatacgtcctctactggcataaggaatggcttgtctgtagcacgctctggtgttgggatccatgtatcaacagcgtccataagttccatgatcttgtctccccacggtccgtctggatcttcaagagccttaagagctgatccctggatgatcggtgtgtcatctcctgggaagtcatactcgttaagtacttcacggatctccatctctacgagttcaagaagctcttcgtcgtctaccatgtcacatttgttcatgaatacaacgatgtatggtacgttaacctgacgggacagaagaatatgctctttagtctgagccataactccgtctgttgcagctacaacaaggatagctccgtccatctgagctgctcctgtgatcatgttcttaacgtagtcagcatgtcctgggcagtcaacgtgtgcgtagtgacggttagctgtctcatactcaacgtgtgctgtagagattgtgattccacgctctctttcttctggagccttatcgatgttctcgaaatctacagatgcgttaccttctactctgtgagaaagtacttttgtgatagcagctgtaagagttgttttaccatggtcaacgtgtccgatagtaccgatattacaatgcggttttgttctttcaaatttagcctttgccattttgaatatcctccttaaaaatataaccctcaatggggcaaccttgttttggttttctattttaaacctggctaagtttgattatatttcaaacttagccgattttcaagccttttatgatattttaggcatttttgttggataatactttctcctgtacagacttcggtactggctcgtatttctcaaagaacattgagtagttaccacgtccctgtgttctggaacgaagatctgtagagtatccaaacatttctgacagaggaacgtacgcacgtacgatctttccgccaccgagatcatccataccttcaatacgtccacgacgtgagttcaggtctccgatgatatctcccatatattcttcaggcattgtaacctctaccttcatgataggctcaagaagtacaggtgcgccctgtttcatagcatccttgaatgcaagggaaccagcgatgtggaatgccatctcactggaatcgacttcatggtaagatccgtcgtatacgttagcgtaaacaccaactacagggaatcctccaaggataccagacttcatagcttcttcaataccttcacctactgccgggatgtattccttcggaatagctcctccaactacagtagactcgaacttgtatgtctcctcaccgttgacatccattggctcgaatttaactttacagtgtccgtactgtccacgtccaccagactgtttcgcatacttgctgtcaatatcaactggctttgtgatggactctttgtaagcaacctgaggtgcacctacgttagcctctaccttgaactcacgaagaagtctgtcaacgatgatttcaagatgaagctcacccataccagcgatgattgtctgtccagtttctttatctgtatgagcacggaatgtcgggtcttcttctgcaagttttgcaagagactctccaagttttccctgtgaagcctttgtcttaggctcgatagcaagctcgataactggctctgggaattccatggactcaagaattactggatgctgctcgtcacaaattgtatctcctgttgttgagaacttgaatccgattgctgcagcaatatctcctgaatatactttatccagctcttcacgcttgttggcatgcatctgaaggatacgtccaacacgctcttttttatttttagtagcattcagtacataagaaccggagttcataacacctgaatacacacggaagtaagcaagcttacctacgaatggatctgtcatgatcttaaatacgagagcagagaacggctcttcatcagaagagtgtcttactacttcgtttccgtcttcatcaacaccctcgattgccgggatgtctgttggagccggcataaactcgatgattgcatcaaggagtttctgaacacctttgtttctgtatgcagtaccgcagcataccggaacagctgtacactcacatgtagcttttctcagaactgctttcattgcatcgatagaaggttcttcaccctcaaggtattccatcataaggtcatcgtccagctcacagattttctctacgagttctgtgtgataaagctcagcttcatcctgcatctcttccggaatatctgttacagtgatgtcttcacccttctcatcattgtagatgtaggcctgcatctcgaacaaatcgatgattcctttgaattcgtcttcttttccgattggaagctgaagacaaatagcgttctttccaagtcttgtcttgatctgatctacagcattgtagaaatcagcaccaaggatgtccatcttattgatgaatgccatacgtggtacattgtatgtgtctgcctgacgccatacgttttctgactgcggctcaacaccacccttagcacagaatacgccgacagctccatcaagtacacggagtgaacgctcaacctctacagtgaagtcaacgtgtcccggagtatcaatgatattgatacgatgctctaaagcgcccggtttcacttttgtcttctcttccaatgtccagtgacatgttgtagcggctgaagtaattgtgatacctctttcctgctcctgttccatccagtccattgttgcagtaccttcatgagtatcaccaatcttatagttaacaccggtatagtaaagaatacgctctgtcagtgtagtcttaccagcatcaatatgagccataataccgatatttctggttctctctaatggatattctcttccagccaagattttttcctcctaaaataattagaaacgatagtgagcaaacgccttgtttgcttctgccatcttgtgcatatcttcttttctcttaacagctccacctgtgttgttagctgcatcaagaatctcgtttgccagtctttcttcctgtgtcttctcgcctctctgacgtgaatacatagttaaccagcgaagtgcgagtgcctgtcttctgtcagctctaacctcgatcggtacctggtatgttgctccaccgatacgtcttgctttaacttcaagaactggcatcatgttgttcatagcctcttcaaacacttcaatagccggcttctcagccttagcttctactctttcaaatgctccgtatacaatcttctgtgctacgcctttcttaccatcaagcatgatgttgttgataagtttggtaacaactttattgttgtatattggatccgctaatacatctctcttctgagtatgtcctttacgtggcacggtccttccctccttaatcatattttccggtttttccgggattaattcatcggtactcacatgtgtctttctatgagatcacattccatgtgctcgcagccgcgaaatctatatagcatccgcaacctacgactaatcatagttctgtttgtgatacgatttaactattagttacacttatctaaaatactatactgcaatccgcgacttcttatttagcgtctttcggtctcttagcaccgtacttagaacgagcctgtcttctcttagcaacacctgctgtatcaagtgttccacggataatgtggtatcttgtacctggcaggtccttaactcttcctccacggatcataacaacgctatgctcctgaaggttgtgtccttcacctggaatgtagcttgttacttcgattccgtttgacagacgaactctggcgatctttctcagagctgagttaggcttcttaggtgtagctgtcttaactgctgtacatacacctctcttctgtggtgcagaaacatcagttgcacgtttcttcagggagttgtatcctttctgaagtgccggtgctgtagatttcttctcagaagtctgacgtccttttctaactaactggttaaatgttggcattcttttcacctcctatgaattattcgttaccttgggcttatgcctcaaggggctgcggataattaagtcattatccttatttgcgcatcaaaaagacattgcctttttccacacgctcgtttagtttattacgtttagcgccgaaagtcaaggcttttttcgcattttccatattatttttcgtattattttccatacaaaaataacagatggcactctctttttttcttaagaaaccatctgttatttgttattaaatcaaattcctttttctaacgactatgaaagtaaatctcttctttattttcaacgaaatgaattagtatgccttgccccagtataccatatgcttcgccggttttccgcagcatacacatacatctgaaagatgttcttcctcttccggaatacatctagatgtagctccgcctgtctgagctttgatctcatcttcacaggcttcgtctccacaccacattgctttgatgaatccaaggttctcattgaacttctcattcatctcatccattgttgttgcttcattgatatgagaatcaaggaatgcttttgctctttcgaacatatcgttctgcattgtctcaagaacttcagtaagttttgttgtaagctcatccagagaaacaacgatcttctctcttgtatcacggcgtacgataactgcctgattgttctcgatgtctttcggtccgatctcgatacgtgtcgggattccaaggatctcctgtccgctgaacttccatccaggtgctttgtcagaatcgtcgattttcactttgtatcctgctgccttcaatgtatcaacaagttcatttgccttatcaaggacaccttctttatgctgagcgatcggaatgatcattgtctgcaccggtgcgattcttggtggaataacaagtccactgtcatctccgtgtaccatgatcagcgcaccgatgattcttgtagacagtccccaggatgtctcgtatacttcatgaagttcgttattcttatctgaatactgaataccgaatgcacttgggaaggaacttccgaagaagtgacttgttgctgactggagtgcttttccgtcatgcatcagcgcttcgattgtataagtatcctgtgctcctgcgaatttctcactctctgtcttacgtccggaaactaccgggattgcaagaacatcctgtgcaaagtctctgtagactctccacatctgttttgtacgctcttctgcttcttcgtatgttgcatggattgtatgtccttcctgccacaggaactctctggaacgaaggaatggtcttgttgtcttctcccaacgaagaacggaacaccactgattccacaccttaggaagatcacggtaagactgaactgtcttgctccagacatcacagaacagtgtctcagatgtaggacggatacagaatctttcctgaagttcttccagtccaccatgtgttacccatgcaacttccggtgcaaatccttcgatatgatccttttctttctgaagaaggctttccgggatcataaccggaaggtatacattctctactcctgtctctttgaaacgtgcatccaagttcttctgaatattctcccacagagcatatccgttcggaaggtagttcatacatcctttaacacctgaataatcacacagttttgcttcacgcacaacatccgtataccactgagcaaaatcttcttctctggcagtgatattctgtactaatttctttgccattgttcttctcctttttgtttttttgcattgctgtcccctgacagcagtttgcttttactttaatataaaaaatcgccgggatatcgcatccccacgatagggaccgaatatctccggcggtaccaccctaattaatgcaatacatccattctataatcaaaaccaacacaaatgatctctgtatctgcattcactttcttctcctttaacgcaggacctacgctgtactttcatacagggactcccgggccggttccataccgtaatgcaaaggctctcacctgccgccttctctctgaagcatgctgcgtatctactattcccgttcaacgtcagttatcaaatgaaattctaactgataaaacacccgctgtcaagccaaaaagctttatcctctaatttccagaagctttgctttcaattcattttccatattacgaagttccgcctccgcttcctggcgtttttctcttccttctctctgaatgttcatcacttcatccaatgtagagatcagtgattcatttgttgcttttaatgtctcgagatctgcaattcctctttcagactcttttgcagtctcaattgtggacatttttaatgtctccgcattcttcttcaacagttcatttgtcatatccgtcacctgtctctgtgctgccgccgcctgtgaagaatgttctactccaagtgcgagaagcatctgactcttccacaacggaatcgtattcacgattgtagactggatcttctctaccatctgtgtatcattattctgaaccagacggatctgtggtgcggtctggatggagatcattctcgtcagttcaagatcatgtaacttcttttcaaaacggttgcacatcgaatccagatcttttgctgcctgcgcatcttccgggaggccgcttacctgagctttgctcatcatttcagcaagctgtgtgcttcttacttcttccagttttttctttcctgcaagaatgtacatagaaagctctttaaaataagtaagattcagatcatacattttatcgagtatcgcaacatcttttaaaagctgcacctgatggttatccagtgctttcacgatctgattcacattttcttcggctttcgaatactttgctttcatagattcaactttattcgatgctttcttaaatattccaagaaatcctttgctctcttcttcatcaaagctcttcagttcagttacaacattcgtaagcagtgtaccaacttctcccagatcctttgacttcacattttccaaagcactttctgagaaatctgccatctttttctgtgtacctgcgccatactgaagaatcatagaagaattcgtcagatcgatctgctgtgcaaatgcatctaccatcctgcgctcttcttctgtcagaattgtatcatccagcttcggttcttccggctgcaccgccggtttcttttcttcttccgcttgaaacggttccagtgtcagtgtcggcactgtacttacatccttgaatgcatcactcatagcaatcctccatttctgtttgtaactgttttgattcattgtctgtttgggatatcattatttcttcagtccgtcttctgtcagaccttcctgcgcaagcattgtatgaagtactgaaatatctgaagatacatcccatgctgtatcctggaacaggctgtccagtaatttctcaaatgcaatattcaatgtatctatcgtatcttcaatctctttcttggaagaaatgatattttctccctgtaccggctgtgcatccagctcttcatacgcttcaagaagtttcatcgttgtcggaagataataatccatcattcttcgcatatcattcacagaatccggattctgctccacgcggtcaaaaatacgatccacgagcagttccatgcgggaaatctttgccgaaatcacttctcccggaattgcgtcattcgctgccttgatccttctcacatattcatctcctgcctgtacgattttctgtacttccggtgaaagtctgtcatactcttcctgcatctttttctgaacagcctgctcctctgccttgcgctgtttcatgtcttccataagagctgtatactgattccatgcatgttcactgaccatcaggcaggattctttctcatccagatgtccctgacagaaccagccttttgtaatcatttttttcacatctttcagaacctttctgacatctcgtcctgtcgcagaagcaatttccttaatatcacaaaattcccggtctctcagaacagatacatattggcgaaaccttcccaccgtacgtaccatatctactcctacataagtcatcactgcaaaagatataaaagcaactgcaaaaattccaataatcagaccactgactacatcaaacgctgtgatcgcacttccaatcaaagtgatgataagaaaaataacagaagtcaatccaaatacagctcctgtcgctgccagaaaagtcccgccgatctttaccgaagttcctttgagatatcttggactcaccggtaccggacaattctgactataatttctcgtttccgacatcttcggtccctgattcggacgatacctctggttttctgcacctgatctgcttccggtcttctttttatctccatataatggctgtccggtcttcggatctctgtaccagccaccgtttttaatccctgccgagacgcagtccatcgcatggttcaccgtatcagacaccatctggttcagtctactgtaatcctttgtatcaattgcatcctgtattgtctgctttatctcttctccaaaatgttcccagtcattattcattgatgttctccttaaaagcttgacctgattcgtttgcatcatgtatcattataacattattaattctcagtttagacgcaactttatcgattgtcaagaaagaaggatacaactatgatttcatcacttacccctgaaataatatatgaggacaaagatattatcgtctgtcataaacctgctggagttcctacccagagcagccgcattggcacaaaagatatggtcagtattttaaaaaatcatctgataaaaaatactgctaaaaaaaccgcttcacgcgaaccttatcttgctgtcatccatcggctggaccaaccggtagaaggacttcttgtttttgcaaaaacacctgctgccgcaaaggaactttcccgccagcttaccacatctggttttgggaaatattaccgtgcacaggctttaggcattttcgaacacaacgaaggaactctggaagactatcttgtaaaagacggacgaaccaacacctcccgtgtctgtgaagaaaatgtgcctgatgcaaagtatgcacgacttcattataaagtaatccatacagatacacttccttctggtgaacctttttcccaactggaaattcatctggataccgggcgtcatcatcagatccgcgtgcagtttgcacatgccggacaccctctgatcggggatcggaaatatggcactgccgcatgcacttcacgacagttaatgctttgtgcctgtcgactggaattcacacatccgacaaccggtgaaaaaatggtttttcatttataagacaaaaaggaaaagtgcagtgatcgggcaatcactgcacttttcctttcgcctgtttcctatctattgtattagccctgcctttacctgtcatttatccaaataagagcagcaccacaataccctacatctcgtcaacaaccaacgactccggctcttcttcaagtgcctgctgatatcttgcaagaattgttgactgaattcgttctcttgttcctgaattgatcggatgtgcgatatcacgatactcaccatctaatgcttttttacttggcattgcaatgaaaagccccttttcaccttcgatcactttgatatcatgaacaacaaactcctcatcaattgtgatagatactactgcttttaactttccctctttcgcaactttacgtacacgtacatctgtaatctgcatattacagttcccctttctcttttgcattatcacggaatatgaacaccctttttcagggtttttgtgcttatcttggcttataatgcatatctttcattcttttcaacaactattttaattccgtcttcccctacatgtcttgtattcgcacggatcgtatccctgctctctacaatacagttctcaatgtatgtattatctccaagatatacatcattcaatatgatagagttcttgatcacgcaattatttccaacaaatactttcttgaaaataactgagttctctatcgttccattaataatacttccgcttccaaccagactgttcttcacgatcgcacccggattatattttgccggtggctgatcactcaccttagaatatacacttggcagatccttgaagaaatattttctcacttccggtttcagaaaatccatattcgtcttgtaatatgcatctactgttgaaatattattccaataactttcaatcttataaccataaatcttctttacattcttataacggatcaggatatcatttacgaaatcatgtctctcttcttccgcacattgttctacaagatcgatcagcagtcttcttcggatcacataaattcctgtagagattgtctgtgatcttgcaatcatcggtttttcttcaaattcttcgattctgcaagattcattcatcttaacggttccgaatcttgtcgcatcttctcctgctccaagttctttacaaacaacagtgatatctgctttcttcgcaatatgatattccagcactttattataatccatcttatagactgcatcacctgatgtaatgattacataaggttcatgacatcttctcaggaaatccagattctgataaatcgcatctgctgttcctctgtaccagtaaccattatcatctgtgatcgtaggtgtgaatacatataatccaccttgttttcttccgaaatcccaccatttggaggaattcagatgctcattcaaagaacgggcattgtactgtgtcagcacagcaactttctggatatgagagtttgtcatattacttaatgtaaagtcaattgcgcgatagcttccggcaaccggcattgctgctgccgcacgtcttgaagtcagctctttcatctttctgctgttaccgccggctaaaataattcctactgctctcatactctgtcacctgcctttatcaatgtctcaccgcttgcaagtactccatctatgtaatcctcggatgatgtcactccactgatggcggtattctttccaatctgtactcctcccggaatcactgaattctctccgatcgtagccagtccaccgctgtaaatattcggtttcatcttattcgggacttcacttccgattccgatagaaacatcatttccaattaccgtgtcttctgctatgattgctttctcgatcacgcagttttctccgatcgtaactccctgcataataattgagtcacggactacgctaccctttcctacagtaacacttcctccaagaacagaactgtggacttctccgtaaatttctgttccgtttgcaatgatacatttgtctacaacagcattctctgcaatatactgtggaggaatattcgcactgttcgtatagatcttccagaattcttcataaagattaaactccggaatgatatcgatcagttccatattcgcttcccaataagagctgagtgttccaacatctttccagtatccgttgtactcatatgcaaacagcctgtcccctttttcatgacaatatggaataatgtgttttccgaaatcacagtttggctggtctttcagcttgatgagtgcctctttaagaaccggccagctgaagatatagattcccatcgatgccagattactgcttggcttctcaggcttctcttcgaattctttgatcctgctgtcctgatctgtcactacaattccgaaacggcttgcttcttccatcggcaccggcattgctgcaattgtcacatcagcattatttgccttgtggaaatcaagcatcacttcataatccatcttataaatatgatctcctgaaagaatcagtacatagtccggattataagtctctatgtaattcagattctgataaatggcattcgctgttcctgtataccactcactatttgtactcttctcatatggtgggagaactgatacacctccaacgttgcgatccagatcccacggaattccaattccaatatgtgtattcaggcgaagcggctgatactgtgtcagtacaccaaccgtatcgattcccgagttaatacagttgctaagcgggaaatcaataatacggtactttccaccaaaagcaactgctggttttgcaacttttgatgtaagtactccaagtcgactgccctgtccacccgccagcagcatggcaatcatttccttcttatacattacgtcacctcatttcaagtaagctagaatcattataccatatatttagaaataacaaacatattttacaatttttttcatacttttttctcctttttatcaatttctaccaaaaagatcttctttcttttttttcgatatatagtataatataaacgatatagaagatttatgactaaaatcacaagttattttataaaatctattaaagaaagggcgtatctcaatgtataaaatcaattttgaaaagccgatacatattcattttattggaattggcggaatcagtatgagcggtcttgctgagattcttctggaagaaggatttactgtatccggttcagattcaaaggagtctccgcttacaaagaaactggagtctgaaggtgccatcatccattacggacagtgtgccgagaacatttctgacggaattgactgtgttgtatacactgctgcgatcaataaagctaatccagagcttatggaagctgttgcccgcaagattccaatgcttacacgcgcagagctgcttggacagctgatgaaaaattacaagacaccgatcgctgtatccggtactcatggaaaaactactactacatccatgatctctcatattttacttgcagccgatctggatcctacaatttctgtcggcggtattctcaaggcaatcggtggtaacatccgcgttggaaaatccgagacttttatcacagaagcctgtgagtatacaaacagtttccttcatttttatccgaagatcagtgtcatcctcaatattgaggaagatcatctggacttcttcaaggatcttgaagacatcagacattctttccatcagtttgcagcacttcttccttctgatggaactttgatcatcaatggtgatattgacaattatcaggagatttatgacagtcttgactgcaatgtgatcacttatggttcttctgatatgcttgactacagtgcttctaacatcacttatgatgaaaaagggcttgttgcatttgatcttataaagaacggaaaagtggttgaccatatccagctttctgtaacaggtgatcataatgtgtcaaatgcacttgcatctattgctactgctgaactgcttcagattccaatggaaacaattaaaaaaggaattctttctttcagtggaacagaccgtcgtttcgaatacaagggaacatttaacggtgtaactgttgtcgatgattatgcacatcatccgacagagattgccgctactctgaaggctgcacagcactacccacacaatcaggtatggtgtgtcttccaaccacatacttatacgagaacaaaggctttcttccatgaatttgcagaagctctttctcacacggatcatctggtgcttgcagatatctatgcagctcgtgagacagatactctcggagtttcttctgccggtcttgcagaggaagcacgtaaacttggaacagatgcacattaccttccaagttttgaagaaatagaagctttccttaaagaaaactgcaaatccggagatctcctgatcacaatgggagccggagatgttgtcaaaatcggcgaagaccttttaaaataaggctttctcaataactttgctaaactattctgtggaaaagttcacatagatatccacatgcatgtgaacttttccacactttatccacattttctccacatagttatctacaaaaaagtcctagttacccactcgaaaattctttttaagattctcatatgatgttataatattcacactaaagagaagaagatatagatttcaggttgcccctcatcagacagagtaagtggcaattggttaatacatagagaaagcaggataagttatgaagactttggttttaaagaataattttcagatgaatatgacaatgctgccgaacagctttgtagatcattatatggcgaatgcgaacggagagtttgtaaaagtatacctttttcttctgcgccatgttgaggatgctgcatcttctctgagcatctccatgatcgcagattatctgaataatacagagaatgatgttcttcgcgctttccgttactgggaatctgtcggtcttctcagacttggacacggaccggacggtggaatcactgccgttgaatttcttcgtgatgaagaagagaatacttgtggagatacaactgatttttccggctgtgcatcaggctatccgcaggattcaattccaactcagactccggtagctccggtaacagagttccgctcagaagctgtttctgcaccggtagaaagcagtatccagactcctgtttccaatgcggttcctcttgatacattccgtgcccagaaggagatcaagtctctcctgtttatcacagaacagtaccttggcaagacactgacgcatacggatgtcgacacaattacttacttctatgatacgctgcatatgtctgctgatttgattgaatatctgattgaatcctgtgtagagaacggacataagagtatgcattatatccagaaggttgccatttcctgggtagagaacggagttgaaactatagcacaggcaaaagaacaggctgctgcatacagccgtaactgctacacggttttgaatgcattcggcattaagaacagaggacctgcctcttccgaactggaatatattaataaatgggctgatacttatggattttccgctgacatcattcaggaagcctgccgcagaacaatctctgccacacatcagccaagttttgaatatgctgactccattctcacaaaatggtatgaatgcaatattcatcatctgactgatatcaatgccttggatcatgaattccagaaagaacgttccttacatagaagtcctgccacaaaacctaagaatgtcacaagaaatctgaataattttgagagacgttcctacgacatggattctctggaagagcagcttttaaagagcaactaatgaaaaaacaatagtttagaagatcaattatatttaagagaatttaaaaggagtctttacatgggattaaaaaattcacagtaccatgcaatcatgcgtaaatatgagcagaaacaattacatagccatgacattcagatggcccggtatgaagaagtctataaaaagctccctgaattcaaaacacttgatgactccattgcctcactgtctattcagcatggaaagaaactacttgatggagataccagtgcagttgatgctttaaagaaagatcttgcagaattacgtaatcgtaagattcatctgctcaaatcagccggcttcccagaagattatctggagccggtttacgactgtccggattgtaaagacactggatacattggtaataaaaaatgccattgtttcaaaaaagcgatcattggattgctttatgaccaatcaaatattaaaaaattccctgtagaagcagattttagcaatttcagacttgactattatccggtttcacattacgataagaaaacgggacgttcttctcgttccatgatggaagatactttacgcatctgccatcattttatcgacagctttggtacagagtttaacaatctctttttctatggagatgtcggtgttgggaaaacctttctctccacctgtatcgcaaaagagattatgaacagagaatattctgttttgtatttttctgctccacagctttttaatactcttgccaagaatgcatttgacaaaaatgacattgatgcacataacatgtgtgaatacatttttgactgtgatctgcttattattgatgatcttggtacagagtacacaaacgcctttattgcatcacagttttttacttgcatcaatgaaaggctgctgcataggaaatcaacgattatttcaacaaacctttctttggagtcgctcgctgatctttatactgagcgttctttctccagaattacaagcagatatagtctgttgaaaatagtcggtgatgatatacgtattaaaaagaagttagaacattaggaggattatgactcatgttaagtcgttcagaacgtatcttggagaacataccagtaggaagccttggaatcattcctttacttggctgcgaagagcttggaaataaggtaaatgattaccttgttaaatggcgccgcgaaagtgctcacgagcacaagaatgatgttgctttctccggatatgagaaagataattatctgatcaatgccagtgtaccgcgttttggttctggtgaagccaaaggtatccttggagaatccgtacgaggaaaagatatttacctgatggttgatgtatgtaattacaatgttacatactctctgacaggaaacacaaaccatatgtcaccggatgaccatttccagaacttaaagagaatcattgctgctgtaggtggtaagggacgccgtattaacgttattatgccattcctttatgaaagccgtcagcataagagaacttcccgtgaatctcttgactgcgcacttgcgcttcaggaacttgtccgtatgggagttgacaatattatcacttttgatgctcatgaccctcgtgtatcaaatgcgattccgctgagtggatttgagacaatctcaccaacttatcagttcatcaaaggtcttcttcgcaaggtaaaggatcttcagatcgacagtgaacatatgatggcgatcagtccggatgaaggtggtacaaaccgtgctgtatatcttgccaacgttcttggtctggatatgggtatgttctacaaacgccgtgattacactcagattgtaaacggacgtaaccctatcgttgctcatgagttccttggaagctctgtagatggcaaagatgtaattattattgatgatatgatttcttccggagacagtatcattgaagttgctacagaattaaagagacgtaaagcaaaacgtatctttgccgctgctacttttggtctgtttactaacggaatggagaaatttgacaaagcttatgaagaaggtattattgatggtatcctgacaacaaaccttatctatcagacaccaaaccttctttcaaaaccatattatatcaactgtgatatgagcaagtacattgctctgatcattgatactctgaatcatgacggatcactgagcgagattctcagtccgaatgagcgtatccagaatgtacttcagaaatataaaaatggagagactatctaaatataaatttagcttagaaatcattttactgatatacggacgaaaacagaaaatattattttaggaagtcgattgttagaagaatgatacaggaacgccgactcaaagttaagcatactgttcatactagaaaaaacaacagactgctaaaagcaaagaaaggattgacaaactcgctgccgctcaagagcacacggttcatacccgtggtgtcgctggttcaaatccagttcccgctactataacgaagactgcgtgcttaagaaattagtacgcagtttttttacgcaaatttactggttactgcttatatcaagcaaagaaataatagtattaaggagcaacttgtggtaatataacagataatgatatagaaaaaagttgttgtctttcgtttatattttaaaacgtggccaataacagaaatacggaggaaacaagatgaataagaaaagcggatatgcgctcagaatagtacttggaggttatcttacctacctgggtatcagaatcttaagtgagatgatccagcagcgtcctagcaatatgacacttatgtcagtactggcagttgtatttatcctagttggagttgcttatgcagggaatgccatctgcaaaacgtttgaaattgatatcaaaaagcagattgcgaagatgatagcaaagagaaaagcggagcagaaacgaaaagcagaagaagcggcagcggcgaaggaaatgtcacaggtaacagagagcacaacgacagaagtgtcagacaatacaatgccgacaatgctttcagaagaagacaggaagaagctggaagacgcagtgtctaaggcggattccgaggaaaaaacaatgcaagacagcaaggctgaagctatagaaaaaacagcagattcagattcaacagaaaacgaagcagcggaaaaaacagtatcagaagaaaaaacggtgactacaacagaatcagaggaaacaccggacgaagaaataagagctgaaggaacaccagttgaagaaactccagctcaggaagaagaactgacagacacaagagtggtagatatttttgcagaactgaatgaagaacctgtttcagaagatgctgaaaatgattttgaggagaaataattatgcgtgtaggtatgggatatgatgttcataagttagttgaaggaagaaaactgatcctgggtggagttgagattccttacgagaaaggtctcttaggacattcagatgcggatgttatgctgcatgccgtaatggatgcactgcttggagcagcagcacttggagacattggccttcattttccggatacagatccgaaatataagggtgcatccagtataaaactgctcgagcacgtaggcagacttttggaagagaatggatatgtgatcgagaatattgatgcgacgatcattgcgcagcgtccaaagatgcgtccgcatattgaccagatgcgggaaaacatggcgaaagcgcttaaaattgacgttgatcagatcaatgtaaaggctacaacagaagagggccttggctttaccggaagcggcgaaggaatctcatcccaggcgatctgtgcgattgaaaaatttacaaattacagtagcgtggatgtgatggagaagcctgcaggatgtggtggatgctgtgcgggaaaataagatgaagattcgaaagctggaccaatcagagcatgggaaaaccaggagcttgtgggaacaggtattttcagaagacagtcaggaatttgttgattattactattatatcaagacaaaagacaatacgatttatgtaatagaggaagacgatgagatacgtgcgatgctgcagctgaacccttatcaggtaaagttacaggaaagtgtcgttccatcggattatatcgtgggagttgccacgcaggcagaatatagaggcagaggatatatgagaaatcttctgattcatgcattacaggatcagtattcgcagaagatgccatttaccttcctgatgccggcggcagaagcaatctattatccttatgatttccgatttgtttatgaacagaaacaaatcgagcttgatgaagcatttttttctgcaagaaaagaatataaaaatgatgaatatagaaatatatcacaagagcggattgtagaccgtgatgcaagatttatggatgcagggaagatggcggcatttgttgaagagaatttttcggattgctggaatgttgttgctttaagaaatgcacaatattatcagacacagattctcgaacaacagagcgagtttggcgggatgcggcttgtctttgaagaagagaagctggtctgtatctatgcatatgcgaaagaagaagggctcgagatcagggaaccactttatctggaagggaaagaagatctcttctgggcgtcggtggatggtcttagagaaccggaagaaaaggtttcggtttatgggcttaaggaagcacctgactggccagatgatgaaacgtctgcatataaagaaaaaccgcttattatgatcaggatcgtacatttacaggaactattttctaaaatgaaaatcccgtcagaatgtgagatccattgctcttttgcggtgatcgatccgattcttcataagaacagcaggatctggaaactcagtagctcaaaaggagaagaaagcctgagcgtgtctgaaacggaagattcacagggagtactttccattgcagcattgacggaaatattgtttggatacaaaactcctgaagaaatacgtgcagaggaaagcgtaattcttacagaagaactagaggaagaactgaggaaacttcagaacttctgtccaatatttttgaatgagattgtctgaataaaatgttaaaatgcagttgatcggcagagataatagttgacaaaaaatgattttttgcataagataatagagatgttgaaaacaataaatattggtaatagaattgagaaagacaaagaacgggaagagtaacagagatttggactcatagagagaaggtgtcaccggctgaaagcacctttgagagaagaaactgtgaagtgcccccgggagtcgatcctgtgaatggagtagcagggtacgtcaggcacacgttacgtgcgtgaaagtgaaagaagttatacttcttttattagagtggaaccgcggatagaacttcgtctctagattgagacgaagttttttgtatattaggaaagtccctttcctaatatataaaaaacgctccgctcaggatgcgcactgcggcgtactaagtgcattcttgaatcagaaaggaatgataaatatgggaatgatatcttatgtcaaacaggagatagaggtgatccgagagcgagatcctgcgatcaaatcaaacatggaagtatttttgtacccaagctttaaagtaatcttaagctacagagtggcgcataagctttacctgaaaaagcattatttctgggcacgctggatttctcagagagcagcgcgtaagacaggaattgagatccatccgggtgcaacaattggaaagggactttttatcgatcatggaacaggtgtgatcatcggagaaactacgatcatcggagataatgtaacattgtatcagggggttacgcttggcggtaccggaaaagaacagggaaaacgtcatccaacgttgaaagataatgttatggtgagcgccggcgcaaagatcctgggttcttttacaatcggagaaaattctaagatcggagctggttctgtagtacttgaagaggttccaccgaactgtacagttgtcggtgtgccgggacgaatcgtccgcatggacaacaagaaagtcccaagaagtgatatggatcaggtacatttaccggacccggtacttacagatatcagagaactgcaggaagagaatataaaacttcacaaacgtttggaatctatgataaaatatatgcgatgtgtggagaaagaaaataaggagagtaagaacgatgaagatttataatacaatgtcaaaaagaaaagaagagtttgttcctctagaggaaggaaaagtaaagatgtatgtatgcggtccgactgtatataattacatccatattggaaatgcaagaccaatgatcgtgtttgatactgtccgcagatattttgaatacaagaattatgatgtgaattatgtatctaactttacggatgtcgatgacaagatcatcaagaaagcaaacgaagaaggcgttacagcagaagaaatctcacagcgttacattgcagagtgcaagaaagatatggacggcatgaatattgagccggcaacaaagaatccgcttgcaacagaagagattgacggtatgatcagcatgattgagacactgattgagaaaggctacgcatacgagaagaacggaactgtatattaccgtacaagaaagttcaaagattatggtaaattatcccataagaaccttgacgatcttcagtcaggcggacgtacccttcttgtaagcggtgaggatgagaaagaagattctctggattttgttctctggaaaccgaaaaaagaaggcgagcctgcatgggtttctccatggggtgagggacgtccgggatggcacattgagtgctcagagatgtccaagaaatatcttggtgagcagatcgatattcatgcaggtggagaagacctgatcttcccacatcatgaaaatgaaattgcgcagagtgaagcagcgaacggaaaagagttctccagatactggatgcataacgggttcctgaacattgataaccgtaagatgtccaagtctcttggaaatttcttcacagttcgcgagatcagtgagaagtatgaccttcaggtacttcgtttcttcatgttaagcgcacattacagaagtccactgaacttcagcgctgaattgatggaagcagcaaagagcggacttgagagaatcattacagcagctgatcgtctgaaattccttatgggaagcgcgaagacagaagatatggcagagacagaagcagagaagtttgcaaagtcagcagaatatgttggaaactttgagagcgctatggatgatgacttcaatacagcagatgcgatcgctgcagtatttgatcttgtaaaattcattaatacgatgacagacgaagacagttccaaagagtatcttgagaatctgtttgaccgtctggtaagactgacagaagtacttggaattatcgttgataaagaagatgagattcttgattctgacattgaagcattgatcgctgagcgccaggcagcaagaaaagagaaaaactttgcaagagcagatgagatcagagatgagcttcttgcgaaaggtatcgttctgaaagatacaagagaaggagtacaatggaaaagagcataacagcaggtttagaagagtatatccggacaattcccggtatgaaagagattgatgcaaagcagtgttccccactggttcttgcttatgtgggagactgtgtttatgatctgatcattaagacgatggtggtcggccgtggaaacaggccggtccaccgtctccatgaagagacaagccagtatgtgcaggcatcagcacagtcctttatgatgcgttccatgcaggagcatctgaatgaggaagaacatggagtttaccggagaggaagaaatgcacgatctgtgtctccggcaaagaatcagtcaattacagattacagaagagcgacaggttttgaagcattgatcggacatttatatctgacaggtcagtatgaacgactgacagagcttgtaagtatcggacttgaaagcattgaaaaagagataaaggaaaaaggagcagaacatgcaggaaaatagagaacagggaacagagacatttgtaattgaaggaagaaatgccgtactggaagcatttcgttccggacgtacgattgacaagatttatattcttgacggatgccaggacggaccggtaagaacaattgtacgtgaagcaaaaaaacacggatctctgattaattttgtgacaaaagaaagactttcccagctctcagagacagggaagcatcagggcgtgatcgcgcatgcggcagcatatgaatattctacgatcgacgatatgcttaagctggcagaagagagaggcgaagctccgtttctgattcttttagacaatattgaagatccgcacaatcttggtgcgatcattcgtacagcgaaccttgcaggtgcacacggagtcattattccaaagagaagagcagttggtctgacagcgacagttgcgaagacatctgccggagctttgaattatacaccggtcgcaaaggtgacgaatcttgtgaagacaatggaagaactcaaggaaaaaggactctggtttgtatgtgctgatatggatggcgagcagatgtatgacctgaacctgacaggaccgatcggtcttgtgatcggaaatgaaggtgagggcgttggccgccttgtgaaagaaaactgtgatttcgttgcaggaattccaatgaaaggtcagattaattctctgaatgcatctgtggcagcaggtgttcttgcttatgagatcgtaagacagaggatttcgcagaaataaatatgagtattgctcgaaaaaagagtgataacaggtgataatcggatgagtaagtatgacagaatgacagatgagcagcttttatgtgattacaaaaatggaaatcaggagattatggattacctgatggtaaaatataaatccatggtaaggaagaaagcgcgtgcaatgtatctgttgggtggagagaacgaggatctgatccaggaaggaatgatcggtctgatcaaagcagtgcgggattttgatgtaacgcagaaaacatcattttcaagttttgcagaactttgtgtctccagacagatgtactcggcaattgaggcatcaaatcgaaaaaagcatctgcctttgaattcttatgtttcgttatatgaagacagtgaacaggtaggagaggggagaagtcttcctttgattgacacgatagaatcatcgaaggagaatgatccggaagttctttattttggaaaagaatatacagaagcttttgcggagcagctcaaagaattgctcagtccattagaaaatcatgttctttatctgcacttgatgggaacggattatcggacgattgcggaattacttggaaagagtccgaagtcagtggacaatgcacttcagaggatcaagacaaaagcacaaaagattctgccgtaaaggagaaatacggatgaagaaaaaatacaattaccttttggcacttgcagtctttctggtgatcatgatctgctttaacaaattcggatacatcatttcttatctggccgcaattggcgggcctctggttatgggaaacaatggaacaatggtggtttatgagttcctgatgagtcatttgaatctggtatcggcaattttgtaccttatggttctgcctattcctgctttatggtattatcttgcttttcagctgcgtgaaggaggaattcgtgcaatcccaggcaaatgcagaagagtcggattggacggatgtgttttaatcgcgctgtttacttttggcatgatacacgtgaccagtattatactggcaattgtagcacggtcacttccggatgcgatggataattatcagaatctgatagaaaattccggcctgacagaatattcgctgatgtgggttttcagtacattgattcttccacctcttgtggaagaaatgattttccggggtttgattcagaaatatcttgaacgtgccggaatgcattggatcctggcgaatgttgtacaggcgattctgtttggagtattccatcaaaatcttgtacagggaatttatgcggcacttcttggatttgcacttggatttgtggcgcagcgctataacaccctggcggcatccatgctgatgcacatgttctataatctaatgggaacgctgatcgtagatcttgagagcagattccttccggcaatagtaatgggaatgattatcctgatcagtattccgatgacagtgagtgctgtgacgttgatttgtctgacaacaaataataaaaaaacagaggtttgaaaagatgagatttgtaatacaaagagtaacagatgcatctgttacgattgatggtgagatatcaggaaagattggaaaagggtatcttgttttgattggagtagcagatactgacacaaaagagattgcagacaaaatgatacgaaaaatgatcggacttcgtatttttgaagatgaacagggaaaaacaaacctttcgcttgctgatgtggacggaggtcttcttctggtttcacagtttacgttatatgcaaactgtaagagaggaaacagaccaagctttattgaagcaggaaaaccggatatggcgaatgagatgtatgaatatatcattgaaaaatgcagggaatcagtggatgaagtacagaccggagagtttggagctgatatgaaggttcagctgctcaatgacgggccatttacgattctgctggattcagatcagctttaacttgacaatcaaactcaagtagtgtatatttaattttgcgttctgctggaacgcaataagctgtcttggcgcagtcggtagcgcgtcgccttggtaaggcggaggtcgggggttcaagtcccctagacagctttgaacttttccccggaatcgcccgtgaatgcggtgtttccggggtttttcttatttcagcagattcgcgatgcagatcttcaaatcttcatagattccaacagaaatctcattgcaggttttcctataggtttacgggtttgaagaaaaaatgcaattccttgttgaggattctttcacttgttatgaaatatgttatactggatttgattgaagtggtggttcaaggtggcgggttctgcataaggggaagccgtatgagcgaaaagaattatgaaacaagtgaattaaaagaactgaaagatgtgttacagacgtttacggagtttgtatgggagatggaagaatatctgccggaattttatcatttttttgatgcgatgaggcagaacatcgagatttttcttcgggtcggcgaagaagatgaagaacagattcatgagattctggaacgggattgggagaaggcacatgcgccgtttgtgggagtacagtgttatgattttcaaggatcacatccggaggcagaagcaggaacttgtgtttattttgcgaatcttctgacagaaatcggtcgtttttttgaaccgatgagtatgttgggagtgctttgaaagaagtgaaaaggagagatggatatggcatcatttttagaagacatcacaccattttatgggacaggagaacggaatgggaaaggacagacactggaagaatttctggaagaatatgatccatatcgatataaaaatccgtgttgcacaacagacacggttgttttctcttataaagatgaacaggcactggaagaaggacgattaaaggtgcttttggttaagagagggaatcatcccagtattggctgttgggctcttccgggaggatttgtaaatttgcgggagaatctggaggatacagcaagacgggaactgcaggaagagaccggagtcagcggacttccggtggaacagtttgcctgttatggagattatcagagagatccgagagcaaggattattacaagtgcgtatctttctatcgtaaaggagtcggatgtaagtgtagaggccggagatgatgcggcagatgcagcatggtttgagatagagatggaaccggagacagcatatgaagaagatggatgggaaaagacggaatatcatctgacaattcaaaatcaggatcagaagagaaatgcggttattctgaaaaaggagcgggcaggattggtcagagaaaaatactatgttgtaaaagaaggtggaggaattgcagtggatcatgcagctattctggtacaggcttatgaattgttaaaaggcagactgcattcaagtcaaaacatgcatcttccgtgtccatcagcggagtgattgacacgggagtgaacagtaaccttaaaaggacaactgtaagaggagacgaaaagaatctcttgtggttgttctttttatgtgataagatattgagcatgaaaacctgtaggataaatcacacttccgaaggaatgtgacagatcatccggatggtacttatggttagtaggaggaagatatggagaacgaaacagtttcaaagaattttattgaacaggagatagataaggatctggcagaaggagtttacgatcatgtatgcacccgtttcccaccggagccgaatggataccttcatattggtcatgcgaagtctatccttttgaactatggactggcagagaagtataatggtgaattccatatgagatttgatgatacgaacccgacaaaggagaagacagaatttgttgagtctatcaaagaggatattaagtggctgggtgctgactggaaggatcatctttattttgcatccgattattttgatcagatgtatgagtgcgctgtgaagctgatcaagaaaggaaaagcatttgtctgtgatcttacagcagaacagatgcgtgaatatagaggaacacttacagaaccaggaaaagaaagtccatatagaaatcgttctgtagaggagaaccttgagctttttgagaatatgcgtgccggaaagtatgcagacggggagaaagtgcttcgtgcaaagattgatatggcatcaccgaatatcaatatgcgtgacccgatcatttatcgtgttgcccgcatgacacatcacaatacaggagataagtggtgtatttatccgatgtatgatttcgctcatccgatcgaggatgcgatcgagggaatcacacattccatctgtacacttgagtttgaagatcacagaccgctttatgactgggttgtgagagaatgtgaattcgagaacccaccgcgtcagattgagttcgcaaaactgtatcttacgaatgttgtaacaggaaagcgttatattaagaagctcgtagaagataagattgttgatggttgggatgatccaagactggtttctatcgcagcgctcagaagaagaggatttacaccggagtcaatcaagatgtttattgatatgtgtggtatttccaagagccagagctctgttgattatgcgatgcttgagtactgtatccgtgaggatctgaagatgaagcgttcccgtatgatggctgtgcttgatccgatcaagcttgtgattgataactatccggaaggagaagttgaatatctggatgttgcgaataatctggagaacgaagaactcggacagcgtaaagttccgttctgtcgtgaactttacatcgagagagatgacttcatggaagaaccgccaaagaaatatttccgcttgttcccaggaaatgaagttcgtctgatgcacgcatattttgtgaagtgtgaaagctttgtaaaggatgagaatggtaacgtgacagaagttcactgtacttatgatcctgagacaaaggctggaagtggatttacaggacgtaaggtgaaaggaacaattcattgggttccggcaccatatgcacagaaagcagaagtaagactgtatgagaaccttgtagatgaagagaagggtgtatacaataaagaggatggttctctgaacctgaatccaaattctctgaagattatcaaagatgcttatgtggagccaagctttgcagatgcgaaagcttatgatagcttccagtttgtaagaaatggatttttctgtatcgatgcaaaggattctacaccggagaatctggtatttaaccgtattgtttctctgaagagttctttcaaactgccgaagaaataaaaaacggactgccgtgatcacaatgagaaattgttcacggcagtttttcatagttataggtgtgatgcaggggggagaacaagaatgtatgaattgacaatgagtttgaatccaaaatcaaaaactccgctgtacgaacagatttatgaatttatcaaggaagagattcagaataacgtaatacagagtggagagcggattccatctacaagagcattgagtaagcatctggtagtgagcaggagtacagtagaacttgcatatgagcagctcctgtcggaagggtatgtggaggcaatcccatgcaaaggatattttgtcgcaaagatcgaaggcatatatcagcttcagaagagaccggagatcaaagttgaaccgatttcttcaggagtgacagaatacgcgtatgatttcactccgaacggtgtggatctcaacagttttccgtataatatctggagaaaattatccaaagaatgcctgatagatgataaggcagagatgttccgattggggaatcctcaaggggaatatgggcttcggaatgcgatcagcagttatttgcatcaggcaagaggaatacactgtcatccggatcagatcattattggagcaggaagcgattatctgcttatgcttttaacgacagtgattggaaatggtcataaagttgcgctggaaaacccaacctatggacaggcctatcgtttgtttgaacgattaagctataaagtctgtactgttgatatggatcaaagtgggatgcggattgatgaattagagaaatcaggggcggatattgcatttgtcatgccgtctcatcagtatccacttggatgtgttatgccgatacaaagaagaatggaacttttgaaatgggcagatggggcagaaggcagatatattattgaagatgattacgacagtgaatttcgatataaaggaaagccgattccggcactgcagggaagtgatagcaatgggaaagtgatttatacaggtaccttttctaaatcactggcaccttctattcgaatgagctatatggtgcttccggaacatattttgaaaatttatcaggaaaaatgcagattcatcagttctactgtctccaaggtggatcagatgattcttcagaaatttatggaagaaggctattatgagcgacatctgaataaaacacgcgcattatataagaacaggcatgatgttctgatcaacagccttcggaagatgaaagagattctggaaatttccggagaaaatgcaggtgttcacctgttgctgcattttaagacggatgattccgaaaaggatttaattgaaaaagcagcgaaacaaggtgtcagagtttatgggttatcagagtattgtgtaaaagataatgaaaacagtacaggaaaagcggtgattctgttaggttatgcaaacatgaatgaggagagaatccgtgcagcagttcaactactctgtaaggtatggaaatagatgatagaagaacaggctgtattttaataaaaaagagaaacggatcgttcaattttattaagtgtaagattgaacgatccgctttcttttttattattcgttttcagtaatcgtatcatctgattcatcagaaactgctggttgtgtttctgcttcagaagagtcagcgctgtcaatatcagatttttcagttaaatcatctggtcgggctgcctgcaaagatacataagatctttcctgtgttggttcaagatcctgatccagatcaaatgtatcggaatccgtttcttctttattgctatcggtgctatctgcttttatatcagaggatgtactctttgattttttgatcagacgaacagtaagaagtccgattgcagtaccaacagtgccaagtccaactatccatttgattaattttttcaattctatagtctcccttctattaaactaaatttcatactgataaacagtttgctctcaggggaaaaccgcctgatttactttttattgtaatacttttatcgcagaaatacaatatttctgacatttaaataaaaaaatgcgaaataacgttttacaaccctgcaaaagtatagtataattcttaaggcggtaatggttataagtaccgctgattaatattatttacaagcaaacatacgcaggagggtttgaaatggtaaaagcagtagttggtgcaaactggggcgatgaaggaaagggtaagatcacagacatgctcgccagagaggcagatatcatcgttcgttttcagggtggtgcgaatgcaggccatacaattgtgaatgattacggaaaatttgcgctgcatacactgccatcaggtgtgttctatggacatacgaccagcatcattggtaatggtgtcgcactggatgtgccgcgtcttttcgcagaggtacagtctatagtagaaaaaggtgttccgatgccgaagattcttgtatccgacagagcacagatggtaatgtcttatcacaagaattttgacgcatatgaagaagagagactcggaggaaaatctttcggttccacaaagtcaggaattgctccgttctattcagataagtatgcaaagatcggttttcaggttagtgagctgtttgatgatgaacttttgaaggagaaggttgtgcgcgtggcagagcagaagaatgtactgcttgagcatttataccacaaaccactgattaatcctgatgagttatataacgaactgatggaatataagaaaatggtagagccgtttgtagctaatgtatctctttaccttcacgaggcaatcaaagaaggaaagacagttcttcttgaaggacagttaggatccatgaaagatccggatcacggaatttatccaatggttacatcttcctcaacacttgcaggatacggtgcgatcggagcaggaatcccaccatacgagatcaagcagatcgttacagtatgtaaagcatactcaagtgcagtaggagccggagctttcgtaagcgagatctttggagaggaagcagacgagcttagaagacgtggtggtgacggcggagagttcggcgctacaacaggacgtccaagaagaatgggatggtttgactgtgttgcatccaaatatggctgcagaatgcagggaacaacagatgtagcatttacagtactcgatgtacttggatatctggatgagattccggtatgtgttggttatgagatcaacggagaagttactacagaattcccggtaacacatcttcttgagaaggcaaaaccggtttacaaagttcttccgggatggaaagaagacattcgtggaatcaaaaactacgaagatcttccggaaaactgccgtaaatacattgaattcatcgagaaagagatcgagtatccgatcacaatgatcagtaacggaccaggaagaaacgatattatttatcgtaataaataatgaaacagaaatacaggacaggaagtgaaagctttccgtcctgtattttttatatattaggaaagttctttcctaatatataaaaaacgctccattcaggatatacacggaggcgtacaatgtagttgttgctccgtgtggaatctgcacggaaaacaaaaaaatagtaataaatcagaaagttcctcatataatatgatgataccagggtcaaaaggtctgaaaccaccggtgcttgcacaaaggtggtgtaggcgatttaaaatggcgagatgcgttgctggtcgcacatcgtgtgaacagtaaccagaaatcattcaaagcatcaccttcctctgttgaaatccgtaatactaattgtcataaatagaaaagagcgttataataaaaacaatttgaaatcaaagaaataagttggaatttctaagcacaaggagaaaaaaatgagtacaaaagtggaaaaagcattagaactacatgacaaagggtataactgtgcacaggctgtagcctgttctttctgtgaggaatttggtgtagaccaggaaacaatgtttaaaatctctgagggattcggatttggcatgggcatgatggacatgtgcggagctgtaaccggaatgatgatggttatcggaatggacaacagcattggaaatcttgaaaatggaaaagctacaaaagcagatacctataagaaaacaaaagaatttgcagaaaaattccgccaaaagaacggaacctattattgtcgtgacctaaagggagtctctggaaaggggaaagttgtcccatgttctcagtgtattgcagatgctgttgaactgacagaaatgtatttagagagtgtaaaataaagtcgctaaataattgggagctatgctcccattatttatttctccctgatctcttgagattgcctcatccactgatcttctcttccagttgtaacaatcgattgttcagtactgtataataagcgctttctctgttttcaaccaagatcatcgtaatattcgctgcaactgcaagatctaccaggaagctgtcttctgttcctgctgtttcctgactgagaatcattttattcccttcattctgttctttcagtattctttcgaacagtttcgtaagaactgtactctcatctatcttaatttcttttatcttttctatctcaatttcttcttttctgatcagctgcggcatacttggatgtaccgcacgtacgcctccaagatacctgtaaagcggaatcttttctgcagccgctgctgctcgcgccactgcaagtgatattgcaaaggatgtctgttcatttccgttttctttcagaattgtatcaatctttctttgttcaaatacattttcaccgattatttccggtgcgatctgactgttaagcagttcaattttttcttcgatgtgcacctgctgtttttctgtctgctcttttttactataatttttccctgccatagacgcttttcctatgatttctcctcctgccagcacttccacttcaatagccggattcccggcgaaatcaaggatctctcttgcataaacgtcacggatttctattgcaagatccagcttatttctaacttctggttccacactccaaaacctccttttcgttgcttttctttctatttttgtatgctgtttttcgtactttgcttaatttcagtatttcctttttggaataacttcatgcgttgacttttcacttttcaacgcttacaatcatatgtacaaacatttgtgacagatttttagattggatgttgcacacaaaagctatcatttttcttttggggaggaatttatttatgttagacaaggggaaacattttcttttactgacagtcagcacactgatcatggcgattggtacctactttttcaagttcacgaataactttaccttcggcggtatcaccggtcttgctgttcttattgcaaagacaggacttatgacagccggtgatttcaactttgttgccagtatgacgcttctggtgatcggaatgattgttcttggtaagaaattcgcagctaagacagcttattgcagtattctgctctcggtaacgctttcttttctggagcgcgtctgcccgatgaaagctcctttgacagaccagccgatgctggagctttgttttgcgattgcacttccggctcttggctctgccattttgttcaacattggcagttccagtggcggtacagatattattgctatgattttaaaaaaatattccagcttcaatatcggaccggctcttatgctttctgatctgttgatcactattgccggattctttatcttcgatatcaaaactggattatattctttgctcggacttacgattcgttctttcatggtagacacctttatcgagaacttcaatttgtccaaatattttaatgttgtatgtgacgacccggaaccgatctgtgatttcatcgttcatgagctgaaccgtagtgccagcgtctttcacgcaacgggtgcttattccggtcaggacaaagcgatcgtcctgactgcgctcaaccgtacccaggctgtccgcctgcgtaatttcatcaagattactgatccaaaggcgtttattctgatctctaatacaagtgagattatcggaaaaggattccacagtatctgatcaactctgtttgatcagatgttgtgagtggggcattctaatgaaataagtgatctccgatccgtgttccgtaaccgcctacactgaaatacagacaatctccaatcggattgcttcctgcaagtgcatcttctgccgcctgcatcgcagtttctgtatagccctggtttgctcttacgcggtcaagccatccggacattgccggtgagaactgaccggactggtagattacttcttccatcgtatccggataagaggaactcttgatacggttcattacaaccgctccaaccgcaacctgtccttcatacggctggtttcccgcttcacagaagatcagggatgccagcaattctttttctgctgcctgctgtgcagccgctgcttctgcctgtgccgctgctgccgcttctgcttctgccttctctctggcgatccgttctgcttcttccgccgcacgtctctcttcttccagctttgcttcataagcaatcttcgcttcaactgccgcgatcttcacattctcgatcatccctgactgtacatcgatcacttcctttgatacacaccagtcagtacctacatccccggcagactgcgtgtcatctaaagtttcttcctgatccgatggctccgttgacacttctgattctacagcactctgctcctgtgcttccgtggaacttgcaaatcccgtcagcatgaccgcactcatcattgctgtatacatcgccagaaacatccttttatttttattaaatttcatataccctcctaacaattttgttgcataatttttaccatttaattgctattctttattaatactatgcattattttcatttttattacatttattacaaaaatgttacgagcgatatattatcataaaaatgtgtgcatgtcaacttttttatttcacgcagaaaatccgatccttttttctactaaaatacagctcctgtaaaagtctcaacttcctacaagaactgtatctctcaacatcattttatctcattttttacaatgtcacgatttctccatcttcatcccagagatcatgccagtcttttgctccatgccacaagaacacctgtccttttacaaggcggtttcctttttcgagtgttgcgatcttcgccatctcttcttctgtcagcggatcttctgtcattgcttttaagttgcttacataattgtgaagtgagaacggaattgcaatctcgcctctctgtcttgcccatttcagtgcaatgatcgccgggtgacagttatgagccttcgcaatctcctgcataaccggagtctgcagatctgctacatcttccggacacatatctctctccggtctcatcggagaaccgattggcatgtaacctaccggctggatatcgtgtgctacgaggtaatcgtaaagttcctgttgctggaagcaaggatggatctcaagctcacaggcaaccggtttgatcttcatcaatggaagtactgcttcgagtttcggaatcgtcatattggagattccgatgaatcttgtcaatccgtcttcaacgagtttttcacactgtctgtatgtattcatgaattcttccacactgaatggtttagaatccggatttcttgactctacatcgcattttggtgcatggtaattcgggaatggccagtgaatataatacatatccacataatcacactggagatctgcgatacttttcttgcaagcttcttcgacatgttcgtgcatatcgttccatacttttgtcataataaagagatctttacgttctacgattccctcatcaaatgcatttttaaatactttaccgatctccggttcatttccgtagcatgcggcacaatcaaacatgcggtatccgcttttgattgctccgtctactgcttcagcaatctgatctgctgtaaatctgtcggaaccaaaggttcccattccgatacatggtgcttcatcacctgtgtagaattttacttttggcacatctgccggattaataaattcacccatgataactctccttttatctaatctaaccgatcttctcaatctccacctgtggatagatcttttccatatcttcttttacgaagaatcctgtttcttctctgagtgctgctgccgctgagatcgcacttgctttcttcaatgtctcttcaaccgaaagtccttcgctaagtccaagagcgaacccggcgatcatggaatctccgcatcctacagtgtttaccgcatcgatcttcggcacacgtgcgcgaaagattccgtcgtcacatacgacaaaggaaccgtctccaccgagtgacactgctacgatctcgactccatctgcatgaatctgttttgccgcatctaccatgtcctggaagttgtcgcagctttttcctgtcaacatacggatctcatcaatgtttggcttgatcatcgtcggctttgcctcgattcccatctcaagcagttttccacttgtatcaaggatgactttctttcctgcctctttgcagattcttacaagacgctgataagctgttccgtcaagtccttttggaacacttcctgacatagcaacaacatctgctttcttcaccagttctgtgaaatgtttttcgaatcccttaaattcttcctcagataccgtgaatcccggctcaagaaattctgtctgcacgtgattgacttcatcccagatgttgatacaggatcggctctcttcttccagatgatagaattcgctcttgattccaaatggtttcagtgcatcttcgatataatttcctgcatgacctccgacaaatcccgtcgcgaccacttccgctcctgcgatagacgccggcttggatacatttaatccttttccgcctggcgtgtacgcacattctttcacacggttgacttcaccgacctgatagccttccacaacatatcttttgtcgattgctgcatttaatgttactgtaagtatcatattcggtacagagctttgacacatcaaagctcttgtccccctctctgattaatcttcgtttacaagcattacttttccctgtacaagtcccggtgtcttaaacatctggaatgcttcctgtgcctgactcatcggaaccattttgtaaataaatcccttgtcgaatttcagctgtcctgttgcaaagtaatgtgctgtcagatcccactctttgcccgggaacggtgcgctgtaggacatccaggatcctgtcagtttgaactctttacggttcatgttctcccacattgccggtgtgaactcaagattcacatgtggtgttccgataaagcatacatgggatttgtttcctgcaagctcaaaggccatatgcatagtcggaacctgtccggctgtctcgaatacaaatccgtatcctttgccgcctgtgattgccattgcctcttccataaaattctctttcgttgtgttgacaacttcgtcagctccaagacgtttcgcaagttcaagtctctcatcactgatgtcgaaaactacaactttcttggaaccgaagatcttgcaccactgcatagtgaacattccgatcgttccaccgccaagtactgcaacatactgtccaccctgataatcattctggaatacaccatggattgccacagtggcaggctcgaacattgctgcctgttcatatgggatgcttggatcgtatacgactgcattttgctccgggatcaccacataatctgcattggatccctgctctctggaaccaataaagctataatgtttgcacagagagaagtttccgttctggcagtcatcacatttcatacatggtttcagcggtgcgccggaaacatggtctccaaccttaacctttgttacaccttcacctacttctacaacatctcctgagaactcatgtcctagtacgatcgggtagaaatgaactccgttatgaagtactcgcggaatatcagatccgcagataccggagcattttacttttactttgacttcgcccggtcccggtgtcggttcttcataatcaagatactgtacgtcttcgttagcgcatacaactgctgctttcattttcaagatcctcctttttatgatcttttgttaattattttgtttctcactcatggtttttcgccataacgtcctttaattgtttataaagctctatatatgtttcataatttctatcgtaaacttttctatttttatcattcggttcgtgggaacgcttatcttctacggtaagcttcactgcctcgtcaaagtctttgtacattccgattccgactccggcaaggatcactgcaccgagtgttgttgctgtgtcagaggatggaacaacgatcggttttcctgtgatgtcagacttgatctgtgtccataacagagagtttgctgatccgcccatcgcacgcaggacttctactttcgctccggcctcttctgcaacatcgaggttatgcttcaatgcataggctgttccttccattgccgcacggatgaaatgtccttttgtcttactgaagtctaatccgtagtagacaccttttgcatttggatcccagattggggttctctcgccggacatgtatggaaggaaaatcactccgtcacttccagtttttactgctgccgcctcttcattaaataaatccagtgagctttttccctgacgttttccttcttctctttcgtaagctccaaactcccgctccagccagcgcatcactccgccacctccggttgttcctccttgtaagagccagcaatccggcacgacatggaacccaaggatcagccgctcatctgcacgatactggtcggtacagatactcattccacctgcctgtccgccttgttcctgtgtctctccgctgtggattacacctgcgccgagagtcccgcatgctgcatcgagtcctccggccacgaccggtgttccttccgccagtccgctttcttttgcagctttttcattcacctcaccgatcacttcatgacaggcatggatctccggcaataaatcggaagaaaatccgaatgcctgacacatctcttcattccatgttcctgttctcatatcaaagcagtgaagaccatatccctgtgagagatcctgtgtcatcacgccggtcagtttatatgcaatgtaactgttggactgaaggatcttataagtctttgcataaacttccggaagatttctctgataccagatgatcttcgccgttgtgtaagatggctgtaaagagttgccgcaaagctcgaagatcttgtctttcccgatcttttcattgaattcttcacagatatctgtcgctcttgtgtccatccagattggggtgttcgtaagtacatttccttctttgtctactgcgatcgcagaccaactctgtccatcgattccgattcctttgatctcttccggggcaatctttccctttgccagcacccttgggattgcgtcgcagattgcttcccaccattcttccggattctgttctgcccagcccggatgtgggtaatagacttgataatcaccggttccggctgccctgactgttccgtcttttgcgaagacggcaatcttgcaggcactggttccgatatctattcccagtaaatattctcccatggtctcctcctctttatgaaatgtccgccactgattttccttctacgaatccggttttcagccagattgtctctgttgtttcagttttgtctgatgttttatctaatgtttcatccttatcttcgagacggctcaataacaaatttgctgccgcctgtccgatttcttccgttggctgcgtcacgattgtcaatcttggaactacggctcttgcgaaatcctcattatcaaatccaatcacagacaactgttccggaactttgatcccaagatcattaatctccatcattgctccgactgtcatctcgtagttggagataaagactgctgtcatatccggattgtcttcgtaaagcttacgcattgctttcgctccaccggcaatcgtatagttaccatctgccagaagttttgtatctgttctatctgttttgccttttaaatctgattgttgtgctaatctagctttggatgattcttgtatcgcaagctcatatccgcgctgacgttctctggctgtatatacagtatccggtcctgtgatcataccaatcttcttatgaccttttttcatcagccgcttcactgcattctgcgcagctccttcattatctacaaggacgcagtcgcaatctccgttctccatccttcggtcaatcagtacaaccggtcttctggattttctgaatttattaagcactttcttctctgctccggtcggcatcatgatcaagccatccactcttctgtgaagaaggaattctgctgcctcttcttctcgcttcacatcagatctgcagtcacagatcatcgtcgcatacccatgacttcttaataaatcttccgctgctgtaatgatctctgaaaagaaaatgttgttcaactcgggtaagatgattccgatggtcttcgttcggtttgtctttaatcctcttgcaacttcatttacctcaaaatgaagcttctcaattgcctcttcgatcttgacccggttcttctcacgcacatttcctccatttaaataagaagaaattgttgcaagtcccagacctgtctcacgggcaatgtctttcatcgttgcacccataagcttatttccttattttgtatcttgtaagctatcacttgttttattttgcttttccatcacatccacacatcttcatgcgtgcgatcacctgttcttttacagcttccatcgcaacaacaccgagtttcttcggatcgaatgtctccggcttctctgcgagcagtttcttcactgcatctgtgtatgcaacacgaagctcagtagcaaagttgactttacacattccacgctctacacattctcttacatcttcttcactcagtccggaagctccgtgaagtacaagcggtacatctacaacttctttgatcgcgcttactcttggcttgtcaagaaccggtgttcctacataaaagccgtgcgctgttccgattgctactgcaagagaggaaactcctgtgcgctctacgaattctttcgcttcctgcggatctgtgttcgtatcagcatcagcctcaaggtcgtcttcctttccgccgactttaccaagttcagcttctaccggaatgccaaatgcatccgctacatccacaaccttcttcgtcactgcgatattattctcaaaatcttcgtgagaaccgtcgatcataacagatgtgtaacctgctttcattgcctggactgcaagttcaaaactgttgccgtgatccagatgcagacataccgggatctttgttttcgcagcttccgctctcacaatccctgcaaatgtctccaaggttccgtacttcacagtagaaggtgttgtctgaagcataaccggtgcgttcagctcctctgctgctgcgataaccgctttgaccatctccatattctctacattgaatgcgcctacagcgtatccacccttctttgcgtctaaaagcatcttttctgatgtaactaatggcatcgtattcatcctccttattttcaaaaccgaaacgtttcggttttgcttatgtgtttattttagtacaggatttattgcttgtcaagataatgaaaacgaaaagtatatttttattaaagctgcaaataatgtaactgttcagagccaacctccaaaatgctacgcatttcgtcggtgtggcgtacgatttaaaatggcgagatgcgttgctggtcgcacatcgtgtgaacagtaaacatcacatccgataaacctgtaagtttctgtctgatttctacttcttctgattaatactcgcggataatgctgctcacttccagaatgctaggcagtgccagaagctcctctaacgcctgcttcatgtatttctctttcacactctcagttacaataacaagctccgcctgatgtggctgtgtatgttcctgaacaactcttgtgatactaaccttatgattaccaaatacttctgcaactgcagcaagaacacctggttcattcgttacctgcatacggataaagaacttattcttcacatccccaatgtcttttaccggaaggttcttataacatgtacagctgattcttccattgcagccatatgccatatttctcgcaacatcgatcacatctcccataactgcactggctgttgggaactctcctgcaccgcgtccatagaacattgcatcatctgctgcatctccatgaacaaaaaccgcattaaaggaatctcttacagatgcaagcgggtgttccttatggatcatcattgggtaaacacctacttcaattccactctctgtgttatgtgctacgccaagcagcttgatcacactgtcaaattctttcgcatactcgatatctttcgctgtgatctttgtgattccttctgtaaatacgttaggaaatactactctagaatggaacgcgatagaagccatgatcgctaccttacgtcctgcatcaagaccttctacatccgatgtcgggtcagcctcagcaaatccaagctcctgtgctttctcaagtgcgtctgagaaatccattccttcttctgtcatctttgtcaagatgtagtttgtagtaccattcacgataccgacaacttcagagatgtcatttattgccaggcactgcttcatcggacgaatgatcggaattgctccggcaactgctgcctcaaacaggaaatccacacgattctcttcagctgttgcaagaagtacatgtccctcctctgcgatcagatccttattcgcagaaactacattcttacctgctctgagcgcctcaaggatcatcgtcttcgccggctctataccgcccataacttcaattacgatctgaatctcctcatcttcaataatatcgttccaattatctgttaaaagagaagcgtctacgccctctctcttcttatttatattacgaacaaggatcttcttcacttccatctgagcgccgattgtcttctccatcacatctgcacgcttctgaatcagtttatagacaccggatcctactgttccaagtccgagaattgctacctttactgttttcattatggacacctctttcatcttttatctctgtgtaatttgttcttttattatagaacaaagatttacaacatccttcttttcacatctgttgtgtttagtcacagtaaccacagtatagcatgattttctttcactaggaagtcttagacttaatttttttcattttctctaattttttttattttttctgttgacattttaacgatcttgtagtaacatatctattgttcgtcggaacaataagttatgcgacagtggctcagttggtagagtacaaccttgccaaggttggggtcgcgggagtcggcgttcctgtaccattcttctaacaagcgactttctaaaataatattttcagttttcgtccgcactcaaacaagaatctctacgctaaatttttattttctcaactgccagaacgccactgcacttgctgctgccacattcagagaatccacaccatgtgacattggaatcttcacagtataatcgcaagctttgattgtctcctgcataagtccgtccccctcggttccaagaatcactgccagtttttcttcgctcataagttgtgaatcgtcaatacttacggaatcatctgtcaatgcaagtgctgctgtcttatacccaagtgctttcaagttctcgatcgcctgaaccggccagatttctttcctgtcgcatctgcgttctttattatcctgaataaatgtccatggaatctggaacaccgttcccatactcactctggatgctcttcgatacaatggattgctgcatcctgaagtcagtaatactgcatccatatgcatcgctgctgccgaacgaaagattgctccgacattcgttggattcatcacgtcttccagaatggcaatcctgttctttccctcgcaaagtttcctgaaatcttccagtggtcggcgtttcaatgcacaaagcattcctctcgtcagcttgaatcctgtcaattgcgtaaggacagcaaactctgctgtaaaaatagaagtgcctgtattctcaaatcttgcaagaacttcttgcgtctcttcattttcttccatctgtttcttttcaaccagaacagatattggaatatatccggcatccaacgcccgtccaatcactttcggactttctgcaataaaaagtccatcttccggacggtctttattcagaagctgtgcttccgtataacgtgcgtagacgtccagttccggtgcgttaaagttgttgatttctataatatttaacatattctctccacttattacttatattttccaatcaattctctataaaaatccaccgccagatgaatcttttccacagatatattttcattttctccgtgcacagatgcgtattgctgtttatctatatcgattggagcgaatcgaatcacggcaccgccttcatccacgatccactcaaagctgatctgattctctttgaaatagtcgagtgccaaagcattttccgattccatgatctccacacattgcaatatcacacaatcttgcaatctcttcgtcactacatccggctttctgcctcatccaccaagagataaagtcagaacgcacggtgctctaaaagctctctgatcttgactacaaacttgtttttaatctttggttcattcacaatttttgacataattttcccccctgtctgtcgataaaattcctgttactattttatcatacacacaggggggaataaagattaaaacacatattaaatgataccgtgatccttcgccaatgctttaatactgcgatcataagttgcttctgcttctttcgaaaagaaacatcccggcacgccttcattgtgatcacgatgataaactacacacgaaacagactgttgtaaaaaccgaacattttactacatgagatgcctccaacgtctcacttagtacccaggaaatgatttttctgaaatatagatccataatactggtaagatatgcatatcctctcctttctaaccatatacctggcttatttttttctatattttaacggagaaactccatatgtttttttgaagcttctgataaaatagcttacattctgatatccactctgcattgcaatctctgtaacaggaatatccgtatcttgtaacagctgttttgcatgctctaaccttaaatgtgttatatattgcgaaagggtaatatgaaaatgttccttaaaatatcgcgatatatatttttccgaaagatgaaactgctcactaaattcttttaatgatatcttttccataaaattctgctgtatatatgaaatcatttctttttctatcgtatttctcccgcttttatcattttcaattacaaagcccttctcccacatttcaagaataaactgtaaaagaattatttttgtctttatctgaacagttattatggactcagttttcttattttttgccacatatatttcaaccaactgctcacatagttcttttgctgtatcttttactcttggacttatcatcagatgaccattttttaacggctccaataatttatcatccaacatgtcatttatgcaaaaagatatgtattttaacggaaaaaggaaagtaaaataatccactgtatcagtctgtgaacccataaaatgcagattacccggcgacactacaaaagcatccccgggggttccaatataattttctcctgatatactaacagtcaaaaaaccgctttttacatatataatttccagttcatcatgccaatgaaccggtatctgaaataatcgtccttcattttttatatgatatgtactaaacggatcatcctttgtaccatgtggtttattttcctttaattcaaagtacatactctctcctatacttctacaagacctttactcttccattttccactcttccatctaagtaccattcccactgctctcgcacattcgtcacctgccatagcaatatatgctcctacagccagaagtcccatgtgtattccgagaaaataggttccgccaactgcaaacaaatacataaatatcgcacctaatataaccggaaaaaatgcgtctccgctcgtttttaacgcctgcccatatacaaggtttattacccttccaagttcaagaaatatatctactattaacaactttaccacaagatttatcatctgtatatcatccgtaaatatatgcacgataaaatgtccggcaaatgcaaaggtcacggaaaagcatgtcgctgtgatgataccatatatcgcagcttttctcgtccccctgttacattcctcaaactcttttgctccaattctccagccggtcataattgcatttgcctgagcaagggcagctcccacgcaatacgagaaatttgcaatctgtatcgcatatgaacgcgctgtaacattcattccatccacatccatctgattcataaaacgcactataaatgtcattgcgatgttgtaaagtgctgtttcaagcgcagaaggaaaaccaatcttaacaatctgtgcaaatatctttcttgatgtaattcgctcaggactctgctttgcttttataagtacagcccccatgccggctacaataataagatttacaactctcgaaataaccgtggcaacagcaactcccatcacaccccagttgaatgcaaataaaaatactgaattaagtattatattgagaacatttccaacaacagttcctatcaaagaatgttttgtatatccaaacactctcaaataactggagaaaataggaatcagtgcatttaaaaaacatgtgccgccaacaattctaagatatatttcagccggctcaagcaaagccggagcaatacttacgcttctaagtatcccaccagaaaaagtagcaagaacgacagacattatgatacctatcaatgcgttgaatataagtccaagttgccttgcctgatatgctatccccggtcttccagctccgatattttgtgacataacggctatcatacccgatgatattactccaaacataataataaaaacacttatatatgtatttgctgttcccactgcccctacagcctgatcacttacagatgatagcataagcgtatcaaccatacctgaaagcatataaaataaagtttctaagcatattggcacagatagctgtgttaatgtttttctttccgctgccatagtttttctcctcacatacaattcaagaatactatatcaataatacgatatatttctatgtaattcttgtataatatcatgtgaaaattgcactatttctactttgtcttaaggagcactgggtgcgagctaaattgattactcatgcttacaaggatttgcaaatcaggataactttttccgttttcccaatttgaaacagtttgcctgtttataaatagactcatatacctcatctgcactactaaattttgcgttaaacatgagccacttgtcatcatcatctgaaacaaagctgttcatcacatcagccaactcagattttgtcacaacatccttcaagccttctgcaacatctgaaatctgcttttcaatagatatcatatctgagttgattttgttaatttctattctgttgttagcagtttccatgcttaactgaagtatttcccgctgacctattaaaggcgcatggatcggatccatacgcctaatttacacattgttattattctttccgaatcctttcaacaatgctttcccgactcatcttttcaaactgatactttggtatcacatacgcaatcccaaccaaaatcggaatcataagcacacatggcactatcgtaagatgcagccggaagaaaaatgccgtaccgagtgtatttgctaaaatcttctctgccccaaacacaactaataatactgcaatcacaaatgcgcctcccaaatatagaaatccctcagtcactagcattttcgatacctgttttttcgtcattccaacaacttccaaaagcgccagttcctttttcctgctgattacagaggttgctgttgtattaaagaaattcataataccgataaatgctaaaataacgacaagaaaaccaccgatcatataatatttgctgacaaactgctgaaaactctctttcatgtccaatacagaaaacacattgatcatatcattttctttcaaaatatttttatcaatgtattcttttatctgcttgtcctcgcccttctttgcatcgatggcagcatacatggctgattcatttcccgtctgggtaatatactcatcttctggaactaataccgtaatatagataaggtctgcatacggataatccaatgcatatggcatcagtgcttctccaatgacttcgtaatctttttggtttccatttttgtactccatctgaaaaacatccccagtctgataataggaaaccggatgctctgcatatttatcaccataatctacaagcacataatttccgcttttaaatgtatcccaagagcatttttcccctctccattctaatttgtcaaacaccgactcgctgattccgagaaaatgaacacttactgtattggaagcctttgcatcttcccaaacctgttcttcataatcagtccagtttttttcatatttatctgcgaatgcttcccatgttttcagaagttccggctccatcttgtgggtttcttcagaataatacacatatcctgtcttagcactatcaggacattcgtccaaaatctctttgatttcaggtgtaataccgttgaaattcgtatttgacaaacttcccgtcatctgatccagttgaaaatcggaagctaaaaatacttttcggtaagaatcaaaatcatatccctgcaccaacatcacgatacagttgacaaccaccatagaaagagcgatagaaagcataacaatcaatccctttttccaatttcgtaacacatttttaactgccatcccccaccaggttacagaagtattcttttttattttcctatgtgactgctctccttctgccaaacgcagagcttccacaggcgaaactctttccaccattttacaagcctgcagactggagagatacaccgttaaaagcgttaaaagtatcgctgcaaggaaaatcaaaggatttgctgatactactgtctgagccgtttttcctgcctgtgcactaattgcagcatctgctgtcaaggacggagccatacaaagacctgcaagataaccacaaagcaatccgattggaatgccaatagctgataatctccacgcctgcatacgtacaattttcttcaactgctttcccgttgtccccacattctttaacaatccgtaagcccggatatccgttttcacagaaatgttaaaaatattataaataatcaggtatccagctaatatgacaaatagaatcattataattaaagaagaaaatgaaaatgaatcctcttcaaagagattatatgccggattgacttccattcctgtcccagctttcgtaaatcccgctgctttggatatcttttccgttttcttttccagattccaaaggttcttgtaccagacagaatactcttttcctccattgtagatgccattttctaattcttcctgcgtaacgggataacgattctcctttgcataggcttcggatacccagaccatctgacctaaaacagctttatccccctgccagaatccacatatctgaaacgtatctgtcttatattgtttcagcataggatttacttcccaggtcagcgtgacttcttccccaatctttggtgtaacacccagagattccaatatcgtgctgctaagtgctacttcattttctttctccggcagtcttcctgtagttggcagacaattaaaactttctgccatattttcatctgcatatcggacctctacggaaaatccaaaccgttcgtccattccagctcccagaaaaataccggaaccatatcgttccacatcttcatcctgttctattgttttttgcaatctctccgcatcttcttctgacaaattctgcgcaatagcatgggatgaatccataaattgcttaatttccgttgctcttttggaaagtatcatggatgcactccccacaaagaggcttgtaaataacagtgatgtcaacatgattgcaataacagcaataatatttcttgctcggttcattttcataaaacgtttcgtcaataatcgtaacgtttctttattctctacttttaccatataatcgccctcactataccaaaccactgtctgagacaatttttccgtcttcaatctgtaaaatcctgtcagccatctgggcaatctcctcattgtgagtaatcattacaatcgtttgatgaaaacgcttactggtgacttttaaaagtcccaatacatcctgactcgttttggagtccagattgcctgtcggttcatctgccagcaaaatagcaggttttgccgctaatgctcttgcgattgccaccctttgctgctgaccccctgacagtgcacttggaagattttccagttttgtccgaatgcccagtgtatctatgatttcatttacataacctttttcaatcttttttccatccagtttcacaggaagaacaatattttcccatacattcaacatcggaaccaaattatactgttgaaatacaaatccaatatttctacgcctaaaaatagtaagctcttcatctgtcatatggcttaaattctgtccgtcaacaatgacctgaccggatgttggattatccaaaccaccaatgatatgaagcaatgtagactttccacttccagaggttccaacaatcgctacaaactcccctttttctacttccaggtttataccatcaagagccctgacttctgtttctccctgcccatatatttttcgtaaatttactgcttttaatatattcatgccatcctcccatcaaaaaagcctgtattgatctttacaatacagactttatcataacaatgtctccatctggtttctgaaatgtcacagttttgatactattccttctttgctattggaagaaacacagaaaatgtagaaccttttcctctctttgatgtcacttttatataccccttttgtgcctgaatgatctctcttgcaaggaataagccaattcctactcctggctggtctgccactgacagactccgataaaatcttccaaatatctttggtatttcttctttttctattccaatgccatcatcaatgatatcaatctttacaaaaaaagaatactgctcgacttttatctgaacatttcccccacatgctgtgtatttaatcgcattgtctacaatatttccgagtgcctccacggtccattttgcatcacacatagcatgtaaatccgtgtcaaatagactcagggaaatatccttctccattgcttttacattaaactgctgctgtacggatgcaaacatctgtgcaatagcagtatcctccggatgtactgctataattccgctctccattcgtgataatttgaccagtgattgtatcagaaaatccaatttctccgtctgctccaaaatggtagctatctcctcttgattttcattactcacttcagagagtatttctccatagactttcagatttgaaatgggagtcagtgtctgatgcgcaatatctgaaataagtttttgtatcacttctttctgttcctgttgatttttttttgccagaaaactactgtctatatattgtttcatgctgttttcaagagcagaatacttttcttctgatatttctgtccgttccagttctccatctattgcacaatccagcattcgctgcagccggttcaaaagctttttttctttctgataaaaaaagctgtaccaaaaaactccgctcaggacaaatataactacaatcaacataattgtttctatcatccattcaccgcccatgtataaccaattccataaaccgtcttgacatattcaggcttctgcgtatcatcttctaatttgtctctgaggcgtttgactgcaacagtcagagcatgagcatccacaaactctgtatccccctgccatacctcgtcaatcagatattcccgtttcaatacttttcctctgttttcacacagcactctaagaagcttttgttctgtcttactaagttcaataggttctccatctttgaaaaattccattttatcgaaatagaactcaaatccatcaagctccatagaatttttagctgctgcctctttatttctaagctgcacagacactcttgcacgcaaaaccatcaagctaaacggtttcgtaatataatcatttgccccagcttccaatcctgttacaatatctacttccatgttatttactgtaagcagaataatcggcacctgactgtttttccttatttctcttacaaaatcaatcccattcccatccggcaagttcacatctaacaaaaccaatgtgatatcttcctttttcaagatctctctagcctcctgcaaagttctgcactgataaaagaaataagcatcattctttaaagccagacggattccatcatttaattttttgtcatcttcaacaatcagtaacttttcactcatattttctctgctttctttcaaattacgctaattgtatcattgccagttttataaatcaaatcattaaatcaaaatctccggcagaaattaacttataaacagcaagaggctgttgcaaaatacagtttagatttaccatacatacaaatctggaagttatctatttctcctcttcgttaagacctagttcattacatattacttgctatccctgataccttattctttctaccagtgtttcctttttcagattactgcttaaaacacaggaaagtacaatctgcaacagaccgaccaaaaaaatcataataaaaattggtacgattggaacatgatagatattcattccaaatattccattatgttttgcataggaaaaaagtgtatagccgagcggcagaccaatgatcaaagctacgcatatggtgccaaccgtaaaaatcagtccctgtaactgcagacataaatttaattgtttatttgtcatacccacagcctgtaatacaccatattcctgcttttttgtcgtaatattcatgatcatggtgtttgccatattcataaaaccgatgagtcccacaaccgccatgaacagataacagccgagcttcatcatgctgcttgcaaattcggcagattgtaactgcgcatgataagtatccatttttatatgcgaagtattagaaatcaaagtattcagactctgttccacagatgtcacatcttttttatcacagtccacccacagatatccataggctgttcccctcggattcatggaacggtatacaccttccggaatgacaagataagtgtctgcgcttacaaaggatccagcaatctttccctgataggtataggttccacttccattctcaaagtcaaatgcaatggattcacccggagcatatccatcttgttccatccacatcgaccagccaaagaaaatttcaccattctttaccgcctgatcatagtccatagagccaatatccccgtcctggcgcataaaatcaaaatcatttttactcacaatagcagccggaaatcttgttccgttcagatttacagagacaatctctctcgtcatgacatctgtcacgcccggaatgcttttgatttcttcaatcagcgaatcattcaatggattatccgtcagaatcgtatccagattattctccggatatctttcatcgtactcagcagaatagtcaagctgcagttccaattgtccatgattaacggaaagacgtgcttcatgctccgtatcaatatttcctacataattagagataatcacaaacaatgcgcaggaaagccccagtgtgaggatggtaccaatggttctttttggattacccgttatatttgccattgccatagaaaacacggtgacattttttctgccatttcgttttccttttttgtgtgtttctgcattttctaaataccgtgttgcttcgataggtgaaatccgtgaaacaattttcattggtttgcgcagtgccaaagcaacggtaagaaatgatacgaaaatacatagaagtataacaggcagggaaaacagtggcacctgctgattttggactcccatagagccctttccggttgatacaaggtttccctgttctaccagccagttaaaaccgcattttgcaatcagaaaaccaagaagcaatccaaccggtattgaaaaaattgtcaaaaacataccctctctgaagatcagttgtttcatctgcttttttgtcgctcccagagccttgatttttccatactcctgtatcttgttggcaataccgacctgaaaaatattataaatgaccacaacagagaaaagtacaattgcaagaatcagaattccacataccgcaatcgtttcataactcggctgcaagacccattgcaaatagagatcattgactataacgtttttttcttcgattccacaagatgctgcaatctgctttataaccggttcaatattattcatagatacatttgcagaatcgtttaacgtaaaatagatattatactgtctgtcattctctgcgacgtgctcatcataaaactcctgtgacccgaaagcaacataagatgcctcgctggtatactcatcccggtcatatagaattccgctgacaacaaattcttccggcttatattctgactgcatccctgcgcggtaatccagtgtaaccgtatctccgaccgttacatcatcatatcccattgcacgaaaaaaagctcttccggcggcaatttcctgcattttttccggatactttccttccttcaactcatattccttattatagggaagcatttttcttgcagtctcatccatgcagacaaacccgccattttcattgcctttaattatgccttctgtacacataattcctattgcatctatttctgcacggcggcttacttcctttaactgcgaggcatctgctgcgacaaacagaccataattgcttccatatgagcctgccgcctgacttttctgcaaacgtatcattccatttcccacagtactgataattacaagcagcatcgtagtcagacatatggacatcataatcagtatacttcttgtcttgttctttttgtcattgctatatgcaatcctgcttattgtcttcatctgaaatccaccacctgtccgtcctcaatcaccagaatacggtcagcgacctgtgcaatttcgtcatcatgggtaatcattacaattgtctgtccatatttttttgctgtcatcttaagcagggcgatcacctcatcactggtcttggaatcaagatttcctgtcggctcatctgcaaatataatttccggacgattcaccagtgctcttgcaattgctactctctgctgctgtcctccggataactgatttggcaaattgtaaatcctcttttcaatccccagagttgcaataatatcatttacatacgcttcatccacttttcttccatccagccccagtggcagtacaatattttcccagacattaacagatgaaaccagattaaatgcctgaaaaacaaatccgatttttcttctgcggaaaacagcaagggcatcttccttcatcctgtataaatctttccctgctaaagtaacactgccttttgtcggggtgtctagccctccaagcatatgaagtaatgtacttttaccggaacctgactttccaacaattgcgacaaattctccctgctcaatctgaatgtccacctgattgaccgctttgacctgattctcacctgcgccataaaacttacaaagctgtttggtttctaatatcacactcatgtgttgcctccttttcaattctgtaaagcgtaccttttcagcacactttctttgcctgtttatataattggtcatttttcaacctacatccaaattgtatcaggataatctttcatttcactttcaaaaaacgagcagaagtcttacagaattgtaagatttctgctcacttaaaatttaaccaacatatggtaattgaatcacaaacgtgcttccttttttctttttgccggaggttaccgtaatcgtacctgcgtgtttttcgataatttctctcgatagaaaaagtccgattcctgtaccactcttttccatgacctccttggaacttcctctgtaaaatcgttgaaaaattttgtgatactcattctgcggaataccaattccctgatcctcaatttccattcttacaagatcgtttcttttttgtaaccggataaatatttttgaaccacacggactgtacttgaccgcattatccagaacattgatcacagcttcaccaagccatcttttatcctgcataaccatgcatgtttccagctcttttgcatagtcaaaaacgaattcaatttctttctcatccgcttttggataagtacagttcacagcagatatgacagtatccataagcggaagttttttcttattaatctgaatcagtccagtttccatcttggatatttcaagaagcgactgcaataatgtctccagtccatccagagcactccgacaacggatacgaaactcctcctgttctgtggcacttaagtcattctgcatcagcacactaaaacatgtatccaaagctgcaaccggtgtctttaactggtgagaaatatcagaaaccatttctttcgtgttctccttttctgcccttgcttcttcctttatcaactgaatatgatgtccgattacttcaagctggtcattcaatttttccagttctgctggattttccgttttcagtaaagcatcaaatttattttcacggaatctgatcagaatttcttccaactggtctaaaattttctgatgacacgcatcttcttttttcttccaataaaataaaaaagtcaagagaagcacgcatatcacagtgcttacagcaccggtcaccataacctgatgccggaattgcgaataaaatgcattccctttattcccccagtatccatattgctccaataattgcattccctgttcgttggtttcaacatccttatccttaagcaattccgaaacagcatccagcccggaaaattcttcctttgcagcaatctctgtcataagattcattttatatttataatcttcataaaacacatacgtggtaaagcaatttaatattgcaaacaataatatgacaggtaataccaaggagagcactactgtaatcttcttgcgatatctctttgtcactgccttacctcctgattccatatatacccaagacctctgatattctttatataaaccggtgcagccggattgtcttcgattttctcacggagtcttctgatattgacagcgattgtattttcatccacaaaatccccttccagatcaaacacattttccaatatttgtgtttttgaaagaatctgtttcggattctgcagaaaaaaagtcagcattttcaactccgtttttgtcagactgatttcacgactctttatcaggactttcatttctcctgcgataaatacgatatctcccgaaatcatctttccggtttccgttttctcctgtctgcggcggaaatgtgcttctattttcaaaagaagtaccgaaagactaaacggctttgtaatataatcatctgcccctgcttcatatcccatgacctgatccatctcctgatctagtgctgtaagacaaataatgtatgtattataattgcatctcatccaccttacaaattccagtccattcccatccggaagattcacatcacaaatggtaacatccacattattatcacttgcaattcttttcgcttttttcactgattctgctgaaaaaacctcatatccggattttttcagtgaaaatgtaattccacgatttaaattttcatcatcttcaaccacgagtatacctggcatagcatctgcacctctctttattaactatttttcctcttcgttaagacctagttcgttacatatttgttctgcctcaatatcttcggtagtgactttccctgtaatatccctataggcttctttatctcatcatatgttgctttagtctctgcagatgttatatccacatcatcaagttcaatcataatattaatgtaatcatccggcttttgtttcagttgggacaaaagaacaactgtctcagcggtactttcgttgtcccaacaaagttcctgtgtctccctgtctccaaaatacactggaaaacggaactttatgtgcttcaggaatctgccatccggccgctcctgctcgtaacctccaaaatgctacgcatttcgtcggtgtggcgtatccgccaaataaaatttcaaaaacagtcttaaaaatgcaagcattttacacctgttttttaaattttgcttggctctgaacaattacataatatcataaaaagagtggacagcaaaactaatttctgctgtccactctcttcatattatgaaagactttgaaatttataagtcttgttctcttcaatcatctatcacattcgatgaaactccaagtgtcatatcttcttcaagataaatcacagcttctgttccgtctgtgattcttccgctgaaatgtccggcgaattttccggccagatcagatgttccgctcacctggactgtaactaccggttttgcttcttccggaatctcaatcactcttttctctccagactgcattgccccgattgttactgtttctgctccgttgaacttaacctgaacattttccagttcaagcggtgaagtgttacggattgttatgttacttgtatactgtccacttgcttccacatattctgattttctatataaaaacatgcccgtaaacaaaaagataactgcaaatgcgatgatcagattctgcaaaactcttctcattcccctgcctcctataaactctctttaaaatttctattcttattttcctttattatactaacagaatagcattcagagatttctttttccagagacagattcacttaatttttttctgtttttcatcgttttgtcattgatttcgttgacaaacattgtttatttcaagacaatgtaatcgtttccacacgtttttgttatattttcacaatacttcttctcacagcttattctatacaatatccaaataggtcttatgctccggtgcaggaaatgcacggtcaagagcagcgtattcttcgtctgtaaggacaacatcttttactgcccagttctgaagtacatgctctgttctgccgcttcttggaattgcaatcacctggtctttccgaagaacaaatgcgagaagtacctgcatcggtgtaatgacacgagcttttgctattttctgcacttctttgttctttaataaacttctttgcaggcttccagcctgtgcaagtgggcaatacgccataatcggtgtctgatgttcttccagccagggcatcagatcatactctatcccacgggatcccagatgatacaatacctgatctacctgacagtgatctccattgggaactgaaaacagttctttcatatctgatgtatccagattggatacgccccagcttctgatcttgccttttttcaccagttcttccattgcatccactgtttcttccaacggaatacttccgcgccaatgcaacagatacatatccagataatctgttttaagattatgcaatgtctggtcaatactgtcataaatctgcggacgtcctgcattgtgcggatatacctttgaaacaagaaagagtttttctcgagaatatccctggatcgtatccccgattaatttctctgaaagtccatttccatacatttcagctgtatctattaaagtaaatcctgcatcaagccctgcctgaagcgccttcttttcctgctggtagattgacagatgttcaccaagcatccaggttcccataccaagacgcggcattttcattccattttttaatgtaagatataaatcactcattttcttccctttccatatatcgaatcatcccttcagcagcccgttttgcttcctctacagcatgaaccaccgtatttgctccctgtacaacatctcctgctgcaaaaacaccttcatgtgttgtcatgcagttctcatctgtcagaagaagtcccttctctgtcgtttttaactgatccgttgtaagtaccagcttattctttggtgcctggctcacgcaaatgattacagagtctgcttctacctgatctaatttttcttcatatccaatcactttattgttttcatcaaatatacttgttttaaacatcggaccggcttcattgatcgactctattgcctttccaaacacaaagtctgcgccctccagttttgtataagacacctcatgagagcttgcggaaatgcgttttcctcttgcatacagtgtaacctcttttgcaccatgacgcaatgcagttctggctacatccattgcaacatttcccataccaataaccgctactttctctcccaattgatgtgcctccggtcttctgaggtaatcaatcccaaagtatacatttccaagactctctcctttaattccgattgccttcggtctccatactcctgttcctacaaagacactgctgtatccgtcgcggaacagattatcgatcacgattgcacttccgatcacggtattcgggcgaatcctgattcccaattcttccattttctttttgtatcggtcgattacagattttgaaagacgaaattctggaattccatactgcagcataccgccgattttgcttcgttcttcgaaaatcgttactttataacctgctaatgcaagcttgatagcaactgtaattcctgccggccctgaaccgatcaccgctactttctttccgtttttctctattttcggcacttccatcctgtcaagataagaatctgaaatgaaattctcaatactgctaaaatggattggactgctctttcttcctaaaacacaatggccttcacattgattttcatggttacatacggtagagcagacagcggacattgggttattcccaaaaaggatttcacctgcttccatcagacggttttcaagtaataattgagtgatttgtgggataggtgtgtgaatcggacacccttgctgacaaagtggttttttacatttcagacagcgttctgcttcatcgataatatgcaatttcattctgttcttcctcctgaccttttattcagatagaaaatgccgaccacagtttcccatgaccggcaataacttatattcttacaaatggttaatcttagttttctttttctacagacacattagatactttttcgtagtattttacaattgcactgtggtcatctttttcatttccatcagcctttaaagactgcatgatctccataatctctgctgtgagtggaagagatgcatttactgcatgtgcagcgttcagcgcattattcaggtctttgatgtgaagttcaatacggaatcccggtttgaagttgtgatccatcatcatcggtgcctttgcatcaagaactgtagaacctgcaagtcctccacggattgcctgatatacaagctccggatctgttccggctttctttgccagtgtcaaggcttcagatactgctgcgatattcagtgcaacgattacctgatttgcgagttttgcaacatttcctgatccaagttctccaacatatacaacagaacctgccatctgcatcaacagttcataatatttgtcaaatgtctctttctttccaccaaccataacagaaagtgttccgtcgattgccttcggctccccaccacttaccggtgcgtccatcagttcaattcctttttctgcaagctcagcgccaatctttttagattctaccggatcaatagagctcatatcaattacaactgttcccggttttgctgcctctgcaattccaccttctccaagacatgctgcacgtacatgtggtgagtttggaaccattgtgatgattgtgtcacactctgctgctacttcagctccgctttttactccctttgcacctgctgcaacaacctctgcaactgctgtctcattaaaatcaaatacaacgagctcatttcctgcttttaacaggttcatgctcatcggttttcccataattccaagtccaataaatcctactttcattttattatttcctttcttttaacacatctgtttcattgcttcatgcagcagcttaaagctctcttctgactgttctacataaggagaatcaatcagatacgcttccagaatatcaagattcttctgcgtcggctcgattccaagctcctgcaaagttaatggcatgtccatccctttcatgaacagacgaagtgcctctttatcttcacttaatttattgtagtaaagctgtgtaaacagtgccactgccacgatttctccatgcagcgcatgctctgcttcctttgtaaaataagtccgcacaccgtcatacatcatatgaccaagtgctgactgtgagaagcttttcgtgatgttcgcgatcacaccggttacagcgatattgataaatgtgatatcttccactgcctttgtcagtctcttatgacggatatcttcaattgcctgtgcaccatactctacaagcacctcgtaagtatactctgccatcttgtaggcactgaacagatcgattttattttcactgagatacatcttcggcttgccgttctgtatctcgattttttttgccatcgcatccaaaattccggctgccgcataacggattgggcattctgcgatcacttgcagatctacaagaactgcatcgatttcatgttcgaatctccagcagtccttcttcgcaccttccggcgtatacataacactcattgttgtaaatgcagcacaggttgcgattgatgtcggaatgttgacaactccggtatccgcatattcaccgactgcttttgcaaaatccataacaagtccgccaccgattccgactacctcatcacagttttctgctttgcatttttcagcatattccctggcagcttcataagaacactttccaccatacagatgcaattcatactcaagtcctgccttctcaaatcccggaattatccgttctttcactgcatcccacgctctgtttccggcaatgataaatgctctctttccaaaacgtgaaatttcttttccacactcttcaagtaaattcttttcctgtctgtatctcccggctccaaatttaattgccggatctaaagtcactttttccattttcccgctgccttccctcttctgtcataatttatcttttaattggatgttttggattctctccggaaaggacaagatgcacatcttccgctacatccagtgcaatccgatccatacattctaccgtattggaaccaatatgcggtgtcaggatcacttgttccagtttcaataatggattgtcttttttgggtggttcttctgagaacacatccactgctgcacctctaatctgactgttcctgattgcttctgctaacgcctcttcatcaacaacaccgcctctggaaacttgaatcagggaagcggatttcttcatcatggcaaactctttttttgaaataattccctggttcttttctcctcccggcacatgcagactgatataatccgatgtttgcaaaagttcttcccaagacacgatttctatatactctggaatatctttcccttccggacgcggcacataggaaataactctcatatccaatcccagtgccgcctttcttgctacctcttttccaatctttccaagaccgatgatcccgagtgtctttcctgctacatcgatccctttcaataaaaatttcttctgaaaatctcctttccttacaagttcttcggattctttcagacgttttgcaagatttaaaatcacagttatagtgaattctgcaacagataaggtcgtcgtgtccggtgaataagtcgtataaatccctaactcattcgcagccttccagtcaagattgtcatatcctgccccatgtctggctatgattttcaggttctttcctgcttcaagtatctccttgtctacttttgcagttcgctgaatcattgcatcacatactgcaatatcattttttattgattctttgtctgtctttccgctgccgcggactatctcatagcctttttctatgagatagtcctctcccgctgcagcgattggctgaggaatgtaaatcttctgtttcattttccactgtcgttctccttatcttacaagacaaggtttctttggatcgaatttccatcccgggatcagatactgcattcctactgcatcatctcttcccccaagacagttatcaaggtacagctgatgtgctttcttcacctgctcaagatccacttcaatacccagtcctggtttctttggaacttctacacatccgtctacgatctgaagtggctcttttgtcagtctctcaagaccttcctgccagatccagtgtgtgtccagtgcattgtactctcccggaaccgctgctccaacctgtgtaaacattgcaagggagatatcaaaatggttatttgaatgagatccccatgtatatccaaaatcatggcacatctgagctacacgtacagaaccactcattgtccagaaatgcgggtctgcaaggatgatgtcaactgcctgagattccagagagtgtccaacctgtctccagtctgtagcgatcatgtttgttgctgtcgggaaacctgtacgtctgcggaattcactcataatctctcttcctgagtaaacaccttctgctccgcatggatcttcacagtatgtaaggattccttccattccctttacatattcaactgcttcttcaagaagccatccaccatttggatcaaggtcgattcttgcgtccggaagtgctttcttcattgcacggatcacatccatctcttcgtttcctgcaagaactccacctttcagtttaaaatctttaaaaccgtatttctcttttgtagcaagtgccatctctacaatcttatctgctgtaagtgcttcctcgtgacgcagacggtaccatgcacaatctgaatccggctctgaatcatacggaagatctgtcttgttacggtctcctacaaagaagagatatccaagcattcttactttatctctctgctgtccgtctccgagaagttcacaaaccggaacaccaagctgctttccaaggagatcaagacatggagcctcgatcgctgtaattacatgaactcctgtacgaaggtcaaatgtctggtttcctctgacatcttcctcccccttagaatcaagatgtgcttttactttaagcagtgtgctcttatactcagcaactcttgttccttcaacaagcgggatacattcctcaagtgcttttgtgatcttctctcctcccggaacttctccaactcctgtctctccgttctcatcataaagaacaacaatatttcttgtgaagtatggtgcgtgtgctccacttaaattcagttccatacagtcttttccggctactggatatacttccatctttacgattctagacataacaatttctccttttatacacgaactttttctctatctgtttctattctacttttatttttacttcagtgatcggaccggagattgacttgcagtccgaccaccgaaatcatggcagcaaattttagtttattaacattttttaataacttcttgttttaaacaaggttcatatctgcaagtactttatgcagcttctctttttcttccggtgtcagttcgccgatcggatctaagcattttcctaccggaattccttcctgaacgagaccttccttgattgctgccgggaatgttcccataccgcatgcaatacggaacggagccaatgtaaactgtgcttccagagctccttcaagatctcctgcaacgtatttatcatagatatccgctgcaattctcggtgctacatttgcacaggatgcgattgctcctgttgctccgtagcaaagagctgcatagatcaaagtatctcttcccatcagtacagaaaaatcttttcctcttgtcagacggatatactctgcagcatttgtcatatcacctgtactgtcttttacagcaacaatattttcaatatcagcaagttttgcaactgttgccggtgtgattgtcacatttgtctttggtttattgttatacatgatgattggaagtgttgtattttctgcgattgtcttatagtaattgtacaactcatcctgtgtctgggatacaaacattggtgtcagtacggaaactgcatcaactccgacctcctcacagatctttaccagtctgataactcctcttgttgtaatatggcttgctccaccataaaccggaacacgtcctgctgtctcatcaacgactgtctcaaggatctttttgtatgtatcatcatcgaatgcgtagaattctccggttgttccaagtgggaacaaaccgtgaactccgttgtcgatcaggtgatttaccatctgtcttaataccggatagtttacttcaccctcgtctgttaatggtgtaataattggagggataattccctttggtacaaatgtcataataaaaaactcctttcaatttataacacaaactgtaataacagtaattctataattccaactcctgccatgatcaatgacactgctgttttacatcttacctgatcttttaattctgtcagaccgaacattccattgaatacccagaatccactgtcattgaagtaggagaaggaaattgctcctacacaacaggaagctgcgagcaagattggggatacactgatagctgccatcagtggtgctgtcagggatgctgctgttgtgattgctactgttgcagatccaagcgcgattctcatcagtgctgcaatgataaatggaatcaggattgccggaagcggaagtcctacaactgtctctccaagaacatttccgataccgctgactttgattacatttccaagagaaccgccggctcctgtgatcagcatgataatacctgtatctttgatcgctgtatccatgataccgataacttttttattatcttcttttcttaccagtccatagattgcaatgattgttccaacaccaagtgcgaagattggttcacctacaagactgatgattgtgtttgccactccttcacctgttccaaacagtccccagaatgttttaacaaaaatcaaaacaatcggaatgataatcggaagaatagatgctgtaaatgatgggagattcttctctcctaccagtttttcaacttcttccatggatttgatatattcttttttgaattcttttctttcatatccatgtccatctttattcggaatctgatagattttctttccaatatatttacagtagaatactacaacaatcagcatcggaatagagattcctgctccgaccatgatcatctgtcccacatcaactccaagcattccggctgctgtcagcggtcccggtgtcggtggtaccagacagtgtgtcagctgaagtccacaggccagtgacagtgcaagtcctacaacagagattcctgttacagaggacattgcttttacaagtggtgcaaaaataacgattgcggaatctgcgaataccgggatggatacaacccatcctgtgattgccagtgcccattcttcttttctcttaccaatcacacggataaaagtaaatgcaagctgttccgctgctcctgaaacttccaggattccacccatcataactccaagtccgattatgataccggtacttttcaatgtgtttccaaatccgtctttgatagcggtcataactccgactgtcgtttctccggctgcatttgtgatatctgcgaccggcatgcccccgatcaagcctgtgattaatgctgcgagcaataaagcaataaatgtatgtaccttcgtcttcataaccaggacgatcattatcgcaattccgatcaccagccccagcatcattctggttgattcactcatagttcttacctctcttaattctttttctcaacagatgtatcagaaatcttctcgtaatattttacgattgcactgtgatcatctttttcatttccgtctgccttaagtgactgcataatttccattacctgtgaagtaagtggaagtgctgcatttactgcatgacctgcattcagtgcattattcaggtctttgatatggagttcgatacggaatccaggtttgaagttgtgatccatcatcattggtgcttttgcatcaagtactgtagatcctgcaagacctccgcggatagctttgtatacaagttccggatctgcatcatttttcactgcaagtgtcagtgcctcagacactgctgcaatattcaatgctacaatcacctgatttgcgagctttgctacatttcctgatccaagttctccgacatatactacagatcctgccattgccattaataaatcatagtacttatcaaagttctctttgcttcctccgaccataacagaaattgttccatcgatcgcctttggctctccgccgctgaccggcgcatccattaagtcaattccctttttgttcagttctgctccgatctctttcgactgtaccggatcaatcgaactcatatcaatcacgatcgttccttcttttgctgcggaagcgattccgttttctcctaaacagacttctctgacctgaggagaattcggaagcattgtgatgatcacctgacagttctctgccacctctgccgggcttcctgctgcctgtgctccctccgctgacaattcttctacgcttgccttgcttctgttatatacaacagcttcatatcctgctttcataaggtttctgcacattggttttcccataattccaagtccgataaatccaactttcattgttcttctcctctcagatttctgatattttgtattactgctatttcaacttgttcctaatcgtctttgataattcgcgcgcttcttattgcctgccttgcctttggtcaggtaacttatctatctgacatgcttattgtacaaaactgagtacaaagattccattgacagattgttcaatggagtgtgctctgatttatgtagatttcataagttttcattttttgaattgtgtatttcatttttatttcattatgtttcgcttctgttttttcttatttgcttaaatttcaatttctttccatttatttcatcatatgtaattattatttcattttttgaaacattgtgaattctacacaaattctcacttcatttttatacataacaaaatacagtttttcacatcaaaaaaggagacagttttaaaccatctccctgtatgcattgacctgttcctatagtaattcatttccaccataattggcttctattccatactttttcattcttctccagagagttgtcgtgctgataccgagctcttctgccaccagtttccggtttccgtggaaacgttcaagcagctcctcaagttcatctgtctcctgagaacgatacacaagaatcctcttctctccatgagattcttccacatgcggaaacagttcgtcatataaattttgaagaacgacttcatcaatcatgcgttttttggctgtaagaacaagtcgttcacaaaatgaccgtagctggattccattccctgtccacttcagctcctgcagcttcttatatgctccttctgttacgctaagcggacggttgtatttttccttatatattttcaattctttatcaaaacaatttctcagatcctccgggcgttcattcaatgaaggaatctcaagtaccaggctctgcagcatataatataattcctcgctaaactctcccttttccaccagatgtttcagatttatctttgatgatcctatgattcttacatccaacgtgtcaagtggctgtgcatctgttctcatctgcgccctgcttaacattgtacgcaaaatctgatgctgtacacgcaaagtcagatgctcgactcctttaataaataaggttccgtgattcgcctttatcattgcaccctttgcaccaaaagttgaaactgtatctccggcttctcttcggaaaagctcttccatctgatgttctttatccattccccgcatattaatgctgacatatggacccactttgcggatactattattgtgaattgcttctgccaaaagataatcctctgtacctgcctgcccataaatcataactgcgtgttcagacaaggcatacattttcgcagtttcaagcatttttcgcatctgtgcattctctgtctgaatagcttcaaatttggtctgcgccgcaaatccatgcagtagcatatctccctggatatccttggtcttttttgaattgtctgccagcttctgaagagacaaaattgctcctgtaatctgattgtcatactggattggtgcaatcattgccatccaggtctttttcctgacagaaacagaagtggaatagctttcgctctttccgcttaaaatattctcgatcaagagcgaatcgattccggggagaatctccgtcagactctttccaaccagatcttcactattctttcctaacagattttcaaccagtttattgactacaatcacttttccttctgcgttcaccttgataattccattaaaggacgtatccagtactgtttcaaactgcgccgtattacgcttctcactttcagctgcataggacgcattctttgctgcaagaagggcttcttttaacgactcttccgtggattgataaaacagcgtcgaatatcccatcgtttctgctgccctgcaggttccttctccaccaatgatcagatccggtctttcctcaaaatctgcaataatgctttcagcctcttcaatacgttttagataaatcacatccagtcgtatatcaaacagctgctccatatacgacatatcacagagcatattttcaaatgcgatcaatgcaatatgtggatgctctttcttaagaatcatctttgctttctgaatgagcagaccaatctcctgtgcatgaaaacgaatctcaacaaccggaatattcgtatattctttgatcagcttcgcctgatatcctctggcaaccagaatatgggctccggcctccactgcaattcttgctttatttactgcatctaccgtatgcacagcctcaagatagaccacatccaaatgattttcttctataatttttctcgccggttcgaccatccgctcttccgggagaaacattcctattttaaccataataaatgcctccgactatgaagatacgaaggaaaattattccgtatgccattcgaacttgcagtgattctggggatttctgcattgggtataggctatgatgcatttgcaggtttagtatactggtcttttgagaactatcacccgtcaggaaatattatgtggaatacaatcagtatgctgggaatcaactggtgtatctggttctgcctactgggagttttcttctgtgtggcagagagtcttcgacttatatttacagagggaagaaattactgggaagaacacacaatagtaggaatgctgatccgttggggaaaggaaaatcgtggagaagtacatgaaaagagacatttattgaagaaagcatggaaagatatgaaagcatttttgcatcatcaatacgaagcaattcttcagatggacctgcgggataaaggaaataaaggaatcctcagaatcgtaatcctgaactttcttctgctcttagtagtgaaattattttcttacagcataggactgataccattaattgtttattctatcattttattctttgtaatgaagaaagtgctaaatggaatcaagaagaaatatcagcttctgcttaaatcaacaaatcagcttgcagaaggacagctagatcttccaatcgaaggtgatgtcggaatctttcgtccgattcaggatgaattaaagaagattcagagcggattcaagaaggcggtggatgaagaagtgaaaaatgagcgtatgaagacagagcttgtgacaaatgtctctcatgatctccgtactccgctgaccgcgatcatcacttacattgaccttttaaagaatgaaaaagacgaagaaaagagaaaagaatatacagaagtacttgagagaaaatctcttcgtctgaaagccctgatcgaggatctctttgagatgagtaaggcagcaagtaagactatccagatgaattacatgaaagtggatctcgtaggactgatccgtcaggcggagcttgagaatgaggaaaagattagagaagcacatctggaattccgttggaaacttccggaggacaaagtagttctctggctggatagtgaaaaaacatatcgaatttttgagaacttaattgttaatattacaaaatatgcaatgccgcatacgagagtttatatagaaatgaatgagcggccggatgacgtgcagatttttatgaaaaatgtttccgcaggggaattgaatttcaatacagaggagatcacggaccgttttgtaagaggagattcttcaagaaataccgaaggatctggacttggcttggcaattgccaagagctttgcacagctgcagcatggaaacttgaatattacaacagaagcagacctgttcaaggcggagatcatacttcctaaattagaaatgagcgagaaaaaagaagattaggggctggaaaatgttgtaaaagaatagtattgttagaatagatggaactttacagaatatgttaggaagaatgattcaggaggaataaaccatgagatatgaaatcaaaggtgacacccttccggtagtggtctgctatctggagaatggagaaagaatgattacagaacgcggttctatgagttggatgtctccgaatatgaaaatggagacaacttccaacggaggaatcggaaaagcatttggaagaatgttttcaggtgaggcactgttccagaaccgttatacagcaacgggaggtaatgggatgatcgcattcgcatccagttttccgggacagattgtagcacgccagattgcaccgggacaggagttgatcgtacagaagtcaggatttctcgcttcagaagaaggtgttgatctttctattttcttccaaaagaaattcggagcaggattcttcggcggagaagggttcatcatgcagagactttcgggaaatggaatagcatttcttgaatttgatggacatgtggtagagtatgaactgagaccgggacaacagattgtagtggataccggatatcttgcagcaatggatgcaacttgcagcatggagattcagacagtaccgggacttaagaatatggtattcggcggtgaaggtgtgttcaatacagttgtcaccggacctggacatgtatggcttcagacaatgccaatctccagcgtggcaggagaacttctgagatatatgccggctggaaaataaaggatgaaaaaaggacaggatactttcgaatgaaatgttagataaaatgaaagtgtcttgtccttttcactgcgtaaacagtaatgttttgcatatcagatagtgctaattatttactttctcaagattgcgcagatgcagatatacggtattcttactgattcccagcgcttcggcaatcgtgacgacggcatcctttagattaaagattccctgctggtaaagtcggaaaatgatttctttattcttatttgtgctcgatattgctgaatccatcaacacttcttgacgaacggtttgaatggtctgctcaagaagatcagaactgctctgggaaaatgtctcatgaatctgaccggagagtgtgagaccgtcagaatcagatggaatcggaacagcaaagttgcagaagaaatctgccattgttgtattcatataaaagttgatacagagcagtccgataattctgtccttctctcctttgacaggaattgtagttgacttcagcggttctccttttacatttgtggaaaaataaataacaccatggtcattttcttcatttcgacggatctgctcgagcatcttcaacgcaaggtcggtaatcggtgcaccttcggtacgtcctgtgtgatatccgttgatgaccttgattgcagagtgttcataatcttccagactgtgaaggacaatctcgtatccatttccaagataattggaaagtccatcgagtgtctgacagtatgagtgcagaatctttttgtcaagtgaagttaattttaaatttccggttggcataatcatgcgtcctttctgtctgtgtgaaagatatccagttttgttcggtcaaaacagacaaatagtatattgatggttttattttatcatggatatgctggtttgtgtgaaaaagaagtcaatgaaaaatagttaagtgaatgaaattttattgactaaacgattttaacgttatataatttcattaagaacttataatttcaataaatcaggaggtagaattcaatgaaaacaatttcaacaccaaaggcaccagctgcaatcggaccatattctcaggcaaaggtagttaacggaatgttatacgcttcaggccagatcccgatcaacccggctacaggtgatgtagatgccacaacaatcgaaggacagacagagcaggttatcgctaacatcgctgctgttcttgaaaaagctggatcaagctttgacaatgtcgtaaagacaacatgcttccttgcagatatcgctgatttcggagcattcaacggagtatacgagaaatacttcacaagcaaaccagctcgttcatgcgtagcagttaaggatcttccgaaggctgttctcgttgagatcgagatcttagctgttgtagagtaattcttatagctagtagagaaaatgaaaaaatgacactgtgctgtgaggcgaggtgtgaatagaaaaggagtccatggaaatgcgatatgtcgcataccatggactctttttgttactgttcacacaatgtgcgaccagcaacgcatctcgccattttaaatcgcctccaagcacacagaacagtcacctgaatcaatccctcaatgtctgtctatcggtaaaatctctgtcgctatttgatttctgctttctcgaaagaagaattctacttgagatggaaagaaaacagatgttctgtagaatgatatccatatctcaaacgtgtttgtatttaataaaatttagcgtagaggtctatctttttcagtgaacagaaaactgaaaatattattttggaaagtcgattgttagaagaatagtacagggacgttactgaaaacctataaaaagttatacacttctatgtttcattcctacttcaacgagtatgcttttgatgatatattcaatgtattaaatcctattgacaattaacagaaaatactactattattatgtatataaacagtttttaattgttcaaatcaatattttattgttaaaagagaggtaattccactggaagttataaaaaatcaaatcaaattttttattgaaaggggaaattatatgaagaaggttatatgtttattttccgcatttttattacttttatcatctgccataacaatatatgtacacgaaacagactctcaagattacctatcaattccaagttataacaaaacatactctacacaatcaacagataataattttttgtcactaaaagaatataatacagaatactccaatggagaaaatcctctaaaaacaaattctcaagattacctatcaattccaagttataacgaaacatactctgcacaaccaacagataataattttttgtcactaaaagaatataatgcagaatactccaatggagagaatcctctaaaaatagattctcctttaaccacccaaaatgtccctgatatatgctatttcccctatccgaaaacaaaaaccattattttaggacaataagcgggaatcctcggcaattcaattaccgagatgaaagcgcaagattgtgctggggtatatttttaccccagctaaaatcaagttgtacggttatttaatcttcccagccagataaagcagcaccgcatcctgaaatttcctcggattcagtgaacatttcttttgaatcgcattcaatttatactgcaatgtatttttatggagaaagagtcgttcgcttgtggcggcaagggacatttcttcagaaaaataaacttccagcaggtgcagttcttgttcattgagcggggcgattgtcttggctaaaaattctttctgattttccggtgtgatcgtagaaagaatcagttcaagtgtcaaatcatcaaaaataacatagtgttcagatgaaattataaggctgtgcaaagcagtttcagcagattgataggaggtatggagctggaagagtgatgtcggttttccaactgcaatatctaaaatatcgaaatgttcttttgcaaagagtttaaaaatataattctgttttttaaaatcagtttcttcgatcaaagcaataaaatcccccggataattaaatgtgtgaagacagacatgtgcctgtgcaaacatttgttgaattttctgttctaaaatagagcggtttgtaattggattttgcttatttgtgcgaataagaacaattcttttctttgtgttgagatcaatcttaaattcatgtagacaggaggtgaggtattcctgattgtcggtttcatttctgatcaaagactgaatgacaaaatgttttttatcggcctgtctgcggctgtactgatttagttcctgctcccggatcagaagattggtgatgcgttctgcgagataagcataactgcggactttatcaggtataccggtgattccgatgacggccagcagatgttcattatgataaagcggaagattgattccctgttttgtgccagaaaaattgttgtcttctgttacttccagtacagaaccggaagcagcggcctgttgtccaatctcgtgaaaggttccgacacgggatgagtctgtgctggcgagaatgataccagatggagcaataaagttgatgtcatgatcacagacatctttgattgtatttacgatttgttctgcgagttcgcggtcaattttagttatcatagaatttttattatatcctttctttcaatatggcggattacaatgtggtatgagtttgaagataatttcttcctttcattttacgtatctgttcagagccaacctccaaaatgctacgcatttcgtcggtgtggcgtatccgcttgacgaagccgaccgtgaccgcacaccaaagcagacacttcccggacgtcagttaacgaacccacaggaaatcttagctttaatgtcaaaaaggaagaaaaaacatgtctgataaatattttaccgttaatattcgggcatatttggataaagacgaaccgacatatatcggagaggaaagtctttacgacttactctccgatttttcttgtcccaaaaatcccgatgtggaatactttttattacataatgcgattgagtttaccaaaaaagatcaatctatcacttatctggtatttgatgctgaagatgcttcactggttggttatttttcacttacaataaaaccaatctctgtccgtgcttcaaatatcagcaagacaatggcaaaaaaactgtcccgtgtcagtattttggatgaagaaacacaatcctatactaccgcagcttacctgatcgcccagttgggaaagaactattctcttccaaaggaaaaacgaattcctggaaatattctactgggatttgcactggaaaccatatccagtctcaaatattccgtaggtggcgttatggagtttcttgaatgcgaagataatgaatttcttctgagcttttatacgcagaatcatttcaagccatttgatacgcgtattaccgcttctcagaataatgagccacacactctgcatcagcttttaaaatttatttgatttaaaaatgcatgaaaaaagcgacagtctgatttacattttgtatttcaggaaactgccgcttctttttcttccttattctgtttttcttccttattctgtttttcttccttattctgtttttcttcctccaactcccggaggacttcagcgccgtacttatcaatcatccgtaccagaaaatcaatgcaccgctcaaattcaatattctgttgcataagctcctcccgttattgttttgatctgagcttattttacagaacctgccggaaaaccacattgaatagaaattgattgtaaattgacacgatcaatttaaaaatatccgcattttcttgaatcgaatatatgttcgtgttatgatagatatacttaatcttaactacgaaaggggaatttctattgaatcgatgcgatttttcttctattagcacttgcttaaaaaatcatatcagcgaaagtaatcaaatgagtcagcctgattttttatacgaattatttgaagattttatggatgatccggcaaatcaggatttttctatggataatggtctggtttgtcgttggctgaccggtcaagcaaagatcagtcccaaaatatctgcctactattccaaacccagtaatcagaaaaaactggcagaaaccattcaccagaatctgcttccattgatgtctgactgcaatatggctatgcaggatatatacacattatttatacaagatgacaccatctccgatgccaaaaagaaaaatctggcttctctgtacaaaccagccagctcacgtctgctttttcttgcaaagctgatttcttttggcatggagcgacaatttatcaaacgtgatactaaaaatcaaaaattaattgccggaggtgccctgtcacccattgtgctggattatattatggacagtgaggttccgaaaccatgccgtcattttatcggaagagataaagaactagaagaattatataccatgcttgaggaaaaccgtcatgtttttctttgcggaattgccggtattggtaaaagcgaacttgccaaagcctacgcaaaacattacaaaaagcattacactaacattctatatgtagaatatacaggtgatcttcatcaggacattactgacatggattttattgatgatccaccagaaatcagcgaacaggaacggtttcaaagacataaccgttttctgcgttccctgaaatccgatactctgcttatcatagataattttaatgtcacagctacacaggacagttttctgtcagtagtattaaaataccgctgtcagattttatttacgaccagaagtaatctgaatgaatactgtacttttcaattaaaagaaataaaggatataaacattcttttccaactgacatctgcattttattcagaagcagacaagtatcgttcgaccgtcgaaaaaatcatagagaccgtacactatcatacttttgctgtagaactggctgcaaaacttttggaaaatggaatttcaactccaggtcagttattagcaaaacttcaggaagaaagagcatctctcgataatgaagataaaattaagataatcaaggatggtcaaagcagtaaagccacttattatagtcatatccatactctattttcactatatgctttatcccgaaaacagcaggatatcatgtgcaatttgtgttttcttccttacactggtatttctgcccgcatattcgccaaatggctggaactgcctaccttaaatgaaattaacgacttgattgaaactggttttgtgcagacaactacacgtcacacaatctccctgcatcctatgattaaggaaattgccctttcagagacaaaaccatctgtaagtagctgtcacatattactggattctttacagaaaatatgtttaatgcatggaattgaagtcgattattacaagaagctgtttcagacagcaggaaacatcatagaattgattgaaaaagatgatataccaaaatatctactttttctggaaaatgtttttccatatatggataattataattaccagaaaggtatgaaagaaatcattcaggaattaaaaaattttttgaagcctaaagacattggcaccgattctgaccgggcattgttactggattttcaggctactcttgaaatcaagccagaaaaagcaataaaactggaaaaggatgcacttgcccagatagaaaatatcactgctgacaatgctcgccttgtttccaaccttcatgccaatctcggtggactttaccgcatgaacggtcatcccgatcttgcaagagagcacatggaaaaaagtatctcactgcttgaccaatttaacctgcttcatataaatgacagcatacctcagattgccaattatgcaatgttcctgacagaacagcaggaacccgaaagaggcatctctgaattgcaaaaattatccggcatcatcaaggaataccattccgatgactgtctggattatgccaaagtacaggaaacccttggaaccatttatctgatgactgccaatcttccgcaagccaaaacacattttaaaagagctttcaaaatatatgaaaagatctgggctgatgaaccagaaatgattgaagcaaaatatcaggaaattcaggagttatatccacagattggattttgcattggaaaaaatctatccggtcttttaacaaaataagtacaatttacggcgggcaacttgcccgccgttatattcaactattcgtcaaataaatatacgcatcttccaaagtgatatcattatccgggacacacttctcatttggcttttctttgcttaatattttcatatgaattccattttctacatactgcttagatgaaatagaataattggcttctaacaaacgggcttcttctgcattttgtaccgtacaattccaaacacagccctttgcattttccagcaatccactcacgcttccggaatataaaaaatccccttttttcataatggcaagctgtgtacaggttgctgctaaatcttctactacatgagtggaaaacagcacagttctatcctttgaaaaatcaaccagaagattgcggatcctaattctttcttccggatctaacccagttgttggttcatcaataatcaaaaaatccggattattaagaagtgcctgtatgagtccgacacgtctcttcataccaccagataattgccgcatttttttattctgatgctctgtaagagaagtcttttccagataataggtaattctttgttcgaggtcatttctggctactcctgacagtccccccatatatacaagacattctttcaccgtaagattcggatataagtcgatttcctgtggaagataaccaatctttttctgtattttctcataatttccctcgttatacagaattccatcaagggaaaccattccttccgtttgttttaaaacagttgtaagaaccctcatcaaagtggtttttccggcaccattctcacccaaaagtccgtaaattcccttaggtatttcaagagatgccttatttactgcaactacaccatttttaaatctaactgttaaatcatttattctaatactcataatctatcctcttttctttaaagtcattggtaatactgcaaataaaaacagccccgctataaaagacacaagcgttccataaatccaactctcggacattaattgagtaggttcacaaaagctgaaagaaaacaatcccagatttccgaaaaatgaacttcccgcttttgatataagtccaatgacaattccaaataaacatccaatacctgcccacatatttcgaagcaatgtacacaaaatcacagagcatatactccaaagccagatagttccaaacattgcaatgaaatataaaagaaatatctgaatacccgaaatgccttcgtttacactgcccggtttttgccagaaaaacaaaacatatccaacacaggaaagtattaataaatataatatttgaacgcccactctctgcgatattacttttaactgctttttttgatcatacaaatgaaatacatcggcacgcttactttttacttccatcaaatatgtgtcactacaaaaaataattgttaaaaatgctattggcgactgaatcgctgaaccgatttcttcatagtatataatcggatgaatagcacacaatatcagtataaatgcacatgaataaaaaatcttatataacgacaggcagttttttagttccgttttcaatgaaccctcctccttttccagattgtaacagaaatacatactaatataactgatgaaattacaagaataatctgatttatgtttgacattttggctacatgtgtttcaaaaaatctgccagggaatcgcaccataatagagaacggtctcatataataaatatcattcttcatggtcagcatatttgaatatataatgtgtaaaaacaagattggtgctgccggaagcggatttttaaatattaatgctgtaattgtatagacacaacatatcatcaaaagattcggaacaatatagatcagagaattcacgcaaaaatcaattggtgttactggaaagcccgattctaaagacgttttcaaacacagcataaagaatataacattcaaaatcactaatactcccagcatactaatgaatccgcttattactttcccacatatatattggattgccgtaacaggctttgtatgtaataattcataggtactttttcgtgtatcctgaataaataaaaatgatagcaagactgttgcaaaaaaggccatatgcaatcctgcaaaatccgtaaattttttggcaaagtaccaggaaaaagaatgttcggataatttcctctcgatataatgattgatttcttctgctgtccccttatgaatttcaaggtcctcataagcatatattgcattataatagccatattgggattccaaaaactcagaagcagtctttacatccatattctgaatttctttcattacatgatctgcttcctgcctgctaaatccaaaaccatttttggaggtgtccattaacgtccctttgatcgtatcttcccactcccttcttctttctttatcatcagatgtgggaatgtacccatccatgacatcagcatcttccaatgctacgtcattttgtgtgatctgttcattctgtttgatataatgaatttgcaaatacgatgacagacattgatacatactggcaactataataatcaagccaatccacaaaacagggttctttaaataatcaagtatacttctttttatgattgttttcattgtatctcttcctttctttatttctttaacaacatcatacaaatcaattctcaataaattcacaacaaaaaagactaaaaccactttatttgtgatttcagccttataaagtatttttattcagctttgaaaagagcttctacatgagcaccgccttgtctggcattatatattttcaaatttcctccatgcttttcacagaaaatacgagaaatatacataccaaggccaaaatgctttaaatcatcttgtggattcttatgataaaatggctctgttactttttcctcagtatccacaaatcctattccatcatcttcaacagaaattataagaaaaccatcctttttctttatctgcaaagcaatacttttttgtgcatatcgaaccgcattttccagtaagttgtctgtcacttccatgacaagttcctcatccactttcacaatgttttgttcctgcactctttttaccttacataatttactttccttcttggacagcatggcagcttctgcctcaatcttttttgccagttccgataactctatctctgagcattgcagttccctctgttctaaatgggacatttttctcatgttttccgtgaaatgctctatacggtcaatctgatacatgcctgtttgtaagatatcaataacatcctctgtttttatactctcggcagaaacaaactctaagagcatttcctgatacccacgcaatatggaaagtggagaacgtatatcatgtgcaattgcattccgcaaagccttctcgtcatcaatcattcgccacatctttctgttgttatctgctaaatcacttcgcatcatttcaaattctttacacaaagttcccatctcatctttattttcataggacacatgaaaatccagttcattatctgcaatcatttgtgaggcatcttttagttcctgtagaggtgtctttaacttatttttataaaaaaagaataccgcaacaacactcccaacaatcgaaaaaatcagtaccgaatatgtttccataaagtcacacatttccgaaagatgatagtccaaacgattcatctgcgattgattaggtcttgatatctcaatctcgtatttctttccatattgctgaaacacgtccgtataatctgcataatcaatatatttttcccatattttattctgcatatttcctgcaaaatgaactgtaaatccagataacagaaatgctgccgttaagctgatcacaaaataaagcagaattgtttttttcagtgacaagtttcttattttttccatcggtatccaatcccccatacagtttctatgtattctttttctgaataatccgctatttttttccttatacgccgtactaattccgttatcgttctactgtccccttccgcatcatatccacagacttgtgcatatatacgttctttatcaaacacctgccctggatgcatggataagaattcaataatctgatattcaatttttgtgaactccatcctgtgtccggctatagctactattttttcagaataatcaatcagcatttcatccatgaaacggtattccgttttttgttgatgcctttcttctctctttatgtttgtgacaatccttgcttccaactcccgaagactaaatggtttcgtaatatagtcatccccacccgaaagcaacccgttaattttatcatcttcatcaactcttgctgttagaaacaaaatcgggcataacactttactgcgtatcagacgacatacttcaatcccatccatgcgtggcatattgatatccaacaaaataatatccggtttcatttttattttatttaatgcttccattccgtctgtagccgtaatggtttcatattgtttcatattaaaataactacaaagcattttcaccaattctttatcatcatcgacaactaaaatcttgtatttcatccaaaccacctccagtatccatattatacgataaaaaacaatgaaatcacaacaagagtacatgaagaatgtacgcacaatatatcttttttctcaattccagctcaatttccactcaatgtcttttacctccgattttcgtatgcttatctcacagcaaagcagtaccacaccggtatgacctgctgaatcaatcaatacgaaaacggaggtattttttatgcgagaactcaaaaacacaaaaatcatcgctgtagatcatggctatggcaatatgaaaacagcaaacaccgtcacaccaaccggaatcaaagcctatgaaaccgaaccaatcttcaccgggaatattctggaatataacggcatttactaccggattggcgaaggacacaaagaatttatcccggataaagctatggacgaagaatattatcttctgacgctaatggctattgcaagggaactgaatgtcttttccatccgtgaagcagatgttcatctggctgccggacttcctctgacatggatcagaaatcaaagagaagcttttcgttcctatctgctccagaatccagaagtccattaccgtttcaacggcaaagaatatcatctccactttgcgggatgtagcctttacccacagggatatccggctattgtaaaccaccttggaaatttcaagggaactaatctccttgcagatatcggaaacggaaccatgaacattctgtatattaacaataagaaagctcaggagagccgatgctggacagaaaaacttggtgtaaaccagtgcatgattgccgcaaagaacgctgttctggacaaattcggagtgaaaattgaagaatccacagtagaacagattctgcggtttggaacagctgacatttcagcaccatatctggattgtatcagttctattgccagacagtatgtggcagaacttttttccacgctccgcaaatatgaatataatcctgacctgatgcgcctgtatgtggttggcggcggtggatgcctgatccgtaacttcggaacgtatgacaaatcacgagtcacaatcattgatgacatctgcgccactgccaaaggttacgaatctctggcttatatgagcctgaaaaggaggggataaaccatgcagaacaatatccgcaacacaaacctgcgctttaatctggacaaagaacaacagcggagagcctgggaatatttacagacgatggacaggcaggattttaaatcttacagtcaggtaatctctcttgcactggtagattattttgaccgctactaccgcacacaggctgatccttatctggaaacaagagaacgggaagaactttttgtgaaacagattgtagatgcagtggaaaacagtctgaaacaggaattgccactttttctttccggactgactgtaggcatggcgcaaagggagccccaaatcagggcgtcctttccaacacctgaaaattcacagccggataatgatgtagactgggattttcttggagaataactgattggaggtgaacacatgacggactttctgacagcagacaccaacctgccatcttatatgatgtttccccgtttccttctggacatggaaataaacgaaactgccaaaatgctttatattatcctgctcgaccgggcaaggctttcccagaaaaatgagggctggtcagatatcgatggtcatgtgttcatttactttacaattgaagcactggcagaagttctccacaaaagccagatgacgattaaaactgctctggcagtactggaaaaacaggagcttatcttccgaaaacggcagggacccggacagcccaatcgaatttatgtaaaactcccaaaagaaaccatccactatacagacagatttctttccctaagacagacagaaaactgtcctattgacagacaggattctttccctgatacagacagaaaactgtctggtaataagaaagagataaaaaagaacaatttagcaataagagggagtaaggagccactctcaccctatggaaaatttcaaaatgtttttctgtcagaaaaagagcttgaagatatccggcagacaatccctgactggaaggattatattgaacgcttatccggttatatggcttctaccggaaaacaatatcagaaccatgcagctaccatcatcagttgggcaagacaggatcatcctgcttcccggcaaagaaattacgaaagtgaggaatacgaaacactatgacaagatttacaggaaaagcaaccgctataacaccaaacagagagcttcagcctgatgaatattttaacgaaacagaccacctgatctactgttccaaatgcaatacgccaagacaatgccggcatgaattacagggaaaggtgcttattccttccattcgctgtaaatgccagcaggaaatctttgagcaggaagaaacccagagaaaacttcatgaaaaacaaatggaaatagagcatcttaaaaccagcggcttacaggacaaagcactctatgactacactttttccaaggataacggcatcaatccggaaataaaactggcacacaattatgtaagcaactgggaagagatgaaagcaaacgcctccggacttctcatctggggtgatgtcggtactggaaaatctttttttgcaggctgcattgccaatgccctgctggaaaaaggcgttcctgtactgatgaccaacttttcccagattctgaatacccttaccggaatgcattttgaagacagaaaccagttcatcaacagcttaaaccgctacagtcttctgattattgatgatctcggaattgagcggaactctgactttgcactggaacaggtattcaatgtgatcgacagtcgttaccgcagtaaaaagcccctgatcataacgaccaatctcactttatcagagctgaataatgccgctgatatcgcacacaaacgaatttatgaccgtattctggagagatgtattcctgtccgtatcaataaccggaatatccgtcaggacaatgcaacagataatttaaaacgggcgaaaaaaatcctgttgaacaatcatgctccgaaccagaattgactcaaagaagtataacgcaatgattatttttcactgacagtggtactactatctttccttatttttcaccaagaacatgccactgtcagttatctaaaaccatagtaccaaaccaaaagattttaaaaccaaaactgcccggatacgggcataaaaaggaggtgccaggtatggcagataaaagaatcatgacaccggaagaaaaagcacttttacaggcaagacaccgccaggaagaagctgaagcaagaaatcgcaaaaaagaacgtgatgccagaacacaccgattagtccaggaaggagccattctggaaagtattgttccccatattaaagaaatggatttagattccctaaaacgggagctgatgatccggctacggggaatgtaaacgcacaagttctactcccgaagggcccgaagggcgcacttactcaccacctgataaatcaggcagtggtatccccttcggggctcgtgcgctctgccgagggctttatccgctgttgcaggcaacatcgaaaggaggtgccagatatggcaatttatcatatgcaagccaaagtcgtcagccgtggttccggtcggtctgccgttgctgcttctgcttatatgagctgtagccgcatgtacaatgattatgacggcatccagcatgactataccagaaagcaggggctgatctatcaggaggtgatgcttcctccaatggctccattggaatggaatgaccgggaacaactctggaatgctgtggaagaaaccgaaaagaccaaagacagccgacttgcaagagaatttgttgtcgcactccccgttgagttggataaagacagcaatatttctcttcttcaagattttattaaaaagaattttgtagatatggggatgtgtgctgattttgccattcacgatacagatggtcacaatccccatgcacacattcttcttactgtccgaccattaaatgaaaatggaacatggcagtataaaacagaaaaagaatatctctgtatcaaagatggggaagaaaaagggtttactgcttctgaatttaaaactgctcagaaacagggatgggaaaagcaatatcgctataaagttggaaaaaagaaagaatatctgacttcctctgttgcacaggaaaaaggatatgaacggattgataaacaccccaagagcagccgatatggcagacagaatcctatttcccaacaatggaacagtgatgaacaactttgtatctggcgggcaaactgggcagatgccgtaaataaaatgcttgcacgtaatcagataaatgctaccattgatcaccgcagctttgcagatcagggaatcaccgaacagccaaccatccatgaaggctacattgcccagaatatggaaaagaaaggcatgatagcagaccgctgtgaaatcaaccgtcagattcgtgcggataacaaaatgctccgagaattaaaagcaaaggtagcaaaactggctgaagctgtagaaaagtctattccaataatagctgaaacgttagaagcgatccgcaatcatatgatttttacacagtatcatttgctccacaatgagatgcaaaaagaagtgatccatgactggatgaatcattttaatccaatactgaataaatacaacaccattaaaaagaaactcaaagctaaagttacagagcggaaagaactgaatgtgaaaaaagagaaaaccagtattttgaatcccatccagcatataaaattgaatcagcagcttaccactgttaccgaagaaattgaagaactgaaatcaaggaaagagcagctaatcttccaggcacaatgctctaccgataaagatatgacaaatctatccaagaaatatgaccaaatgaataacaatcttgatatcctagattctcaggacatctcgctcaaaaaacagcttgaaaaagatgccgccgctttccgggaagaaaaatttcatcctgaaccagaacaatatgccgagttactggataccagaatccagatacgtcctgatttccgggataagctgattgaacagctcaaggggactttcggtaaatattatgactatcaccgtcgtgatattgcagccgatgaggtggattatctcaatgtggaggatcctgatgttttctcccatcgtgcatgggaacttaaatatcagcgagaacaggaaatgcggcgaaatcagcctgcaagagctaagaaaaagtcctatgatatggaattgtaatcatcttcgagtagataacatgctcttacaaatctcttgttcaaaaataaactcctttcaaaaaggcgtatggaaatcaaaacttccatacgcctttttatattctgctcttcaaattgtctaaaagttgactaaaaatatatcaccgttcatatgatacaataatttctttgctatctgctgttttataatcaattgttcccaaattaccaatcaaatcaaatgtcatatctgcattaacctgcaattcatcttcaagcttgactgcagacggctcatcttttagaaaaactgttaatccataaggctctgtttcagattgtatctctatactatcatatgagtatccctccggatactcttgaccgcttacaatatttataacattcgaagaatctcctacataatctgtcttatacttcgataggtcaggaatttcgtatagtttttctttttttccgcacgccgaaatcagcattattgatacggcaaccaacataattgcaagtacttttttcttcatagaaacacccccgaaagctttattcaaaaatttacgatttgagtaaaagcccaaggaactttaatgtcccttatgcttttctcttttctttcgctgtttcagttcaaacattcgctgctcttctgcctcttttctcttgcggcttttctctttacgttcctgcttgttctgttcctgttgtaatttcaacgcctgttgcgattttgtaccaatgcctatttccagcatctgcttctttgtttcccgctgcatccgtttcgaatttcttttgatatcctttacaacagtttcaacaaccggactgaatttcaaactgaaatagcacttttgaatatattcctgtacttcataatcttttggctctgcaccaaatgttacctttgccacagatagtttaccatcttcgatgcgttcaaagattcccacccaaaacggctcttcaaaaaatactgtcagctttccatttactttgtccataaaaatccctcctaaaaatgattgaacaaagaatggacaacccggaggggcaggttacttaccctatttatataggacggccgggctacctaccggctctggtacatcaaagatgtacgttgcgtttttatctttgcttttataatcaagccatgtggcacgattaacttaattctgaaacttctaagttactttttatgctaaatagcgaaaccatcaccttttgagaaaaaatttatactccacttagggagatatcatttaactcaccatttaaaaatcaatatcggtatacttatttttcaacttgtaaaatgctattattacgcttgtataatattgcatcatccaatcataccatatttctttgctataatcgttcttttgatctgcacgattatggcgaatattataaccattaactataccaaaaatcaacttatcatgttcatttttaggaacttcatactcagcatttaaagtatcttttacttcttcacgttcactttccaaaatatcggcaagaatattaatagctttctttttctgttctaaattggcatcaaaacgataatacatttctgtggctgttgctaattgctcatatactgaatcgggtaaatcagaaccgtcatattctaactgttcacgcaacgcaccgttaggtatttgcattataaatccatttgtcggttcaagataatatccctctttatatgcacgtaagatattattaatttgttcagcaaattcttccttttgtgcttcattttcaaactgatctgtttcatagttataaacaccaatatggtcgtataaaatctcaatcactgaaaacaatgtctgctcatcatattcttcaagatattgccaaattggccaaacctctttatcctgtaagcatgttgcaaaatacacttccggtgatggcaacaaacttggtggtaaaatctgctccgaatcctgcgtataaggaatttgcctccacactcctcttgtagccacttcaaaatactctttatcacaaaaatatttatatacctgtccgaaatactgtaataactcatcaaaatctatctgtagttgctttgtaagtaaaccatgtctttctgcgtaatattttttcatatttttctgttctccttatgtcaactaaaaattgccttgttcatttttaatactattttccattaatctaatcaaatcatcaatgaatgcattacagatttccccaaagtcataagccttatattcgcaggcaaattgatttgcaattacatttcttaattcatcaactttcctcatttctgtccgttcaatctaatagtattattttaccatatcacttgtttttttaccatcttcaaaagagcaatagcaaaaaagctgatcaagaatcataaccttccaatattttttctctctgcatctgttccatgtaaatagattgctttccggcacgagaaaaaattgtttgtagaaacggtaaaaagctcccgaaggagctttccacgctttaaatatacactaattcttttaagacaatctcttctgctacatttcggatattatttacagccctgacccattccatctggtcacaagctttcatttcttccgtaatgccttccttttccatcatctgacgcactagaatgtccattctctcctgtgcttcatcgtccacagcattcagatgttctgtcaatctgtcttccaacatatacagtgaatacattgccggacgatgctctttcagatacgtttttcgcatcattccatatttcccataatgcggttcttcatctgtactaacaagattcggataataaattccgtctgcgccaagtgtgtaggttccacccattttttcaaatgtgcttttcatgtgttattcctccttgaaatcagcgatgttcttagatcatcgcaaaatatttcagggcagccttgatagcatcttctttctctttcgggcattgtggaactcttgcattttctgattttggaagattatagttttctcccacttcaattccacatttgcgttttacctgagaaatatataaacttgaaaccttcaagccagattctttcagcacataatccttgatttcctgataggttgctttcaactcggcactggtggcatccagctcatccagatctaagtcgatctctatcgtgtcatctggtttttgttgggacaaaagaacaaccgtctccacatgcacactctgcgggaactgatccacacctctacacatcttgatctcgtatccattcgcacacagatacttcagatctctcgccaatgtcgcactgtcacagcttacatacacaaccttctccggctgcatcttcacgatcgtctccagcagtgtctcgtcacagccctttctcggtggatccacaacgatcacgtctgcatgagctgtctcgccattatgctctcgctcatactctgcataatattccggcagaacttcttctgccttcccgacgaaaaattctgcgttatcaatcgcattaatctttgcattttctttggcatcatcgattgcctgcggcacaatctcaactccgtaaacctgttttgccttctgggcaaggaagagggaaatcgttccgattccgcagtacagatcccacacggtttcatcacctttgaggtctgcatactcaagtgcaagtccgtatagtttctctgtttgtaccgggtttacctgatagaatgataatggggaaatctgatattttacatttccgatatagtctgtaatatatccctgtccccagagaatttcataagaatctcccataatcacattatctcttcgtgtattcggactgatcgtgatacttgtcataccctcaatctgaataagcttttcaatcagatgctctgctttcggaagtttctttccgttgaccacaagacagaccataatttcttttgtcctgaatccatagcgaatcaatgcatgccggatcagaccttttccagtcttctcgtcatacgatttgatcttgttttcacgcatatattgtaaaatgatctcgagaatctctttgttctgctctacgccaagagcgcaatctgtgtttgcaatgatatcatgtgttcttccggcatagaatcccgtgatcggattgccttctttgtctgttccaaacgggaactgtgctttattacgataaccaaacggatgctccattccaacaaccggctgcatcactgtatcgatctggtcttttgtgaacccaccgattcgttccaaattgccacgaatcttctggtctttaaacacaagctgacgatcataagacatttcctggatctggcagcctccgcatcttctggcaaatgcacactttggttctacgcgatattctgacggtgtgataactttcatcaatctggcatagccgtaattcttctttgccttcatgactttcgcttcaacgacatcaccgatcactgcgtctttgataaagagcgtgtagccatccacatggccaattccttccccgctcactccgatatctgttatttcaactgttacaatatcattcttgttcattcttttctctcttctattttactcttaattatacaaagatgttggggtcaaaaggtattttgacccctatgatacacggattgcttcgcatgcgaagcaatccgtgtatcataggggtcaaaataccttttgaccccaacatcttatgtatgaatgcggagggatgaaagcatgaagatacttctgatcaacgggagtcctaaaggtaaaagaagtaattcattaaagcttgcatacagttttattgaaggatttaaaaatggatgtacggatgatgaagaaagcatctccatcgatgaactccatgtagcttcaatgaatatagctgcgtgtaaaggatgctttgcgtgctggcagaaaacgcctggcatatgctgtatcaaggatgatatgcaaaaggttattggaaaactgattgatgctgatcttattctgtggtcttttccactgtactattttaatgtcccaggtatcttaaagaatttgatcgaccgtcagcttcctatgagccttcctttcatgagttcaaaacagaacggatacggaagcggaagtcatgactccagatatgatatggaaggtaaaaggcatgttctgatctccacctgtggcttttattctgctgttggaaactatgacagtgtattgcggatgtttaatcattttctcggcaaaggaaattatacgaccatcttttgtggtcagggagaattattccgtgtaaaagaattgtctgcaagaacagatgaatatctttccactgtaaaatgtgccggctcagaatatgcaatgaccggaacaatctctgaagaaacagatgcaatactccacacgcttttatatcccagagatgtgtttgaaaaaatggcggatgccagctggggcatcagtaaaacaaccggagaaaaagaaccggatgatcttgtatttaccaggcaaatggccgctctttataataaagatgcctacgatggaaaagaccgcgtgcttgagattcacttcaccgatttggatcacacctaccaaattcagcttaacaagacaggaagcgaagtatttactgatggacgtctttctccaactactcgcatagatacgccttttactgtatggtcagctatttcccgtggagaaatcggtggcgcagaagcattggggaaacagatgtatacggtatccggcgacttttccttgatgattgattgggataaaatcttcggaagcgcatctgtggtcaaaaaaacagaaaaaacgccgcaaaatacgattgaacagaaaaagccttccatgacgacaatgctgataccatggattacgttctggatcgctgtttctattcatccggaagtcggagctgtgataacactacttgtggtcgcaacagtaccgtttattatgagaaaacataaatttgtcatctgggatcagctctctatggcagctgttgctatactttctgcagcggcaaatataaccggaaacggagttcttccaacaaacatcggatatcttgtatttggactcttctggctgctttcatgcctgacaaaagaacctttatgcgctgcatatgtaaaatataattatgggggtgaaaatgcgcatcagaaccctctctttatgaagacaaattatattcttgccgcggcatggggcacgctatatgtactgacagcaatctggacctttctgtttaagaaagccgggtttggaaatgtacttatccttgtgaataatctgattcctatattgatggggcttttcacagcatggtttgaaaaatggtatcctgcacggatggcaagaggcaagagaaaataataattctcttgcctcttatgattctcaactacctctttcaatatatcttctgtacgcccaatctttgacaattctaagataacatctccatgtttaaatctacaactctttcaacaattccaacagttcttccttactgaaacttccactttccatttcttctccgccaataatctggtcagcaagagccatcttcttttcctgcaattttacaatattctcttctattgttcccttggcaattaatttgtaaacggttactatattctcctgtgatcatatctctcctgcacttccgttacatattattgatatctcttgcactatttatattcctggcactattacaatactgctctgcctcagtatgctttgctccattaatatttataactcaaactctttcaacagcttttcctgatattccttgtcaatcgccgctttcaatatatcttctgtacgcccaagctttgacaattcaatatttaactggttaattctgtttactccttctgttcgtccctcttctcttccttcctctattccaatcttacggccagcttcaattcctcgtctttctgcggttaacattcctatattgtaatccctgattgctcgttgtcttgtctcgtattctaatctcttcttttcatctgcacttaatttatccaatacatcatatgcttcttccaattcagaatttttctttgccatctcttcaaaatcctttcgaaccggtgaatcagggtgttgcagacccacgccttaccgcttggctactgcgccgtatttatttaactattaaagtatagcaaaatacgtgcagtacgtcaatggtgttttctttgatttttaacttcattattcaacttctacaggaatgaatgaaaatgttgtcacatcaaacaatcccatgtctgtcagcttaatctccggaattactgcaagtgacataaagcacagtgtcattaccggctccacatctccacagattccaagttcttcgtatgctttttcatgaatgtctgttaatttctgatctacccattctccgctctgatcactcatcagtccggcgatcggcattggcatgctctcgatcacttttccttccttcacaagaacaacaccaccttcctgctcgatcagactgttcacggcaaattccatctcttcatcattaactccaacaacaatgatgttatgagaatcgtgagccactgaaagtgctacagcaccttctttaattccgtatcctttcaggaatccacaagctacattccctgttccctgatgacgctcaacaacagctacttttacaagatcaacttctggatttcttacgaactctccatttgcatccaactcaatctctgctgtatctttcgctgttacaactccacccggaagaatcttgattacatttactttgtttgatttcaggttcattttaaatttctctttggagaaatcttttacgatcacacttcccttaacggaagaaatatcacattttttgatctccggcagatattttccttcttctgccaccagagcaccttctacaaatacacggtttacatggaaatctttcagatcatccagaagaacaacatccccacggtatcccggtgcaattgctcctctgtctttcaggtcaaagcattctgctgcgttaagtgttgccatacgaattgctgtcacaggatcaagaccttcctctacacagatacgcagatgattatcaagatgtccttcgtgaaggattgtcttcggctgacggtcatcagaacagagcaggcatcttctgctgttctctgctgtcacacctttaagcagtgttcgaaggttatggcatgctgatccctgacgaagcaaaatgtacattcctctctccaatcgatcactcatctcttctacggtagaacattcatgatcagctgcgattcttgctgccgcatatgcattcaattctttccctgtgattcctggtccatgtccatcaataaatttgccttcctgttttgctacaatgatcttatccagatcactgtctgccgcattgatcacacccgggaaattcatgaattcaccaagtccggcaattccttctcttgtgatcggctctttcattgcttctgcatcgatcaccgcacctgaatgctcgaatggtgtagccggtacacaggatggaagctcatatttcacatcaagcactgtgttctcagctgctttcatcatatagtccagaccagcggttccacatacatttacgatctcatgtgggtctgccataattgttgttcctccatgtggaactaacaggcgtccaatctcttcaggacttacataagaagattcaatgtggatgtggctgtcgataaatcctggcgctgcatatcttccttctgcatcaatcactttcacgccttcatactcaccgatacctgcaatctgattacctgaaaatgcaatgtctccttcctggatctttcctgaaaatacgtttacaatcttacaatttttgatcaccagatctgccggaactcttcctgcagctgtatcaataagtttctttaattccaccttcattgttgctacgtctttcacatcagaagtcctcctctttatttttcatctgaatcctctttgcttttaaatggaatcgcttcgcattcatttgaagattcttcgtctttgtctgaatcttcttcgtcatcttcttcctcgtcttcttcctcaagaaagcttttgatttttgataaacaaattttgattttcctgaacgaattttcactctttacatcggtttcatctttctctgcatccggcacaaaattctctgatgactgttcctctgtgtcctctgtaatcacaggcatcgcgattgtctcacccaaagtttcagactcttctgagctatctctgttttcggtcactgcctctgtttcagtcgccgcatttatttctgtaactccttctgtctcagccgtttcatttatttcagatgttacatctgtctcagcttcttctgtagttgcatctgtcgcaactgctccttctgcttctgtagtcagatctgcatccgtctcctcttctgtttcgtctgttccattaattccttctaacagcgcatcaactgtcttctcttcctctgacacttcttctacttctgcctctggcttcggttcgcacggcattcccactgtaaagcagcttccggatcccaggatactttctgcatccacccatccatcgtgtacttcagcaatccattttacaacagaaagtcccagtccaaaatgaccttctccggcacctaaaggatctcctctgaaaaaccgatcccatacgtgcggcagatccgtctccgaaattccaattcccgcatctgcgatcttacaggtaaattcactacctttgctttcaacaacaactttgatcagtccaatctcccggctataatcaatggaattctccagcagatttaacaacatcttccgataacagttctcatccacttctgcgtagatctccggttcaatctcatagtctatctgcaccggttcatctgcctcctgaagtctgctgatctgaccttctataattcctgttgtcagttcactgatattcatgcgttttttataagccggctggcatccctgatctgcctttgcaaaaaatgagacttcctgaataaaatctgaaagaatctgtgccttcttctgcaccagttcaatctgccagcgctgacgctgggacagtcgccaatcgccaaggcaccatgcgcttcgtgtaaggatcacactgaccggcatccacatctcctgtacaacattttctgcaaaatgtccctcctcgcgcacatcctcaagtaattcattcaatgtcagctgcagtctctccaattccgcatcagattcttccagttccaactgtctggagaaatcttttgttctacagatttccgccgctgactctgccaggtctgcagtccgtttcagaacctctcttaccagaaagtacccaattgcaagagatgcgatgaaaacgattggaagtaccaccttcgccatcgcttttgctgactgcgcatctgttccacttatcactgtagcaagaaacaacgcaatgcctgttgccacgaatatgcaccctgtatattttagtgttaattttattttcaaagatatttttttcattcgtactcctccaatggaatctctgacattccaaattagattatagcacattttaaaacagtatgttgtgaaattcttcttaaataaaaagtttttattatgcttttccgccttgtatttctctctgatttgccctatcctaaaaagtaaatatatcagcaaaaaaagatttttaaaacaatttgaaagaaggaaatatctatgaacaattcagtttctcaagaactattaaaatttcttcaaaagagtcccacagcgtttcatgcagttcaacagatgaaatcagagcttcttgcagttgattttactgaactaaaggaaaatcagcgttggaatatagaatgcggcaaacactattttgttacgcgaaatgactcttccctgattgcgtttacaatcccggaaaatggtattgacaagatgcacattctgacaagtcatagtgattctccgacctttaagatcaaagagaatccggagatcgaagtagaaaaacattatgtgaaattaaatgtagaaaaatatggtggcatgctctgtgcaccctggtttgaccgtccgctctctgttgccggacgcgttataataaaagataagacaaacggacaattcgcgagcaaactcgtcaatattgaccgggatcttgttatgatcccgaatctcgcgattcacatgaaccgtgagatcaatagcggttacaactacaacgcacaaaaagatcttctcccactttatggctgtggttctcctaaaggaacttttatggaacagattgttgaagctgccggggtagaaaaagatgaaatccttggacatgatctattcctttataaccgacaggaaggttccatctggggggcttctgaagaattcatttccagtggcagacttgatgacctgcagtgtgccttcgcatcacttcaaggttttctttccggtgagaaaagagactgtatggctgtacactgtgttttggataatgaagaagttggaagcggtacgaaacagggcgccgcatccacattcctttttgacacactgatccgtgttcacgaagcacttggatatgatggagaagattatcgtgttcatcttgcagacagctttatgatctctgcagataatgctcatgcggttcatccaaactatacagagaaagcagatccgacaaaccgtccttacctgaacgaaggaatcgtgttgaaattcaatgcaaaccagaagtactgcacggacgccgtatctgctgccatgttccgcgacctatgtaagcgggcagatgttccggttcagacatttacaaaccgctctgatatggccggtggctctacccttggaaatatttccaacactcaggttgcgctcaataccgttgacatcggacttccgcagttggcaatgcattccccttatgagactgcaggtgtgaaagatactgagtatctggtacgagctgcaaaagaattcttctgttagtaaaagaaggagcagggatttcattatgacgaaatccctgctctttattttttacaaatgctttctcagcgcgtctacataataagacgcataacgactgaaaataatatttttctttttaataataccgatcctcatcgttttatcaacatctaatggcttcgctataatactgcttccatttaatttctgatcgatcacaccactgcttactgtgaatccgtttaatccgatcactaggttaaataaggtcgccctgtctctcacctgtatactcttcgggaaatcaagcatgcttataaattcctctgaaaaataaaacgaattattatttccctgttcatagacaagatacggatatggctgtaaatcttccatagaaatcatttctttctctgccagtggatgatctttacagataaatacatgcggttctgcaacaaacatttcctcaaacttcaactgattattctttatcagcttcagaatcacatcttcattgtgttccgaaagataaagaaccccaatctcactttttccgcttgccacatcttcaatgatctcgcccgtctgtgtctctcttataataaaactatactggtctgcatcatattctttgattagatcaacaaaagcatttaccgcaaacgaataatgctggcaagacacagaaaactttggtgttcttctctctccatttccaaaatgttctttcatattgtcagcctgctctaagagcatccttgcaaaggacaatagctcttcgccttctctcgtaacagtaacgcctttgttagaccttgtaaatgcagtcactcccatctctttttcaagattatgaattgctgcactaagcgacggctgtgaaataaaaagcttttctgcagcctccgtaatattcccacaatccgcaaccgtaactaaataggttaattgctgtaatgtcatgttcgctcactccttattgaaactgatatccggtcttatcataaaagtattccccataaccatgttgagacaaatggctgtaagaaaaacataataacacctactgaaccacaaatcaaataaaaatcattaatttttgaatctgataaagttcgctttgtaaagttttcggttacaaaacgcacagtaaagtagccgatcaaagtaccgatgctatttgtaatgatatcatctatatcagttgctctgccagtaaaaagttgagaaatctcaacaaaagacgttgcaacaattcctgccaaagcaacactttttatatttctgaattctttccataacattggtaaaaagaaaccaaacggaacgaacaagagtacgttcaaacacgcattaacaaaatctgacaacatataaataaatggaatcagattcactgtaaactccgtttgcaacatcgtgatattcggaaatcccactaatgctaatactactgccagataaaatccaaagatcatataaaccatcgttcgtttccagctctgaaagaaaaacttctcatatataccccaaagcggaattataaaaactgctgctgcaacaagttcgatcagggcgttgtatattctactcattttttcctccatgaattgtattttacacaactcatagtctatcatatccggcctggttacagtagatttagacttcttaattaagtttaatttttcattaagataaaaactatatataggacacaaaattatagaaccacaaagcaacatatgatatactagcaatgttaccgcctcctatactggtacagaacggaggtgttcaccatggatttagcattatcttttattgtcgctgttgcggctggtgtagtttgccactacatcatcaaatggttagatggcgacaaatagccggtaactagcctgtggattcaaacctttccacacaagaattaggaatagaaaaaccctcggatggcactccgagggtttttcgttgctgttcactatggaatagcattatctttttgcctactggcattatagcatatgcaatttaacaatacaatatgcaattttaatagaaagtgggtatgtccttgcttttcttgtcttttcatgctatactatcacccgttacaaaaccctaaaaaaccaaggtcttacaagggtttcgccgatttccggcgtaaggtcatatacttactgtatatgccttccgcggcattcgtcaaatgtccatgcaagcatggccgcctgactcattgctgcgcgaaaatgaatcgagtgttcgtgaccttccactcgtaaaacaaaactaaaggagaactgaataatgaaaaactcaagtaacaaagtgctttacctggcacaggcagccatgattgctgccatctatgtcgtactgactgttgtcggtgcatcactggcttttggagaggtgcagatccgttttgcggaagcactgacgatcctcccggtatttactccggctgcaatccctggattgtttgtaggatgcctcatcggaaacacacttggaggtgcgatcctgcctgacattatcttcggcagccttgcaacactgattggtgccatctttacatggtctttaagaaacaagagcaaattccttgcccctgttcctccggttgttgccaacatcatcgtggttccatttgtattaaaatacgcttacatggttccacttccgattcctttcatgatgctgacagttggtgtcggagaagtgatttccgccggtgtgcttggtctgattctttacggagcacttaacaaatatcgaggaattatctttaaaaaagctttatagatttttcttatgtaacaaagggagtggctatgtgaataatttcgtttcacatagccactccccttttctaagatgggattttcatattatcatcacggttttggcgtaccacagaattcacagaatgctccggtattctctgctccacactgacatatccatgtaccgcctgtctgcggctgtgcgttagcattcatattctggttcattcccatatttccatactgggctgtgccgttcatgttctgcattccattattcattcccatgtttccgtactgagctccaccgttcatgttcggcattccgttattcattcccatgtttccgtactgagctccaccgttcatgttcggcattccattattcattcccatgtttccgtactgggctccaccgttcattcccggcattccattattcattcccatagctcccatagcggcagctcccatatttcccatagctccgcctgccatacctgacatgcctgacattccgctattcattacaggatttccggtaagcgcagccacaatctggttcgctacctgttcaatttccatgatttccatacggtctttctcatcaagacgtgaattacataatctgaaatccatgtcatcaaaccactctgttcttactttgatacgcattgtataatcatattcgtatcgatataccggcggctgataactgacagtttttccatcttttgtgtaagtctcttctctacggtcctgttgtacttccatcttacacattacaatagatgacaatggtacgatatccggattctctgtcgtatccagattatgtgctacagtaaagttgccttttgtatcgtcaataaatacattatatgtgtttgtagcaaactgacgagttacaacaaagctctgtacaagctgtttattctgctcgcggtatgccaactgacgtttaatgtcttctaccgtactgtgtctgcgctcctcaaaccaaggggacagttttctcgcacagtttttacataaattaccatcatctaactttcggtttccaagtaaaccaattttttctccacagatatcacaatttttcttatcaaataatcccatactcacatctccttcctaaattgatttttccattcctaatcttcctctactgctctttcataactttcctgtaaatgagaagcatcctcatcgttcaatcctgccattgtagatttcaatttatctttctgtgcatcgtctccaagtttcaaaattacctctatcgtttcatttcttgcaagccagtttgcatctgaatctgtaagaatatctatcataatattacaaatctcatccggatcaaagtaggttgctcttgttctccattcgtccacttcgtcttcatcaacgtaacttacataagaaatacatgtccaacaaggaacctcttctgttctcggtgtctttgacagatagcccaatgttgcccggtatgcagcctcacttgtattgtaatagaatggataatcgagccacatcctcgtcagtccttcaatacatgcatcatgtaattctacctgacctgaatcatctaaaatttcaaccaacggttcgatcagatcatcatccgcaagatatccagcactgctacatgctgtttcccgcacatattcatcttcatcgttcattaattttacgattgcttcagccatgccttcaacaccttttgaccaaggagacccgattgcatatgctgcctgctctcgaactttcggattctcatgttctgccatctttataaaaaacttcgcaaagtatggatcggagccgcagctggaaaaggactctaacgccatatacaaaacaaccgggtctgtttctttctctaatatttcctctacctttttttccagtgtttcgtatgtcgtcagattactgtccattattgaaaatccatatgcacgtacatttgaattttcactggttataagagtctcaataaagccttctgaatccggcagccatccaccctcgtcgtaaatcgtgcttactgcttcatctgttatattttcctctctttcaaattcttcatcatagtctacatatgcataggttgacacaagtgctattgcttcttcctctgttatattttccggatcttcaattctgtccaacaaatcttgtgctgtcatgttctgatattcttttcttgtgactcctgctggttcatagtcttctttcgattttttatctgttttctttacactttccgttttagcagattctttcttatcatcagatgttttttcttttccacacgcagcagctgagattataatcatcgttacaattaataaaattccgacggtttttttcttcataataacgcctcctcccttttttgattccgatttcaaatacccttgcgcatactgttatgtacactatttgttataattattattgcacctttaaagttttctgacactagcacttgtgataggtaattttctgtatgataaaaagaacattgcagaaaatctgcaatgccctctctatttcaatgtcgtaacaagtaatttactttccaacgccgccgcgatcaaatcttctttacaggaataccctgtcttcgaaatcatttcctgaaaattccaccttacccctgcagtggaacatcccattctttttgcaatttctgaataggataaccctttgatatataatcgaagcatctccagctgcctcggactgatctcatcactctgaatccagttcagctgaacattcggggaaatgtccggaaatacccttttcccttccagtgtctgatgaatgacatcaagaatttcctcatctccgtgatctttataccagagactgtctgcgcatcctgttttcgctctggcaagcacttccggatcgatcaatgatgtgataataagtacttttgtcttaggatgagcttctctgatttctttccctgctgccagtccatcatgattatgaaatgtctgcacgtccatcagtacaagatctacctttgtagaattacatacttttatggcatcattggcatctgcaattgtctgtacatgctgaaattctttattactttcaatcagatattcaaaatatttctgcatgattttctgatcttctacaattaatatgcgaatcattttcctctccctctctcgtctcaatcgtcactgtctacagtgactgtacccagcagttctcaatcttccgttcctccaagtggcagttctaacaccaataaaaacctgggagcaaatcttgtaatcatttgacctccttctctttcaacagcttctctcaaagcggaaagaccaccgccctctttacttccttctttaggattttccccgtcatttgttatacgtatcttccatccttcaagtatcttataactttgtacatacactttacttccatgtgcatgtcgtatacagttcgtaacgcactcacggattgctttatctgtgattaatgccactttagcttcctcgcagatttctccctcaatctccacagacactcccaatttctgtgcatgtcttattgtctcctgatactgtttatccggatcatcctgcgtgattccggataatatgtaaaccgattgtttcagaatttccagctggttttccatgtgatctgtttctttatgactttccagcatacgacggattgtaagaaggcttcgtccgaaactatcatgaacctgcatcttcatcttcaaagtttcctgttcgcgaatactgtcatcaatctgggcatacatttttttcaattttttatttaacacttccagcttttcattattcatacggattttttcactattataataaatctctgaaatatcaaatgctactgtctgaatatacccttcaagttctgattccgacaacatatattcctgaaacatccacactgtattatctgacagataaaagacactgctttcttcactaagcttcgtaatccctgaaattatttttccgcctcccagcacgatcttaaggtcttcataattttggagtgcctctcctgtcagctttctgcccagttctctcatttttttattcgataacacaatgcgtcccaacggatccgacacacagacaccacatggaacattatctatggtttccttaaccgaccagaaagaaatactttttcgacatacaataatttcttttctgatcaacagacaaagcaatatgagcaacagaaacataccggcaaaaagtgtccatacagggacgtcaatcatacatgacggatggtcattgtctccaatctgatatctatgatcatttaagaacacacacatcacacaaaaagaagaaaaaaacaatactcctatgcttaccatttttttcagtttttcctcacgcattattctggaaaaaagtatccacaattccaggatcagacttatttccatcagaaccattaatgtattatgcagttttacactatctgttacataattatacattctgatttctcctcgcaccttttcagacttttattgaaacaaaccattcatcctctgtttcctgttctacataaagttctggtttcttctctgtcaacactgacagattttctactcctttcactgttacagcgactttcttctgtccgtcaatctctgcaacacgcaagaaaataaattgaattacatcaattaattcttccaccatccactcaaagaaatcataacagctcaaaatactgtcatcctcaagaaagtttatttccggatcaataaaatatttcccgttgattccacatagctttaagctgtcacaggattcttccagacttcttctcaaatcttctactgtcaatttctcctgtttttctttctgcgacaggatcagattcttacgacgcttcatataagttcctaccacaacaatcttccgaagaatccggtcataaatttcttccgattctgtcttctgaagttcattgagatattgatctaacagacgtatctgatgaaatgtttgattctgtatgatgttaaacagacggttcttttcctcaattgccttcttctctgcttccttttcataagcaatctgcagtaaatgatttctttctgttaattcttcctgaagttcctcgagttctttatactgatccgatacttgtgaaacatcttctgcccaaaatgcatgaccgcctcgcaaagaaatgtgctttatctggattccatgttccagtaacagtggtgcctgttttgtgtccttgcgcatctgatcagtcattttcgggaaatctccggaacgataccgcacattccagtccccatctgtaatttctgccgtgataccgccgcccgcctgaaataattctgtgtatcgtgtatttgtcccaatcaacccacaataaatacagctttgataaattgctgacatcagtaaacagcaagatactgccatatccccaaaatatttcgttatgagtggcgttccgataacgttaccaaaattccaatacagaagcattattcccggaaaaaatggaagccaaaatcttcttttctgcggacttttactttttctgatcaaaatcacttccattgcgatcagacaaaaaatcgcccatatctgaatcccaaagaaaatcggtccgtactgataattttgatctataaacggcttcccattcggaaatgaaaatacaagctgatgaaaatcatttgtaagaactgcaacaacaaatagaattgcaggaatcacaagtgctgccgtacgtttcttcgtattcttctcttcctcttctcccattaatattgctgcattaagtccaagtgtaggaatcatcatacatggaatataatataaataccagcacgttctcaaactaagtatttctgtcataatatgatattttatacttcgaagaaaaatccagaaaaccatcagacaggcaatttcaacaaggcatcttcttatcttaggattcacaactcgcttctgcagataaatcccccaggccgtgtacaatccaagatagagacaggtgcggctctgatccaggatgatactctcaatatctgttgttttcggtatatgacgacacatagcagccagtgccacacacagcagaactaccacataagccattctttgctttttcgaatatgacatatctattcccccacatacatcacatttacaactatctttttttaagtatcacacactcccaacatcaatgcaacctaaaaacgacaggatcttcatttgaactattgaagaacctgtcgtttttattccattttctagtaactgttcagagccaacctccaaaatgctacgcatttcgtcggtgtggcgtcatgcaattgcatgacgcgcacctcgcagcaagaatgccgaggcattcttgaaaatgaaacttagaataaaaaagttcacagctggttatagatgatcagctgtgagcttttcttttgcaaaataaaaatagaagacaactcaatattttctattgacattaaaaaccaatgtgataaacttgtttatgcaggaactgttcacaaatgaacaattcactggtaaacagttcctgcgtgtgaagatagaaaggaggattacaattttgtgtgaagaacattttcatatcggtccacaggtacataaaatggatcgttccatttcaaaattacttgaggcgagagtaaaagcggaagggttggatgaagtaacccttatgcatggatggattttgcgttatctctatgaacatcaggatgcagagatttatcagaaagacatagagaagtatttcggaatctgccgttcgggagtaacgaatatcattcaggctttagagaagaaaggacttgtctgtcgtgcttcggttgagagtgatgcaaggttgaaaaaggttatgctgacagaggcaggacgcgaaagtcacgaaaagcttggagagattttcaagcgaatggacgcagaactggaagaaggaattaccgaagaagaattacaggcatttttgagagtgactcataaggttcatctcaatctaagaaaaatgagaggagagaattcatgattcgtactttattaaaagaagtaaaagagtataaggcagcatcgatcgcgacaccgattttcatgattcttgaagttttatttgagacattgatcccgtttttgatggcatcgatcattgataaaggggttaatacgggtgatatccaccacatttataaagtgggtggaatcatgatcgtagcagcatttttaggcctgcttgccggaatggcgggaggacgttatggagcaaaggcttctacaggtttcgcaaagaatttgagaaatgcaatgtttgatcggattcagacatattcgtttgcaaatattgatcatttcagtacagcaggactggtaacgcgtctgacaacagatgtaacaaatgtgcagaatgcgtatcagatgatgttacgtatgatgatgagagcaccggcaagtatggtatgtgcgatggtgatggcatttgcgatcaatgcaaggctggcaagtatttatcttgtggcagtcttgattcttggaattattttgttttttattatccgtcatgcaactgcatatttccaacaggcatttccaaaatatgacgcattgaatgagtctgttcaggaaaatgtttctgcaatccgtgttgtaaaggcatatgtaagagaagaggaagagacaagtaaattcaaacgcgcaagtaagaatatttatgatatttttgtaaaagcagagaagaatgttatctggaatgcgccgatcatgatgtttacagtttatacctgtatcattttaatcagctggtttggtgcgaagatgattgttgtggattctcttacaaccggagaactgatgagtcttcttgcctattgtatgaatattcttatgagtcttatgatgctttcgatggttttcgtcatgatttccatgagtatggcaagtatgcgccgtattgcggaagtgctgaatgaaaaaacagatattcacaatccagagcatccggtatatgaagtcgcagacggaagcattacatttaaaaatgtagacttttcttataagaaagacagtgcagagaaggttctcaaagacatcaatctggagattcgttccggagaaacgattggaattatcggaggaaccggaagtgcgaagacaagtctggtcaatctgatcagccgtctgtatgacgtcacggacggagagattctggttggtggaaaaaatgtaaaagaatatgatcttgaggtgctccgtaatcaggtgtctgtagtgcttcagaaaaatgtcttatttacaggaagtattttagacaatctccgttggggagacaaagaagcgacagatgaagagtgtatccaggcatgtaaactggcctgtgcagatgaatttatcgagcgcttcccggataaatataatacgcatattgaacagggcggaaacaatgtgtccggtggtcagaagcagagactctgtattgcaagagcattgctaaagaagccgaagatcctgattcttgatgacagtacaagtgctgttgatactgcaacagatgcgaagatccgacgtgcatttcgtgaagagattccggatacgacaaagctgatcattgcacagcgtgtatccagtgttcaggatgcagaccgtattattgtgatggatgaaggaaagattcatggattcggaacacatgatgaactgcttgtgtcagatgagatttatcgcgaggtatatgagtctcagacacagggaggcggagattttgatgaaaatggaggtgaagcataatgcgcggaccaatgggaaaaccaaagaataaagtggaaaatcctgggaaattacttaagcgtctgatggattatattttccgggattataaatttcattgcattatagtatttatccttatttttgtaggagttattgcaaatgttcagggaacaatgttcacaagagatttgattgataaatacattacaccgttcttattgtccagtgatacaccgaactttacaccgcttgcacatgcaatcggaaaagttgcttgtttttatggagtcggaattgtggcaacttatacttataaccgaattatgatcaatgtgacacagggaatgatgatgaacatgagaaatgatctgttcagtcacatggagaaacttccgattaaatatttcgatacacatgcgcatggcgatattatgtcaatctacacgaatgacattgatacactcagacagatggtaagccagagtattccgcagattatcaacagtggatttacaattgtcagtgtatttatcagtatgctgatcttgaatattccactgacagcagtgacgatggttatggttgcaatcatgatctggggaacaaagaaagctgccggacagagtggaaaatatttccttgagcagcagaagaatcttggtaaggttaacggatatattgaagaaatgatgaacggccagaaggttgtgaaggtattctgtcatgaagaagaaagtaagacagaattcaaaaagttgaatgaggatctgtttgtaagcgcagaccgtgcaaatacttatgcaaacttcctcggccctatgaatgcgcagattggaaatatcagttatgtaatgtgtgcaatcgttggaggtgcacttgctcttaaccacgtcggtggatttacattgggcggtctggcaagtttccttacatttaataaaagcttcagtatgccgatcaaccaggtgagccagcagctgaatgcgattgttatggcactcgcaggtgcggagcgtatctttacacttctggatgaaaaagtggaagtggatgaaggttatgttacattagttaatgcgaaagaagagaatggaaaactgacagaaagtgagaaacgtactggccgctgggcatggaaacatacacatcaggcagatggttctgttgattatgttgagttaaaaggaaatgttgtatttgacggagtggatttcggatacaatgatgacaaaatcgtccttcatgatgtgaagctatacgcagaaccggggcagaagattgctttcgtaggttcaacaggagccggtaagacgacaattacaaatctgatcaatcgtttctacgatattcaggatggtaagatccgctatgacggaattaatattaacaagatcaagaaagcagatcttcgacattctcttggaatcgtattgcaggatacacatttgtttactggtacagtgaaagataatattcgttttggaaagctggatgcaacagatgaagaaatcattgcagcagcaaagctggcaaatgcagatggatttatccgcagacttccggaaggatatgacacggtgatcaccggagatggagcaaacttaagtcagggacagcgacagcttcttgcgattgcccgtgcggcagtagcagatccaccggtactgattctggacgaagcgacaagctcgatcgatacccgtacagagcgtattatccaggaaagtatggaccggctgatgcatgggcgtactacctttgtgatcgcacaccgtttgtcaacagttcgtaattctgactgtatcatggtacttgaacagggaaggattatcgagagaggtacacacgaccagttgattgaagagaaaggtaagtattatcagctgtatacaggaaatgcaatatcagcgtagaagaaagtagagataaaaaagaactgaacccagataattaatgtcaatgggttcagttctttttgaaatagaaatcaacgttcagtaaaatctaaagcttcatgtgcaagtttacgttcagcttccccagcagaacggtatttcaaaagtaaattcacttcattttttgtaagaagaatgtcgttttcactattttcaattttaatacagaaatagttttttacttcaactgatgatggattctttgcattgcagtattgagtgataagcgagtcgacagaggtgtgatagatccaggatagttctgcaagaagttgaaggtttggttcacgtacaccagtttcataatttgaataagcctgatgagtgatatgcagctttttgccgatctgagcctgcgtgtagttatattgctttctcaaacgccgtagattatccgcaagttgaatatttgccatagtttcacctccgtttctatcatccgttaaggttcaaggatgtcttttccctcaatgagatattcataagaaacgtcgaagatctcagttagagctttcaattctatgtctgtaacgtaacgtttgttggtttctattcgtgtaattacatttttgtccatatcatatccgcgcaattggagtttgtaagctaaaagtctctgtgacatatggcgttgccgacgaagttcaatgagccttttgccgatcagattcttctctccggtagtaggtgttcgttttggcatagttctaatccctcctgcaaatagtgtgaacaggtttgtctcgttttttgcacttttaatgattttacatggaattgggtaaccaaatggttggaataatgagacaaatggaaaataattgtatgatttgtaatgattgatctccgaagatagtgtataatgtattccaaagatattttagagaactaggagaaaatacaccatgtatgaaataatgactgccgatgaagcaatccggctgattcgggacggagactgtatctgtgtgaattcatttgtcggaatagagaatccaattgaacttcacgaagcaatttacagaagataccagaagatgcagtccccaacacatctgacaatgatttccagtgccggttttggtgtctgggatgatgaacataatgcagaaggatacatcaaagagggtgctgtggacaagcttatctgcgggcattttggagcaatgctcagtacaaagaaactggttttagaagaccggtttgaggcatacaatcttccgcttggatgcatttcacatgcaatccgtgcacaggccggaggtctcccgggtgcactttcaaaggtgggcttggatatatttgtagatccaagaaaagaagggcctggaattaacagaattacaattgatgattcactggtcaggcatgtggaagtggatggagaggaatttctttattataaattaccgaaaattaatattgcactgattaaaggaacagcagcagaccgaaagggaaatattacttttgacgatatgtttatgtccggtgatgcgctgtctatttgccaggcagtaaaagcgaatcgcggcaaggtgatcgtacaggtagaccgcctggtggacaccccatcacgaccgagaaatgcaattattccgggctgtctggtagatgcgatcgttgtagcagaaccggaagcaagaaatgaagcctatacagcactgactggaagctttgagattccatatgaagagtggaacacatggagtgagcgtttagattctgtctcagtgaaacagtcaaagaacagtacggtggcaaatatcatcggaaaacgtgcatcgaaggaattacgtgtagatgatattgtaaatattggaatcggcattccggagatggtttctcgttttgcaagaaagagtggaatgcttgatatggtgacattgacggttgagtccggaggaatcggaggatttccggtttcaggagaagcatttggagcaatgatcggtgcggcatctgtctatgatatggcaaaccagtttgacctttatgataatggtggtctcgatgtctgctttatgggcgcgcttgaagtggataaagaaggaaatgtgaatgcacaccgtggaccgggagcgtttgccggaatcggaggatttgcgaatatcacagctaagacaccaaccgttgttttctgtttcagctttacggcaaaaggactggaagtttcacagaagaaggggattgttgaaattgagaaggaaggttctatttcaaaatttgtagatcgagtcaagagtatcagtttttctgccagacgtgcgatcgcaaatggacagaaggtactttatgtgactgaacgctgtgtatttcgcctgacaccgaaggggttgaaattgatagaagtatatcctggaatcgatgtgcagaaagatattttagatcttctgccattcgaagtggaagtatgatatagaaaatcaatgcaaaataagatgaagatttgttaaaatagttcatggacttcatcacgttaaattgatacaatttatccacaggacaacagaaaggacattattattatggaaaaaggtacaatttttaaatttcataatgatcttgatacagatcagatcatcgcatcccagtatctgcttctgccgaacttagatgagatgaagagccatacatttgaatcattggatccggattttgcgaaaaaagtaaaaccgggagacttcgtagtcggaggagagaattttggttgtggatcctccagagagcaggcaccgggtgtgctcaaagcacttggagtacaggctgtcattgcaaaatcatttgcaagaatcttctatagaaatgcaatcaatatcggacttccggtcattgtctgtaaggagcttccggatgaggtgaagacaggtgatacaatggaacttcgcatgtctgacggaacagctgaggcgaatggaaagacttattcctgtacaaagctgccggagtatatgcagaatattctgaatcagggtggactgatcgcttcactgaataaggaggactagaactatgggaatgacaatcgcagagaagatcatcgctgctgcagccggtgtggacagcgtaaaaccgggagatatccatacagtaacattggacagaatgatgagtaatgatggaacgacacatcttactgtggatatgtataataacaaattaaagaatcctcgtattgcagatccgaagaaactggtattcattgtggatcataatgtgccatcagacagtccgaagacagcggcatctcagaagaaaatgagagattttgcaaaagagaacggaattgacttctgggaaggaaagggtgtctgccatcaggttatgatggagaactatgtccgtccgggagaactgatcttcggagctgacagccatacttgttcctacggagcactcggagcgttcggtacaggtgtcggatgcacagacttcctttatggaatggtgacaggacagtcttgggtacttgttccggaatccgtgaaattcaatctgatcggagaacttccggaaggtgtttatgcaagagacctgatcctgacaattatcggtcaggttggtgcgaacggatgtaactatcaggtgatggagttcacaggagaaggagcaaagacactgagcatcagtgatcgtatcgcactttgcaacatggcagtagaagccggagccaagacaggcatctttgaggcagatgaaaaagcaatggaatacctgaaagagcatggccgtgagccgaaagctgtatttcacagtgatccggatgcgcattatatcagagagtatacaatcgatctttctaaagtggaaccggtcgtggcaaaacctgattttgtagataatttaagtccggcaaaggaagtgcgtggaattaagattgatgaagcatttttaggttcctgtaataatggacgtattgaagatcttcgtgtcggagcagaagtcatcaaaggaaagaaagttgcagataaggtccgtttccttgttgttccggcaagccagacaatttaccgtcaggcgcttaaggaaggacttcttgacattttcatggaggcaggcgcaattgtgatgaatccgaactgtagtgtctgttggggaagctgtcagggagttatcggtgaaaatgaagttctgatcagtacaggaacacgtaatttcaaggggcgtgcaggacacccaagttcaaaagtatatcttggatccgcagcaacagttacagcatcagcaattaagggcgagatcgcacttgcatctgatctgtaaggtgatgggaacaagagataatttacacagagaagaacttatatattttgaggtgaactatggataaatttacaggaaaggtgtgggtactcggagatgatatcgatactgatatcatcatcccgacagagtatcttgcactgaaaacaattgacgatatgaaacagtatggattcagtccgcttcgtccggagctggcaggacaaatccagaaaggtgatatcatcgttgcaggaaagaactttggatgtggatcttccagagagcaggcaccggagatcatcaaagcacttggaatccagtgtgtgatcgcaaaatcatttgcaagaatctttttccgcaattcaatcaacaatggtctgcttttgatcgagcagccggatctgtatgatgatatgaaagaaggcgacacaattgatgtcgtgatgaatcagcatgtagactataatggcaaagaatacccgatcgcttctctgccggagaatctgatgagcatcattcaggcaggcggacttgtaaaagctatgcgcaagctgaatggacttgaggattgagcagaaaggagagcatgatgggcgagacgattattgaaaagattatcagacataatacaggaaaggcagtaaagccgggagatatcgtgacagtcaatgttgacagatgcatgatccatgatattttcattccttttatagcagataaatttgaagagatgggatttacaaagcttcacgatccggataaagtggttttgatttatgaccacctggttccggcaagccagcaggatgacacaagacatttccacaaaggagatgaatttgtagaaaaatatggactgactcacgtacatagaagcgacggaatctgtcaccagttgatgacagaagccggatatgtgaaacctggagatatcgcattcggaacagacagccatacgacaacttatggttgtgtcggcgcattttcatccggaatcggttatacagaaatggcaagtattctcggaaccggtacaatgtggatcaaagttccggagacaatcaaagttgtgattgacggagaacttccggaaaatgtaatgtccaaggatatcattctccgactgatcggagatctccgtgcggacggagcaacttacagagcactggaattctcgggaagcacgattgagaatatgtcagttgcaagccgtatgacaatggcaaacatggcaatcgaggcaggagcaaaatgtgctcttttcacaccggatgagaagacggcagaatattgtgagattgaactcaacgactaccagaaaagccttgttggagatgaagatgctgtctatatgaagacaatgacatataaggcagaggatttcgttccggttatggcatgtccgtcccaggttgataagatcagagacgttagtgagttagagggaacagagattgatcaggtattcattggatcctgtacaaacggacgtctggaagacctcagagctgcagcagaagtactcaaagggaagaaagttgcggactttgtgaagttgatcgttacaccggcaagccgcaagatctacagacaggcactggcagacgggacgctggacattctggcagaagcaggtgcaatcatcacacatccgggttgcggactgtgctgcggaagaacaggaggaatcctttctgacggagaacgagttgtagctactaataatagaaatttccttggacgtatgggaacatctaaggtagagatttatcttgcaagcccgagaacagcagcggcatgtgcagttgccgggaagattgtgaatccggaataagataatatagaaatataaaaagctatcgattacaacaattaagatgaaatgtgttgtaactgatagcttttttaaaatgttgtaactgtttttctaattgacacctttgaatgattttgttatagttaattcacatcaaaatctcagacatatattttctatatttcatttgtctgaatgtgttatggcggatacgccacaccgacgaaatgcgtagcattttggaggttggctctgaacaatcggctgttctcgtgtgagagccgactgtttttataaaggagcttttattatgaactatattggaattgacatcggttcaacctgtgcgaagacagttgttttgaacgaaaagaaagaacttatcctggaattcgttcagccaaccggatggagcagcgtagatacagccgaggaaatccgtcaaaaactggagtttgccggaatcaatctttctaatgaatcttcccactgtgtagcaaccggttacggacgtatctctgttccttatgccgataagactgttacagagatcacctgtcatgcacttggtgccgtacatttatttcagcatcctgacctgaccgtaattgacatcggtggccaggatacgaagatcatccagattgaacagggattcgtaaaagattttatcatgaatgataaatgtgccgccggaaccggacgttttcttgaagtgatggccaacacactttcccttcgcccaaatgaaatgtttgatctggcacgcctgggttctgacacaacgatcagctctatgtgtactgtattcgcagaatctgaggtcatcggactgatcggtaaaggcgagccaaaagaaaatattgcttatgcagtagtaaattccaccattcgtaaagttgccgcccaggtcagccggatgaatggtgaaatgttcacattctgcctgaccggaggtctgtgtgaatgtgattacatccgtgaggctttatcaaaagaacttggaaaagatgttttttcctgcccggatgcccgttacgccggtgcgatcggtgctgcacttagtgcgatgaaggtacgaagataaatatccacaaaaagcacttctcagattaactcctaagaagtgcttttatacgtcttctgtttgacttaactgtttatgaacattacgtccaccatacataattcgcactacgtatactattcccgtttcatttctgcttcaacttcatctgctgaatacactctgcctgttcttttacttcaggttcgacacgtgcaaatacatttgctgttcttgctttccatttagtgaaactgcgattttctatattctctcggagtcattccataatttttttgaaaaagtctgtaaaattgtgtcctattgctaaatccaatccgttccataatttccgccactgtaaggtcagaatccaaaagaagttcccccgccttttccattgtaaatttcgtactatattcatacagagacaaccctgtatatttttcaaccgttttataaagataatcccctgaataactgaactttttctccaaatcctttctacgtacctgtccatctttttctcgaatgtaactgcttatctgatcaaacagttccctttcagatgtatttccaaaagcaaccggcgtattcgtataggcttctttatcaaacaatgcagataacatttcaatcattgctcctgcaatctgaaaatttgattttggcgttctctcctgcaggcctagtgcaattttgtcaaaacaatcatgcactacttttgtctctttcatcggaataaaatcgatataagcccgttgtgatgcctcttctttatccagttcatgtaaaaagaacttccttaccatttcatattccggtgtgagtttcccggtaaaaacacttggaaattgtagtaaattcaaaatatattcttgtgtaaactccaggaaaatcactctgcaatactcatcgaattcctccagatggcgaatattcatattcatcagacagcaacttcctttcggataaagatgtatggtattctcaatattctgatataaccttccatccgcaacatacatcaactcatagaaattatgtctgtgcatactttttccttcaagaattttgtccgattccttcttgtccatgcaaaaatatcctacatccttcggtcctataaatgtaagcacctctcttccttcttctttttccggataataggaatctaaaataaaagaaagactgtcttctgtaaaatgattttctccaaaacctttttcatacgccttcatttctttaattaaatcctgatgcatcataagacgcgtagattgaaaatacatcgtttattcctctttctgataaaaatcagttttcgtctttttatagttatcattcctgtttagcacgaatagctcttaataattgaatctgatacatataggattcaatcccctcatatatgccatttatactccatttcatattatttataataatatgaaatgatatgggtgtcaaaatttttttaccactcactagtataaccgaattgttctgttcaatagtaaaaggggaggaaaacttatgcaaaaaacagatttcaaccgtgactggaccgtgcagaaagacggctccaccgaaatacttcatgtcaatcttccagatgacgccatgatccgtgaagagcgctcaaaagagaataaaactgcaagtgcaagcgcctatttcgccggtggcaaatatatttacactaaaattttcaatctttcggaagatgaaaccagacagactctgatcttagaatttgaggctgtctatcaaaacgcaatcgtattcttaaacggtagacaggttgccgaacgtccttacggatacacaaacttttttgttgacatcactggaaaagtcattgccggaacaaatgaactgaaagtcgttgcagacaacgcagatgtcccgaacagccgatggtactccggatccggtatctaccgcgaagtgcacctttaccgttccgaaagttcttatattcgcccagaagggttgaaagtgcagattgttgatcttaatacaatccacatttttgctgatgcggttatgcagcctaatgaaaaaattgtactggaaattttcagtgacagtggcaaaattgcatctgccgaaggcacagatgtcacaattaccatcccagatgcacacctctggtcttccgaagatccttatttatatacctgtcaggctactcttctgcaaggcggaactgtcattgatactgcaaaaagctctttcggaatccgtaccctttcctggggaaaagatggattccttgtaaacaacaatcccgtccttttccggggtgcctgcatccatcatgataatggagtactcggcgcctgtggcttccatgatgccgaatttcggcgagtacgcattttaaaagaagccggatttaatgccatccgttcttcacacaaccctatttcaaaggcaatgttggatgcatgtgataaacttggtatgtacgttattgacgaagcttttgatatgtggctgatcaaaaaaaatccttacgattacgccggtgaaaagttttccaaatggtggaaagatgacattgctgccatgatttcaaaagactataaccatccttctgttgtgatgtactctattggaaacgagattacagaacttggccttgcaaccggacaggaacaagcccgtatcatgactgaattctgccatacacaggatcacacacgccctgtcacagccgggatcaacctgatgctcgcaacaatggctaaaagtaaaaaaagtatttatggcacagacgaagacggcaacgtcaaaaacagtggtaccggaggaatggatgatgctccaacctctgaatttttcaatatcatgatgaacaaaatgggcggactcatcaataaagctgccaaaaccaaaaaggcgactgccattgctgaaatcatgtccgatatttttgatattcccggatataattacgcgtccagccgctataaaattgatgcaaaaaatcatcctgaacaggcaacaaccggttccgaaacccttccacagactctttacgataactggcagcttgtaaaatccatttccactatgaccggcgactttatgtggactggatatgattatcttggcgagtcaggaatcggtaccatccagtataaagataagaaaacaaagcaacctgctgatccaggtctcattatttccggtggtgccggtatcattgatatctgtggaaagaaacgcccggaagtcggatggagtaaaatcatctggggattacagaaaactccaacaattggcgttgatccttatacacgtgcagactacttccagtctctttctatgtggcgtatcacagatgcggtagaaagctggtcctgggaaggctgtgaaggtaaaaaggcatctgtaacagtctactccgatgcagccaaagtagaactgtttgtcaatggaaaaagtgccggtaaaaagaaaacaaaaaaagatattgcaaaattcaaaaaaatcccatatgaagccggaaaaattgaagccgttacttatgactcctccggaaaagaaacaggccgcacctcactgatctctgccactggaaaaactttgataaagcttactcctgaggcaaccagtctctgcgcaaatggtcaggatctctgcttccttaatatcgatcttatcggggaaaacggaatcacaaaatcttctgtcgaccagaatctgaagatagaaatctccggtcctgcaacccttcagggctatggctctgcaagaccgaatattgaaaaaagcttctgcagtgatactttcaagacattctacggaaaatccttagccgttatccgggctggatatgaaccaggtactgtcactgtaaaagtttccggaaaaggattagacacacaaaaacttacattaaatatctgctgaaactctacagatttctaaataaaatcaagggagaacatcagaactctttttccgttctgacgttctcctttcggtcatttttctaatatagttgtgctacttgaaaatcaattgttatgttctaattatcttttctctattaccgttattatgcaattttattctaaaactccaatcgaatctgtctgtcaatccagctttcctgctttgcctcacgaacaatatcacccggcatatgtccaccaattagaaaaggagatgcaggattatgctttctcatattttctttgaccaaaacaggatttacattcgcataacagtatttacacaaatgtccgcaagtatcataggcacctatatctgtccccaaaaggcacgcacattccccatttctctgatttttctttctctttggaacttccagtctgctatggagagctgtctcaaatgtatgaacagtcatacacccggagcaatctgcaccatattgggcaagctcttctccttctgcacaaggcctcagaaccattccatactttgatgctatttttacaaatgcttttcctatcatagcccggtcttctgcccgtactgattttgcttctggaaaattgcgttccacctttttataaatatctataaagctgattacacatgtctttgtgtatccggcaagattttcagccattttttcaaattcagatatatgccactccacagaatgttttttatctataaaaatcggatcatatctccatccaatactgtctacgcccacgacatccgacaatttttttaaaccttccatcacagtttctttatccggaacgtttggctcaacatctcgtccgtaaggcgtaattgttacaaaccagtattgaccatacggttttaacttatcaagaaacggcagcattggaagagggttcttcgtgcagaatgcgatcagatccacaacttctggtgaaaggctgtatttcgtcacctgttttggattatagggattcctcacgcatacatatccatcttttatccgattcaaaaaccatttcgaataaaatgcaggtatatctgttctcattcctgtttgtattatcattttatcataccctcttttgtcactgttcactccgttcacaaccgctctttatcacaagtctacagttctttcagaatctctccaatatcttcattcatacaaacagactttctcgttatttctgcaggtgcatatgcttcaccctgattcagacacacataaaatgcatgttgaaatttgtttgtcatctgccaaaacggatattttataataccaggagtattatatcctacaccaagctccaggaacaccattttctgctttttgtgatcctgtataaatttctcgtaccgttctgctgcctggtgccatccttcatcttcaacaaatgtctgatccgatctgagattcatactcatcggcttaccgcaacgtggacaatatggaatcataccagacggaaccatacgcttaacttctccatctttcggtttttgcagttctccatcttttatctgaaatccctgactcagcaccatttttttaattgtttcttcattgtcataagtttccttatgacaaggctcactacattgaaacagaccataatctccctgtgtataaaagattctgtttttatcaaaaccggccttctggaaacaatgatccacatttgttgtcagaacaaaataatctttttcttttaccagctcatacaggttctgatataccggttttggcgcatccatatatcgattgatatagatatacctgctccaatatgcccagtgttcctctaaagtcgcatagggatagaatccacctgaatacatatctgaaaacccatactttttctcaaaatccgaaaaatagtatgtaaatctatctccggtatatacaaaccctgccgctgtagaaagccctgcccctgccccaactataactgcatctgcctgtctgattttttcttttatctgtaatatcttatccgagtaactgtttgtagagtcgttcatcttcctctttaaaaacattaaatatcacctttatctttgattttgtcttttctttatattgctttactgtctgtactgcaagctcagcagctcttttattttggaacataaacacacctgtcgaaatacaacaaaaagcaatactagtcacctcattctcatcagcaatcctaaggcatgattcataacaggatatcagcaaacgttcgtgtttctttgtcagccttccctgcacaattggtccaactgtatgaatcacatgctcacacggcagattaaacgctggagtaatctttgcctgccctgtcggttcttcatgtctctgttttatcatcatatgattgcaatagtttcgaagctgaattcctgcataggtatgaatacaattatcaatacaattatggcaaggctgatagcaacctgtcatgccgctgttggctgcatttacgattgctcccactttaagtcttgtaatatcacccttccagatatacagatcaggctgcatctccctgatatctgccaatgtgacaatccctttcttctcattttcttctgaaaggtacgcatcctgaatctgcaaaaatgcaggatcaatttcctccggcattcttatattcataagcgatcggagcagcattttctgctcacctgcatctgatggaatctgcatgttttcatattccggtcgctctttcaataattcttcgattaaatatcttcttctgtcattctgattcatttcctgatcaccgctttcaccggacagttttcataacagtttccacaatgaagacagtgctcctgtcggatgacaaaaggtgttcccttctcaatacatttctgtggacaatgtttcatacatgtgccacagccaatgcaggattccgttatgtaatatcctttttcttttatattaacattccccagaatatatgtctcccgaaagattggatttacgccaagattaaaatactccacttccgcctgatcaatacagaaaataattccgatttctcgcgtatctcccggatatacattcgcaaggtacggctgttcttcaaaaatgatatccatccattttttctgttcattctctgctactgcataaacctttcctgacaaacggatcatttctttgtatttcgtataggcaagaatctgaaccctgccatcttccattaattctttgcaaaaatttttacctctggcggtaaagaaatagagtgcattcggttcgtaatgaatggcactgatatttcgtatctgtggtgctccttcactgtccactgttgcaaacgcaagcactcccaccagttgcatcttctttaagcatgtttgtaaatccattttatcgctcctccaatatctctccggtaatctcatttcttgtcttccagcactgtggatctgccccataaaagttaccgcttgttccattggcaactgccggacatccacggcaccatgccttaagttcacatttgctgcattttacaaatttatcgtaatctctgtatttttccatctgacagatccagacgtctgccagtcggtcttcaaaaatattggctactttactgtctgtcacccttctgcatgccataatatctccattcgaagatatggtaatatgacagtttccacagttacagccaccatagatcattcctgcctctgcactctcaggaagcttaaactctcctgtttcatattcatacagcgtccacaaatgatcctttttattaaaataggtctcacatcctgccttttcatatgccttatactttgcatcacagacttccagaagttttctgtattcttccggtgtcatgcttgtgtcaacttcaccacctgtaggcacatagcgcgaaaatgcaaagacctttactttcgcttttacaacttcatcaataatatccggtatctcttccatatttgttttggataccgtactcataattacactttttattcctgctctgttcagacatccgattttctcaatcgtcaggtcaaaacttcccggctttctgaaccagtcatgcgtttctcgcattccatccaaagacatctggtatttatcgcaaccacacacctttagcattctacaaatttcatcgttcaaatgaaatggatttcccatcaatgtaaatggtatgttttttgattttaacaacaccatcagtttccagaaatccggatgaaggataggatcaccgccagtaatataaaaatatgggattctgttatacactttacagaaatcttcacagttttctaccacttctttcatctgcttccaagtcatactcttaagctctttgcagccttcacctgaaaatatataacaatgcttgcaacgctgatcacactcatctgtaatatgccactgaaaagaaaaatactgactcatcctatccaactccttccttaacttattttacttgtcagatgctccacatgctgttccgcatgccgcacttgtctcttctggcttttcacctgctccacacgctgttccgcatgctgaaccagcttctgtttctgcttttttccatccaaaaagatttaataatgacattttgttacctcctgatattttgtctgttgttatctttgttgcaagattataatatcaagagttcttaaccgacaaaagtacgcacttttttattacataggcataaaaaggtaacctattgcttcttttggtctgttacattaaaattaaatataacaataaaaaaggatgttatactaggaggcgatcatatgttaacaaaagaagaattaccggaatgtccggttgcaaccacagtttcactcatcggcagtaaatggaaattgctgattatccgaaatctgctggaacgcccttggcgattcaatgaattaaagaaaaatcttgaaggaatcagtcagaaagtattaactgattccttaagatccatggaagaggatggacttatcacccgaactgtatatcccgaagtccctcctcatgtagaatatgctttaagtgatcttggtgaaactatgcgccctattttggatgacatgaaaaaatgggggacatggtataaggagaatttttaaaagggaagctgctttcacttgcagcttccctcttctacaacatcgtataatcctcaataatcgttattcctggaatgtcttcaatgcatcaatcgtcctttggatcagttcatccagtgtccatccaagcatctctgcgcctctttcgatcacttctctggagcagccggcggcaaatcccttgctcttatactttttcttcactgactttaactgcagatcctgaacgcttttggacgggcgcatcaatacaaccgctccgatcaacccggtcagctcatctactgcataaagtaccttctccatctcatgctctggttttatatctacggtaatcgcatatccgtgacttgctgttgcgcgaacgatcttctcgtcaatcccgcgctctctcataatttcctgtgattttatacaatgttcttctggaaattgctcgaaatcaagatcatgcagaagtccgacgattccccagaattcttcttcctcgccatagcccagttctctcgcgaaataacgcatggtattctcaacgatctgcgcgtgttccaaatgaaatgcatctttattgtattctgttaataagttccatgcttcttctctggtcatatcttctcggtcctttctttgtgtaaaacagtttctttgctgtttgtttttcacatcataacacacttttcttttatatgcaattcctatctgttttgtatgttatacattctactggtctggataaataaatccaaacaaaaaataccctggaacaggatttaaaaccaatctgttccagggctacttatattctttcacttatattcttttatttgtaggttttctcttcgtctattatctgattctgaagattgggctgatcttcttataaatcaaaaatacaacaagtgatacaacaattcccttcacaaggttgaacggtgctactgcaaacataacaaatgtagaaaggcttgtaatatgtgagttaactgctgttcccataccaaccagtgcatcaatcggcattccgaatgcttttgcataagtcggaagaagtacgaatccattcacgaagcatccgatcacgatcatcagaagcgttcctgttgccattccgatcagagcgctttttcttgttctgttttttctatagatcagacctgccggtacacagaaagaacatccgataataaagtttgcaatctctccaacacctgctgttgatgttcctgtcataacaaggtttaataagatcttaacaagctctaccagaacacctgccataggtcccatcgcaaagcatcctaccagaaccggaacttcacttaaatcaatcttataaaatgtcggtgcaaacggaagtggaatctcgaacatcatcagaataattgcgattgctgaaagcattccgatctgaactaatgcctttacccccagcttcggctgaatcttcgcatctgcgtttgttagtgtctttgtctctgtactcatagtgttactctcctttttctatccgctgtctttacccaaaacagcactttttctttttgaaaaaggtaatcttcacaagaaaaaacccggaaggtttattaccttccgggattcatgttttctgctcttaatggcattctcgcaagattctcaaatagtcaggcatcctatcctgatatctcttttctgatcctgcgggcatgaatttcttctctcatccagactttactgtcggtaccggaattcccattctgtaatgccatcacagacgagtcaccagttcagccgcatcatatgcgggtcgcggactataccgccggttgggacttgcaccctaccccgaagattaaattccttttactcttactactatagcgcgctcttactaaaaatgcaaccccttttattgatatttaatatcattttgcaccgtaatcgatatcacttgtagcactttcgactaatatattgatattccttttttcctactaggtttgtcgtgttcttaataaattttttcaataatgttcattttcggttcaaaagttcatcacacttttttcacaaaatacctctatactataagtgttcttaaaaagaacactttttcataaactttttcccccttgagtcacagagatgtggctcattccttttatataaagaaaaatcctgtcttctcgacaagattttctcatacattctttatagaatacgttttctccatttttcccatagggttccctgaacatactgataagctttatcataaaccaatattgctatctgcccaaccattacagctgccaaaagcaattgatctgacactgctttctgaaacagcatcgagcggaatccgaaaagacacgggagatacaccagattaaagatcacatatttcacaagccagtaaatccccatcctatgtcccatctgtggtcttttcgcaagaaatacccagaccgcttcaattccaagaatatagaatcccatcgcagcaaatgtaattacataaaatttgttcggcgtaaccaggaatcctaataaaattgctgccagataaaaggctgcccctgtacgaaagccgaactcacgaataacaatccctacaaaaaatgccgctgctgccaacaaaaacaatgtattcgtctcgatcacgcttccaagtgccatacacacgacagtcaccgcaaggatcaaacctccaaatgccatttgttttgcttttacatgcatgagcaaagatcgccccccatacattcacacaatgtgtccgcaagccataagtcgcaacacatatttcctgtaccacaggaattctgtcctcccggtgcatagccgccaccatacggactgttctgatatcttctgctgttaaagtcgagctgattcaacagctgacggaactgcatgttatttggttccatatttactgcctgtgccgcgtgatcccttgccagaatctgatttccgattcctgcattcgcacagccactcagataataccacatcgcacttctctgctgaacctgatccaatgtattgattgcttctctataacgtctgctgttaatatagttcgcagctgcctgcagtttgggatccatcgttccatagccataaaagctgttctgatttccataagaataactttcagaagaaccatatccataattattcccgtacgaatttcctccattcgcacgctctctcatgataatatcatacgcttcctgtacttccttaaacttctcttctgcaagatctgctaacggattattcacatttgcatccgggtgatattttcttgtcagatcccggtatgctctctttatctcatcatccgacgcattcggtgacacaccgagcacatcatatggattttttgtcatcattcttttcctcacttttcttcatctgaatcttattataatgattccagactccatcatacagtatatttctcaaaatgtccacgtcaaccagacatggcagttgttcaaaacggactgtgctctccgctatcatcatccgaagaatctgttccatctgcacctcataatccggccgctttgccagttctttcaatggattgtagcgattcttctttctatcttccggcagatcctcataggcatccatcagataaatgaattttccgagatagaatcccatctttctgagcgtcttctcccagatatcctccttccagacaaaaagctctgccattaatctgccaaaacatcctgctgcccggtcaatatccatactattctcacgctcacattctccaagttccctcaaagactgctgaatcaccttgctctgccgcggatatttctctataattttctttgcttttccctgaatcaggctcttcgtcatcagacttgacactttatgatcatcctgccagtcatcttccatatgataatatgcaagcagcacattcatcgccgccgcataagatgtaatttcattccgcaacatatgttgccgcttcactggatgaaccttacagcggtattcctcatgtttcgcaattgtctcatataaagaagataacagaataactgcaaatgtcatgtcatacgtcaatgtcatctgccccataaatccataatcttctttcaatgtccggcaaagtccacaataatatgccctgtatttcttcagatcttttacttttaattccggttcacagaccgttacatatccaaacatgcaattcctttctcttctggcaattttcctgactttatctattctaccttattctttccattttgcctatcacatgtctgcaaaattaataaaattaataagtttttaattgttaacctttttgtattttgtagttgacaattaacttttcatgaattatactaacgaagaactcaatcgttgccatatttcagacaacgatgttaaagctcgcttgaaacagcgataagtattaagatctaaaggagtaaattgaaatgtcacagaatgaaacttccggcacagttgccgtagacaaccaaaaaataagaacaaaacagatggtactcatcgccctgatgactgcagtaacctgcgtcctcggaccactttccatcccgttgccattcagccctgttccgatttcccttacaaactttgcaattttccttgcaatctttgttctcggaatgaaatccggaacaatcagctttatcatctacctcctgctcggagcagttggtgtcccggtcttctcctctttccgcggaggtttccaagttctcgcaggaccaaccggaggatacctgatcggcttcatcttccttgcactgatcatgggatttgcactcgagcactttgaccgtaagctcgttcctacaatcatcggaatgattatcggaatggctgtatgttatgcattcggaactgtatggcttgccaaactgttaagcctctccttcaaagaaggtcttatgatgggtgttattccataccttccgggagatgcagctaaaatcatcattgccgcaatcgtagggccaaaactttacggtgctacacagaaaattcgatagttatattaagaacttgaaagaggacagtcactttaataataattgttattaaaatgactatcctctttttatatttttttcgaatccgtctcctcgaagcaaatactttcggtttgaataatgtaagtgaggtagcgggccggtgtccgatgcaataaagaaacttcctcacgcatcttaatcaaaccaaaatacttgcttaaccttaaatccctctcatcgtcagctgaatcctcttcttcttcagatccacactcatcaccttcacatccacaatatctccaacactgactgcttccagcggatgtttgatatatctgtctgtgatctgagaaatgtgtacaagtccgtcctgatgaactccgatatccacaaatactccaaagtcgatcacatttcttacagtccccttcagcaccataccttccttcagatctttcatctcaaggacatctgtgcgaaggattggctttggcatctcatcacgcggatcacgcgccggtttctcaagctccttgacaatatcacgaagcgtaatctcaccgattccaagctcttctgcaagcttcttataatctccgattgtaagaccaagtcctgtcagctgatgtgctgtgatagcatctgcttcgtacccttgcttcttcaacagcttttctgctgccgcataagattccggatgaacacctgtagcatcaagtggattcttaccttcggaaatacgcataaaacctgcgcactgctcgaacgctttcggtccgagtttcggtactttaagcaattcttttctgtctgtaaaacgaccgttttcttctctgtaagccacaatattttttgcgattgcactgctgattcctgagatgtaagaaagtaacggtgcagaagcagtatttaaatctactccaactttatttacgcaatcctctacaactccgtttaaagactccccaagcttcttctggttcatatcatgctgatactggccgacaccgatggatttcggatcaatctttacaagctctgcaagcggatcctgcagacggcgtgcgattgatgccgcgcttctctgtcccacatcaaatttcgggaattcttctgttgccagcttacttgcagaatagacagatgctcccgcctcattaacgatcacatactgtaccttctccggaatctctttcagaagctctacgataaactgttctgattcacgggaagcagtaccatttccaagagagatcagagaaacgtgatacttcggaataatcttcttaagcagatctttacttgcctggatcttcttctctgttgtcggtgcagtcggataaataacggttgttccgattacctttcctgtctcatcaacaactgccagcttgcatcccgtacggaaagccggatcccagccaagcacaaccttgcctgcaatcggcggctgcatcaggagctgatgaaggttctttccaaacacttcgattgccccgtcttctgccttctctgtcagttcgtttctgacctcacgctcaatagccggtccgatcagacggttgtaactgtctgcaattgtctctttcaataccggtgttgtataaggattctctgtacggatcacttttctctcaagatatcttaaaatatcttcttccggtgcttccaccttcactgtcaggaatttctctttctcaccacggttcaatgcaagaattcgatgtcctgcaagcttcgcaacggcttcttcaaactcataatacatctcataaacagactctgcctccggatccttcgcctgagaagtaacctttccttttctcattgtcgtctctcggatccaggttctgtaagctgcctcatctgaaatgctttctgcaataatatcacacgctccgctgattgcatcctttgcactttccacacctttttcttcggaaatatacgcttccgctgccttctcaagcggctcttttgtcttctgcaatgtgatcagtgcagctaatggctcaagtcccttttccttcgcgattgtcgcacgggtacgtcgtttcggacgatacggacgatacaggtcttctactgccacaagtgtttccgctgccagaatctgtttctttaattcttctgtcagttttccctgctcctcgatacttgagattacctgttctttcttctcttccagatttcttaaatacaccagacgctcatatagctttctcaattgttcgtcattcagttctccggttgcttctttcctatatcttgaaataaatggaatcgtattgccttcatcgatcagctgtactgccgcatcgatctgccagcgttttacatccagttcttctgtcagtctctgattaatatccattctttttagtcctttccactttcataggcattctgtacctgttcggtcagctcttttccgccgttcgcataccattctaccacaaaagtatcaaagtaatccactggtttctccccactgataatctgaagaaacgcttcattctccagttcttgtaattcctgcgggatttcggcatttacgttttccaaaggcagtgtctgtgcacttcgtattcccgctttctgcagttcccccactgcctcaattcttgatgcataagctgcccagccatttgccgttgtcaactgtccattcaaaaatgatttacatgtatcataataagatttttctagtccactcaattccgacacatcaagcgttttatccaacgctgcctgaatatgttccgttgtccgataaagtgcatcctcataatccacattaatattcagcggacgggccgtcggatctacattaatggaaaaatagtcattcacctctcttgctgaagcatcatttgcatatctggactgatcaaaaatagcactcacatactttgctacaatttccggatgctcatatcctttgcgtaccaccacatacatccactgatcatacgattcaaaaactgatatcttctgtgtctcattcacttgttctttgtctaaaagatacggtttccactctgcatttgaatcgacactatatgccgcactaagcggattattcggagcccaccaacgtccgtagattgctccgcaatgtccggtttttaacagattatctatgttttccgtctttctcaacaagaatctctggtcgagtatcccatcctcatatagattacgaagctttgaaagtgcttcttttgtttcctgcgttactgacccataaactacatctccactttcatccagaatccagtgacatggcattgcacctgcatgtataaacgctgaatccactccataagtctggtccgccccggcaatcacatctgtactacaggcaagaccaatcgtctgaccgtctcctgctgcatcttgttctacaaatgcacgcactatctccaacgcttcttctaccgtttccggttccttcaatcccaacttctcaatccagtctttcctcaaccagagaagtggagctccgtcatcgatcaccgtattcggaaatgcatacaactttccatcaactgttgcagattgtaagagagaatctccataactgtcatacatttctttgattgtatctgtcgtacactcttcataagtttctgtgaggtcttcaatcatacctgcttcaatcaggcggagcaggttatctcttcccttcacgacaagcacatccggaatatctcgatcttcaatcgctacattgactgcctcttcatacgtattgccatcctgcaattcaaagacatctgcatttttaatattaagcactttcttcagatatctcgtatacgcattgttttcgtacgtatttcccaccgggagattcgaattatttgctcctgcaatcttgccaagtgtatacgtgactgtctcaggatattttccaagcggcgtatgcattgcttcatacatctgttttcttttcccttcagctgcttcgcctgcaccagactcactttgagatgcatctgactgttccatctgtctttgactttcttttgattcaaaacaagttccgcaccaaagtatcatcaacaaaattaatacaagctgggctgaaagaattcgctttttcctatcgtttttcatagcacctttgcctccgtcttcttcggaatccggataaagacacgcgttccttttccaggagtgctttctatcttcatctcacctttctctccgtaaagaacatggattctgtcacagacatttcgcacgccataaccggacgactgataggtcaggatctgatctgccttttcctgcgtcattcctgctccgttgtccctgatttcaaagaaaatatgctcattttcttcacgaatcgtcagccacaatgttggatcctcattatctgacacatcgattccgtgatcgattgcattttctgccagcggctgcaggatcagcttcggtatcatataatcattaagaccgtctgaaatctgttcgaccacacggaactcgttatcatgcataaccaactggatcttgaggtatgcacggatattatcaatttcttttgccactgtagtcattgtttcaccacgattcaggcttgttctataataagtagacagtgccaatgtcacataactgatttcatcctcccccgcttcaattgctttccagttgataatagaaagtgaattgtaaaggaaatgtggattgatctgtgcctgcagcgctctcatctcactattctgaagctggatcttactctcatatacttctgagatcaaatggttcatctgatccatcatgcgctggaatgaccgaatcaacacaccaacctcatccttggacttactctgcaccgtaaccttgcgaagtcccatattgatctggttcatattctctgtcaataattccaactgtgacaccatacggatggagaaaacataccctaaaagactcaaaaggagaacactgattaaaattaacggaatatttttaagcaaaagcttatggattgcattttcacttaccgccttcggacgatagatatagaaattccatccggtatctttcattgttctctgtgaaatataatacttatcactgatatccttaagattctcaatattctttggacgatattttttatccatagaacaatccgcataaacaacatttccattatcgtccataatcatgccacctgtattatctgtaatctgactcatgaatggactaagaactttttcataatccagacgcatctccaatactgctttgatcgtatcattatcgtagaattttcgactggcaatgattgatttatttcccccacgagtaatgctccactgcatcagcgttccttcattcagtctggaataccactgttgattctccgcttctgacattggaagaagtgtatctccatgtggcacttctatattgtcagaatacagcgtaatactccgaatctctttgtgatagatggtcggcatctgaagcaacggatctgctactttcacatatttcaaatatttctcataatctgattccatttccgtatcgaaaatattcctgagactttgtgaataggataaataatcgaccagattttcataaatctgtgactggttctcaattgagttcaccgactgctccagtattttttccaggttatactgttccttttctctcagctgattcgtcatgccatattgcatagaaaaagccaggaatacaaccggcaccaatcctgcaatcaacatcaaaactgacagtttcttacggaatttcagattttcaaatcgatggagcagcttccgtatttgttttttcatccgcctctgttcctttcctgcatgcttccggtgtgtctccgaaaaattcccggaagcttctgcagaagtatgagttattggaaaatcctacttcttttgcaattccggagatcttcatattcgttgtctcaagaagttctttcgctttttccatccgcacttcacggataaagcggttcagtgtcactcccgtttcttctttgaacacagcactcaaatatccgggagaaagaaataccattgctgaaagcgtctctgctccaagattcctctcctggtagtgatgataaatgtaactttttactttcgtaatctctgaacggaatccgtcttcctgttcctgtatacagtgttcatattcctgaagtgcttcgtctactatagcgatcacatccttcaggtttttgcaacgatataaccgatccactctcttcgaaagcattttctcatccatttcatccatctgatcaagcaattcttttaaaattccggaaaatacaaactttacatacatatctgaaaactgcttattggcacggtatttatcttccaatttctgaaaatcctgacggagatggggcagatctttatattgaatatcattcgtaatctgttccatgatttcagaatcttctgccgggtctgctttcttctcttcttgcttttctccatgaaaaaataaatgctgatgtggctggtagaactgctcttctagcattccttccagggctttaaactcctctgccagattctttctatcctcaatttctttactgaccgcaaaataacattcactgtcaaactgatacgcaaagaaccgatacattttctctacaaccacatgatagtctgtatacttctccgcgaacagaaagatggactcatttgaattcagatttacataataaaattctctctgcacctcttccttcagacttgtcagaaaatgttcctcctccgtctcgaaaaaaccattggatgcactgacaagaaccatgcgcgaaagctgtgaaacatcgtcttctgtttcatccgttaatttctcaagttgaacaaaatcctcttcttttcccgaatatagatatctcaggaagaagtatttcttcagataatcttcttttctgttctgctgcttttgcttctcttccttagatgagatattttccatcactcgttgaaaggtcttatgaaattcgtttggatcgaccggctttaggacataatccacgacaccatatcgcagagcctctctcgcgtaggaaaaatcattatatccgctgaaaatcacgatttccatctccggatgatcttctcttgctgcttttgtcagttccagtccgttcatgtaaggcatctttacatccgaaaataaaatatctacatgattcgaagccagtataccaagtgcatcctttccattcgccgcttctaaaatctggaagtctccttctcttttcagcagaaaacggattccccttctctccagtttttcatcatctacaatcagtattgtaatcattcccccgcgcctcccacacgctcattttacattttcactattccttttataacgtccgaaaacagcagggaatgatcactcactctctgctgtcttttttaagtttttataattctattttaattcatctctcagccattgtctatactagcctttgttactgttcacacgatgtgcgaccagcaacgcatctcgccattttaaatcgcctttggcgatggggcgagatgcatatgcaagcattttacacctgttttatgaaattttgcttggctctgaacagttacatttcctataagcaaatctcggcagtccgccttcttccggtacttttacagaaccctggatgagaggcagtgcatagtcaatgaactgctgtccgatatcggaaccatttcctgtgatccagtctaaaggaactgttttctcctgattacagatgagatttacatcttccggagcgtaagaaatgtggtaatccgcatcgtctgtacggtggaaggcgatcatcattcctgttgttcccttcagtgcagtctgcacaccgaaagaaccggaagcaatcgcttctttctcgtctgtcgcagagagcatagcggaagaacaacgctggttgacattgagctcgatggagcgaacttttacgccaaggcggtctttcacgaggttttccagatattttccggagcctgtcagcattttatgtccgaatgtgtctacgcctacatcacttgcaagctcgcagacaaacttaccgtttccgtcattaattccttcggaaatgcagacaaccaggttggaagtatgctcgaaagctttctgaacatctgcaaggaactgttcctgatcaaatgcaacttccggaagatagatcagaaccggattgtcgccttcgaatttacgggcaaggacactggcagcagccagccatccggcatgacgtcccatgatctcaacaatcgtaacggattttttattatcataaacagaagcgtcgatcgcaatctcacgaacagtggacgctacatatttggcagcacttccgaatcccggtgtatggtctgtcaggacaaggtcattgtcgatcgtcttagggattccgatgaaacggatctcgctgtttacagtctcagcatagcgggaaagcttgcttactgtatccatggaatcatttccaccgatgtagaagaagtagccgatattgtacttctcaaatttctcaaagagctgcggatagacagcgtctgtcaggtcttccggaagtttgtaacggcaggaaccaagataagatcccggtgttgtcttgatcagttcaagctcaccgttcacttctaaaggtttcatatccatcatattctcattcaggaaaccttcgattccgttgatcattccataaattgttccaataacatcctcacgattcagtgcttcgtaaacaaccccataaaggctggcattaataactgcagttggtccgccggactgtccgacgattgcattcttcttcataaagattctcctttggtttaagttgagatagtcgatttctgttgtcaatatattctaagaactcaataatatattgatgattcgttattactatagctgaaaaaaagaaaatttacaacaataagtcgaaaagatgctataatgagcgtaaaagaaaaggaagcgacgccgtaggcggcattttaaaatggaggaaaaaccatgaaatatatttcatttgcaattccatgttataactcagaggcatatatggaaaaggcaatcaattctattcttgttgggggcgaggatgttgagatcattgtagtgaatgacggttcaaaagacggaactcaggaaatcgcagagcgatatcaggaaaaatatccgacgatcgtaaaagcagttgcgaaaccgaacggtggacacggagatgcagtgaactgtggactggagcatgcgacaggaaagtattttaaggttgtagacagtgatgactgggtagacgaggaagcattgctgaaggtccttgatacgatcaaaggatttgtaaaagatgagtctgaagtagatatggtcattgcgaactatgtatatgagaaggttggcatgacgcataagaaagtcattcgttacgataacgttcttccggagaatcagatttttaaatgggaggatatcggacatttccgtctcgatcagtatatcctgatgcactctgtaatttaccgtacagagatgcttaagctttgtcagttagagctgccgaagcacacattctatgtggacaatatttatgtatattatccgctgccacatgttcgtacactttattacatgaatgtagatctttacagatatttcatcggacgtgaggatcagtcagtcaatgagaaggtgatgatcagcagaatcgaccaacagcttttcgtaacgaagaaaatgatctccatgtatgagcttcgtctgatcggaagcaagaagctgagaaaatatatggtgaattatctggcaatcatgatgacagtttcttctattttatgcattcgctctaagaagaaagagaatttcgagaagaagaaagaactgtgggcttatctgaagaaaaaagactataggacttatatgaagatccgttatggaattcttggacagacgatgaatcttccgggaagatcaggaagaagagtgtcttcacttgcgtatacggttgcaagaagattgatcgggtttaattaaaaaaaaaattcccatgaatatttaggacaggtgaattaataaaccagtcatgacatatactgatttggatgaatttagcttttagaaaagagtaaaagatctgaagaaaggaagtatatgacatggctgttttattttcagaaagcaagacaaaacaaaatctgatgcgtgcgttcgcaggagagggacaggcgcgaaaccgttatacatttgcggcggagcaggcacggaaagaaggaaaacctgcaattgcagatattttcctgtacacagcagatcaggagcgggcacatgcgggaagatactatgaattgttaaaagaagcatcaggaacgaatatctttattgatggaagttatccggtagatgagacgaagacgctggttcagctgttgcgtgcggcagaacataatgagcaggaagaggcggaggatgtgtatccggcatttgcagatgtagcgaaacaggaaggattctttgaggcagcagcaacatttcagcagattgcagagatagaagcagcacatagccaaagattccgtaagattgcagatagcctggagaataatacgttttatatgtgtgaaaatgcggatggaacaaaaaaatggatctgtacaaattgcggtcacatctacgaagggaaagaagcacctgcattgtgtccggtatgtaagcacccacagggatattttcttcctggttttcttgatttgcacattggattttaggcaatgaggcatttcagaagtttttgaaaaaacgggcagatttataaatgaagaggaacagcaggtggcatgtgtattgccacctgctgttcctcttttattatctatatattttatgaaagttccctgtccttcccaataaagaaaagtgcaatcgtatccggtccgacatggcttccggtacagaaatcataagaagtatttataaaatcacgcactttgattttctgttggatcttgtccatgacgtaaagcgaatcttcatatgcatctgcatgtgcgatcccgagaatctgcttttctggctctacaatgttgtcacagaccagattgaccagttcgttcagtgcggatttacgtccgcgacagttcttgtaagaaacgatatagccatctttgtttccacgtaagattggtttgatcttaagaacatttccgatggtggcaacgcttcctttaattcttccggtgcgggaaagatattttaaatccccgacagtgaagactccgttcatttttccaacataatattccagagtatcagcgacctcatccacagacattcctttggtacgcatctcgcttgcatagatggcaaggattccctgggcaagtgaggcattgagagagtcgaccagacgaatcttgtgtttatctccgaattcatctaacagctcttccgaagctaatcttgcggaattgtaagtaccactgatatttttactcagtgagaaatataatacatcctggtctgcttcgagtgcgcttcgaaatgcttcctcaaaggcagcagtgctgatcagtccggttttgatttcgcagcccctgctcatggcctgatagtattcggttcctttctgacgttcttcctctggtgaaagatccgggtcaaaacaggtaatctctttgccgtcaacaagattgacgaaagaaatcacgtgaatatcgtattgttttgcagttacagccggcagattggctgccgagtcaacaaaaatctgaaacatagtatctttatccttttatccctgtttatttttgcagtaaaaaatcttagagcaataatataaattttaacactgaatgtaaaggaatgcaattaagagaaaataaaatcgatttgccttagtctagtaataaaattataaaattttagaaataataatagaatctataaaagttaatagaatgcaaaaaacaataatattcaatagtttttacattgcgatgcaaaaactattgaatattattgctttttacattatcataggtgagacgatgtggaaaatcaatactattggagatttatcaggattatctaaaacagcatggcgtggacgaagagcagattattgcaattaattttgaagatcttgattatgaggaactgacagaatataagtaattacagcgactatatgtagtcgctgaaataaataccgtagtttcagggctttcagcccagtgatcacgagttttgagaggagaaaagaacttatgaaaagaggaaaaaagattctggcattcttgctgatcattacaatgctccttccatttgtaatgaatattccagcagaagcggcagaaaaaagcaaacagttagatgtattgtttacgcatgacacacactctcatttaaacagcttttctacaattgtagatggagaacagaaagaagtcggcggatttgcgaagctaaagactctgattgacgagaagaagaaagagaatccggatacactgatactggacggcggtgatttttcaatgggaacgctgatccagacagtttatgataccgaagcagcggaacttcggatgctgggatatctcggatgcgatgtgtcaactttgggaaatcatgaatttgattatcgttccaggggactggcagacatgctgacagcggcgaagaattccggcgagacggtaccgagtcttgtcgtgtgtaatgttgattgggacagcatggaaaagaacggattaagtgaagggcaaaaacagatccagtcagcatttgaaaactatggcgtaaaggattatgtggttgttcagaaaggtgatgtaaaaatcgccgtagtgggcgtgtttggagtagatgccctgaaatgtgcaccgacctgtgaattattatttaaagatccggtcgagtcagttaagaaaacggtagaagagatcaaaaagaatgaaacggtagatatgattgcctgtgtgtctcacagcggaacctggaaggacgagaaaaaatcagaagatgagatccttgcaaaagaagtaccggatcttgatctgatcatcagcggacatacacattccgagttaaaagagcctattcagcacggaaatacttacattgtatcctgtggagaatacgcaagaaatcttggatcactttccatgacacagaaacaggatggtcgttgggagatgacttcctacgagttgattccggtatctgaagatattgagccggatcaggcgacacaagagcggatcgatgcgctgatggatacagtagatactaattacctgacgaatttcggatatacaagagatgaagttcttgccgagaatgatgtcgaattcaacagtctcgaagaaatggagacgaagcatgaagaactgaatcttggagatattatgtctgattcgtatatctattctgtagagcattcagaagactataatggaacgccggtggatgtagctgttgttccaagcggctgtgtgcgcgacacatatacgaaaggaaatatcactgtagaagatgtatataattcattttcacttggaataggaaaagacggactggcaggatatccgctgattgatgtttatctgactggtaaagaattgaaactggcagcagaagtagacgcttcggtttccgattttatgacaactgcaagattatattgcagcgggctgaatttcacattcaatccgcatcgaatgatcttgaataaagtaacagactgttatctgacaagagaagatggagaacgaatcgagatccaggatgaccagttataccgagttgtgacggatctttataccggacagatgcttggctctgtaatggaaatgtcttatggtctgttgaagatcgagccgaaggataaggatggtaatccgatcgagaatctggaagatcaggcaatcatggaaggcgataaggaactgaaagcgtgggatgcgatcgcaagatatatgaagtcttttgatgatacagatggcaacggcatttcaaatgtgccggagtattatgagacgacacatggacgtaaagttgtagatgaaagcagaaatgtgatcgatctcgtgaagaatccgaataagttttcagtgatgatcgttggtatcgttctggttcttattctgatcattattctgttggtagtattgattcgaaagttaatcaagaagagacgaagaaagaaaaaatagaagattgaatttatagaagcagcggctgaaaatggaagtttcggccgctgtttttcttaaagcaaaacattaattcagtcttttgataaaagataatggtgtcatgtgatatttggctttaaaggctctgtgaaaataagaaagattatgaaagccaacggagagtgagacttccaggatggatgtttctccatgttcaaataattctactgctttttcgagccggacattattaatatattggatgcaggtcatgttcatatgctttttgaaaaaacgcataaaatgatattcactgaaatagcaaagctctgcaagttcagaaattgtgagaggctcagcatagtggagatcgatataatcgagtacatttttcagcttatctgaagaagcagaaatagttgcagactccgtggtgctatattgaagtaggagaaacagtgcctgcaataggactgatttcagggcaatttcatatccaaatgtttgttccgtatagagtgaagccatttttataaagcattcatgaagagaatgatgtgcagggtgtgtggatgaaatatgataaggcaaggtcaattcatgatttatcataggtgtaagataacgggtggagcatatatctgttgcatttccccctaaaaagttaacatgaaacacataggtttctgagcagaaatcatcagttccattcaggcggattgaatgtaaaagcagtggtggaatgaataacagatcaccttcatttacttcatagtcaactaaatcaatttgataaatacaggaaccttttgtcatcaaagtgagttccgcttcttcgtgccagtgagtcataatgaccggggaatttaagttaagttttgtaatatatttttggatcggaaagaatacttctccatgttttgtattttctttttgctctaatatgagtgaatgtggaacgttcatacgagtcccctcctaaaatagcagtattgtgttatacaatgaaaaaataatgcaagaattcatgcaaatataatcatataatagcagtataatacaggcgatgggatctggcaatacgaaagcttatgggatcgtgacgccatattatgtggaagataaaatgatgtgaaagaggttgataatatggaaaaaaagtggtggcatgataaggtagcatatcagatatatccgaagagttttcttgatacaaatggagatgggatcggagatttgagaggtatcatatcgaaactggattatttaaaaaagcttggaattgatattatatggttatcaccaatctataaatcaccatttgtagatcagggctatgacattgcagattattatgcaatcgcagaagaatttggaacgatggaagaatttgatgaattgctggcggaagcgaaaaagcgagacatgcatattatcatggatctggtaattaatcattgttctgacaaacatgaatggtttcagaaagcattagcggatccggaaggagaatatgcggattacttctatttccgagaaggaaagaatggaaatccaccgagtaattatcgttcttattttggcggaagctgctgggaaccggtgccgggaactgataaatattattttcatatgttcgcaaaggaacagccggatctgaactgggagaatccgaaattaagacagaaactctatgatatgatcaactggtggctggaaaagggactttccggttttcgaatcgatgcgatcattaatatcaagaaagatctgaaatttcctgattttgaaccggatggggcagatggcatggccggctgctggaaaatggttgaaagtgtagatggtgttggagaacttctggaagacttaaagaaaaatacattccaaaaatacgatgcatttacagtgggagaggtcttcaatatgaaagcggatgaattaccggaatttattggagaaaacggacatttctcaacaatatttgactttagtgcacattgtctcagtgatggagaacatggatggtatgatgctccgaagatggaattttctaaatggagaaaagcaatcttccagtctcagatggaaacacagaagtatggatttaaagcaaatattatagagaatcatgacgaaccgagaggtgtgtcaagatttcttccggcttatgcccagacaccggcgggaacgaagatgcttggtacggttaatcttcttctcagaggaattcctttcatttatcagggacaggaaataggcatgaaaaatgcgaagtggaacagcattgacgaattcgatgatatcagtacaaaagaccagtatcagattgcccgtgaagctggattatctgaccgggaagcaatggaagcttgtaatcggatgagccgtgacaatgcgagaacaccaatgcaatggacaagcggggagaatgccgggtttacaaaaggaacggcatggttaaagacaaatcctgattacaaagagatcaatgtcgaagatcaggaaaacaatccggattctgttctgaattattatcgaaagttagtagcactgcgcaaatcagatgattttaaagccgtatttacatatggagaattcattccggaatatgaagaaatggatgacatcctggcattttatagaacagacgcagcaacaagtatttttgtcgtggctaatttcggaacagatgcagcaagcattgaattgaaggggaatgtgaaaagagtattaatgtcgaaccagaagaacgagacagtagattatacaaagaacaggctgaatctgaaaagctgtgaggtggttgtcttagagatgaaaatggaataatctgcgaaattacttcataaaacatagaaataagagatgaagtaaggtgcagccttcgtgagccagaaaatagaaaatcaattgaatcttgcattaagtatcacagaagaagaacgtcagaaaagcgagagtctggatatcggatatgatctggaagaaaaagaatgggaattgatcgtgaagtattccgggacgttagagcgagtaagaacacgagctgtttatgtgacggaactgacaggtggatatgccattatccaaataaaagaaagtcagataaaagaactggcagcatttccagaagtagaatttatagaaaaaccgaaaagtttatattttcaagtagagaatggaaggcgtgtgtcctgtattgatgaagtacaggctgcgtcttctttttcttcgattgggcaagaaggggtagaggataatcagcagaaaaaacagtcatttccactgctgggaaaggacgtattgatcggaattgtagacagtgggattgattatgaaaatcccgattttagaaatgcagatggaatgacaagaattcttgctttatgggatcagacgttacaaaacggtaaaccgccgcaaggatatcatatcggaacagagttcacttcagaacagataaatgaagcactacgcatggaagtcagggaagaaaggtatcgcatagtaccaagtcgtgataccagtggacatggaacagcagtagccgggattgcggctggaaatggaaggggtagtaagaatggaaaatatcggggagttgcacccgaagcagggctgctgattgtaaagatggggggagcagggaaaacaggattcccaagaactacccagctgatgcgaggtgtggattatatcgtacgaaaagcggaagagttaaaaaagccggtggcgatcaatatcagttttgggaatacatatggttcccatgatggaacaagtcttttggaaagatatttgaatacagtatctgaacgttggaagaatgtgatttgtgtaggaagtggaaatgaaggaacgactgcgggacatgcggcaggtgaatatagaaaaggaatgatggcagaagttcaacttgcagtacagcagagggagaagtcattcagtctgcaaatttggaaatcttatgtcgatgaagtcacaattacaattgtcgatccatccggaaatcattccggcagactggaagaaaaagaaggaacacaaagaatacagattggtgaaacagaactcctggtttactatggagagccaaaaccatatagtattcgtcaggaaatttatattagttttctaccacgaaatgaatttgtcacagccggagtgtggaaaatacagatgatgccaggacaggttgtggataagttgtggcaaatgtggcttccggtacagaatgcacttaatatcggtactgcatttttaaagccagacagttccacaacacttacgataccttctactgcatctcttgttattactgtggcagcgtataatgcattgaccttttcttatgcagacttctccggacgaggaccgacacagatatatgagggggaaaatgcgaacaaacctgatctggcagctccgggtgtgagggtaatggctccggtagcgggcggaggatatgcagagttcacaggaacttcatttgcaacgccatttgttacaggaagcgcggcacttttgatggagtgggggattgtgaaaggaaatgatccgtatctgtatggagagaaagtgaaagcatatttgcggagaggggcgagacagattcccgggtatgagaggtggccgaatggggagttggggtatgggaggttgtgtattgttcaaagcatccctggtatgtgaaagttaaatgtattcatctgaaatatttacaatctgtgattttcgaagaagaataccttttgtaatattcacaaatttcttcaaaatacaataaaacttttcaaaattcattttaagctcttgataatagatgattattttgaacttaaattaatatattgaaaaacatctaaaatttgtatgtgtttactcattttaaatccataaagatattgctgtttaagcgtatttatgttaaaataaaaaaagctaatttaggtttgaaaaagaacagaaaaaaagtaattactttgatcgtcgctgcattggcatttaccatgactggctgtggccagttcaaccgcaatttcagtatcggaattaacagcggaaagcaaaccagctacccagtatacgattgatgcaaatcaggaagtttatgcattgctggattttgaagatactgcggagtttgagaatgcgaccaaaggtctgcttgcttctccggatacagcgaatcccagcctttggagagatacacagctgaatcatatttatggcctttttgaagtgactgatggaatttatcaggtgcgtgacggaaacgcatgggcagagtatatcatggaatctctggctctttatggtgataaggcagatgtagtattccagtcccataactggtcacattggggaaatgataccattcaggaatatatgaccaatactgcagctgtatataagtttattaacgaccagacattgctttatattaatgaaggttatacggaaacagagattgccaatatgatccagcttccaaaggaactggagaaagtctggtatacccgtcagtattacggtacagtttctcataattcgaaggcagtatatgagaaatatatgggctggtatgacgctaatcctgtccatcttgctgaacttacaccatcggattatgcccaaaagctggtagaatatttcggtgatacagatgctgttcagaaaaacgcagagaatgttgctgctttgatcgaacaggagggtgatgagacctgcctgacacgattgatggatgcggttactgttacgtcagagtataaatattttaatattattgaaccataaagttttggggcggaagcaggaggatatgaatatgaaaagatttgcagcatctgttgacagtgagacagatgaaaatatatgggagacagtggaagatgcttatgtttatgcatttccgctggtgctcatggatgcaactgagacctcggcaacgaacacagaggaagttgttaccaaaaaagcacctgtaaatcagtttatacacagtgttgcactggcagatgcacaattcaggactgtggtgactcctaatgtggatacgatctattcacaggtctggtatgatctgagcgaggagccgatggtctatgaacttccaaaaacagatcgtttttgtaaggttcaggtactggatggatggacaaatactgctgcggttcttgataaggctggtgcatatgcaattactctttctacgtgggaagggaaactgcctgagggagttacccgtatagatgttcctacatctatggcatggtccattaccagaatcgttttatcaggagaagaggatcttccaaatgtgtatgccatccaaggaaaaatgaaacttatgccgctttccgattatatatccggagacacttatgaacctccgaggggaagctacagcgaagagaatgattatattcctgttgataaggtcctttccatggatccgatcacattttttaataaggccaatgagttgatggtaaagaattctccgacagctgcagataaggaaatgcttgaaaaaatagcagctgtgaatataggtcctggtatggaatttgacatttctgttcttaccggtgatgttgcagaaaactggaagacaatgctgacagaaattcagctaaagcttatcaaagagggccagaaattctcaaaaaagcttggtcagtgggattattttggtgaaccgatcggagatttcaatacagaatacgcttatcgtgcactggtagctcttgcagggcttggtgctaatacagttgaagttgcgctgtatccaaagatagagcaggatgcggatggaaatactctcacaggagaaaaatcatatattcttcatttcgaaagctatccgcaggttcttgaagggggattctggtctgtgactgcatatggggacgatgatttcctgatcgataatcctattgatcgttactgcataaatgaccgttccggtttacaggcaaatgatgatggttccgttgatgttattctgtctgaagatgccccaaaggacactacaaactggcttcctgtgggtgttggaggtttccatctgtttatgcgtatctatacgcctgatatggaagccttggagacgtggatggcaccgaccattacagagatttatccatcaaatgtgaactaaatattttcacattgtacagaaagaggattgattcttctgaaaaatgtgctagaataaagaaaagacgaatattagataccagagatttgagcaaggtagatgaaacgacaggcagtcgttttatttgccttgctttttttgtgtgataaaggagaggaatggatatgtttgatgttgttattattggtgcaggagtgacaggcagcgcgattgccagagaggtttccagatataagttgaatacgtgtgtgattgaaaaggaagaggatgtctgtaatgagacatccaaggcaaacagtgcgatcatccatgcgggatttgatgcagttccgggaacgatgaaggcaaagttaaatgtgatgggaaatgcgatgatggacagaatcgcagaagagcttgacattccatttaagagaaacggctctttggttgtatgtacgaaagagcaggatccggaaggacttcaggttttaatggagagaggtaagaaaaatggagttcctggacttcagattttagacagagagactctgattgagaaagagccgaacctggcagatgatgtgacatgtgcactgtgggctccaaccggaggaatcgtttgtccattccatatgacaatgggatatgcggaaaatgcatacgagaacggtgttcggtttttcctgaatacaaaagttgaaaaactggaaaagacaggagaaggatttagagttcaggttcatcacgcagataccggtgttgatgagacaatcgagacaaaatttattattaatgcagcaggagtttatgctgatgagatcaataatcagctttcagacagaaagcttcatatcacagcccgtaaaggggaatacatgcttttggataagacagttggagattatgtgaagagtacaatcttccagcttccgtcgaaaatgggaaagggagtactggtcacaccgacagttcacggcaatctgcttgtaggtcctacagcagtaaatgtagaagataaaggtgctgtaaacacgacaatggatggtctggatcagatcgcaagagtttcctctcatagcgttaagaatgttccgcttcgtcaggtgattacttcttttgcaggtcttcgtgcacacgaggatggagatgactttgtaattggtgaatcagcggatgtaaaaggactgatcaatgcagcaggcattgaatctccgggactttcttcagcaccggcaatcggtgttacggttgcagaacttgtaagagaccttttgaatgcagaagaaaagtctgattttaatccggtgagacatgggattttagatccggatacgctttctctggaagagagaaatcagctgatcaaagaaactccggcttatggaaatattatctgccgctgtgagatgatcacagaaggagaaatcctggatgcaattcaccgtccgcttggtgcacgctctctggatggagtgaagcgccggacaagagccggcatggggcgttgccaatcaggattctgttccccgaaggttatggagattttggaaagagaagttccgatgccggttgatcagattggaaaaaacggcgttggatcagaatttatcgtaggtgaaaataaagaactggaggatgagtaaaatgaaaacatatgatttaatcataattggtggaggtcctgcaggacttgcggcagcagtcgcagcaaaagataacggaattgacaacattttgattttggaaagagataaaagtctcggaggcattttgcaacagtgtattcataatggattcggtctgcatacatttaaagaagaactgacaggaccggagtacgcagcacgttttattgagcaggtagaagaacgtggtattgaatataaattaaatacaatggtcatggacatttcaccggaaaagctagtaacagccacaaatcgtgaggacgggattctgcttcttcaggcaaatgcaattatcctggcgatgggatgcagagagcgttccagaggagctttaaatattccaggatatcgtccggccggaatttattctgccggaactgcacagcatctggtaaatatggaagggcttatgccgggaaaagaagttgtgatccttggatccggagatataggtctgatcatggcgagacgtatgacacttgaaggggcgaaggttaaagtggttgcagagctgatgccttattccggtggtttgaagagaaatatcgtacagtgtctggatgactttgagattccgctgaagctgagtcatacagtgatcgatatagaaggaaagcatcgtgtagaagctgttacgatcgcagaagtcggaccggaccgcaagccgattccaggaacagaggaaagatatacttgtgatactttgcttttttcctgtggactccttccggaaaatgagctttcaaaaagcgcaggagtagaactttcacaggttacttcaggtccggtcgtaaatgattcactggaaacaagtgtggacggcatcttcgcatgtggaaatgtattgcatgtgcatgatcttgtggattttgtatctcaggaggcagcgacagcaggaaagaacgcagccacttatataaaggcaggagaaaaggacgtgcaggcagaaatgcttccgatttctccggaaggcggagtgcgctatactgtaccatcctttgtaagaccttccgaaatggaagaaaatctgatcgttcgtttccgtgtcggagatgtatttaagaataagtcgattgcagtgtattttgacgatcagctgatcagcaagaagaaacgtcaggtgatggcaccgggtgagatggagcaggtaatcctgaagaaaaagaaactggaagaatacccggagacaaagaagatcatgattcggatcgaggaggcataagaaaatgagtgagagagaattaatctgcatcggatgcccgatgggatgtccgatcgttgtaaaaatggaagatggaaaagttacatcggttacgggaaatacgtgtccacgtggagaggcgtatgcaagaaaggaagtaactgatccaacgcgtattgtaacgactacagttcgtgtcgcagacggaaaagtgccaatgatcaatgtgaagacagagtatgacattcccaaagataagatttttgactgtatcgcagcacttcgcggcgtaacgatcaaagctccggttcacattggagatattgtgttggaaaatgtggcaggtacaggtgtaaatatcgtagctgccggaaatgtggatgcagtacactagacgattgtgaaggagatatagtataatttatgaaacagatgccagatacaagtactgttgttcacagtttctgtgtctggcattcatttgatcttggcggaacaaaggagaattgaaatgaattataaatttctggatgcgttggaggtatcccctgtgattgcagcggtaaaagatgatgaaggagtagatgcctgtctgaaaagtgaaagccaggttgtatttattttatatggagacatctgtacaattccggagattgtttctaaagtaaaagcagcaggaaaactggcggtagtacatctagacttgatccatgggctggcatcgaagaacattgctgcagattttatcaaaaaatatacagaagcggatggtgtaatttccacaaaaccgacgatcattcatcgagcgaaagaacttggaatgctcacggtattgcgcgtatttttgattgattctatggcttatgaaaatgtgaaaacacaggtaacggcagcaaagccggatgtggtagaggttcttccgggaatgatgccgaaggtgatcggaaatatctgtaaagatcttccggtacctgtgatcgccggaggaatgatccgggagaaggaagatgtaatggcacttcttaaggcaggagtaaccagtgtatcgtctacgaatccggaaatctggtttgaataagcttttattttttcatcttctttaatttcagccacccggcatgaagcacatacacaactgcaggaattaaggaaagtagctgtgtgtatgtataatctattgccagagatacaggtgaaagcacaacatggaatgcaaagaagaggaaagctccggcggtaatcagattacaaaggagatacttccagccgaagattcctaaagcagaggctgtcaggagtgccaccagcgatatcgtatcaagtgaaaccggcaaatgaataaaatcatactttgtagaaaaaagtgtcaggatcgcgtaaaggaaaagaagcaggttcaataatcccatgatcttgaacaataaactgtaaaaaggtgtgaccgggcaatccggccacaattctacatccagtttttcagcaagttcaatcgcggagcgggtgaatgttgtgtttgtcattacgatgaccttgtcacagtcataaaaattcgcaccggcataagcttcctggactgctttgttaccaacgggatacgtgtaatacttacactgtatcccatatttttttctgtgtttataggcaatgatgtcaacgccttgatccccagaacttttagtaacttctatttttgaaaaatgttttctttttagtatgatcgcacactgttcttcgaactgatatccatccatgtgttgctgcttctcctatatgctgtctgaaatcatgatgttggggtcaaaaggtattttgccccctatgatacacggattgcttcgcatttcatgctctcgcaatcctaaaacaccatgcaagcattttacacctgttttatgaaattttgcttggctctgaacagttacagattattttgcaaatgctttgattttctcgtagatgctgtctgtatcaagaccatacttcttcagaagctcaagtgccggaccagattcaccgaatgtatcattcacaccgatcttcataacctgtgtcggagctttctctgaaagtacatcacatacagcacttccaagtccgccgataacggaatgctcttcaactgtaacaacttttcctgtctcttttgcagctgctacaacaagttcctcatcgagaggtttgatcgtatgaatgttgatcactttcgcatcaattccgtctgcagcaagcttctcagctgcttccagacagttacttacaggaagtcctgttgcgatgatcgtcaggtcttttccttctcttaacacaacaccttttccaagctcaaacttgtagtccggtctgtcattgatcaccggcactgcgagacgtccaaatctcagatataccggtccctgatgctcgtaagcagcacgtacagctgctcttgcctctacatcatcagctgggttaattacaaccattcccggaattgtacgcatcagagcgatatcctcattacactgatgtgttgctccatcttctcctacagagattccggcatgtgttgcaccaatctttacattcaggtgtggatatccaacagagtttcttacctgctcaaatgcacgtcctgctgcgaacattgcgaaagaacttgcaaatggcacttttcctgttgttgcaagacctgctgcaacaccgatcatattagactcagcaataccacaatcgataaaacgatccggatgtgctttcttgaatacacctgtctttgtagctgctgccagatcggcatcaagtactacaacgttatcatgttctgttccgagttcagccaaagcattaccgtagctgtctcttgttgcgatcttctttacttctgacataatgcttcacctgctttctctaattcttccattgcaatcttgtactcttcatcgttcggagcttttccgtgccatcctacctggttctccatgaaggatacaccttttccttttactgtcttagcaataatagctgtcggctgtcctttgactgtctttgcttctttgaatgcagcatcgatctgatcaaagtcatttccatcaatattgattacatggaaattaaatgcctcaaacttcttatcgatcgggtacggagagttgacttctgtaattgctccgtcaatctgaagattgttattatcaacgataacaacgagattatccagttttctatgtgctgccagcatggaagcctcccatacctgaccttcctggatctcaccgtctccgagcagtgtgtatactctgtagtctgcattgtcaagctttcctgcgattgccatacctacagctgctgaaattccctgtccaagagatcctgaagacatatcaacacctggaatgtgtttcatgtccggatgtccctgcagataagatcctgtatgacgaagtgtcacgagatcttccttcgggaagaatcctttctgcgcaagtgtagaatataatcccggagctgtgtgtcctttagaaagaacgaaacgatcgcgatccactttctttggatctttcgggtctacgttcatctcttcaaaataaaggtatgtaaaaatctctgttgctgagagagatccacctggatgtccggcctttgcgctatgcagtgctgttacaatccctttccggatctcattcgcagttttcataagctctaacttgttcatgatatctcctttttaatttccattctgattccattttcagtcttaacgttatttcccggattactcaccaaaaacagcaatataatcctttttaaacttctcgatacctgcatctgtcagtgggtgatgtgtcatctgctcgattaccttgtaaggtactgttgcaatatctgctcctgccagtgcacattctgttacatggattggattacgtacacttgctgcgataatctctgtctcaattcctgctacttcgaacatctctacgatctctgcaatgaggtcaactccctttgtagaaatgtcatccaggcgtccaaggaacggagaaacataagtagctcctgctcttgctgcaagaagtgcctggtttgctgtgaagatcagagttacatttgtcttgattccctctgctgtaagaactttaacagccttcagaccttctactgtcataggaatcttaactaccatgttcggatggatctttgcaatctcacgtccttctgcgatcatgccttctgcatctgttgttgtagccttaacctctccactgatcggtccgtctacgatagatgcgatctcagcgataacttcttcaaaaacacgtccttcttttgcgatcagagacgggtttgttgtaactccgcagatcactcccatgtcatttgctttcttgatatcctctacattagccgtgtcgataaaaaatttcatttttaagtcctcctatacatgaatcttcctcttaccactgatacaactcactatttttccagcagtaattcgtttgtttatgagctgattatatagcttccaaaacctgaggtcaactgtctgaaaaattattaatagtcatttttcacttaataatccgacatattaaccgtttttattaatattagttaatatcaatcgtttttattctgtataaaaatctttattttaaaggctttatcaacattttctaaaatcagaatcgtttgtttttgttgtttttattagtaataattttattattttttattaattttaaataatacaacgtctatacatcaactattttgtcttcgcataagacgttgttccacgaaccacgatctgtggctcatattccacatgataaatactgaccggttcaaattccgtatacttccagtcccttgaactgatctttttcatgatgatatcacaggcatccattcctttgtgaactacaaaatgctcgatcgttgtaagtgacactttcttaactttggaaaataaagtattatcacatcccataaccgagacatctccgggaactttatacttcatatcctggagtgcatccataatcccaaatgcgatcatatcattcagccccacgattgcagtgagatctttttctgtcctgagcagttcttttgtcagatcatatccgatgcggtactctgaatcgattcccggaacattccggtcaaattcttcatctgcttcttttacaatcacctgatcgccatatccggcttttctgaattcatccagaaaaccttctacccggcggaatctctgcttctgtcttgcagttaatggcggtgtaatgtatgccacatgctgatgccccagctccagaagatgtctgcccattaatcttcccagctttgtattatccaactccactgcatctacatccaaatgcttctcctggttattgatcacaacaaccggaatcctttcagacatttctttgagctgtccgagaaagcattttcccggattgcacatatagataattccctgtgcattcagagtcgagatcattttcagataacgctcttccagttttaaatctctctgtgtattacagacaaagattccgaacccctgctctgttgcccttgattcaattccttgcaaaagcattacatagtatgggtttgtcaggttcgggctgatgacaacgagcagtttttctcgtcgctctccacgctgtgttctgcgtttcggaagttcataccccagttcttccgccgctgcctccactttctggattacttcttttgaaaaagagacgttatacttcttattgagtaccatcgagaccgttgcctgtgaaactcccgcgcgctttgccacatctgaagatgtaacttttttcttcgccatagccagtccctcctgccggtgtctcaaatgcttttacaattctgttcttccttccaatgcccgaagcagtgttacctcatcaatgtattccagatcaccaccaaccggaacaccactggcaatcctgctcaccttgattccgaccggtttgataagtttactgatatacattgctgttgtctcgccttccagactggaattcgtcgcaatgatcacttcatccacatctccctgcagacgctccatcaattctttcagacggatatccccgggaccgattccaagcattggagaaattgctccatgaagtacatgatagactccgttgtactttccagtcttctcatacgctgccagatcacgcggtgtctccactaccatgattgtcttatgatctctgtccggattgctgcagattgggcagatctccttatccgtcaacgtacagcactccttacagtaacggacattcttgcgggcatctacgattgcattcgcaagtccttctacctgctctaccggcatattgatcacatgaaatgcaagtctttgtgctgatttattcccgattcccggaagtctcgagaactcctcgatcagacggctgatctgattactgtagtaatccattagaacattccgcctccaagaccgccaaatccgcctgtcatcttagatactgctgcatttgtctcctgctcaacctgacgcagtgcttcatttgtcgctgctacgatcaggtcttccagcatctcaatgtcgtccggatctacaacttcttctgcaagttttacttttgttacttctcttttgccggatacagttacttctactgctccgccgcctgcagctgctgtgaactcttttgtctcaagttctttctgctgctcttccatctgacgctgcatcttctgtgcctgcttcatcagattcgccatatttcccggcattccgccgcctggaaatcctccacgctttgccatgtctaatcctccactgttatttccatatttattttctgttctatgtccacaaatgtatcctcaaagtgtctgccctcttctacatgacggacatccacctcgactttctttccaatcttctcttcaatgagctgttcaagttcctgcacatgatcttctctgccaaccatatctgccgacatagcatctggcagtacaatcagcaagcgattgtcaccaccaagactcagtcttgcttttttaagaaagcctctgatcatacctgacgcttcatctgcgatagaacggaaattcttcaccacctcctgcacatcctccggaattgcattcggcagctccggtttcgccttcctgcttcccgcaacgcctgatccggatgatgacgcatcatctccattcacgtaaacaactcgctgcggcatatctgcggctgcagcaagtcctttctctactttttcttctaccgcacggattctgtccagaagtgcatcctgaccagtctccatcgccggagtacaaagcttgatcagtgcaacttccagaagcactctcttctgcgtcgcatacttcagctgaccggaaagttctgaaaatatacggatataacgcaacagcatatcaagttcgatcatctttgattcttccttgagctgcaacatattttccgtagacacatccagcacgtcctctatattatcagaagttttaaccaaaagcaaatttctcagataccatgtaaaatctgcggccagctgggtcagttcacgtccctgcataaccagatcttccacgatatcaagaactccggcaacatctctttccaatactttccgaagcaggcggctgaacacatccgtatccaccgcaccaagtacttcaagcacatgatcatacgtcagcttctgtcccagataaaatgcaatacactgatccagcagactgagtgcatcacgcatagatccgtctgccgcctttgcgatatagcgaagtgctttttcttccacttctacctgttctgtctgcatcagatcacgcatacggtctgtaattgtctcaatgctgattctcttgaaatcatagtgctgacatctggaaagaatcgtaattgggattttatgcacttctgtcgtcgccagaataaaaataacatactccggcggctcctcaagtgtcttaagcaatgcgttaaatgctccgatggaaagcatatgcacctcgtcgataatgtatactttatacttaccttctgtcggtcgatatgtcacttcctcccggatctcacggatattatcaacaccattgttcgatgcagcatcgatctcgatcacattcattgaagtgccggcagcgatagatttacacatctcacactctccgcatggacttccatttaccgggtgctcacagtttactgccttcgcaaatattttcgcaaccgttgtcttaccggttcctcgcgttccgcaaaacagatacgcatgtccgatcctgttcgccttaatctggttctgaagcgttgtaacaatatgatcctgtccttttacatcttcgaattcagaaggacggaactttctgtatagcgccgtatatgacatgaattacacctcgtctccgaagctgataccgattgttctcgcttctttaatcagaccacagttcggatcaacatatttcagctttcctgcaacctcttccaacggaactttcactgtctcaccatttctcatggctaccatatatccgtattcttcattcaggatcaattctgctgccttcgctccgactcttgttgcaaatacacggtcataagcacaaggtgtgccacctctctgtgtgtgtccaggaactgtgatacgaacttccttgtctgtctctttttcaatctgttctgccagttcgtaagcgatagaaggatattttctgtttgccagcttctctttgtattctttctttttcagttttgcatcttctttggaaatcgcaccctctgcaacagcaaggattgtaaatctcttacctgcctgtgtacgtttgtcgatcacattcttgattgctttaatatcatatgggatctccggaagaagaattatgtctgctccgcctgcaattccggcatgcagagttacatgacctactttgtgacccataacctcgataataaatacacggctgtgggaagttgctgtcgtatggattctgtcaatcgtatctgttgcgatatcaactgcactctggaatccaaatgtcatgtctgttccccacagatcgttatcgatcgtcttcggcagtgtcactacattgagtccttcctcacgaagaagatttgctgtcttatgagttccatttcctccaagaataacgagacaatccagatgaagcttatgatatgtgtgcttcattgcctccaccttgtctattccatccttatccggcacacgcatcagtttgaacggctgacgggatgtaccaagaattgttccaccctgtgtcaggattcccgagaaatcctttgatgtcaacatattgaaatccgaatagatcagacctttgtatccatctttaaatccatagatttctacatctttgcgcttgttgcaaattccttttacaacaccgcgcattgctgcgttaagtgcctggcagtctccaccgctggtcaacattcctattcttaacatagcaactcctcctattactctttgcacctgtcttaatcagttactttcttttcttgtttataagccctaaaaaagcagttggttcttctttccctgccgccattcctgatattccatgaccggcggctaccaactgctttttattataccttatttacaaatgctgctcaagaaattttagttttcgttatgttaaaaattcttccagaatctgacgaatcgccgcttctctttctgcatttcttcctgaatctcgctccgaatctctatctacgtctctctctgaatttcctttcggattccttgccggctctaccgctcttggttctccctcgatattaatcggcagctccgtcctctctgcttttgttttatttccattctgtacgttgtcttctctgtgaatctctctttcccctttcttttcttcccactcctgctttccggtattctctgcagcgatcacattcaattcttctctatccgtagtccgctgtctctttacgtgaaatgcacaattattctcaagataatccaccatatacatcctgacagcattaagcttgtactgttcgtccgaaagatgactgataacaaaaaggagtaccatctccgctaatcctgtttctatatattgatacgccgcatctgaaaatccataagtaatataacattcgaatgcaccaagagctgcaagaattccaacaaaccacaccgtcagtaattgcatctgtctccaggtatgaatcccaaacaaaaatcctctatattcataaatatatttctccacaaatgcattcgtattctctacactgtcatgcaccatacatgcatgttcgtattttgctcttacgagttttatcagtcggtgtgtactcttgggcatattccctgccgccttcagcatctgattcaatgtctgctgattcactgcttttgccagcactccgattatgcccagaagtgccatcagataatagatgactcttgtgttcactgccagttctcttaacatagcaacccctcctggttttaaaaatattgcgcgtaactgttcgggcctccccttcgttacgtttgtagatattataaacctgattttatattctgtccgcataaatcgttctacagatttctacagcaaaaatcaaaattgtcgtattgaggaaaattatgctgaaagatgtgaaaagaaaaattgtttttttatatttgatttgctataattcaaaaggtaactaaaagatctaaaaatttaaatgaaaggatatctagatatggattatagaacaaaaggtgtctgttcccagagcattcactttgatatcgaagataacaagattcataatgtttccttcgttggtggatgtaacggtaacctgcagggaatttcccatctggttgaaggaatggatgtagatgaggccatctcacgcctggaaggaatccagtgtggattcaaaaaaacttcctgtccggatcagcttgctcaggcactgaaagaagcaacaggaaaataacttaaaaaatggcaaactaatagggaaggatcgctactcttgattcaatccttcccttctgccctactagtccatggactgattaacagccgcttatggtgattatatgctcatttattcaattgtggtgtatcaaggaacaaggctctcacttttatctattagaatctaatttgtgagtatccgagcgaaccaccgcgcagcggctgttaggccagcccacgggctgcatcttctgccgttggtgcgggaggaagatgcttatgggactaggatgccgttggtgtaggaaaatgtttcctcatccggagaaccggccatacgtacaatgtgagaagcatgaactcgataataataccctctatcaacttggattgacttagaagttgctacataataatcattctctattttcttggaaaatgcatcaatctgatgccacttcccatctttctcattatactgatctacataaacaataactgctaacgcatcaactgtatgatttgctgttgtagctccatatgtataaattcgcttggttcctgcttttgtaattgaacattccccatccatcagatgttcgccacgctcatcactcttcggcgtatagcctgttgatgaatctgctgaagttaaataagatccatcaacaactttaacttcaccatcatctgctttaacccccgtcacggatgtacataccataaaacaaaatatcatggcacttgttacaatcgaaattattttcttacttatcataaaactatcttccccctctttttattattattgtcttctgataagtaaacaactgagtcacaaaaaacttacgcgtttttacataaaaaataaattttttataattttgtcaaactccgccttttccataatgccttttaactgatattgaacatctttatattcaaattctgctatatatcttttttcttttgtattcttcacttgatattcatttacttgaattttcttcccctcattttcaatttcatacgtatttgttagattatcaactgttttttgtcctatggaagaatctttagaatttgtatacatcgtatagcgaatcacctgttctccatattggaaaaaaagtgttgctttcctttgttcgccatcaacactatatttctttaaaatcatatttttaggcttatactgcattttcaccaatgatgtgcccatcacttttgtaatttctttatcgacttcaatttcatttatatccgctgtctctattgactccatattctccacgtctataccattattctgttcatctccattactatcattccacaacgtcttccaatacgacttactccccacgctggtcatcacacttccgcacaccagaatcagcactgctgccagtgctccgattacaagcttgcttttcttctttttgcgaacaacttttttatgcctcttgtcgtattcgtaatcctgaatcttattgaaaagctctttttccatctcatcagacactgtaatatcatccagtgatctgtcctctcggactttcttttcaatctgttcagcttcttttttcatttcattttccaatgataattttttcagttttttcattttctttaccttattctctccagtttgtgtgtcccgtttttcttgacattttttcaaataagggtaatatgatgctataaggctagtgttctcaatttacttcgaacagtagcactctacactaaatctggaggttaatttatgaagcgaattatattgaccggcggcggtactgccggacatgtcactccgaatatagccctgattccaaagcttagagaattaggctatgatattcaatacataggttcttacaatggaattgaaaaggaactgattgaaccttttggaattccatatcatggaatttcttctggaaagctgcgccgttatttcagtctgcagaatttcacagatccattccgtgtgatcaaaggctttggtgaagcccgtaagttaatcaaaggcttaaagcctgatgttattttttctaaaggcggatttgtttcggttccagttgttcttgctggaaagcgatgcaaagttccggtcattattcatgagtctgatatgacacctggcctggcaaataaactggcaattccatctgctgtcaaagtctgctgtaacttcccggagacgttagatgctcttccggaaggaaaagctgttcttaccggttctccgattcgtcaggaacttcttactggtgataaggatgccgccagaaagatgtgtggctttacagatgaaaaacctgtcattctcgtaatcggcggaagtcttggtgctgtagctgtcaacgaggcggtacgtgctgcccttcctgaactgctgaaacagttccaaatcatccatctctgcggaaaaggaaaggttgatgattctctgaaagaaatcaaaggctactgtcagtttgaatatatcaaaaatgaactgcgtgatctctttgctcttgcagatgttgttatctcacgtgccggtgcgaatgcaatctgtgaactgcttgctcttagaaaaccgaatcttctgattccgctttctgcccgtgcaagccgcggagaccagattcttaacgcacattctttcgaacgtcagggattcagtcttgtaatcgaggaagaacagcttacgaatgcaacgcttttggatgcagttcataacctgtacgaaaaccgtgagcagttcataaatgcaatgcacaattctgggcagcaagatccgattgctactattatcggcctcattgaagaagctgccacaaaataatgtagttcatctaccggcaacactcttcataaaactacagtattcaaaaagataccgggaaactatcggcaccactgttcctcatacactttttctttgtacattgaacagtaaacatttggttttgctcttagtcttcccggttcatttcttcgtactctgttccgtactttttcttaatccatttctttgctctgtgcagaagactatgaagcacttcgagtcgaatgcccattaattctgctgcttttgcctgaggcatctccatataatatacaaggacaatagcattgtaccatctttcattcttttccatcaaattggtgaaaatcttttcatgaagctctaacctttgtttctgaagctcatcttccagaaactgttcctcagcactgtttacctgtgcttcatttttctctgtatcctcttcactgtcccaattctcatcaatctcgaagatctccctgctatgctttttcctgtaatttaatgccgcattttttgccgttgtaaacagccatgaagaaatatttttcttcttcatgctgtcatatcccatatacagtttcagaaaagtgtcttgagtaatatcttccgctgcattataactgcctgaataagtatatgccgcttttagaatgagatttttatattgttcataaatctcattgaattcgcgattttctgttaacatatcttctccagtactattttaatttttcaagtatctctttcttatcttcttctgtaagttctcccatatgccatccgagacctacattgtcattcttatatcttgggattaagtgcatatggaaatggaataccgtctgtccagctgcctcttcgttgttctgaacgatattataaccatcacatccaagtacatccgtcatctttgtaatcatcttttttgccagacagattgcttttgaagctgttgcctcgtcaatatcatacagattgcggtaatgattcttcggaaggatcagcgcatgtccttttgatgccggtccaagatccagaattactctgaactcctcatcctcatacaatgttgctgatggaatctctccatttgctattttacagaaaatacaattatcatctctcatgatctttcctctttccattttattttatctgtagtatagaccatttttcagaaaaagagaatacatttttcagacaacaggtcgaaaaaggtcgaaaatagtcgaatgatttttattgaatgctgttttcggtggtgctacactcttaccaaactcaagaaaatctaactattaggagtaagtattatgttaacaaatatcgatcttgaaaaaatgaaccacctgatggaaacaaacaaagatgcaaaagagattatcacacagcttctgaagaaccatgatgctactgttgctacaattgcgcatgagatccgcaatcctatgactgttctttattcttctatgcaattaatgagctctctttatgctgaaactgctaaaggttcctgtgtctgggaagaatgcatggatggcgccagacatatgtgtgatttgctggatgatctgacagaactcaacaacggaaaccaattaaaccgtgcttcctttcctcttggacatgttcttcgcaactctgctgttctgttcgccatgtctctcaactttgaaaaatcaaagattgagatgacttccagtattgataagaatataaaaaggttcaatggtgatcgcaccaaattagaggaagtcttcttaaacatacttacaaatgccaaagacgctcttgccgattgtaagtatgccccacgtctgcagtttcgcgcaaagaagcttgacgataaaattctgattcaatgccaggataacggctgtggtattccgactgaaattgttgataagctttatgaaccattctttacgaccaaagaaaacggtaccggtcttggtctcgcagtttccaaaagaatcattgaagcacataatggaacgatcgacattacatctgaccataccaatggaacaatcgtatcgatcacacttcctgcgtaaaatatcagatatcgttaatatcagataccgttaggatcttttgatcttttcttcgataggttagcagcgctgtcaggaaaccgcaaatcaatccgcctacgtgagccagattatctacacctgtactggtaaatccaaaatagagactcagtacaaccataatcagcatgcctcttcctgacagtgttcccagccttcccctgttcgcaaatacaatccaaagcaaccctcccattagtccgaaaattgctcccgatgccccggcagatacaatctgtctgtcgtgcatggtattccagtacaaagacagcagattaccacctattccactgataaaataacagagcagaaaccgaattttaccggcctctttttcaaaaatcgatccaagtgcccacaaaagcaccatgttatttaataaatgtgagattccaaaatgcagaaaaagactggtaaacagccgatagtattcctgattttctataatatacggttcatacattgctccatgctgcaacataaaataaccatcctcagtccgtccgatcatagtaagaacaataaacaccagaatattgattcctatcaacgtgatcgtcattatttcttttggtctctctttcattctttctgactcccttttgacttctatgatatgtttttgaatctgcgtatactataccacatcctatatatcattcatagtcatcagcttccgttatcagatcttcccattctccccattttccagacttaaagcgttttgcgaatttcttgatcggaccatatctcttttcttccatcactgcataattctctctcgccttgttataatagctgttttcctgtacctcaatgttttgattttcttccatttctcttctgtctttttctctcttactttcttctctgatcttctcttcttttgacttttctttcctgctttttgcttcttcctcatactgctgcagtatgctttccagatcataggtttcttttagcgtttctttgtgaagcatgcaggcaagttgaatactctccaaatcctgataatcaactttccttacaaaatactccgtcagctcatgataagacacctgccaggtcttctcattctctggaaaaaaacagaaaaaatagttttcattcttttcaaaaatatatttttctgaaagcatcagataatttggttctaacatataatctttcattttttccataacactgagaaattgtcttgtcagttttaatatctcttctgctctgatatctttatttttataatacgtttccaacgactgtgcatgccctgtatgataataatatctacttgcaccttccattccacacccacttactctcaataatccgggaatccgattattcttaagcatccgcatctgataattctcccgatacggttgtacgctgtctattatgatttcagattctgccactctgctctgctgatttgtctttttttcttccatctgattttcttctcccttcactttttcagctttacagaaatctattttttccatctggctttttcttctggtttcaccttcgttgcacgttgtatcagatgaatcttcattcgtccttttgatgcaaaaacttctacctctattttcttccctgatagatcaactctggttgttatattttccagaaaaatcaattttccactcgtcctttctcggaaaaaagcatccagatctgcgtcttctatctttttcctgtccatttcaactcctgtcacagccgtttccgctgccgctgcgtttaaaattgccttatcatgaaagtaaaaaatgatcgtgatgagcagaaaaaatagaattaagcaaaaaggaataaggtaagacatctctaccactgtacttcctttcacgtattttttcgtatatttttcagtaaactccaccaatcatgcctcccaaataagcaactgtcagaaatggaataaatggaaatgaattttttcttgtatacttctttcgtgcgatcataattcctccgtaaacagatgcgatcagaaatgcagcaaacagaatccaaagaagattccatcccccatataaaattccaaggatcagaattaatatgctatctccgtaaccaaatgactcttgtgtgaaccaacttaaaaaaagaaatactcctccacacaatccaccggctaccatcatcctgagttctcctttgctgcatagtacctgacataaaactgcaatcgcaagcaaaatcaaaagacttcttacacttactttcttccaacgaatatctatcacagacaaaatcaacagatacactgctataacagcttgaaaaaacatccatagattttcccttccattttgcccgaatacattcattattttgcacatttagaacatcctcctcttcctgctacttcgcttttatgaactgcacgtattgttctcttcagagaactgcaattcaatgagttgtgataccggtttccataactggtaatatatacaccattcattgcctgtccataaacacattgctcacatttatggtattttcctccaccttcatttctcatattttttaattctgaatattgaacatattgaatagataattgaagatagctgcactgataatctgaatgccatactgttcctttttctgtgatatagacaatctgtccgtcttcatttccctttctatctttttgataaccattccatgcactgactttaaactcatctttcaacttcaccgaaggacttttcattagtggaaccggaatctttatcttgtactcgataacaacatttatctcttctgttcccggaatccaataagacttccagcaactgatagctgatgtaccaccattcagaatacttctctcaattctttcttctccaatcagattcaccagatctgattttaattgaattgtattcaatacaggaaggacagccgttgactctgctgcctgtttggctgcatcacttcctgctgcatggatgcagcctcgtatactctggatttcaattaaaaaaatcaagcttaatactgcaaacataaagaggggaactgcaaatgcagcttctattgttacacttgctcttacccccggtgcagatgccctttctcttgttggactggtattttttacctgtttatttgacatcgcagcttttcctttctaaagtgtgtgggtttcctgcaagagggattgcaggattctgagtgtacgttttggggtgtacaaaagaaggtctgaaagggcatctgcaccgggggtaattctggcttcattcatatccgaaataaaccggatattggtaatttagatttttataaacgattatcttattctgtatttctaatttagtcacacattgatctgcctgaaacaaaatatgtttggaatggagtgcctcttctacacaatctaaagtccgcattgtaatttccggcaccgatttcaaaaagagaaacatcctgatataatcagaatatccgactccttctccggaatcatttccccttacacttccaccatctgtcagaagaagtggcagctgtgacagagaaacaacccatttatctgcactttttaccagtggaacttttcttccatccagaagacaacgaagatccataacactttctcctcctgcccacgcaacaagtatcatctgtttcaaagcttctaccgcttcaggcatcagtagtagtgcagatattgtcacagccaacgcttctgcctctgccactcgtcccatatcctttgccagacagccataatttcctgatattctcagaagaaaaagacgaaataacacggattccagattttctttatctgatccttttccttgtagaatatattccagttcgtatgctaaagcatctgaccgatcagactgccattccttctctccactctcatccgttccttctgatcgttctgaatcctgccgaaatgcatagccgaatgttttgagaagatattcgttgtacagaagtttccccgttgtctgatcaagtccttttcttgttgggaatgtcccatatccttttttcaaagttctctttgatgcctgccccgacaaatcaacactcttttcagatactttttttcctttcggaatcacaacagaaagaattccttctttttttatcttttgcataatacgaaacggattctcctcatctggcagacttggaccttcttccacgtcttctccttccgtttgactgccggatgcgtcaagactgtcattcacccgttccattgcatctgtcatttcatctgttttcttttccatatcagattcttctgtctctgtctgttcccatttctctgttgttccggtaaactttttaaccagatccattccatacctttgttccatataagccagcacttgttctcgaaatgcctgtccggattgatctgtcaaatactgaattcccttgatttgatgatctgtagaaccagaattgtaataatgcaaacgctggatcagattttcttcttcataatttcctgtcctgtaaccaagatcaattcccaaaacatgatattgttccataagttcctgatgatattctccgaaaacggagtagattgcccgatctgtgtcaattctgctgagattttttgatccttgaatcacagcagactctagaattccaaagataaatgaaagtaacaaagtaaatgataaacttaaaaatacagtaatttcgccttttacggaccgcatgctatatgccggagctttctgatgtcactttctcaaaaatcgtagtgatcagactaatcaactgttctttaaaaatcaacagaagcgcaattaatataaccaaaattaaaaccagttcaattgttgtgatcgcggcaacatatttcttatctttattttttcttatcaataattttctcatcttgtatctctccttcttttctctctttttctcaaatctgaatcgtcaaaaacgctggaacagtcacgatcacgaacacgactgccaacataagaaacaacggtatcatcaactttgttcctgcctcttcaccaagtttctttgccatatttttccgttcctcaaaagcttcctgcgcctctctttgtaacagattcgtcagtcccttggttccttttcttaaattctgacttaaaagcattccgaactttcggtaaaccggactttcgcacctccttccaaatgcctcgtagcattcactttccggtcttccattcttcagttcattcattgtatatctcatctcttcatacactgttctttctccaagatagtgtttctctttgtcatattcttttacaatttggatccaggctcttctcactgtcattcctgcccctatatacagactgaatttattgatcagctgcggataatcaaactgcatctgcctgatttctttctttcgttgttctttctgcttttgtttctctgctgtaaactggaatacaatcatcactccgccaagcaaaagaattccaaatgctctcatttccttcacaggcttccaggataattttcttccatctacctgatctggcaatatcaggtaatccttttcccgctgttcctgatctgctttttctacttcctgggatatctttttcagaacaccttccttctttgacaacggtgtggaaaacaggtgtgcataaaattcacaggacattttttcctcatcatatcgaaggacagcggttaatttgacgagtgttccttcttccgtcagcttctcctgctttaaaacacctctgctgttcataacctcgtagttatcaagttcccatgacacgctgattcccgtatgtggaatttccataataagattcaggtctgacctgacctcatccagacttttgttttcaccaaggatctgagccggaagttcttctgccgccttagaaagctgttctccaatctcttcttttgcatacttcttttccgaaatctgaaccttcatcttctctttccactcgcctgtctccatctggattttttctgtcttttttccttctccctgtccttttctttccaaaatccggtttccattttcatcctgtgctaattgacgatgattatctgtgacatacactgcactaaacattacgattgacaataaaagaacgattccagcctttttatagattccatattttcctttgtcaggctgaagtacttttttccacttcttgttaaatctcaatctgtagaatcctccttccaaacctgtatgctccaagataaagtacaagacaaatgctcattacgatacatccggtccatgtaccatacaggacacttaagaattcaccaaatgtcatcttcatgtagagaatcattataaatgggattacgctcatgatttcaaattccagctttttcgcagccagcatggtctgtatctcacgttctgtatcgatcttctctccgattgttctagccgcatctctgataatcgcaattgaatccccaccactgaccttagctgctgcataaactgtaataaaattcgtcacatcctcctgctttacttcagccgcaaattcattcaatacggttacaactgacagattcagatccagcttccttaccatctgaccatattcttttcgaatccttgtattcgcatcatacattccaatcagatcacgatttgtttccctgattgcattctctacagaatatcctgccttaagtgcccctgccattgtctggatactatctctgaactgcctcctgaattcctgttcttttccgattgctttctcttccatccactccttcatgtataagaaccataacaggaacaggagaattgccggaagtatcgattcataaaacaaatacaaaatcagaagaaatctcaccgtacattttatgattccgacagtatattcagatggtgtgatatcctgcagccaggagtttttctttattcgtgatttcatttttcttcataaggcatccctgtatctttccattcttcatcccctcctccttaaattcataaagaacctttgtctggatccttccatcttcataaccttccacttctacaatctgcaaaacctttcttgtcttatctcgaagtcttccaagatgaatgataatatcaagtgccgatgcaacttgtctttgaattgcctgtaacggaagatcaatccccatcagcatcattgtttccagtctgtgtaacatatctgttggattattggcatgtcctgttgacattgaaccactgtgaccattcaacattgctgaagatatcatatctactgtctcttctcctctgacttctcctacaacaattcgatccggtctcatacgaagtgctgacttaatcaaatctctgatggttacagccccttctccttctgcattcggtccgcgtgcctctaagcgcaccagattctgaactccctgaatctgtaactctgcattatcctcgatcgtgatcaggcgttctccttttggtatatagttcgacaacgcattcaggaaagttgtctttcctgctcctgttccaccactgacaaaaatattatattttgctgctaccagctttttcaaaaagttagcagcttcatcagttacgctgcctatacggatcagctgttccatcgtaattgcttccgatggaaactttcggattgtaaggattggtccattcacagcaaccggattcaatacaacatttactcgagatccatccttcagccttgcatccacaatcggagaggcctcatttacataacggttcgattcacctacaatctgttgaatcacatccagtaatctctcctgagacaaaaaacacttcttagaccggaaaattcttccttctttctcataaaagatatggtcgattccatttaccataatctctgtaatcgaatcatcttcaagaagctcctgcagaacatccagtttacgaaaagagttgaataactcacgcccgattctgatcttatcactcaacgaaatatattcttcatctgctgcctcatccaatactgtgcgaatcagctcctgcagttcttcatcatccgtctccttcgtaagatcgatttgttccaggatctgttcatacagctgctcttttctaatcatccttacgacttcctttctctgtccggaaattccgtaattttacttgcagatgcttctaaagcaacaggatttcttggctttcccattctgcgtcttaccgtcttcttaagaatctcgccatatcctgctgatctaagattctcttcatactgattgagttttgcttttgctgcaccttcctcaatgtaaggcgtataaactttactgcatcttcctaacagatcatacagaccgtctaccgtatctccaagatcaagaatgatcactttgtaaatactcttctccagaatcagatccaaaagttgattccattcttcttttgtcacttctctgaaatcttgttctgcccggatcggtgcgatataatccaacccattcatatggctgatcaaagtactgatcttccataccggattgatactttcctgcttcatgtaatacagcagatctccaagattcattccggattcttccggcaggtaataatttaatcctgaatacccttccagattcagatacaacgtaggaatcgattctgaaagaactcgtcccatacgcacggcaaaccttgtcttcccgattcgatgaaccggtgaatagatcccgatcagaccatttacatttgctttcactgtctgcgatctgtctgagacaagttggatttgatgcgtctgtacttctgaattttcctgatctttttcctgaagtaaaagttccagcatactgctgacactttgataccggaagaatggaatctctgtgggacttctctcgttcggaatcttctcgccgatcagaagatacttctgtcttgccggaatctcatcccgatcttcttttccatactcttctccgatcagcagaatatttacctgcatactcttggctgctattttcagattctcaatatcatgaaatacatgaaactgaaaataaccggataatttctcagataatcttctgaacagattttctgaataactcttttgtgtatcacaaatcacaaaattctcagcagttcctcttactgctctttgctcaattgtcataattcgaaactttgctgcgatcatacagcctgaataaagaaattgtaccgaaggtccaacgcttcgatgcaaaagatacatcagtaattccccaattcactgatgctgcaacagatgattttctgttggtaagtgagattatatacgggcacttctgttttgtccataccaaaattaaaaatataatgtttttgtaaaaaacttacaaaaattgataccatgtaatgctataaagaagacaaaccccaggaattccaagggttccggatgtcaaaaaggtcatcggattcaaaccgacattaattgaagaatctgctggaagaacatatttgtttattataaaaatcaacgccattcctatggttgcacgtataaaaaacttaagaaaaaaatatcctgttttctttttcatttcactcttccaatctgtttttcttgatttattttattttttccgtctcttttttattccttttgattccattttcaattctttatactcaaaaaagaaagcggataaagttcactgtaatcaagtaaacttcatccactttctcttatctttttatttttcaggacagcttacaatcttctgtaaaacataacaactttattcctctgttgtttcctgctcagttatctcagaaactgatccttcctctgatttttcagactcatcttcatcagaaatctcaacttcttcaccgtcgatctcggcagaagcctttctcaccttcgcaacactcgctacagtgtcattttccttcaggttgatcagttttacacctgatgtgattctgccgtaaacagagatatcagaacacttcatacggataataattccctctgtgttgatgatcatgatctcactgtcttcatctacagctttcattccgacaacatttcctgtcttctctgtgatcttataacatttcacacctttaccgccacgattctgacgagtaaattcatccatgtctgtacgtttacccataccacgctcagatacgatcagcatatctttgccctggctttcgatctgcataccgatcacaacgtcattatctgtcaggttcataccacgtacgcccatagaaacacggcctgtagaacgtacatctgtctcattgaaacggatacacataccgtattttgtaacgaggaaaatatcctctgtattatctgtgatcttaacttcgatcagcttatcatcctcacgcagtacgattgccgcaagtcctgtctttctgacatttgcatagtcctgaatcggagtcttcttcacaagacctttctccgttgccatgaacaaatacttaccttcctcatactcacgaagcggaatgatcgcagtaatcttctcttccggcatcagctggagtaagttaatgattgctgttccacgcgcagttcttcctgcctccggaatctcgtaagctttcagtctgtagacacggcctgtgtttgtaaagaacataatgtaatggtgactggttgtaataaacagttctcggatgtaatcatcctccagagtctgcattcccttaatacctttaccaccacgattctggctcttgaatgtgtccatagacattctcttgatatatccaagttttgtcattgtaattacgacattctcgcgcggaatcagatcttccatggagatatcaaattcatcaaatccaatcttagttcttctgtcatcaccgtatttctcagcaattacaagaatctcttttttgatcacaccaagaagaagttttttatcagcaagaattgctttatactcttcaatcttcttcataagctctgcatattcagcttcaatcttctcacgttccaaacctgtgagtgcacgcagacgcatgtctacgattgcctgtgcctgggcatcactgagtccaaagcgtttgatcaattctgcttttgcttcctgaacattcttagaaccacggatgatgcggatgacttcgtcgatgttatccagagcgatcagtaatcctttcagaatatgagctctctcctgtgctttattcaggtcatactgtgttcttcttgtcacaacatcttcctgatgacgcaggtagtactgcaacatctcaagaagattcataaccttcggctgattatcaacgagcgccagcatgatcacaccaaatgtatcctgaagctgtgtatgtttatataactgattcagaattacattcggattcacatctcgacgaagctcaatacagattctcataccttcacggttagactggtcacttaaatcagtgattccatcaatctttttatcccttacaagttcagcgatcttttcgatcagacgtgctttatttaccatatacggaagctcagtaacaataattctgttctttccgttctgcattggctcaatgtttgtcaccgcacgcactctgatcttaccgcgtcctgttctgtatgcctcttcaattcctcttgttccaaggatctccgcacctgtagggaaatctggtcccttcacgatttcaaggatttcctcgattgtcgtctcttctttatctgcaatctgatcatctatgatctgaacaactgctgaaataacctcacgcagattatgcggcgggatattcgttgccatacctactgcaatacctgatgttccatttaccagaagattcggaaatctggacggaagtacagtaggctccttctctgtttcatcaaagttcgggataaaatctacggtatttttgttaatgtccgctgtcatctccatggagatcctactcagacgtgcctctgtataacgcattgcagcagcgccatcaccgtccactgaaccaaagtttccgtgtccatctacaagaggataacgggtagaccactcctgtgcaagattaacgagagctccataaatcgagctgtctccatgaggatggtattttcccatcgtatcaccgacaatacgcgcacatttacgatgcggtttgtccggtccattatttaattctatcattgagtacagaattcgtctctgtaccggcttaagtccgtctctaacatccggaagagcacgggcagcgattacgctcatggcatagtcgatgtatgaagtctccatcgtctttttcagatcgacttcatggactttgtcaaaaatattgtcttccatcacttgtctccttttttctagggtcagtctatcatattcaaaacctggctgggtttcgcgttcttacgctctgcaccagctcaaaatctgactgggtttcgcgttcttacgctccacaccagctcaaaaatctaactgggtttcgcgttcttacgctccacaccagctcaaaaatctgacgattttttcgctgggttggcatttctaatgccaacccagacaactacgtccaggtctgctttcgagtaaactcgaatcagccctgcccgaagttgcctgttgtgtcgctataactactatatatccaagttttgtacatactttgcgttttcttcgatgaattctcttcttggttctactttgtctcccataagggttgtgaaagtaagatcgagctcggaagaggtctcatcatccatcgttacacgcagaaggattctgtgctccggatccatagttgtctcccaaagctgctctgcatccatttctccaagacctttgtaacgctggatcttattgttgctgtcacgaccaacttctgtaagaatctggttcagttcgtcatcgctgtatgcataccataccttcttgttcttctccagcttatacagcggcggctgcgcaagatatacatatccctctttgatcagatccggcatgaaacggtacaggaatgtcaaaagaagtgtactgatgtgcgctccatcgacatcggcatcggtcatgataatgatcttgtgatatctcagcttactgatatcaaaatcttcgtggattcccgttccaaatgctgtgatcattgccttaatctcagcatttccgtaaatcttatcaagacgtgctttctctacgttcagaatcttaccacgaagtggcaggattgcctgagttgcacggtctctggctgtcttcgcagaaccgccggcggaatctccctcgacaatatagatctcacacttggacggatctttatctgaacagtctgccagttttcccggaagggacattccctcaagagctgactttcttcttgtaagatctcttgcttttctggctgcttcacgggcacgctgtgccataacagacttttcgatgatcatctttgcaacacttggattctgctccaggaagatctccagctgtgttctgacaatattatcaacagctccacgtgcttcactgtttccaagtttctgctttgtctgtccttcaaactgaggatcctcaatcttgacactgacaatcgcagtcagtccctcacggatatcctctcctgaaagctgctcattctctttcagcagcttatttttcttgccataatcgttgaataccttggtcaatgcacttctgaatcctgcaatatgagtaccaccctccggcgttgtaatattgtttacaaaaccgtaagtagtctcattgtaggagtcattatgctgcatagcaacctcaactgcaacattatctttcataccttcacagtaaataatctgctcatagagcgcagttttactcttgttcagatatgttacaaattctttaataccaccttcatagtggaatatatgctcatggatctcttcctcacgaagatctcttaagtgaatcttcaatccctttgtcaggaatgccatctcacggaaacgctgtttcagtgtattataatcaaatactgtttcctcaaagatttccttatccggaaggaaagtaacctttgttcctctcatctccggctcacaatctctgtcaactctgagtttatagcatactttaccacgctcataacgctgtttataaatctttccttcgttggcaatctctacttccagccactcagaaagagcattaacaacagatgcacctactccgtgcaatcctccggataccttgtaccctccaccgccgaatttaccaccggcatgcaggattgtaaatacaacctcaactgcaggaagtcctgccttatggttgattcctacaggaattccacgcccattgtctgtgaccgttatcgaattgtctttgttaatgtctacctgaattttatcacagtatccggccagagcctcatccaccgcattatctacaatctcataaaccaggtgatgaagtcctctgacggaagtgctgccaatgtacatacccggtctttttcttacggcttccaatccttccaaaatctgaatctggtccgctccgtattcagcgtcaaattctgtacctgatgcacccattcttaaacctcctagttttcttttgctacatgtccacttttcacatggaatatcttgttgatagaaaatctatgatttacaaactcatccagtcccgtacaagtaatcaccgtctgtatatcatgaatactatccagtaaatagttttgcctgtttttatctaattcagacaaaacatcgtctaataacaggatcggcgtatccccaatgatccgcttcaccagttcaatctcagctaatttcagcgacagcgcagctgttctttgctgtccctgagaaccaaattttctaatatccaaatctcctgacaggaaacacaggtcatctctatgaggacctacagacgtacttttcatccgcagatccctctccctgtttttcttcagagcctgctccatcgacatctcaccaatacttgattcataagtcaatgacagccgttctttcccgcctgtcagacagaaatgaatctctgaaataatctcattcacctgtcgtacaaattcttttcttctgtccaaaacctttgttccataagcagccagctgcatatcccagatatccagtgtctccagcaaatgctgctggttcgagccatagatatccttcaaaagtgaattacgctggttaataatacggttatagttcgaaagattgttcagatagatcttatcaagctgggaaagctcaagatcaataaatcttcttcttcctgccggaccctctttgataatattaagatcctctggagaaaagaaaacaaaatggacaataccgaataactcacttgcacggcgaatcggtaccttatcgattgcaattcccttcggactgtttttcttcaggtgcatatcgatctggaaaatgattccctttttctcaactactgtctccagatgggattcatcatacccaaactgtatcatatcccgatccttcgttcctctgtgagatttcgtcgttccagacaaatacaatgcttccagtatgtttgtctttccttgagcattgtcaccgtacaaaatatttgttttcggatcaaaggtcaaatctaataaatcataatttctgtaatttttcagctttaaagacttgattatcataatttccccgccatcacgttataacacgagcgagaaaacctctcacatgttattctacacgttttttaattatttttcaatttttatttcatttccgtcaaaagaagctatatcgcccggataaagctttcttccgcgtctcgtatcaatttctccgtttacaagaacaagcccgttctgaattacgtccttagcctcaacaccactttcaactaacccggctgccttgagcgcctgaccaagtttaatgaattcatcctgagggcgcagtttgattatttccatttcttatcactccttaattaatttttatcattgtttttgatctttgtttttatttaaactttttaaacatttttaaacttttaattttctggatttctaaaagtcaaaaaattgcagagcagggcgtctgctccgcataatctattattttctgagtttagacagctgcattaaaattgactggaagaatcagataaatgtaagactgattctcgtctttgataaagcaaggtgcttttgcattcataaaatacaagtctacttcttcatcttcaatcacacgaagtgcatcgatcaaaaactttggattaaatccaatcatcagatcttttccgtcttttgtacagaaaatcagttcatccatagatccaatctgtgatttgatcttcaactccattgattcattcttgatgtcaatgataatcggctttttgtctccctctttgataagcagagttgcacgatcaatacaatctaacagttcttttttattcacatgtactcttgtctcataatcactggacagcatctgatcaattcggaaatattcaccttcaatcagtctggaaacaaccaatgttctgtcaaattcaaagacaatatgattttttgtaaacgaaatctcaacttcagcatccgcttcaccgccaataatcttgctgatttcctgaagagtttttccaggaacaattacttttctcggctgataagcatctttcagttcgattttccggattgaaattctgtgaccatcaagagaaaccactctgagaacatcattgtcaatctcaaaaagttctcctgtcatcatcttgttcgtatcattgtcagcaattgaaaaaatagtctgacgaacaacttctttcaaagtaaactcggaaatagtaataaaatcttcacgctcaatcgccggaagataagaaaaatcatctcctgactgggctgcgatattaaatttcgctttttcacaagtaataatcgcctgattgtcagattctgtttcaataacaacatcattgtctggaagtttacggacaatttctgaaaaaatctttgcatttaatgcaataatacctctggaatcaataattccatcaattgtagtttcaattccaagttccatatcattggcagtcagtttgattacatccgttgttgcatcaatcagaatacattcaagaataggcattgttgttttagagggtactgccttggaaacaatactgactccttttacgagattcgattttttgcatatgattctcatgttgatgattactcctttcaggtttcaaggttacggttggtatgtggataacgtttttttctcgcgtaatttatgtatatttatataaatcgattccgccttctccgccttagggggtgtggataagtggataagtacctgcagccctttaaaatcaagggtttgcgggtttggataactatgtagattacaaaaaaataacgtgttgaaactgtggggaaaaaaattcggcaaaaaatccacatttttgttatcccaacgttattcacatagaaatctacaggttttctacaaagttatccacaattaacgcgaaaaactgacaagttattcacattttatagagttatcttccttatacaggattgattttcttcttaattatattcacagtgttgtttaaagcttcatctgtcttcagatcattctcaattttgcgtacaccatggctaatggaagcatgatctttaccaccgagcagggcaccaatggattttagtggtgtatcggtcatatttctgcacagatacatgacaatctggcgtggaagaacaatctcagcgtttcgttttttaccttttagttcagctaccggtacattaaagtgttcagaaaccacatccatgattagttctggtgaaactgcacgggtatcatccggtgagatcatatccttcaaggcctcagcagccaaaggaatgtcgatcggtttattctccagattagaaagagcgatcagtttattcaaagatccttcaagctcacggatattggatttaatattgttggcaatgtactgcataacctcatccggaatatgatatttctcaagtccgtcgagttcttctttcttacgaagaatcgccattcttgtctcatagtcaggagaggagatgtcagcaatcagaccccactcaaaacgtgtgcgaagtctggcttccagtgtctcaatgtccttcggaggcttatcactggagatgataatctgttttcctgacacatgaaggtggttaaatgtatggaaaaattcttcctgtgtactttcttttcctataataaactgaatatcgtcaatcagaagaacgtcattattacgatatttctctcggaatgtggtcattgccagttcatttccgttcttacctactttaagagcatcgatcagttcattcgtaaaagtttcacttgtgacatacagtacttttttggagggatcatgttccaaaatgtaatgtgccacggagtgcatcaaatgggtctttccaagtccaacacctccatataagaagagagggttgtagatctctcctggagattcggcaactgcgagggaagcagcgtgggcgaaattgttgttgcttccaacgacaaatgtgtcgaaagtatactttggatttaagtttgccttttcataaatcgcatttacacgggtcttctggacggaagactctttcttttccttaatcactttcgggctgtcggttacaaattccacttcatattctgtaccggttacttcggcgatgcagaccttaaaaggaagcagatatttatcttgaatatgttcaagactcgccttcagtttgacgagaatatatacggtattgtctttgacttcataaacagtaagtggtgcaatccatgtagtataagaaatattggatgagcaatattccagcttcatcttgtttagtacctgatcccagttttgttctacaatgttcatcgatagtaactcctaattttttaaaattataatggaaaggttgaaaatccagcgcaaataattcaggacttatccacattcaactcctgattatggcttttagggcagactttcccctacccaaatacaatgttttcagcaactgtttgttaaaaaagtgaaaaacagccactttttattaacttcgtactaaaataatgtggataactctaaaaatggtagagtctctccattacattctacatcaaaaaagctgtagaatcaatgaaaaaacagtgtgtataactttatcaacatcttaaaacgttgataaatatggttttttatgaataaaaaaaattttatcaacacgatatttagtggttttccacaggttatacagaagttatccacatatgttgataactttgtggataacttctgtataactgttgtataattatgtgaaaaaatagttatactccttgatatataagggtttcgaggaactgtgaaattattcacagaaaatgtgaaaaactctttaaaatgaaaaaaggccagaaattaagggaaagattgttgataaagcttgactttatgcggttttccctctataattaagagcagtgtcttttaatattgaggcgcagtaacgaagttaattttgtgaatacttttattataaggtatatcaggcataagggaggtgtaagaatatgaagatgacatttcagccgaagaagagatcaagatctaaagttcacggattcagagcaagaatgagcacaccaggcggaagaaaagttctggcagcaagaagagcaaaaggaagaaaacagttatcagcataggccgcatatatgtggccttttcttctatttaatattaaatgataacaggatttttgttatctggaatgaagaggatattgatgaaattttctgagtctttaaaaaagaataaagattttcagtcagtctacaggaatggaaaatctttcgctaataaatgtcttgtaatgtatataatcccgaacgaactgaataagaaccgactgggaatatcagttagtaagaaggttggaaacagtgtggtaagacatcatcttacccgattgatcagagaaagttatagattatcagaagaacatttccgatgtgggtatgatatagtagtaatcgcgagaacaagtgcaaaggataagaattatcatgatgtggaaagtgcactgatccatcttggaaagcttcatcacatatatgtctgataagacaatgataaggaagtggcgcagatgaagtatgtcttgttatggatgattcgtttttacaggaaatatctgtccggaatgaagggcggatgcacttgtaagtattatccaacctgctcacagtatgggttggaagcaatcgagaagtacggagcactcaagggaggggctctggcggtatggagaatcctgcgctgtaatccattttcaaaaggtggatatgatccggtaccttaaggaggataagtaatggaagtatacggacttttggcttcaggttatggagactggccgattatcaaacagattgcctggcttttaggtcaggtaatgaatggtatcttcaatgtacttagcaagattggtattgagaatattggtgtttgtatcattattttcacaatcattatttatacattgatgattccgcttacaatcaagcagcagaagttttctaagatgtcagctgttatgcagccggagatcaagaaaattcagaaaaaatacgaaggaaagaaagatcaggcttcaatgatgaagcagcaggaagagatcaatcttgtttatgagaagtatggaacttccatgacaggtggatgcctcccgatgttgatccagatgccgattctgttcgcgctgtatccggttatccgtgatattccgacgtatgtaaaaggtgttaaagatgtttatatgcctgtgacagaagcaatcatgaatacaaatggcttccagaagatcatggagacgatcggtgaagtaagcccggttcttatgaacccaaaggcttatgattattcccaggcagatacaattgtaaatgtactctataaattccaggattctacatggaatacgctgatggaaaagatgccgagtatcacggatcttgcacagcagacaatggataaggttactcacctgaacagtttccttggaattaatattggagagcagccgctgacacagttgacaactgcattacacaacggatctgttgtaggaatcatccttgcagtacttattccggtacttgcaggtctgacacagtttatcagtgttaagcttcagccacagccggcaggagatgacaaagataacccgatggcaagctctatgaagacaatgacatacacaatgccgctgatctcagtatttatgggattcacacttccggcaggtcttggtctctactgggcagcaagtgcagcagtaagatgtattcagcagcttgcaatcaacaaatatctcagcacaaagtctcttgatgagatgatcaaagagaaccaggagaaagcacagaagaaacgtgagaaacacggagctcctgcaaaagagatcaataagatggcaacaacaagtactcgtaatgtgggtactgttacaaaaggaaaatctggaatttctgaagcagagagagaagaaaagatccagaaagcacagcagaaggctcagaattctaagccgggaagccttgcttctaaggcaaatctggtaagccgttataacagcggacagcagacaaaccagccgaaggcagaagatgagagcagctccaaaggaaaaaagggcaagaaaaaataaaggaagattcgtaactcctaaccgttctcttaaaaagcaggagacgggtcaggatttgaagatggaggaatcgggatgaacggtagtatcagagtatcggcgaaaacagttgatgatgcgatcacagaagcattgatccagcttggtgtaacaagcgacagactggagtacgaagtaatcgagaagggaagcgcaggattcctgggaatcggaatgaagcaggcagttattgaagcaagaagaaaaccggaaccgaaagaggagaaggtagaagagcctgtagtagaagaacctgtgagagtagagccaaagaaggttgaagcagttcagcctcagaaagcagctgcagaaaagaaagcggatgaacctcagaaggctgcttttgaaaaagctgtagaaaaagaagcaaaagaggaagttaagaaagagacaaaacttgtagaagttcagcctcagacaatcaaagcagtagaagatttcctcaagaatacaatgaaagccatggacatggaagttgagcttaagactgagatcgatcaggatggtgcactttgcgtagatatgagtggagagcatatgggaattctgattggtaagagaggacagactctggattctctgcagtatcttgcgaaccgtgtagcgaacaagcatcaggaaggttatgtaagagtaaagcttgacacagagaactatcgtgcaagaagagaagagactctgagacaccttgcaaagaacattgcacataaggtaaagagaaacagaagaccggtagcacttgagccgatgaatccttatgagagaagaatcatccactcagcactgcagtcagatccttatgtgatgacacacagtgagggagaagagccgttcagaaaagttgttattactttgaagaaataatactgtttatgaatcggaagcgaaaggacgtttacgcttcacggatactttcgtgaggtgtggaacgtccttttttctatggtaaaatatgatgatattagaatacagagcaggaaaacagaaaggaaataaggcatgaatcaggatacgattgcagcgatttctacaggtatgactaattcgggaatcggaattgtaagaatcagcggaagtgaagcgctggagatagcagatcgtgtatataaagggaaagaaacgattacagaagtgccaacgcatacgattcattatggacatataatggatggagatgagacagttgacgaagtacttgtgatggtgatgcgcggacctcgtacatttacaggagaagacacagttgagatcaactgccacggtggaacttatgttgtaagcagagttttggagacggtcttaaaggcgggagcaagaccggcagagccgggagaatttaccaagagggcattcttaaacggcaagatggatctgtcacaggcagaggcggtcatcgatgtgatcacatcagaaaatgagtatgcattgcagagttcgatcagccagctcaagggaagtgtgaagaacaggatcaaagagatccgtgagaagattatttatcatacagcgtttattgagactgcgctggatgatccggagcatatcagtgtcgatggatatggtgaggtgctaaaggaggcagcagaagaggtgatcgatcagctgaaagaactgattgattcctcggatgatggaaggatcatgaaagaggggatccagacagtaattcttggaaaaccgaatgcaggaaagtcatcccttctgaatattctggcgggtcatgatcgtgcgattgttacagatattgaaggaacgacaagagatgtcttagaggagcagatccgtctgcagggactgactttgaatattatagacactgcaggaatccgtcagacagacgatattgtggaaaaaatgggtgtcgataaggcgaaagaatacgcaaaagaggcagatcttattatttatgttgtagatgcatcaagaaatcttgacgaaaatgatgaaaaaatctttgatttgatttatgataaaagaacagtgattctgcttaataagtcggatctggatactgtagtgaaagaagagatgatccgcgaaaggatttcacaaaagggtgttcagaagcagattcctgtgattgcgatttctgcgaaggaagagcagggaatcaaggaacttgagaacaccgtgaaagcaatgttcttaaagggagatctctcattcaatgaagaggtttatattacaaatgcaagacagaaaaatgcattggtcaatgcgagagagagtatgaagaaagtcattttcagcattgacgccggcatgccggaggatttctattcgatcgatctgatggatgcctatgaatcacttggaaatattaccggagaatcaataggagaagatttagtaaatgaaatattcagcaagttctgtatgggaaaataaagatgaatatgatgttgtcgttgtaggcgcaggacatgcgggctgtgaggctgcacttgcgactgcaagacttggatttaagacagtgatctttacggtcagtgtggacagtattgcgctgatgccatgcaatccgaatatcggaggaagctcaaagggacatttggtcagagagctggatgcacttggcggagagatgggaaaagtcattgaccagacatttatccagtctaagatgcttaacagttcaaaaggtcctgccgtgcattcactgcgtgcacaggcggataaggcaaattatagtaaaacaatgcgtcaggtgcttcagaaccaggagaatctggatatccgtcagatggaagtgacagagatcctggcagaggatgggaagatcacaggagtacagacgtactcaggcgctatttaccgctgtaaggccgttgtactctgtacgggtacatatttaaaggcacgctgtatttacggcgaaataagcacacatacgggccctaacgggcttcagagtgccaactacctgacagatagtctgaaagcactcggaattaagatgtatcgcttcaaaacaggtacaccggcgcgtattgataagaatacgattgatttcagcaagatgcaggagcagaaaggagatgagagggttgtaccgttctcgtttactacagatcctgagagtgttcagatcgatcaggcgtcctgctggctgacttatacgaatgagacaacacatgagatcatccgtggcaatctggaccgttcaccgctttattcaggagcaattgaaggtacgggaccgagatattgtccgtctatcgaggataaggttgtgaaattcccggacaagaaccgtcatcaggtgtttatcgagccggaaggacttgagacgaatgaaatgtatgtcggtggaatgtccagttcacttccggaagatgtccagtatgcaatgtacagaagtgtgccgggactggaacatgcgaagatcgtgcgaaatgcgtatgcgatcgagtatgactgcattgatgcgagacagttgaagagtacattggaattcaaagagattgaaggtctgttcagtggtggacagtttaacggaagttcaggttatgaagaggctgcttcccagggactgatcgcaggaatcaatgcagcgagaaagctgcagggaaaagaaggtatcgtgatcgacagatctcaagggtatatcggagttctgatcgatgatcttgtcacaaaagagagtcatgaaccgtatcgtatgatgacttcacgcgcagagtacagactgcttcttcgtcaggataatgcagatatacgtcttacaaagattggttacgaggtgggcctgatcgatgaggagagatatcagaaactgttgaaaaaggaagagatgatcgagaaagagatcgagcgtgtggagcacacaaatgtaggtactacagaagctgtacaggcattgcttgaatcatatgaaagcacaccgctgacatcaggaacaacacttgcagagctgatacgcagaccggagttgtcttatgagaagatcgcaccgatcgataagcacagagaagaactgccatatgatgtgaaagaacaggttgatattaatatcaaatatgacggttatatcaagcgtcagatgcgtcaggtagagcagtttaagaagcttgagaacaagagaattccagaaaatattaattatgatgagattcagagccttcgtcttgaggcaaaacagaaactgaatcagatccgtccgtcgtcaatcggtcaggcatccagaatctcaggagtttcaccggcagatgtgtccgtgcttcttgtatatttaagcagtaaataaaagtgttagttaaagagatacatgagaatctaaaaatgctataataatattctacggaacggtattgtcggattgttgaaactgttccgtgggaaataatgattggagaatatagtgggagagaacacacagagtaaatttgatctagaattagaaaaaatcggaatcacattaaatgagcggcagaagcagcagttcgacaagtattatgaaatgctagttgagtggaataaagtgatgaatctgacagggatcacggagtatgatgaggtgaatctgaagcactttacagatagtctgacaatcgcaagaacacaggagatgcagaaggtgcagagcgtgattgatatcggaacaggagctggtttcccggggattcctctgaagattgcatttccgcatctgaaggttgtacttcttgattcgctgaataaacgaattaagttcttagatgcagtaattgaagaattaggattggaaaatatcagtacaattcatggaagagcagaagattttgcaaagaaaaaggaatacagagagcagtttgatctctgcgtttcaagagctgttgcgaatctgtcaacattgagtgagtattgccttccatttgtagctgtaaatggcagttttgtttcttataaaagtggagattctgaagaagaaatccatcaggcaaaacatgcgatttcactgttaggtggaaaagtaaagaatgtggataagttccaattacctggaacagacatgggtcgtgcacttgttgaaataaaaaaaacaaagcagacaccgggcaaatatcctagaaaagcaggattaccggcaaaagaaccattaaaataagcaaatatatgaggacctgtttactggcattctggtgaataggtcttcatttttgagtgtattgttgaaaaatgccgaaatagtcagaaaataagtctaaaaagaagatatcctcaaaaaaagaaggagttatccacattttccacatgagatattcactctgtgtggatatctcatgtggaaaatgtggataactctagtttttagaaaaaatatgatacgagtaaaatttctaatttatgcgatattctattcacattcttcagcgtctgacaagaaaatttctacattttcaatgaattcgtcacatttttcaatatgaggaagttgtttggttttggccattcctgcaatttcaatcgaaggaagatagttctgatattcactggctgccaaagaattttcaggattactatttcctacaataatggagatgctgttatttaatttattcagacagtgaagaacatttgcattcgtatatctcgtcttttgacaggcgaaaagatatttggaatttgtatgttctttgtgtgctgcttcaaagtaggtgagaatatctttttcactaatttcattctgagtataataagaagagcagagggcatgagcaattgtcttcttatttacatacatattatagataaatgtacccagaataggagaatacaggatattctttatgaatttactacgttttgtaggaatctttgccaggtctaccagattcggcggatttatcataataactttatttataattgtttcatcgtttgcacaggccattagtacaaatggacaggattcaccagaaacaattacatcagttttttctccgataatatgtttgataaagttcgtgattaattctacatacagataattagtatatgttaatcccggacggtcggaacaaccgcagcctaaaagatcaattgtatatacagtatgggacttggcaagttcctctatattgtttctccattcataggaagaagaacatacattgagattatgcactaaaagtaaaggtgatccttcaccagttttcttatatgcgattttgccaaatctccagttatagtattcatattcatcagaattgattaatttatcagcagttgagatatattctaatacacggttggcaatatgcattgcaccgagagaaactcctgctaaagtagtaaaaaaagttagttttttcttaatactcaaattattcaccttccttattataatagtggtttgttttatataaaagtaagagcctgaattaaaagaaactcttactttattatactacattcttaaattcaaataaagcgaaaaaatcttaatgtttaattatagaagatagtggattatctctaaaaatgtttcacgtgaaacatttttgatccgcacaatcaaatccgcaccctgcgcgtataatacagttatttacaaaatgcagtactagaaataactgagaaaacacaatgtttcacgtgaaacattttagaaaatgagaaaaatgaaaaggaagatgtttcacgtgaaacatttgattagttctagattaatgaaaagaaaggtgatataataatgaatgtccgagagaaaggagtaaaaataatgggtagagtgatagcaattgcgaatcagaaaggtggagttggtaagactacaacagcaatcaacttatcggcctctttagctagttcgggaaaaaaagtgcttgctatagatatggatcctcagggaaatatgtccagtggattgggcgttgataagaatgaggttgaaaagacaatttatgaacttattattggtaagtgtaaaattgaggagtgtatttgcaaggaaccaatagaaaacctgagtgtagatgtgcttccgtcaagtattgatttatcagccgctgagattgaactgattggcgttgacaataaggaatatattttacgagatgaagttgaaaagataaaagataattatgactttataattattgactgccctccggcattgagcatgcttacaattaatgcaatgactacttctgactcggtgattgttccaattcagtgtgagtattatgcgctggaaggattaagtcaattgatgcatacgattgaacttgttcaggatagactgaatccgaaacttgaaatggaaggtgtcgtatttacaatgtacgatgcaagaacaaatttatcattacaggtagtggaaaatgtaaaagataacctgaaccaaaatatttataagacaattattccgagaaatgtccgactggctgaagcaccaagttatggacttccaatcaatctgtatgatccaaaatccaaaggaacagagagttacatgcttttagcagaagaagtgattaataaaggagaataagtatgcctgtgaagaagagcggacttggaaaaggattggatagtctaatcccaaacaaaaacgttaaaagcgcaaaaccttctgtaaaagcggacgagaaaaaggcagctccgaaagaagaaattttagaggcaggaccgatcatggtgaagataaataaagttgaaccaaatcgggaacagccacggaaagattttgatgaagatgcattgatggaacttgcagattcaattaagcagtttggtgtattgcagccgattcttgttcagaagaagaaggactattatgaaattattgccggtgagagaagatggcgcgcggcaaagctggcaggattgaaagaagtgccaattatcgtaaaagaatttacagagcaggaaattgttgagatttctttgattgagaatattcagagagaaaatctgaatccgattgaagaagcaatggcttataagagactgttgaaagaatttaacttgaaacaggatgaagttgctgaacgagtgtcaaagagcagaactgcggttacgaactcaatgagattattaaaactgaatgacagagttcagcagatgatcattgacgatatgatcagtacaggccatgcaagagctcttctggcaatcgaggatgaagagcagcagtacatgcttgccaacaaaatctttgatgagaagcttagtgttcgcgagacagagaaactggtgaaggctctgaagaatccgaaaaaggaagaaaaaaagccggaagtagaaaatcagtttgtatacacaaatcttgaagagcagatgaagagtctgatcggtacaaaagtaagtgttcatgcgaaagcaaatggaaaaggaaagattgagattgagtattactcaccggatgatctggaaagaatctatgagttgctcatgacaatccagcataattaaaaaggagatggtagaagtgactggagtatttggcaatctgggaattgatccattctacgcatttcttattttacttattttgcaggtagccttgcttgtcgtacttgtgttagtgtatgataagtataaacacctggaaaaagtattcaatacctttatgaagggaaagaatgggaaatcactggaggaatccatttttgaacggtttgacaagatcgacgaagtcgtagatcaggtagaagaaaaccgtgaggagattgcagaactttataataaaatgaaaacgcattaccagaaagtcggaatcgtaaaatatgatgcattccatgaaatgggaggcgaattaagttttgcaattacaatgttagatgaaaacaatactggatggatcttaaatataatgcatagccggcagggctgttatgcatatgtgaaagatattgtaaaaggtgagagtacaattcagctggcagaggaagaaagagaaagtcttgagaaagctatttttcaagaaaaataaatagtaaaaaagaaattagacaggaaagggtaaataaacatgttagacatcaaatttgtaagaaataatccggatgtagtaaaacagaacatcaaaaataaatttcaggatgagaagcttccacttgttgatgaagtaattgaactggataagagaaacagagaaatcaaacaggaagtagaagcacttcgcgcagagaaaaacaaagcttctaaggaaatcggagcaatgatggctcagaagaagattgaagaagcagaagcactgaagaagaaagttgcagagagcaatggacgtatcaatgaactttcagaggaagagaaagaagtagaagagaaactgaaaaagaatatgatgatcatcccgaacatcattgatccttccgtaccgatcggtaaagatgacagtgagaacgtagaggtagaaagatttggcgagccggttgttccggatttcgaagttccatatcacacagatattatggaatctttcaatggaatcgatctcgatgctgcaagaagagtagcaggtaatggattttattatttgatgggagatatcgcaagacttcactcagcagttatctcttatgcaagagatttcatgatcaacagaggattcacatactgtgtaccacctttcatgatcagaagcaacgttgtaacaggtgttatgagctttgctgagatggatgccatgatgtacaagattgaaggagaagacctttatctgatcggaacaagtgaacattccatgattggtaaattcattggacagacactggagaaagatcaggttccacagactctgacaagttattcaccttgcttcagaaaagaaaaaggtgctcacggaattgaggagcgtggagtttacagaatccaccagttcgagaaacaggaaatgatcgttgtctgcgaaccggaagaaagcaaagaatggtatgacaaactgtggaagaatacagtagaccttttccgttctatggatattccggtacgtacacttgagtgctgctccggagatcttgcagatctgaaagtaaaatctgttgacgtagaagcatggtcaccaagacagcagaaatacttcgaggtaggaagctgctctaacttaggagatgcccaggcaagaagacttggtatccgtatcaaaggagagaacggaagctacttcgctcatacattaaacaacacagttgttgctccaccgagaatgctgatcgcgttccttgagaacaatcttcaggcagatggttctgtaagaattccggaagttcttcagccatacatgggtggaaacaaagaaattacaccaaagaacaaataaagaaatataaagcaaataaaatatgcatcagtatttaaaagcaattggatttgaaaatattcaaacaagaaaagatctgaaaaagctcttaaaagaagtagaagagaatttcacacatcagacaattgtatcctacagaccgggcgaagatttctgcgaatttcagaaagagttcggtcaggatgtagggatcacactctgcggagaacttgatgatgaggaacattttgaagctgcatattatttcccgtattttgaaggaagcggagttacaacgtatgcagaaatcgatgtgcagagaaagattgagaaagaacagtatgttggtctttgtgaagattctaaaattggaatcagtctgatcttcacactgcagaatggtgtggaatatatgcgggagaaacaggctggtcttgcaaaagatgtgcagacctcagtgacattttcaggattggcacaaggtggaatgatcctgcttccggttaataaaaatgagcagcagattttaaatgaaaagcgtgcgtcagatacaagaagagaattgatgaacgcagcccgcaagggcgaccaggcagcaatcgagacgctgacatttgacgatatggatctctattccaaggtgtcaaagagattggcgaatgaggatgtattttccattgtggacacatatttcatgccgtttggagcagaatgtgatatgtattcgatcatgggagaaatcctggcagtgagagagcggatcaacagaatgacaggtgtgagactgtatcagatgcgtctgaatgtaaatgaactgacatttgatgtctgcgttccggcagattccgtgatgggagagccggagattggaagacggttcaaaggtacgatctggctgcagggatatattaatttttaaaaatgaagagaaattgttgctggacacacgcagtgtgaaaagtaatgggaaatccacatccggaatgtgaaaaacatggaataaatgtggaaaaaagatttcatttaacagaagaatgtggataacaaagacaccatctctggctgaaagtaattcagtcaggagatggtgtcttttacaattcgtgccattttagcatgattcgtgccaaaagaattgaaaataagagatgtttttttataataaaaacataactgttcagagccaaccttcaaaatgctacgcatttcgtcggtgtggcgtatccgccaaataaaatttcaaaaaatgcaagcattttacacctgttttatgaaattttgcttggctctgaacagttacacattatatatcaattacacctcagtgcaatttttttctttttcagcatgaagatagttcatgaccattgttgcaatcttaaatgtcattgcatcttcgaattgccttaagtcaagtccggtacgcttttcaatctgctccagacgatagatcagcgtgttacggtgcatatgaagctggcgtgaagtctcagcaatgttcagattattctgaaggaaacggttgatcgtcaggagtgtctcatcatccagcttgtccggaatcttgtctaagaaaacttcctggagaaagctttcgcacagtgaaacaggaagctgataaatcaggcggccaatccccagttcattgtatggaaagacagtctgttccggatagaaaagttttccaactttcagtgcaagacttgcttcacgaaaagccccggataattccaaaagagaaggaatcatctgactaaaagaaacctgaacatgtgcaagagcttccgcattcagcgtgtcaacaatcgcatgagccagatgtcttgcatgttcatcagcagaatctttggaatcctttgtctcatgaaatggatataatacagccagtcgctcttttgaaacaggaatgatataagcttttgtctgagaaggaaacagatttttaaggatctctgcaacaatctcgtcaggttctttcatttcaatcaaaaagagaattcgattttcttccggtgcaatgtggagccgtgcggcacgctgctgtacatcgtaggaaggaacaccgccggtcattagtcccataagaaaatcatttttattatatttttcccggtaggcaaggcagagacagcgaatctgttccagggccatctgctcctgttcagaatctttggcagtcactgcaagtgtgattccggtcaaacgttttaattcattgagtcctttttcaagttcggatgtattagccatagtaatctccgtaaataaaataataatagatggaagaaaggctgcaccttccgagaaaagtacagccccctccgtgtttagtttaattgtaaaggattagtttgtaatagtcaactctgtgtctttgtcaaagagatgaatcttttccatatcaagtgcaaatactgcatgatctccagttctgagtgttgtacgtgggttaacacgtgctgtcaactgagttccctcaacatcgaagtacaggaatacttctgctccaagcagctcgtaaactttgattgtagactcaattacgctgtcaggagagttactgataaatgcctgtgagtcatgtacatcttccggacgaataccaagaacaactgtctttccgtcatatccgccatcaatcagtgcctgcttcttagaagccggtaccttaagaacatgttttccaactgtaagagtaacatcatttcccttaattgtacattttgcatccatgaagttcatctgaggtgatccgatgaatcctgctacgaacaggttgcatggtgtattgtaaagtgcctgtggtgtatctacctgctgaacaactccgtctttcataacaacgattcttgttccaagtgtcatagcctctgtctggtcatgtgttacgtagatgattgtagcacccagattctcatgaagcttggaaatctcgatacgcatctgaactctcagtttagcatccaggttggaaagtggctcatccataaggaataccttaggattacgaacgatagcacgtcccatagcaacacgctgtctctgtccaccggaaagagccttcggtttacgatcaagcagtttgtcaaggtcaagaatcttggcagcctcacgaaccttcttatcaatctcatctttcggaactttacgaagtttcagtccgaaagccatgttatcatatactgtcatatgtggatacagagcgtagttctggaataccattgcaatatcacgatcctttggctctacatcgttcattacttttccatcgatcttaagtgtaccgccagagatatcctccagaccagcgatcatacgaagtgttgtagatttaccacatcctgatggtcctacgaagatgatgaactccttgtcagcgatttcaagattgaaatcttttactgcgtgaaatccgttaggataaattttctgaattccctgaagagataaacttgccattataagtgcctccttaaatgattattttttacttgtttgactaaatttggttttgttttttaattggtagttgattttggtttgtttaacttatgtacttagtatagcgttaggtacgaaaatcaacaatgtcacgagtgactaaaaaaaggaggggaaagtgtacatttcaaccatatgaggaagaatgatggttgaagttatgaaataaatccgctacaataagactattcacagtgtatagaaaactgcgaacgattattatagaagaaaagaggaattaaacatggcaaatccagtagttacatttgaaatggaaaatggcgatatcatgaaagcagaactgtatccggaagtagcaccgaatacagtgaacaattttgtgtcacttgtaaagaaaggattctatgacggattgatcttccaccgcgtaatcagtggattcatgatccagggaggagatccggaaggaacaggaatcggtggtcctggatattcaatcaaaggagagtttgcacagaatggtgtggcgaacaaccttgtacatgatgcaggagttctttctatggcacgtgcaatgcatccggattcagcaggaagccagttcttcattatgcataagaaagcaccacaccttgacggagcttatgctgcatttggtaagatcacagaaggaatggatgtagtgaataagattgctgagacagcaacagactacagcgaccgcccgcttgagaaacagataatgaagaaagttactgttgagacattcggagaggattatccggagccggaaacagtatagttcataaaaactttatacttttaacgaaattattagcactctttcaaaaggagtgctaattttctattgacttttaaattttgctgtactagaatgtccattaggcaagcaaatatactatcgatatcagcgaaaaagctgattgacagccgatattaaaagaaacgtaactgagcagttacggatagattataaataaaaaggagtgcagtaaaatggcagttaaaaaaggtactttatcaattgacagcgaaaacatttttcctattatcaagaaatgggtttattccgatcatgatatctttgtacgtgaactcgtatccaacggatgtgatgcgatcactaagttgaaaaagctggacatgatgggagaatatgaactcccggaagattataaaccgaagattgaagtaattgtcaatccagaagagaagacaatgaagtttatcgataacggacttggtatgacagcagaagaagtagaggagtatatcactcagatcgcattttcaggtgcaacacagttccttgagaaatataaagataagacaacagacgatgagatgattggacacttcggacttggattctattctgcattcatggtagcagacgaagttcagattgatactctttcttataaagaaggcgcaaagccggtacactgggcaagtcagggcggtacagagtatgagatgcaggaaggaaataagacaacagttggaagtgagatcacactgttcctgaatgaggatagtcttgaatttgcaaacgagtaccgtgcaagagaagtgcttgagagatattgttctttcatgccggtagagatcttcctctccaaggcaaatgcagagccggagtacgatacaatcgatgaggcagatgttcttgatacagatactgtagtagagcatattacagaggaaccaaaggaaggcgaagagggcgagccgaagcagaaagcgaagattgtaagacgtccggtatctatcagtgatacacacccactttggacaaagaatccaagtgagtgcacaaaggatgactatattgatttttaccgcaaggtgttcatggattacaaagagccactgttctggatccacctgaacatggattatccgtttaacttaaagggaatcctttacttcccgaagatcaatacagagtatgattccatcgaaggaaagattaaactttacaataaccaggtatttatcgcagataatattaaagaagtaatcccagagttccttatggtacttaagggagtgatcgactgtccggatctgccgttgaacgtatcacgtagtgcactgcagaacgacggatttgtaaataaagttgctgattacatttccaagaaggttgctgacaagttgaacggaatgttcaagacagaccgtgaaaactacgagaaatattgggatgacatcagtccattcatcaagttcggctgcctgaaagatgagaaattcggcgagaaaatgaagaattctatgctttacaagaatcttgatcataaatacatgactctcgaagatatcatcaaagaagccaaaggcgaagaagctgacgcagccaagacagaggaagctaaggcagaagaaacaaaaacagacgcagaagagtctaaggacgcagatgcgaaggaagaagagaaaacaagaatcttctatgtaacagatgaagtgcagcagagccagtacatcaacatgttcaaggcccagggacaggatgcgatcattctgacacataacattgattctgcatttatcacatatcttgagcagaaacatcaggaagttcagttcttgagaattgatgcagatgtacatgattctctgaaggatgaagttgcagaagatgagaaggaagaattccagaagacaacagacagccttgttgaaatcttccgcaaagagcttggcaatgagaagcttgatgttaaagttgaaaagctcaaagatgagaatgtagcatctatggcagttctttctgaggaaaacagaagaatgcaggagatgatgaagatgtatggtatgggcggcatggatgcatccatgttcggaagccaggcaacactggtactcaatgctaaccatccacttgttcagttccttgtaacgaacaaagacagcgagaacgtgtcaatcatctgcaaacagctgtatgaccttgcaatgcttgctcataagccgttaagcccggaagagatgacagcattcgttaagagaagcaatgatattatgatgcttctgacaaaataataaagtaaaatgatgagaaatatgttctatgagtttctcatcattggcagtaataagttcagccgcttcacgattatctgaccgtgaggcggctgttattatgtgcgccttgcggcacacattgctaatggattttcaaatttacatcaactcaaattcaatctctttttttaaaaagaacttctttaccatctcatcccattcgcgttccagggtcttatccatcataaaactcttgaaggaagttcctgtcacgcaggtgagatgagttccatcgtaacgtatattcaaatatagtccctgcacgtcagcaggattaagtcccagttctttctgttcaatcagacgggaaatattctttgaattcaggctgaagacaaaatgaaaaccgagcggtgttttctttcctttaattaaggaaaaacaaaattcacgcagatttttccaaagagaatattccggaatctcttcttcggaatcaaagaaatctttctgcatatacccgtcaatccgaaaggtattaaacgtaataatctctccttcaataaaagagaaattgtcaaaggtctcttttaacagaaggtgagacatgaagctttttacatttgttaaagtcagtgaaatcatataaatcagatacctccgcagtattaacaattactagaaattatagattgtaacagtctattcattattgtactagaagacagaataagatacaagtgtagaattaaacgcacaagatgcattttcattgacttttaagtctaaaaaaagtatgattatatcggtatgcaaattgataaatataataaaaaacaagctttttgcaggtacatttttagataaaaatcagaaagaatagaatgttatgaagaaaaaaaacgatagaaaaagacaacgcagtatccgagtggggattgcaggtgttgcgattgtaacagcagtactcttgacagtacagggtgtcagtcatttgacgaagaaatcagtagacacaagtaaggggattgaatatattaagagcaaagaatctgcagatgcgaagacgatagaacagaagatcaaacaggcagagagacaggattttatcgtggatggaaaagatacgagaagtctgaaagaacgtttttccggagtggttgtgatgggagattctatcacggaggcatttgaggagtatgatgtattaaattcttccagtgtagtggcaaaagtcggaattaactttaatgaagtagatgaacagattgagcaggcaaggcagcttgatccgcaagtaattttccttaattatggaaataatgatatagaagcagatcaggatacatttattaaagaatactcgtctataatcaaaaagatacagaaatcgataccggatgcacatatttttgtgaatgcgatgtttccagtgcaggataaagcacttcagaaagaaccggcatttgttaatattgcggaatacaataaagcaattgaagctttgtgcgaaaagctgcaagtagggtatcttgacagctccgatctggtgaaagacgagtattacgagccggatggaatccattttaaggcggagttctatccaatctgggctgagaaaatgtcggaggtagctacattatgacagataaaagacagaaaataattgccgggatgaagtatgtcatacttgtgtttattattttgtatttgattatgctgatggtttatgcaagtggaagcaagcgagctttttcagaagtagagaaggcagttagcagtgtgttgaatagtgatgaattgacaaagatggatgaacggatgttgaaaaagaatttcggattgaacagcgcagactatcagggcgtgatgtactatgcttctccatcgagtgtatcagcagcggaagtacttctgatacaggtaaaaaatgaatcacagacagatgctgtaacagatgcgatcgaaaagagaaaagcacagcggatggaggatttcgaggggtatcttccagaagaggtgaagctgttagaagatgcacagcttagtgtcagaggaaaatacattttttatgcggtatcatcggatgcttctaagtacagaaacacttttgataaaagtttatagggggaaaggaatacaagatgttattcagtagtattacatttttgtttttatttttgccaattatgttggcggtatattatattgcaccattccggttaaagaatggactgcttttgattggaagcttgtttttctatgcatggggagaaccggtttatattatattaatggtgttgagtattctgctgaattatttttgcggaatggatatcgaaaacaacagtgagaatgaggcgaaagcgaagagaagtctgatttttgcagttgtggtaaatattcttttactggtattttttaagtattttggattttttgtggaaagcatcaatggtttgttccaggttcatattccatatcgagaacttgcattgccgataggaatttcattttacacatttcaggaactttcatatattattgatgtttacagaggaaaggtaaaagcacagcatagtcttgtggattttgcattgtatgtatctttgtttccacagttgatcgcaggaccaatcgtttgttatgaagaaatcgaagaacagctttcatccagaaaaatatctgcgaggaaacttggaaacggagcaatgctctttattgtagggcttgcaaaaaaagtcatccttgccaatacgatgggagagatttttgaacagattacttccacagcgacaagtaatcttactgttttgatggcatggctcggatgtattacctatgcattccagatttattttgatttcagtggttactctgatatggcaatcggacttggaagaatgtttggatttgaattcaggaagaattttgatattccgtatgtgtcaaaaagtgttacagaattctggagaagatggcatatttctctgagctcctggttccgcgagtatgtgtacattccacttggaggaaaccgtgtgacgatatcaagaaatattttaaacttgatgatcgtatgggcactgacaggaatgtggcatggagcagcatggaactttatcgtatggggattatattatggagtgattcttgtctttgaaaaatatgtatggggagcaattgtggatagcctgccggcagcattacaacatgtgtatgcgctggttctgattttagttggttgggtgttctttttcagtccaagtcttggagctgcaatccgttatctgtttgcaatggtcggcggaggcgccgggtttgtggatcgtgaagtattctttgtgatatttacgcattggttattttacttattggctgtcattgcgtctacagcggttggcggaaaggtgttgaagaagatattgaattgttcaagaaaatctgctgtacgcacagcagtgacaattgttgtattttttggaatgttggcagtttctgtcgcatatctgattacaagtacatacaatccatttttgtattttagattttgataagagaattaaggtggaagaatgaaaaataagagaaacagaagtatgcgggaaaccctgattggaaatttgttcgttttgatcttgtttgtgttcatgcttgtgaacataatcgtacccgataagacaaaatctgaaatggagaatcgtatgctcacaacaaagccgaagttgcaatggagcagtatcgtgaatggcgattatacgaaaaagtttgaaaattatatgacagatcaattcgttggcagggacttttggagaaagatgaaggttgctgtagatcagattggcggtggacgtcaggaaaatggcgttttaaaagggaaaaaaggacagttgatggaacaaatcgaggtggcggataaagaacatctggcagcgaatctaaaggcaatcaagtcttttgcagagagtcagagtgatattccggtaaaaatgatgcttgttccagatgcagcgaatgttttggaaaaagatcttccggcgttcgcaaaagtagaagatcagacacagatgttcagtatggtgaaaaaggatcttggagatgctgttgaatggatcgatgtagcaacagaattgagcaagcacacaaatgaaaagatttattacaaaacggaccatcactggacaacacttggagcattttatgcgtttcaggcagcagccccttctttgggaataacagatgatatgtcaggaaaatatgtatcttatgcagtgacagacagtttcaatggttctttggcatcaaaaagcggaatgaatctgaaagagaaggaacagattgacatctatgttccgacagaagaagatacagatctgattgtagactatgtggatgaaggaaaacgtgtaacatcattatataattcttctgcgctgaaagaaaaagacaagtatacagtatttttgggcggcaattattctttacttgatattcgtacagtttcaacaagcaaggagaaactattgatcgtgaaagactcctttgcgaattcatttataccgttcctgacaccatactacagagaaatcgtagttgtggatccgagatattacagcggaacgatcaatgatcttatggattcctacagaatctcagaggttctgtttttatacagtggaaatacatttttcaaagacaataatataagtggagtgtttgcagttgagtaatcgaatcaaagaagaatttttacagaagagtgagccggtaaggctgaataaatatttgagcgaggcgggcgtgtgttccagaagggaggcagaccgcctcattgagattggacgcgtgacggttgatggacagcgtgcgcagaccggtatgcgtatcgtgccgggacaggttgtgaaagttggaaataaagtcgtttccaaacaggacgagatgatcgtgctggcagtgaataagccgcgcgggattgtctgtacagaagaacgcagagaaagggacagcattgtccgtttcctgaattatccagtgcgtgtgacttatatcggacgacttgataaggattctcatggactccttctgatgacgaacaacggtgatatcatcaataaaatgatgcgtgcagccaataaacatgagaaagagtataaagtaactgtagataaagaaatcacagaagatttcctgaagaagatggcatccggagttccgatccttgatactgtgacccgtccgtgtactgtaaaaaagattggaaagtatacattttctattatcctgactcaaggactgaaccgccagatccgcagaatgtgtgaagctctcggatatgaagtgaaggatcttttacgcgttcgtgtgatgaacattacactggatggactgaaggatggacagtacagaaaactgacagatcaggaactgaatgaattatatgatcagctgaaagattcttccgtacttccgggaggaaaataccaggaacagtgggcagcagcacaagataatagaacgagacatgggaaagggaagaagcgatgatggatgagcagaaagaaatgaatcacatgcgagaactggtggaacttctgaacagagcgagacgttcttatgagcaggaaaatacagagatcatgagcaactacgagtatgacaagctctatgatgaactgcaggagttggaagagaagcttggtacgagaatggcaaacagtccgacggtaaatgttggatatgaagtactcagtgagctcccgaaagaacgtcatgagcgtccgatgctttctctggacaaaacgaaagatgtagaaaggctgaaggaattcctaggcggacaaaaagcattaatctcctggaaactggatggacttactgttgttctgacctatcagaacggagaacttgcgaaggcagtcaccagaggaaacggagtgatcggtgaggtcattacaaacaatgcgaaagtatttaaaaatgtaccgcttaagattccatatcagggagaacttgtactgcgaggagaggcagttatttcctataaagatttcgagaagatcaatgaagagattgaggatgtagatgcgaaatataagaatccacgaaatctttgcagcggttctgttcgtcagctgaataatgaaatcactgcaaagagaaatgtaagattctacgcatttacactcgttcgtgcagaaggcgtggatttccagaattccagaaaatatcagatgcagtggcttgaaaaccagggatttgatgttgtggagaaccatgaagtgacaagagatacgattgaagaggaagtggcatggtttgcccgtgagattgagcacaacgaagttccgtcggacggtcttgtgcttgtgtatgatgatattgcttacggacagtcacttggaacaacagcgaagttcccaagagattcctttgccttcaaatgggaagatgagatccgcaacacaaagctgcttgagattgagtggagtccgtcacgaacaggtctgatcaatccggtggcggtttttgagccggtagagcttgaaggaacgacagtcagccgtgcaagcgtccataatatcagcatcatggaagaacttgaacttggtgttggagatgagatccgggtatacaaggcgaacatgattattccgcagattgcggagaatctgacaagaagtggagtgaaagatattccaaaagtttgtccggtctgtggtggtgcgacaaagatctctatggaaaatgagacaaagacgctgtattgtaccaatccgaagtgtcaggcaaagcatgtgaagttatttgcactttttgtgagcagagatgcgatgaatattgagggcctttcagaggcgacactggagaaattcattttccacggttatgtgaaagactttacagatctcttccatcttgataactacagagatgagatcatgacaatggatggctttggcgaaaaatctttcctgaaactgcagagcagtattgaaaaggcaagaaagacaacacttgcaagactggtttatggtctcggaatcccgggaatcggaagtgcgaatgctaaggtaatctgccgggcacttggaaatgattcgcaacgcgtgcttcaggcagaagaggcagaattggttgagatccagggtgtcggagcagtcatggcgaaaagctatgtagattattttaaagagcaagagcatcaggaaatctttaagcgacttcttagcgaagtggaattagaagaagaggaagtaacagaagacagtcagaaatttgccggagtgaactttgttattaccggaagtgttgaacattttgcaaatcgtgcagaggtaaaggctgagattgaaaaacgtggcggtaaagtgacgggaagtgtcacatcaaagacaaattatctgatcaataatgatgtgaattccacatcttcgaaaaataaaaaagcaagagatcttggagttccaatcatttcagaaaatgattttctggaaatgctgtaaagaaacagtggcaggacacaggttataagaaaggtgacttaaaataactgggagatgagagtgtgaagaaaaataaattctacccgttggccggaacagcggtattccttgtggatcaatggataaaagattatgtagaaaagaacctgaagatgggagagaagaagaagctggcagagaagctggagctccggcgtgtccataatcaggggatctgtctgggagttttcgcaaataaaccggaaagggtaaaaaagcttacagaagcaggaacaggtattgtgacagtgatacagatgctgacacttctagggaacagcaatattttaagaaaaaccggaatcacacttgcggcagcaggtgcttggagtaacttgacggaccgttatcataaagagaaggttgttgattacatcgggattaagacagaaaagaaaaagctggaacaagtaacttataatctgggagactttgcaattggagcaggtggagtactctgggttcttggttctatgtttaagaaagaaggaacagaattatgattcaggatatacagccacatcagtttgataaccagtacagaccatgccctccggatgcgcagagctatgcattgtattacgaaggacaaagtacactgctgaagaaaaggaaagatagaattgaatttccaagatttcgtgatttggaacggcttaatgaagagatttatgaagaagcagtctatctgtttacaattgatgaagaacgattttaccttgtacacaacattaaccgtgaacgcttgtcagagtttacgatggaaaataaagaagccttccgctttgcggaaccacagtatcttgcttttgccggaataacaggctatcagctgaataactggtatcgtgaccgcaaattctgtgggcgttgcggacatcggatgagacacgatgagaaagaacgtatgatgcgttgtgaccattgcggtaatatggaatttccgaagatctgcccggctgtaatcatcggagtgactgacggagataagatcctgatgtcaaaatatgccggaagagcatacaaaaaatatgcacttcttgcaggatttaccgagattggagaaacaatcgaggagactgttcagcgtgaagtaatggaagaagtcgggctgaaagtcaagaacatacgttattataagagccagccgtggtctttcagtgatacgatcctgatggggttctattgcgacctggatggagaggaagaaattacattagatcgggaagaactggcactggcagaatggtttcaaagggatgagattccggtggagccgagcagagacagtttgacgaatgaaatgatcattaagtttaaaaatggtgaagtgtaaaactttcttatgaacagttacaaaatgtgaataaattcagtaagaaaacggaaagatgtgaatatctctgagaaattcatatctttccgttttgatatacttgtttaattgcgtgatattgcagtaataacagttaagcttcgggacatgtgattttgatcacctgctcgatcatatgatgcagcagctgtgcctggtttgtgtcggctgctttgtagtaaacttctttcccctctctgcggcttgtgatcagtccgtaagatttcagctggcggagatggtgagagacagccgggctactcatgtccatcatggaagaaatgttgatcacacattcttcgcagtggcagagaagccagaaaatgcgtaccctgctgttatctccgaggaccttgaacaagtcagcaacaatctggaaatcctccgtctttgcaatattatctataagaagtttagtattcagatgttcaccatgattatgcggtaaagtatggtcagccataaacaattctcctttaaaaatattatagtaactgttcagagccaacctccaaaatgctacgcatttcgtcggtgtggcgtagttcccggttgcatatcaggagaagcacatggtataatcctcttgcgtgtaggtatatcatggcttcggtctgatagaacctttggcggtttcgtaggaagccgcctttttaagttgccacatttcttgtgacagcttttacattccctttatccctcagatctcgcccctcgttggcttccatgaacttttccagaatgtcagttttaataaggacttttcttccgacctttaataccggaagcttcttccattcaaccagctttctcaaagtatttctgccaattcctgtatagtcggctgcttcctcgatggataatgcaatctttctttccgtcatcttgtcacctcctattaaattgcattatgcaatttttgttgtgctgttagtatagcggttttatattgcgttgtcaagcgttatgaaattttaaaattaatcattagattgcatattgcaattatgtgaggtacatgctataattcatacataccgaaaaaggaggcaatcagcatgaaagataaagaattacgcaagctgataggtagcagggcaaaacaacgtcgtctggaattaaatctgacacagccttatgttgcagagaagatgggagttacagcttccacaatcctgcgttatgagaatggttcgattgacaataccaaaaagatggtgctggaaggtctttcggaagcacttcatgtatctattgaatggctcagaggtgaaaccgatgaatacgaaaccgatattacggataagaaagaattacagattcgtgatgcaatgggcgatattctcaaacagctacctctcgaccttagtaaaaaggaagatgctttttcaaaagatttactgctgttaatgttaaagcaatataacctgtttctggaatcattccagtttgcctgcaagaattacaagggcagcacgaatgaatcggatattgcaaaggtaatggggtttgaatcgaatgatgaatataacgagattatgtttctccgggagatcacccatactgttaatgcctttaatgacatggcagatattgtaaggctctattccaagaaaccggaaatggcagaacaaaggcttgaaaatcttttatcagaagttttgtatgaggattccgattcggtatagaacgacaaccggagttatgatagccacaccgacgaaatgcgtagcattttggaggttggctctgaacagttactagatataagtgagaacaaaacagagagaatacgtttgtaacttgcgtatcctctctgtttcgtttttcagagtattattcttctcaactatttttcagcacacattactctgcagctcgctcgatcagcagattctggatttcctctcttgtaggcattacgcgcagtgcaccttttcttgttgtgatcacagaagctgccgcatttgcaaatgtcagcatatctttcaggttttcttcctttaagtcttccattccatgttcacagatataatgtaatacacaaccgcagaatgtatctccggctcctgttgtctcaattgtatttttctgaaggaacggttttacctctacaatgcttccgttatagtatgcacggcttccttcttttcccatagatacaagaatcagcggaatctgatatctttctctgatccagtttacacctgcagtataatcctcttcacctgtcagccactgaatctcattgtcagagattttaagaatctggcaatgtccaagaccgtataacacctgctcttttgcctcatccagtgaattccaaagtggaggacgtaagttcgggtcaaaagaaataatcgcaccggactcttccgcaatacgaatggcttctttagttgcttcgcgcactccttcatgtgtcatagacaatgtcccgaaatggaagatctttgtttctttgataagttcttcacaaatctcttctttgttcagcatcatatctgctcccggattacgataaaatgaaaaatctctgtctccgtccggataagtatgtaccatagcaagtgttgtatggatttctttatctgtgcataatccggatgcgtcgatcccaacttctgtaattgcatctcttaactgctctccgaaaaagtcttcacctacttttccgataaatgctgtcttatgtcctaactttgtcagcatcgcaagcacattacacggtgctcctcctgggtttgcctcaaaaagaggatttccctgattgctctttccgttttctgtaaaatcaatcaataattctccaagtgctactacatcatattttttcattttcttctccattctgctgccaaagcgacaacattttttctattctcaacagatttctattttttcacacaccatctgtactgatacggattcatccataccgagttcatctccagtttttctcctgtaaataaatcttcatattcaccttccagacaattcaaccatgcattctgtccatactccgagaaattagccagacagatcagttcttctcttcctgctgtccttctgattgcgaagactgaagaatttcctgtatcccatgtagagataccggcagtctctccaaagcaattttcctcacgtctgaattcttccatctgtttcaaaccattccagatcgcatactgtacagtacctggtttttttctcttctctgcattctcccactggaacggacttcgatgcagatatcgactgtctgcagcagtatccgggtttttcttataattgtaatcattgacctgaccgatctcatctccggatgaaagcatcacaaaaccttccatgctcatacatgccgcatgcatcatcagcactctctggattccctgtttcacctgctcaagatctccttcaaatccacctttttcgattccacacagacttgccgttgttccacagcttctggcatctttggtcaccggatcgtaattataaagctctccacgagcaaagctgtacggatacgtcccctcaaagaaatgatataaatattccttgtgctgaatcggatctatctccagtttcttctcctgctcttcatccaggccccagccgatatcatcatgacagcgaaggtaattgacaaaatagcagttcttcggaagactgtgaatcacatccatctgatgcttcagcattcttgtgtctcttgtagccagtgctgcccacagattcaccatactggaaacaccgtataacatatggcattccggctcttgctctgttccaaaataaaccggaagttcttttggctccataacaacctcgccttttaagatcacacccggacaaaccatttcaaggatcatacgcagcatacggacgatactatgaacctgcggaagatttctgcagttggttcccaactccttccaaatatacggaactgcatcaatacgaaatacttccactcccatattagccagatacaggatatttcctatcatttcattaaatactttcggattgtgataattcagatcccactgataaggataaaatgttgtgagcacatgtctgtgcatctcttcacaccatgtaaagttgcccggcgcagtttccgggaacacctgcggcatcgtcttctcaaactgatccggaatctcgcgtgtctcataacactgatagcgatccatatattcctgttcgcctctcttggctcgcatcgcccactcatgcgtatctgctgtatgattcataacaacatccagacacagactgattccgcgttttctcagctcttttgtcaacttttccaactcttcgtttgttccaatttcaggatccacctgtttaaaatcctctaccgcatagccaccgtcattatatggatgcggcattttcagaagcggcatcagatgaagataggtgatcttctgctcagacaaataatccaaatgctctatcacaccgtttaatccccctgcaaatagcttcggatacatcgttatcccaagcatatttctgtttcgataccaattcggttctttttctcttttattatctaaccgtctaagttcagcaggtctgttctgataagcctcttccaatgactgcattaattcttcataacattgttcattatgatacaactgcatatatttttcgtgcagttcgttttcatgtctttttcttcttacttctatcatcaatactatactcctatactacataaggggattccttaatcaggaatccccttatcattatccatgcattttcaatctcaatgtatatttatcatgtaacttctataccagatcatatttcactacatcgattttagctgcaccatcagcaaagaatgaaattccgtttgcttcctgttctgtaaacataacagcagacataacctgctcgccatcgttaataaatacttctgcgctgaatctgtccaaaatcacacgaagctttaactcattggcatctccgtttaccagacatcttctctgatgaaccagtgcgcgttcggttcctgaaaattttctgtcaattttcaatacagactcatacgggcggaagctcaattctgtatggaatttctcattctgtgcaaaacgtaatgcgaatttcttatatacattttctttatcttccggacgtatcacgagttccatgtcgatggttcgtccttcgacgcgatctaatgtgatcgtatcattatctattactacatcgttgtactcaactctgtttttgcgcagtgcatcgagttctttgattggagtttgataaagtcttccgtttttcacagacaattctctcggcagactcatttgcgcaaaccattttgagtcattacaacgatgagcaagcgtatcccagttctgcatccagccgatcataattctgcggccatccggtgcttccactgtctgcattgcataaaaatcaattccataatccacagactgattgaactgctcttttaaggtatatgtatccttgtccatttctcctatgatacataaagtgccgtttccggtatgatattccaagccttccggcaacatatcctgcggacttgtcaggagaatgtgttttccatccagttcaaagaaatccggacactcccacatctttccaaaacgtttcttattttctgcaaggatactgacaaattcccagtcaaatccatttgcacttctgtaaagaagaatctgtccacttccgtctgccggtctgcttccgatcacacaatagaagtttccatcttttcctttccagatctttggatcacggaaatccactttacttgcaccttccggaagatccttttctgtcaagaccggattcttctcatacttcacataatctcttccgtctccgacagctaccgcctgtgtctgtatatctcttttacttccatcttctaatgtttcatgatctacggctgtatacataagcaattgtctgccatcatccaactcgattgcgcttcctgagaaacagcccatcttatcgtagtcttcatctggtgcaagagctgccgggagatattcccaatgcaataagtctttacttaccacatgcccccaatgcatactgtcccaatgtgtatcgtatggattatactgataaaataaatgatattctccctgatagtatgaaaatccattcggatcattcatccagcctacatacggactcacatgaaaagccggtctgtcttctgcttttatctgctttccctgttcatcttcatattttctagccttttctaacatctcactcatgcaaattctcctgttgttcgtatcgttatttttcttcacttaatgacttctgatactcatcaaagtacttctgtttaattgaaagataatctgaaagcccatactgttccattttctttagataggaatcccactctttttcaattcctccattcaggatccagtctgctttcttctgttctgcatatttttttatatctgtatcgtactgagatactttattcgtatcatcaatactcataaagacatttggataaacatatttactgttcatatcctgtaaataagtttcatgcatattatccaaacgccattttgcatcttccggctgtgttacatatacatcataatattcatttaaaactgcaagaggtccatttaccgattgtgcctcacgcacttctaccggagactgtgttccaagatccatatgctttaacatttttccaccatctttgtttgtggacagttcaaaaatgttaaaggagtccttttctccataagttccccagttattctgtggtgattgaagtggtgcatacatctggtcaatccatgcagcagcaagtgctgtattccgacaacttgacgtaagaacacatcttccacggtcaaatccacttgtttcactgttgttctgtctcgtgatatttctcataccattcggtcctgtcagcgccggtagcatcacataatcttcattgttatcaatatttgcaatgtcccatgtaaaacagagaccgtatcgatggttcttaccttttgctacataggtggaccactcttgtgtaaatgcttctgggtcaactaaatcctctgtcacaagtttatgtaaccattcaattccttctttataaccttcctgaacagttgtataaataacttttccttcatccgttacagcgaaatgatctcccgtatctccataaccttctccaaatccattgattaaaattgccggatcttggtctccgttattgataataaatgacattggaatcacatcaccttcgattgaaaattctttttcaagttcatctgcatgatcacggaattgaatcaatacctgttccaattcatctgttgttgtcggaatctcaagtcctagataatccagccattttttgttaatatatggaacatctccgattgcctgaatggcttctttcccggctccaagctgttcaatccaagggaatgaataaatatgtccatctggtgctgtacacattgtcctatattctggatatttttcaaatactgcctgtaaattcggcatatatttatctatcagattctctaatggaataatgataccctgctttgcataacgcaatagatcataatcactcattcctgcattgaataatccgtccggtagatttccaaattgagcaagtgccagatttttcttatcagaaaactgatccgatacaaaacaagtccaatcaatatgaacattcgtctgctcttccattctctgaaagattactcgttcatttggctcctgtgttgatgtagccggtgcacttgtaataaaggaaagttctgcagtttccttcaatggaaactgcacttccgttgcaggtgtatccgggttgatttcagcttcaagctgctgctcttttccacaacctgtaactcccaccagcatcgtcagagatagtacaattgcaagtaatgcatttacttttcttttcttcatatctgtatcattcctttcttattagccttttaccgatccaaccataattcctttgtcaaagtacttctggaagaatgggtacattactaacagtggtaaacttgatactacaatggttgcatatttgagctgttctgctatttttgccatttccgctgtgctctgaatatcggcaatcatgcccggctgtggtgtattctgtactaagatagaacggagtactaactgtaatggctgcaaattcgcatcattcaaataaatcattgcgtcgaaataactgttccacattccaacgaaagaccaaagcgccagtactgcaatgattggcttacataccggaatcataattttaaagaaatgttggatttcatttgctccatcaatcgcagatgcttctcttaattctgttggaattgactgataataagttcttgcgagaatcatattccatacattaaatgctcctggaatcaggattgcccacactgtattaaccatatgcaattgattgatcaaaatgaatgtaggaatcattccgccgccaaaaaacatagtaattaagaagataatattaaaaacctttcttcctacaaattcttttttggacagcggatacgctgccaacaatgtcacaaaaacagaaataactgtaaatgcaagtgaatacaggaaggaatttaaaaagccacgccagatcatttcattctctaatactcttcgatatgcatctaatgtccagtccttaatattaaaactcaatccctggttattcaaaacagtcggatccataaaggatgcaagtactacatagataatcggtattgctatagaaaggacgaataaaccaagaatggtaaatccgattccaaggattactttgtctgtccttgaatattttttcttcttttttttctccatctcttctccctcttttctataatccttctccgtcattcagtttcttaacaacacagtttacaaagatcaacaagataacatttacaaccgagttgaagagacctaccgctgtcgaatatccataatctccgttcagaagtccaatacgatatacatatgtagacaggatttctgatgccggcaagttcatgtctgtctgtaaagcatatgctttttcaaaacctatactcataatatttccggcctgtaaaataaactgaattacaataatatttttaattgccggcaactctacataccaaatctgctgcagaagatttgctccatccatggtcgctgcttcttccagctccttgcttgcatttgccaatgctgctgtatacatgatagatgaccatcctgctgcttgccagattccgcttgcaatataaattgttcggaatgcagaaggcattgtcatccagtttgtgctaattccgagcactttgttcagaggtcctacaggtgataaaagcatacgaaccataccgcaaagtacgatgactgaaataaaattcggcatatagatcaaaagctgaactttctttttaatccctgtcttacggatgcgatttagaagcaatgcaagaataatcggaaccgggaatccccacaacagtccatagatactcaattttaatgtattcatcagataattcataaaatccggtgaagataaaaatcgcctaaaatactcaagtcctacccagggactaccaagaactccttttattacattgtagtcttcaaaagctatcaggagaccacccattgggagatacttaaaaataattgtcagtaaaagccctggcattaggaagaaaagatataactgccagtttttcttcatataagtcatcttttctctccacgttcgtttgctcacggactttgcttgattttgcattcttttcatgcacttcttcctccattcctttaactctatggaaaaccggttacgtaaccggttactttatagtttgatattactatattcttctatttctgtcaacacttttgtgcgataaaataaccggttacgtaactggttatttaagtgttgcgtttttccatgaaaattgctatactaaaagatattatgaaccatcagccatcatattgaaggagattcaacttttatgagtaaaaaacaggtaacttttgcagatattgcggaatataccaatttttcaaaaactacaatatcaagatatttcaatcacccggattcactgacggttgaaaaccaggaaaagatttcacaggctcttgatacacttggatataaaaagaataagctggcaaaggttctggcaaatggaaaaagtgaatttatcggaatcattgttccaaacctttatctgcactattattctgagatgctgacacaattcctttccagttacagtgattatcactataaatttcttgttttcgccagtgaacatggtgctgaagaagaacaacagtacattgaagaacttctgtcttatcagattgaaggactgattgttttaagtcacactcttccatctgagaaacttgcttcctatcagattcctgtcatcgcagttgaacgcgaagcagaatatatcagcagtgtcaatactgataactatatgggtgcacttcaagctacttccctgttgattcgggataaatgtgacatattaattcatataaatgtcaatgtgaataaatccatcccggcttatgaccgaatccgagcctttcaggctacttgcgaagaatatcatgttccatatgatatagatcttagtgtagaaggtgattcttatcatgagattttaaacgtaatccgagagattttcaataaaatagaagcaaaataccccaatcaaaaaaaaggtatctttctcgcgaatgatacctatgcaaatatgtttcttaatttaattttccaaaaatatggaacatttccttctacttatgagattgttggatttgacaactctccgattgccagcgaggcaatccttccgatcacaaccatcggccagcagattgatgtgattgcaaagactgccatggatcttcttgtccaacagatggaagagcagaaaaagcgtgttcccaaaccattaggtgaacctgttcataaacaaattgcccctgtattaattcgtcgtaatacaacaaaataatttatttttcatgattgagaacgttgcctccagcgccaggacctgattaccggttccggcgctgtcttctgatatctgcagatactgagtagtaatccgagcaggatataagatgtcagcatacctgatcttcctgttccaaagaatggacagtagattcccatattaccgactcctcccagattttctaatataaaaactactgtctgaatcaggaacaatgctgtacatcctgttcccatcaccataccaagctggttcttctgatttaatgaaatcttagcaaaccgaaggatcagaaccgccagacaaagaaccagtagaatacctgccagtattccataagcagctaccacactggcaagcagatggacacttccgtctacagatgtcagaagttctttaaactgcggattgccatgaaatgctgagcttccggaaatcatttcccgaatcacattgactcctgggaaatttgctgcataatcaccgatcgataaaatagccactacacgctctttctggtaagccttgccaaaacaccagaggcctcccgcaagcagaaccggtatcagaacgactactgctccgattcccgtaagtactgcttttttacaaacctgaaaccagcctttgtaaacagccgccgccagaaccacacaataaaccaattccagtatcattgccgcaatcaggctctggcttcttatgaacagaaaataagatggaatgatcatccagaggattgcctttaaaattcctcggtatccctgacctctataactatataataccgctgcaaacaacggaattgtcagccaaagcaagtcaatcagattcaatccaatatttccaaacggtattctaatatacctcgccgctccattcactttcagccccgtaaactgcagtccgaccaataataaaacctgatatacaatcaagatttgttttgcataagccgcaatcctcgtataatccatatagcaaatgccgatcatcagcacaagtccaatcaaaagtgccggcagttccagcgacgtatgccagctcgatgacattcctgtccagaacagttcttctgtttttcccgcactctgctcaatacctaaagcagtctgatacataacactccgtaaaagatagcctgcaagacttaacccaacaatcagcgcaatcattccccacgccattgtcggccggtggattctatccatctcaagcccgacttctaccggatcacccatttctcgaaccgcagcttcttctgcttctgtctgactcattccttcacttaggaattccgctttctgatcctcaatatgatcattgatctcctgttctatcgtccctcttgccatcttacagcgaatctgttctgttaatgtatacaaatactcctctcgtctcatcaaacatcaccctttctaacaaactgctgcattcaacacattcactacagccgatgaataaattttccactcttctttcttctcttctaaaactttcctcccggttttcgtaatactgtaatacttacgaaccttaccaccgacctctttctcataaactgtcagatatttcttatcttccattccatgaagcaatggatataatgtgcctgcttttaattcaaacacattctgggacttttctcttaaggtctcgatcatctcgtaaccatacatatccttttcagataaaagctttaataacaacatcgttgtgcttcctgataccagacttctgtcaactgccataacaattcctcctaatcttctgattttacgttaaccgtacacttcttaacattcttactgcgcacctctgcaatcctgccgaaggctatatcagctggtggattgactcccagctgatatatcggttatctatatatcttggcttgattatatatcgattatctatatatgtcaataaaagcttccaaaattctttgcatttttaatatagtaaaagcgaacaaacagtaattgtgagcgaacaatagcaaaaaagtcttattttgtattgttttttggatacaaaaactatactctatgtgaaaaatatgttataatttgtgtacacattatgcagtataaatacatactagccatacaattcaagtttttcgaactaatttaggaggagaattatgactgattctgttacaaataagatcattttaagcgccgacagtacctgtgacctggatcaggaactaaaagaacgttatcatgtacactattttccactccacatcattctggatggaaaagattataaggacggcattgacattacaccggaagaaatatatcagaaatattacgatgaaaaaatccttccaaaaacagctgctgtcaatgttgcggaatatattgaacattttaaaccatgggtcgatgaaggctatgaagtgatccatatcaatcttggcagctcactttccagtgctcatcaaaactgctgtattgctgctgaagagcttgggcatgttcatgtgattgacagttgttctctttccaccggaaccggacttcttgtaacagatgccggtcggatgatcgagcagggaatgaaagcggcagatattgccaatgccctccgtgaacgaacaaagcattgtcatgccagctttattttggatacgctgacatttctacatgccggtgggcgctgttcgacggtcgctgctctcggagcaaatgttctgaaattaaagccatgtattgaagtcagcacggaagacggaagcatgaatgtcggaaaaaaatacagaggaacgcttgataaagttcttgtgaaatatgtaaaagacaaacttgctgcttatccggatatcgatccatctctgatctttatcacgcattcaggaattgatccggaatatattaaacttgttaaaaatacaatcgaagaagctatgcattttgatgaaatccatataacgaaagcaagctgtacgatttccagccattgcggaccaaatacgcttggaattttatttgaaacctgctaaggaggagacgcctatgacgaatacaaaaccagtttttcatggaagtgatattgagaaaatcagtgagtattatcatatcgaccaaaacagtattacaaactttgccggaaatgtaaatccactcggactttccccttctgttaaggaagctgttgcggctcatgtggacctcttttcttcttatcctgaccgagattataaatcacttcgcaacacaattgctgagtactgcgatgttcctgctgatttcatcctgccgggcaacggttcaagcgaactgatttcacttttgattgaaacaagagcaccgaaacgcactctgattcttggtccaacctattctgaatactccagagaactttctttctccggaagtacgcaggactattatcatcttcaggaagcggaagattttgaattagatgtagaagatctttgccggactttattaaacggatatgattttctgattctctgcaatccgaacaatccaacttcttctgccatcttaaaagatgaaatgcgtgcattgctttcattctgtgcaaatcgcgatatctttgtcatgattgatgaaacgtatgtagaatttgcaccttccgttcaggaagtaaccgctgttccatacacaaaagatttctccaatcttatggtactgcgcggtgtgtccaagttctacgcagctccgggaatgcgttttggatacggcattaccggaaataaagaattcttatctcagatgaaagaaaagcagattccatggtccttaaacagccttggagcatatgccggcgagcagatgttcaaagacacttcctacatccgtcagacacgtgcattaatcctgacggaacgtgaccggatgtttcttgaattaaaaaagatgtcttctttcaaggtttattttccatatgggaactttatccttgtgaagattttaaagccagaagtaacttctttcgatgtattcgaagcttgtataaaagaaggacttatgatccgcgactgctcttctttccaatgtctggatggcgaattcatccgcttctgcattatgaaaccagaagacaataatcggctcttaaaagtattaaaaactatttaatgataccagagtcaaaagtctgaaaccaccggtgcttgcacaaaggtctttcttaaaaagcgggagaatctgatccaacgattctcccgcttttcttcttattctttcttttggttttgtactttcttgctttttctatgattctacagctgttttctaacaacaagataatcatctccattccgataatatggacattgataatgctgatttgtcatcagacggatgtaatcatcctcatccatattcttatcacagagataacactcatactcctcatcataaatataataagtgcatgtttcacagctggttcttgactctttactcaattttctctctccatttcccgcccgttgcaagggcctgtagcattgcattctgttgctgttcgttctatgtgcagctggcaactcttttcttagtatcataccatgtttccatagattgcgtccacttttctgtctaatacaattaccttaaacgcaactaatagcctgtattttttgtgttttatttcttattttctgtatatttaaattatttttaacttttttctgattttctattgacaaatgcctatctgtgagttaatatagaatcaacaaaaggaaacgaaataaaaaacaaaaaggaggacaaaccaccagacacttaatcctttcattaaaattaattttaaagaaacagaggtatagtccaatgggaaggtaaattaaatccttaaaaatctaaagaaagaggtacagaccaccagaaagagtaatttaaaaaacggaaacgatatttaaagagagagaggtagaatccaatgggatagttcattaaatcatcaaacaaataaattgaaagaggtaaattccaatgggacgataagttaaaatccaaaatagataaaagaagaatcgaaagaaggatattccaatgggataattaaatgaaataaaatataaaatcactatttgagataatagtttcagatagatatcaagtaaataaggaggaatattccaatggatggaataacaaagtgaagatccactgtatagcgtaggtgcatacggtggattttcttttgtctctttttcgtggatatcccggataatcaaagggataacaaaaaggggcaaagctttttatgcttccaccccatcacttaaaaatgtttaaattcttaatacatagtctttttattatctcttcacaaagtactcttcataccatacaaggaacgtatagattgtccatacttttctccagttatcagaatttcctccaacatattcatcaaaaatcgcattgattgcatccacatcaaagaatttctctgcaatatcactgtggaagagacgctgtacgtcctgattgtatctctcatccgccatccagatacggattggtacgataaatcctaacttcttacggaatgcaatttcttccggaagaactttcgcagctgccgtacggaatgccaccttattctgctcttttttttttcaagcagaagacggcatacgagatgcgatatcaaaaattcttctatctgtcaacggcatacggatctcaagtccggctgctgtactcatcttatcaacattcaggtaaatatcaccttccagccagatctgaatatctacatcagacatctttgtcaacggatcaagaccttctgtctcctcgtagattcctcgtgcaagttcgattggcagtacgtctggatcgtatttcttaagaatcttctgcttctcgtcttctttcatgatattggtatttccaacatagaaattcttcagattctcaccataacgttctgcgtttctgtacatattataaccaccgaagaattcgtcagaaccctctccggaataacagatcttcgtatgttctgctgttgcgttacatccaagtgtaaatacaatcgccgatgcatctccaagcggctgctccatattgtacataacataaggtacaatatcaaagaactgctccggtgtaatgatacttctggaaaattttcttccaagaagctgtgctgtcttctctgcaagaacagattcatcaaatctctcttcctcatatccacaacagtctgcctgttctgcatcagacattgcaagcacataggaagaatctacaccacctgacaggaatgactccactctctcatctgcggtcttcacttccggcatgatttctttcagagtattatgaatctcatctgcccagtcttccagagtcttgctctcatccggacgaaattccggtttccagtatctgtgaatctcaagctttccatcctgccagatcagatagcgtcccggcaacagttttttcagtccacggaaaaatgtattttctccggcaacataggtcagacttaaatacagctgaagcatctcttcattcagttctttcttaaatcccggctgatcgataatatcacggatcatcgttccataaagaagctctccatcttctgtctcatagtaatagaatggttttgttccaaactgatctctcagacagaaaagtttctgctcttcctcatcccacagagcaaatgcaaacattccgtgcatatgatctgccatctcgcatccccatgtctgatatgccttaatcaaaatctcatgttctctttcttctctggaaagtgtaagatcaattccaagtctctcacaaagttcttcccagttacgaatatgtcctctgtatgtttttacaattatcatctgtttaacctctcttttgtcaccatctttggttttgaaagttgtttcttctcccgcttatatcctacagatatcgacaactttcacggttcaatcctattctatcacactgactttttcttgtaaattctcaactgtcactctgataccaatctcggtctgaagcatatataacatatgtattttagtcagaatgcatctcaccttcattcgcttcttccatttgcacttcttctgctgcgctacttcctgctatctctgcatcaacatacccaaaacgaatcactgcctgtggccagttaaggctgattcttggtttcttccctttctccacacctgctttttcaatcagatcaagcaattcttccagaactgtttttgtcagataacctccgcgccagtgaaacgtcagaattcttcctttctttgccatctgaagtgctcttttgtaaacttcttccggttttgtaaaagacagtttcttttctttataatagaaatgatctccgtccgtacacttcatagccggagcgatcaaaggctcatgatcccggaaaatcgatttatcttccagattgaaataatcataacggatttcttctccgatcgtacaatttcttgtaagtgtattatcaaatgtcgcatctaaatgataatattttccattaatcctcacgatattccatgtatgacggtatttgattcccttatccggattattcccgcaaatagcgatcatacaccagactccaagctcatcgcacagcactttcaccgcttttgcaatcccctcacaaactccgaccccctgtcctaacggaccaataatctcatgtgaataaggtttcttcaatttatcatattttacattctcacaaatgaaatcatgaatgtatttttctttctctgattctgataatttctgtgccggtcgtgcaagtttctctattctggatttcattgccttctgatgttctttcaccttcgcccggtcaaacaaatattccggcagaaactgaatgttcggcgattcctgataataacgatacttaaatcccgttgcccagaaaatctccggatgatccaggcgcatctggaagaatacattatacaattcttccccgctcatacgcggtacttgaatctccttctccatccgcaagatgccctgacagattgcatgatacgttgcctgctgcatcttattcatcttactataataaaatggttccatacttatcctctccggtcagcagaaaattcttctatctgaacttttcgtttttttcctttcttttcccagatcatcagactgattttgtattggagtgaatctcttgatgcaataaatggttcctcacgaaatatatttatccgaaatccctgttcttctaactctcgtttccgctctgatgctctcttctcagtcttacgattctgattttcttcctcatctgtgaattttcttctcggataatttgctgctgccatcttcagttcttccatcaaaagatctgtaacttctgcatgacgcttttcctgcagcatcccagcaatcttttttgcactccgcttccatggatgtttctgataaaactttagacatcttagtaactttttatcttctactgttgccgcaagctcctgcatcacttgatgtgcttctgctgacggtacccacggattttcccttggaactacatattgctctgaaactgccggataacagcaatgattcagcggcggaaagtccgccagcacagctagtttccgctccgtctgattacagtattttgctcccagataatccagtttatcccgtacgattgcaatcttatattctatctgacgcagatattccgcacctttcacccagaaatgtccgatttctccataatcatataaatgtacttcttcacttaaatcctcaaaaaaaatcgtaaccacggtctcaccctgatgaactacaaggacataggactcctccggttcttctgttacacttaactccgcttctagttcaccttcataatcctctctatactgacctgtcatccttgcattttcaaagacaagaaagctctctaccgcatcgttcatcaaataaaccagccgcagtttttcttctgtaaaaagcagttcaaactgtccttgttccagcacttctcctagtttcagaaatgcttccggcaattgaatttcactcattttccgctccctcagtgcatttgtcttccaggcactcacgaatcttgtcttctttcagatcctcaccgatcacgatcagaatctcctgtccttctttgattggatttactgtcatcttctgcgttgtcgcattcagctccatccagtcaccggattgattcttcataaatccttttacacggaacactcttccgatatcattaagatttttattgttttctttttcagaatcatctgtgcatccacgtttaccaaacagcttttccacagccggaaccagttcttcttctgtccgattcagattcataaaatataaggtctggaatccatccttttctgtaccttccggtctgcgaaacgactcaatctgatagctgctgttctgaatctgtgcaaaatcttcctctgtcagcatatcccagtcttttgcgatcacttctttttcaattcttctggtacatccaatgcgttcaagagaacgattgacatgtgaaataattctgttttcctgttcttcacaagcattgtccttatccagcctgctcagcacgatcacacccgcatccgccgcctcagatcccagcaaatattccgcctgatctgacagattttcttccagtcccgcatctacgattgtgatcacacttccgatttcgtaccaccgatccagaggttcttctcttaatccatcaaaaaactcatccacgtcatagattcccgacggctccacgattactctgtcatatccacacattgccatagagatcagctttgtcttgaatcgtctgcggtgtgtctctttatcacaccctccggaaatcatttccagttcacatttttctccctgcagctcctgaagaagcatcatatccacattcaccgcaccgaaatcattttccagaattccgatattcagaccctgacgaagcaggtaggatgcatactcttttataaatgttgtctttcctgcccccagaaatcctgtaatcaaatctatctttaccatgattgttcctctcatatctgatatactcgcacaatttactctaactataataccacaatctccttgcatttcaagaatgccttggcattcttgctgcgaggtgcgtgtcatgcaattgcatgacatacttctactgcgcacctctgcaatcctgccggaggaagataaagcactaatggtatactttatctcttacacttatatggtactaaaaaggagcgaaggaagatgtattctaaatcaaaacagacattttatcatgtgagagattctttgatgaaacatagatggcttctgatagctgaactgatttggatgatagtttgttctttttggacagtgtccgagcagaagaagatgtatcagttttatcatctttcggccagtacgatagattatgttattgcacagcagggaacactttacagtggattgaccatatttccgtttgtactttttttcgtaatcaaatgtaaacaggacagcttgaacattcaatatatcttacggtatcaatcgagaaaaagaatgtttcagcaacaactgaaggagagtctggtatatgctgcgggaatttcttttataattatcctaatggctacatttactggctggatttttagcagaaatctgatcaattgggatactatggaaagcgtttattttgggcagacaggaaacgttgtaaagtccaattttttatctgtagctgttgttatctggttgatgtatgttttaaaattaatgttactttttacaattgtagatctatccttgtggtatccaaagaccctgtttttcgtttggattgttcttttaattccacttggaatagaagcacttcactacggaaagatctattttagtctgttcgcagtatggcagacatcatggaatacgcctggtaagtggttaggaattattcagattggaattgtcgtttccttcatcgagaaactgataggggaaaagatgattgagcggagagatatctggagataggagatgaggccatgtggaaagttgacttgaaaatattttttaaagaaagttggaaaaagtatggctttgtatttttgctggttctcgtgcagtgtgtaggttttcgtaatctgatccaacaatataatactgtgaatggacaggagtggaaacttcacttttgggattatgtgatctgcttttttcaggggacagttccttatacacaatcggaaggaaaagagacttttaatattccaccgtactggtctttgtatttgatatattttgttttattgattggaaaactgacaggacaattctcaaaaaaatacgaacagcaaatgctcttacgtctgaaaaacagaaaacagtggtggatggaaagtcatttgaaaatttggctggaatgtatgggatatctggcagtgacagcaagagcatttcttgttttttctttttgtacgaagagtgctgtagaagggataaatttagagttactaaaggattatctgggattggaaatcaacaaaaataatttccgtattttttcaatggttcttgtattttttgtggcattgctggcacttacttatattcagtatattgtatcattagcaatcaatgcagtaactggaattttggtttctattgttattttaatttccagtgtatatcagatccatccgtttttaataggaaattattttatgtgtatacgtcagatgatgtttgctatggatgatgttggatttctgacacaaggagcagttagtgtaggaattattttctttatggctgtaattgggtatcaaattttaaaaagaaaagatctgttttaaagaaagaaggggaaatatgtatcttgaacttacagatatcagtaaaaaaattggagcagatgaggtcctcagtggaattacactttctatggaaagaggaaaggtttatggactgcaagggaaaaacggttgtggaaaatctatgcttatgcgagtaatctgtggattagtacttccaactgtgggggaagtaaagattgatggaaaaattcttggaaaagagttttcatttcctccaagtgtgggcgtgtttattgaaaaaccaggctttttagattcttacagtggatttcaaaatctaatgatgcttgcgtcaattaaaggacaaatcagtggggcagaggtgaaagatgttttaaagagagtggggctgcaggatgtaatgtacaaaaaatatcggaaatattctcttggaatgaaacagaaactagggattgcagctgcaatcatggaaaaatcagaactgattatcttagatgaaccttcgaatgcattagatgaaaagagcgaagaaatattatggcagattgtcggtgaagaaaaggaacgaggagcattaattcttatatcctgtcatacaacggagactttagaaaaagtttcagatgaaatttttagaatggatatgggacaaataaaagagcatatgacagtataggtgagtgtatgagaaaaaagatcatcatcatgacggcaattgtattatttggtggatttatagccgggtatcgaaatataaatcaaaaatatccggcaagaaaagttgagacagcagaaaagggagaatctctcgaatttctggatggagttaaaatttcagcgaatggagtaaaatggctgtccacagaagaacaggcagcaatttatgagaatagtgggatagatacgagtaaagtgaattatgatacaaaaataatagaagtgagtgtatgtctgaagaacacaacggaggaagaaaaagaagtgccaatcacttatctgtcgttagagacaacaggcgttggaacagcaatctcacaggaacttctaatgggaaattcagaacattacggttctatggtagaaaaattagaaccaggagaagagaaagtagttacgtatccatatgaaatgtgttccatatggtttcataaaaaagactgggaaaatgtagagaagagaagtttctggctgacattttcttcgtatcctgataaaattgtgttatatttataaatgaggaacaagtcaaagaatgcaggaactgttccccgaaaacagcaaaaatgcacagcaagtcaatggagtgaggagaaacttaatgaagaaaaaaataatatatgtcttatgcattttaggtgtgcttttggtgttattaggactgaaaaaaagaaatgacacaatgtattcttcgggggtataccatcttaacagaagcgggattgtagaatctatagagaataacaatatagttgttcgtttggataaattgaatgaacaagatgaggattttaaaaatgtcgatacactgcagttagattgtagaaattgtggttatgaattagaaaatctaaaggaaggtaaaaaaattatattttactatttcccatataatgcagacgttcgaccacttaaagtcgagaatatctatgtgataaatgaaaaagagtctaatattgatttgatgaagaaagccggacaattattggatccctatcgagataaaacagatgagtctatttacgcaagaggtaaatccggtggtgttattactacaaaggatattgaacaagctactgaattctacattttagcagggtatgaacagtcagacgctgaagataaggcagtagaatatatgttacaacgcgatgcgacttatcaaagagctattgcagcgggatattctgtgtctgatgatgaaatcaatgattatttagatgatttaaaagttacaataaatgattcgattaatagtgaggaggctcaggctcttataagtcaatttggttcggaagaaggatattggcagcatgaatttgaagtttataagataaatttaccaattgaaaaatatttagaatcattaaaacaagaatatttgcagaatagtatttctacacaatcaaataatcaagaggcagaagaaacaatagaaaattataatcgttatattgaagaagttcaatcagagttagttaaacaagagcaatatgaaatatttgaatgatcaataaatgtcaccaatataaaaagcgtgaaggaagggatttttttgttaaaaaagaataatgaactgaggaaaggtggatatctaaaaagtttttataaggatattatgaaagttgctttttttgtatgtattttatttctattattttttattatacatacaaaacttcaaaaatcgatagaattacaagttcttgaagttcacgatacctatctgatccttcaagatttaaagtattctaatgactatagggtacatttggttggaaaagaatctacggattttaatgttggggacttggttatagtgacatacaatggcgctgtagaggatacagaacctgcttctttaggtggtgtcacggaaattaaacctttaaaaaaataaaaggagactgtcatgaaaaaatatgcagaatcgaaaggattctttgattttaaagcagaaagggaattatattccattgttaaagcatggtgagagtgttcaagtcaacgaagagaggggatattgttgtccgagaattgcaaaatcgcgaagcaagtcaaagaatatcgctggaacagttccccaagaaaaactacaaaaacaggaaatctatacagaaaaaagaaccgacaatcgcaagagcctatcaaaacgggggtttttaatctgcggattaatccgtagaatcaatattccttgacatttcaataaaatagtttatacttaaaatagtttgaaattcaaaataaaatacaggagaattgaaaatgagtataaacaaacaattaaaaataggtgatctgactgcgaagctcccgatcattcagggcggcatgggagtaggtgtcagcagaagttcccttgcaggagcagtggcgaaagaaggcggagtcggaataatttcaactgctcagattggttatgatgaagaaggatttgagaaggatcaggctgcatgtaacaacagagcaatccacaagcacatcaagcgagcaaaggaaattgcgcaggggaatggtcttgtcggtgtaaatattatggttgcactgaagcattatgcggagcatgtgaaagaggccgtggcagcaggtgcagatgtgatcatcagtggtgccggacttccgatgaatctgccggagctggtcagtgagacttgcagaacgaagattgcgccaatcgtttcttccaaaagagcagcgcagctgatcttgaaaatgtgggcgcataagtatgacagaacagcagattttcttgttgtagaaggtccgaaagccggaggacatcttggtttttcaagagagcagttagatgagattgatacgatggattatgatgaggaaatccgtcagatcattgcctgtaaggaagagtatgaaaagcgctatgggaagaaaattccggtgatcgttgctgggggaatcttcgacagagcagatattgatcacgcattggaacttggagcagacggagtccagattgcgagcaggttcgtggcaacagaagaatgtgatgcgtcagaggcgtataagcaggcctatatcaatgcaaaagaagaggatgtccagattatccaaagtccggttggaatgccgggaagagccatccgcaacgcattgatcgagcgtgtcgagaaagaaaaagagcctattaagaaatgttataattgcttagcaaaatgtaatccgggaaaagttccgtattgtatcacgaaggcgttgattgatgcggtcaaaggtgacgtggaaaatggacttgtgttctgtggaagtaatgtcggacggatcaatcagatgatgagtgtgcatgagctgatgcaggaactggtgtcttagataaatgggaagaatccaaagtcatattgaggaaaattaaaaagagagaatagtgtgaaacaaatttaaaatatcacattattctctttttttatgatatacttagatgatatattaaaactagaaaaacttacaaggagcagcaaggatgaagatgcagaataacgatacaaaagatgaaggactgaaaggaaacgagaagattgaggaagcgatttttgcactccagcaggaaccatctcaggaacttttagcacatgcgttgacaatgatccgtagacgaatgaaagaagaaggacaattgattcttgcggtagagccttctgttgcagaacaactgaagatacaggcagtgaagacagctgatggaaagaagtggtggagtgcatttacaagttttgaggaagaattaaaaggttctaatagtgtgatgtctacatttttaacagcaatcgaaccattattccagtctgctgtacaggagaatgagattgaaggtatcattctgaatccatggaaccggacaatcatgcttgacaagacactgcttcgactgattcttggagaaagtggaaagtgagaacaaagcgaaaaatgacagtaactataatatgtattttatttgcagtgttatttgcctggtatggattctggatgagcggaaatggatctgggacgggattcttcctgatctggtttgtattggctgcattgcttggaggatgcgcagcaattacatttctggatggatgggcaagacttccgatgtggatgatgtggatattaaggggaatactgcttgtatttgtagtttcctttgtgattatcgaaggatgcattatcagtcagatgcatgcgaaggcagatgaaaatctggactacatcatagtgcttggtgcacaggtgagagcagatggaccgagcaaagtgctgaagcatcgtttgaacacagcaatcgattatctggagaaaaatccggagacaatctgtattgtgtcaggtggacaggggtataacgagccatgtacggaagcgcaggcgatggctgattatgtggaagcggccggaattgagaaagaccgtttgattctggaagacaaatcgaagacaacagagcagaatataaaatatagtaaaaaatatatgaaaaacggagcaagtgtgggaattatcacaaatgatttccatatgtttcgggcaatgcagattacaaaaggtgagggattaaagtcagcgaaagcaattgctgcaggctcgaatccattgtatctgccaaacaatatgcttagagaatatctggcagaatggaagtatctgatcaggtcaatcttataaaaagcaagaaaagagagatgaaagaaacaaatgggtagacgagaattagaagaacgaatcgagaaaagaagagaggactttgtaagaaacagtcttctttcagatgaatttattgactttgtacaggagaatttaaagccggtcaatacgatgatggcttattatcagtgtgcgatcatggaagttgagacgaaatttaaggtgctgagcgaacagtattcgctggagtatgaccgcaacccgattgagagtattaagacgcgtgtaaaatctatggagagtctgctgaagaagattcgtcgtaaaaatattccattgacgattgatgcaatcgaagaaaatattcaggatattgccggtgtgcgtgtgatctgcgcttttcaggatgacatttataaacttgcgaaatgcttccttgatcaggacgatgtaattttaattcaaaaaaaagactacattgcaaatccaaagccaagtggttacagaagtcttcatctgatcgtgaagactccgattttcttaaaagaaggaaaaaagatgatcacagttgaagtgcagcttcgtacgatcgcgatggatttctgggcgagcctggagcataagcttcgctataaaaagagtattccggaagatcagagtaagtatctggcagaagagatgatggactgtgcacagatcagctcagctcttgatgagagaatgcagaaggtgcgtgatgtgatcatgcaggcggaggaaaaagaggaagaaaaaagtagcggcgtggaaccgttaatgcttcgaggattgacagagcggataagacagaagaatctctgatgtagacaggcggaagatgtttgagacgaacagaaagctgtcgagatatgcagagatttgtagggataaacagagagccggagggaaaagattatgatcaatcgagaagatatgctggcgctgaccagacgaatgacagtgaaacggacatcgatcactcggatcgccgggggatatatggatatagacggatttatagatggaacatttaacaccagtttcctgaaattaagcccggcagaacaggagaagaatctggcacttgcgaagaaagtgccgtttgcaaaaacaaataaaaatctgaaggaatataagttttctgatgatcaaagaaatccggacagtatgtggaagcttctgatggggatgcgtgcctgtggcttgaaaaatgatgctctgatggagacattttatgagattatcggggaacattaccaggcagatgaagattatgcaatctatgtttttcatgacagatatgacattccggcgaaggggctggatcatatacgtcagggagaatcagaacgaatgtatgaatacattttatgcgtgatctgtccattaagcggagaatatgaaccgggcgaaccggaatgcggtttcctgtttcctgcattcgtagatggaggcgctgcaatgaattacgtggatatttaccaggaagacgaagaatacccgcatgaagaactgcttgaactgcttggagtggaaaggaaaaagttatggcagaaacatacaagtcaggagaaaaagtaaaataccggttggcagaggcaatgaaagaatgcatgaaaaaagctccggtcgaaaagatcactgtgaaagagatcacagaagaatgcggagtgacacgtcagaccttttaccggaattttcaggataaatacgatttgatcaactggtattttgacaagatactgattgaatcctttgaacatatgggagagggacaaacagtctatgaaagtcttgtaaataaatttcaatacattcagaaagaaacacttttctttcgtgcggcatttaaaaatgacgaccagaactgtttgcgtgatcacgactttgaactgatcacacaattttataccgatcgtatcgaaggaaacaccgggaaaaagatgtccgacaagattcgctttcagttagaaatgtactgccaaggctccatttacatgacggtccaatgggttctcggcaatcacaaagccacccccgaaaccctggctagattcctctccgaatccatgcccgcagaactaagagacgtctttaaagaacgtggattgttgtagatagatttatttctacacacaaaaaaatgtgcgaatcatttcaccccttcgtatattccgtaaatctatttctatacacagaaaattcggaaatgtgggataaagtgaatctccgaagaaggatgacgcatcgaagatggtgaatgtggagtgtgcttgataatacttgaaaaacttaaggttacgttaaagaaaggtttggaaactgtctgagcggcagtgagttttccaaacctttctttgtatttagtaatcttaagtttttcctagaattatcagtacacgtaaccctgagccagattcgatgcgtcatcctttgaaggaatcacagcttatcacatttcagaattttcgtccgtgtatcagaaatcaatttacataagctttctaaagagctctttcagatcctctacacttgcatctttcggattacccggtgcacaagcatcagcgtgagcagactcagcgaggaactgcaggtcttcttctttcagagcttccagttttgtcgggattccaacgtcaacagaaagtttctgaacagcatcaacagcagcttttctgtattcttcaacagacatgtcgtcaacacctttaacgcccagtgctcttgcgatttcacggtatttctcacctgtacaatctgcattgtattccataacgattggaagcatcatagcacatgcaacaccgtgtggagtatcgtatacagcaccaagtgtatgagccatagaatgagcgattccaagacctacattagagaatcccattcctgcgatatactgtccaagagccattccttcacggccttctttttcatttgcaacagcgcttcttaaagattttccaatgatctcaattgctttgatatggaacatatctgtcatttcccaagcagcttttgttgtatatccttcaattgcatgtgtcagggcatccatacctgtggaagctgtaagtccctttggcatagaggacatcatatccgggtcaacaactgcgataaccggcatgtcatgtgggtcaacacaaacgaattttctctttctttcaacatctgtgataacgtagttgattgtaacctcagcagctgttccggctgttgttggaactgcgatgatcggaacacaaggttttgttgtcggtgcaacaccttcaaggcttcttacatcttcaaattccgggtttgcgatgatgataccgattgctttggaagtatccatagaagaaccaccaccgattgcaacgatgtaatctgcatcagctttcttgaatgcttctactccgtgctgtacattttcgattgttgggtttgctttgatatcagaataaatttcgtaagcaagtccattttcatcaagaatatctgttactttctttgtaactccgaatttgatcagatcagggtcagaacatacaaaagctttcttaaatgctcttgcttttgcttctgtagcgatctctttgattgcgcctgctccatgataagatgtttcatttaacataattctgtttgccatgattttcgatctccttttttaaaaacagattttcgggaagctttagagatattcccgatgtactatgtctttattttaacaagcgtaaataaaaaagaaaagttacaaaaggttgaaaatgtaacattttaagcttttttttgtggaaaagttttgaaaattataaagggtttattaaattattgtgaaacaagcacagaaaataaaatcgaatactagacgagatgaagagaaagttgtaaaatctaattatagttttgaatctggaaacagatcatttacggaaggagacaggcattatggaaaaattaacagacaacttaaagaaggtaatactggctggaatcggagcggttgctacaactgcagagaagtcaaaggacgttcttgatgatatggtaaaaaaaggcgaacttacagtggagcagggcaaggttctgaatgaggaactcaagcataatctgaagcagacagtaaagaacaatgtgaatgtgaaagtcaaagtcactacaccggaagagttgagcgaacttctcgacaagatgacaccggagcagttagaagcactgaaggctcagatcaaggcgaaagagtcaactgtagattcggaagcagaagaggtggatgcagaagatacagtggaagatgttgaaaatgtagaagatgcagaagtagttgaggaagatacaaaagaagagtaaaaatatcagagaagctgccgaaaagcggcttttctgctttctcaagaaagaaaaaagtgactattattttaggtctatcagcaaggaatacaggaaaaaagagaaatgtgtcactgagacagcgggagaatacagatatgagtgagaaagaaaagggaacgaataattcaagatttagagagattatttctgtacttcgaaaacataatattacacgtggacttagtccgaagaaacttcgtttgatcatggaggatcttggtccgacttttgtgaagatcggacagatcatggcactccattctgacattcttccaaaggcctattgtgatgaattgatggaattatgtacggatgcaagaccgatgcccttcgaggaggcagtgtctgtaatcgacgagtcttacggacgctcctggaagaaagttttttcatcgatcgaagagacgccaatcggttctgcatcaattgcgcaggtacatagagcagtcttaaagtcaggagaagaggttgtcgttaagattcagagaaaaggcatttatgagatgatggcgcgggacattgagtttatccgtaaagcaatcaagctgatgccgccgatcagtctgaaaggaatggctgattttgatcttgtgcttgacgaactctggtcagtgacaagagatgagatgaatttcctgaccgaagcatcgaatatcgaagaattttccagaagaaataaggatgtcaatttcgttcagacaccggttctgtatcagcagtatacgaccgttcatgtgctggtgatggaatatattgatggttgcggtattgatgagaaggataagctgctcgaagatggctatgacctgaaagaaattggaagcaaacttgtagataactatattaagcaagtaatggatgatgggttcttccacgctgatccgcattccggaaatgtaaagatccgtgatggaaagattgtctggattgatatgggtatgatgggacgactgacagagcatgaccgtgagatgatcacgcttgcaatcgaaggcgttgcactgaatgatgttggtctgattctaaaggcggttctcggactgggcgaattcaaagaacgaccggagcagagaaaactttacgaagacattgaaggattgcttttgaaatacggaagtaccgatatgggcaagattaatgtggcagaggtcatgacggatctgatggaagtcatgaaagaaaataagatcatgatgccacatggactgacgatgcttgccagaggacttacgcatatggaaggtgtacttgccaatatcgcaccggatatcaatatggtggagattgccagagcaagacttgctgcgaattttcttcacaattttaactttaagaaggaattgaagaacacaggaagaagccttttgaaatctgtgcggaagatgattgaccttccatccatgacaacggacttaatggatgaattcatgaaagggcagtcaaaagtaaacctggatctgcgtgtgtcaaaggatctggcatttcttttaagacgacttgtaaggaatattgttatgggtctgtgggtcatggcacttctgatcagttcaagtattatctgtacaacggatatgacaccgaagtttatgggaatcccggcacttggtgcgttcggatatctgatggcagtggtgattatgatctatgtatttgtgaaacatattttctcgagaaagtaaaaaaagaatataaagcaaaggaaaagagagatgaaattttcgtctctcttttttatatattaggaaagtcctttcctaatatataaaaaacgctccgctcaggatgcgcactgcggcgtacaaagataaagcactaatggtatactttatctcttacacttatatggtactaaaaagcaggagacctttttcagatttcctgctcggtgtgccgctgtgtaaacggcgggtatttagttgtgaaagttcgggacaagttgacccgatgtgtgtagaataacaaactggatttatttttctttacattttatgccgtaatttcccctactaccattttcgtagcccctatatatttcatatctttttccatttatctccacttcgtcatcgttaataaatgtataagacttaccattttcttcacaatactttgaaattgcttccatagtttttgcaagagttgggtaattggcactatcctcataaggaacccaaaaagcttttttaaacatataaaatacctccttctaatttgttaagtaatccacgaattttcaaagcgttataaaataatagtatcatacagcttcgcaaaaatccacttataacttcaaacttgtcggctgggaacagcttgcaacgcaaggtgtccccagatggcaagtccacaaaagggtagctggtggtagccagcgcaggggaagcgtagcgtcccctgtatgatttggagcagaccatgactgcggaaaatcacagccctccggcgaggagccttcggagaacgcaatgcaccaacctctgggtggtgtataattgcgcccttagtaaactaaggggtttccggcttctcccgttccagcagctttttcaatagttcctgcgtgtcctgcctgtgaaaaatgagtttcaacaacagcatgacatcatcatctgtcaggagttccggctcttgcagaaaactttccagcataccgccacgagtgcagagccggtgcgtccgttcctttcgggtaagctgcttcaactggtgctgcaatgccttttcatcattgatggctttccgcagtttcttttcgcttttctccagttcccggttgagtttttccagctttgaggtatcaggcaagggcagcgtcctcctttcccggtatcagcacataaattctattcggttctcccacgccctgacgcacccgcatgataagtccggcggtttccagttcattcagagaacgcttgaccgtcatgggactgcgggacaggactgcggcaatggctgtgacagggaagcagacaaacaggattccgttctcgtcctcctgccctttggatagtatagcgtccagcatccggcagtacatgacctttgcggtgctgctgactggaaatcctgtcaacgctctgggaaagggcatacagggcggcaatggtgtgtctatcgtcataaattcaaaattcattcggtgtgttcctcctttttctttgctcgtttggataaataacgggggcagtcaaccacaaccgcccggaagctctgcttgcacccatgctggcatttccggcataattcgttgtaagtgacacgcccccggtcattaaggtaaaaggaaagctcatgcttcctctttttgctcattctcggcatattgcacttcctcccgttttagtgtatggtttcggggcgattttcggcaaaattacagccatagagccgcctaaaatctcccgaagtatcagcgatagggtagactatccccctatcagattgtcgtgtttcggtatcatttcggtatcagttcgccagttctccccggtgtcgttcctcccctgaatctcacagcggcgtatcgctccctttggtacgctcgtttcggtcagggttcctccatatccctgccaaaagtcatggcgctacatcgccggggaagcatatcccacacaggctggtcattcgattggaataatccatcgatgaactacctgtatcatagaacatttttgtgccctgtgccgtatgtccacaaagtaggaattaagggtaaaaatcagaaatttccacgattgcggaaagtatgatataatccagttaagcggcagtaatgaaaccgccggaaaggagcgtgcgcccatgaaaggagcgacaagcatacaggaacgcctttgggaactccgcaaggacaaaggcttaaatctggaagaattatcagagctgacgggcatttccaaatcagctcttggcagttatgaaaaagaggattataaggaaatcaatcatggcaaccttatcacgctggcagacttctatggggtttccgttgattatctgctgtgccggacagagaaccgggagcagatcaacacgccactaacagagctgcatttgaatgatgagatggtggcacttctgaaaggcggtcggattaacaaccgtctgctctgtgagcttgccactcataaggactttatcaagtttcttgcggacattgagatttatgtagatgggattgccaccatgcagattcaaaacctcaacgcccttgtcgatactgtccggcatgaaatcattgaacggtatcgccccggcgaagacgacccgcatttgaaagtgctgcaagccgcccatatcagcgatgatgaatatttcagccacatggttcttgatgacctcaatctcattatccgggatattcgggaagcccacaaaaaggacagcgagagtgcgccccagaccaccgttgccgatgaattgaaagaaaatttggaagcggttgaaaatttcaagggcagtcgggatgaaaagctggttgtcctttactgcaagcagctcggcatcaactataaaaatctgtcagacgaagaatttcgctggctcattcggattctacaaaaatcaaagaaaacaggaactcctatcagtcaaaggaaaaaacggtaaagaaaaaccgctgttgcatggttgtgtttgcttccatgtagcagcggttggtgctatacttattcagttaaaatttcaaagcgataaagtggaatttatcttagaaattacagcaatgttattttgataaactttcaagaattgaaatatcatgcttatctttatctcttaattcataacctgagtggaaaactctttggccttttaaggatatacaaggaattgtttttccttcaaaaaaagcactaccaaagtaatctttttcaaactcataccagccaccctctaaatcagcttgttttgaagttccgtcctcatttaaaacgaacgggtgaatgtctaagtaaccaagttcatcactatataactctattctaaccggtttccagtctgtatcaattttatagcccagattcaaaagcacatttaacaatttttccgtatgttgagcatcaaaatttatatctatatctctatgaattcttgtttgtttaccagctaaaatatctacaccccatccgccatccaaccagtatgtaattccagtattttcgaataattctattactttcattaaatcttcttttgttgttatttcttttctacccatacaaagtctcctttacaacttctaatttgtaataatcattctaccataccgttatgaataaatcatctcatgtaaaacaatttcttctgcccggttgtgaatgttattgcaacgctgcacccattccatttgacgggtacgcttcaattcctcggtcacgccctcggcagctttcatctgctccatgatggtgtctaaccgtttctgtgcctgttcgttcaggtctgcaagatatgtccacaattccccggtcagggtcaatgtgtgtaatctggctgggcagacttctcttaaatattcccggtgcatccgtccgtactttccgatggggcggtgttcctccggcaacttcaagtccgggatgtagtaatctccaacaaggatataatcaattccgttttcttttattcttggtttcaattcgctcatgttccttacctcctgtggaagcaggctcgtctggtactaactcaatcacatcggtaatctcacaattcagcgtttcgcagatacgggctaatgtatccatgctgatgtgctttccctctttgctcatgttggcaatcatatttgttgtcataccagcagcaagccttaaatcctcttttctcatatcacgctctaacagtgtgtgccagagtggtttatagctgatgtgcatattgttttcctgcctttctatccataccaccggagcggctgccccggcaggcacttttctcttattatagcaccaatcttgtgaaatcacaatttattcttgtagcctgccgctgataccgtctggattggcttttcctttctttttgttccctttaattagccatgaactgcttcatgccctgagattttacttgtgtgtgataaagaagcaatagaagtgtaaaaaattttgccgttcctatccggcacttgcgcgttgtgtcggataggtcgggcgtttattcgggcaagtccaccttgccaacaaaagaataataaatctcaatgtcctgtctgcgggtcttgttctcgtcatagctgcactcatgtacaacgattttctctacaaactcccgcaacagagtaggggtaagttcttcaaagctggtatgccgccggacaacattcataaacttttctgcgttcacagtggcttcctgtgctttggaaagctccgcttggatagcggcggctctttctttcagctcccgttgttctgcttcatagtctgccgacagctctgtgaaacgctcgtctgatatgcgcccggtcacgctgtcctcatacagccgcttgaagatagcggataactcggctatgcgtttctcggcggcttccagttcctttttcttggcggcgttcctgcgcttgcccccgtcctcgttctgctcaatcaagagcttcataaaccgggcttcatgctttgccgcatagcttgtcactttccgcagattggagagtacaccagcggtcaagaggtcggtgcggataaagtgcgctgtacagtcatgggtgcgtttcttgtagttgccgcagatataacagtcctgcttgcgcttgtccgtctggtatcgctgctgatacatcacactgccgcagtctgcacagaacagtatgccggagaacaagcccacttcatcatagcggttggggcgtttgcgctgcttgcgaagctcctgcacccgttcccatgtttgggtgtctatgataggctcgtggtggttctcgaatatcgctagcttttcctccgggttttctacgctgtgcttgactttgtaagagagtttttccgtcttgaagtttaccaggcagcccgtgtattcccggttttcaaggatatgcacaacggtattggtcgcccacttgcactcatagccggggtggtagcggcgagtgctgcccgtcctgcggtattccagcgtccccggcgtggggatttgctgctctgtgagcatacgggctatcttggtcggaccgttcccggcaaggcagaagttgtatatctgcttgactacgggtgcagcttcctcgtcaataatgaaattttcgtcctcgtccatgaggtagccatacacaggcttgcttgtgatgggcttgccactcatgccctttgagcgttttactgctttgattttcttgctcgtatctctcaccagccattcgttaaagatattccgcagcggggcaaagtcattgtcgccctgtgcgctgtccactccgtcattgatagcgatgaagcggacgcctttctgtgggaaaatcatttccgtgtacattcccacttgcaggtagtttcgccctaacctcgacatatcctttacgataactgtcccgacttttccggcttcaatgtccgcaagcatggcttgaaaaccgggtctttgaaagttcgcaccagaataaccgtcgtccgtgtaccagcgcagattggaaaagccgttctgctttgcataggtttcaaggatacgcttctggttggaaatggaattgctctcgccttgcagctcgtcctcatgggaaagtcttgggtaaagggcggtaattggttgttggttggtctgtcttaacataaaatcctccgtttccgacagccagccccactattccgtaccttgattgtaccacatggggcggctgtctgtatagcggcaaaagcgtcaaatctgcttctttatggtcggtcaaatcgccgttttttgtgtagtagcttccgcttccagcactttcatcatcttgtcggctgcggtgtcggttgcgccctgcttgaagaagccggaaacggtaaggacggagttgcccatgcggatttccgttacacagtccgggcggcggtctgttttggtggtgcttgtctgtttggtttctgtcataggctctcctttcgctgcttcatcagttgctttaatcgttccagcttttcctgtgcggtttcctttcggaagttgctacccgtgaagcggacgggggcgcacatggaagtcagcctgtcatagatacgggcgtggggcgtgtcctgcgggtgctgcaattcctccagcgtgaggttggtcgtggcgatcagcggcttgccgcttcggtaacggctgtcaatcacgctataaacctgttccagcccgtattctgtccctcgctccataccgaaatcatcaagtatcagcagggggtagctgcaaaggcgggaattatactcattcctgccctcaaagctggcggcaaggtcattgagtattgttgcaaagtttgtcatgcagacggcaacctctttctccataagggcgttggcgatacaggcggcaaggtagctttttcctgtccccacgccgccccagaacaggtagccgatattttcagcctgcatggtttcccagctctccacataaaagcgggcagtttcggtctgtgggtttctgccgttgtcatgctcaaatgtccagttccgcatagcagggtcggtaaagccccggcgtttcaagtcctccactttttcaaggtgcttctgtcggctttcggcggcttgctgcttttcacgggctgctcgctgacagtcgcagtctgttgggtggcggtcacgcccgaaacaggtctttccctctgcaaagtaggcttctttgggcgtatggcacttgccgcagtataaaagcccgtcctcgcctgtgtagtcctccgcttcggcggtagtggctgtaatgtccgtaatcatagcttcaatctcgtttttcataagctctcgccctccttgcatgaataatcgggtatgccctgtttcggggcagccttgcctttggcagtgtcctcctgcgcccacttgtaaatggtggctgcatggctgtggtactgcttcccggtggaagcgatatggcaggaaagccggtcaatataatactcccacttgtcgggcagctctgttttcagcccggaaagctctgtatcggtcagtatcacattgttgtatctgccataagcggcgggggcggggtgtcccgtttctccctctctctctttttctatctctatctctttctctttctctaactctatctctggtggacgaatgtcggacaaatgtccgtcttttgtccggggcggtaaaagtgccttgttttccagccttgcagcccgttttctctcggcttcggtagaggactgtcctatcatcagctcaatgtcggtcatatagaaagccccgctgtcaagctgctccacaagccccaactgccggaaaatctctaaagccctctcaactgtccctatctggtggcgggtcagtgttgctatcatctgcgctgtgtaggggatatgctcgtcaagctgcaatttcccgccgcttttcagcgattttaagtacagcttcaagaggatattggagtataaaatcccgtctttcatatcttccagcagcacaatggagtcgctgtcaaaaaagttctctttcagcttgaggtagtaatatttgcggttatctgccattgtccctgtcctcctttttccggcgtttggagtagtagcgggggcagagtatgataaccgcccggaagctctgcttgcagctatgggtacagccccggcagaggtcgttgtatgtgatacggtcgcaggtggcattcccgactttcacttgccgcaggaaaaaagaccattccagccgccgtttcttgctcattcttggcatgggtgcgctcctttctgccgtttccgctggtgtggcggtatcggcgataattctgtatcatctcggtatcattttcggggtttttctgccctgtaagccagttaaaaaatcctttggtattgcggatagggtacggggcagcccccttgttctgtatgggttcaggtacatttgggggcggttttttatcgctcctgttcctgccttttcacaggcttgcgttcccggcgtaaaatctggtcgatattgcccttgacagtctgtaagcggcggtattcctcccgttttgcccggtaatcgttgtagccgctgtttttctctttgataaggctttcaatctctgcttgcagggctttatagcttggcagcttggaaatgccgttctccctgaaataacgggcggctgcgtctgctatgataaagtcgctttcgtgcttctgacggtaggctgcttttgctttggcgtttttctgctgtttcagcccgtcccggacagggcgggtcttggaataggcaagcacctgccgttgcagctccctttttccgttcagcgtcttttccacctgcttcagctctgcaaggctttcctgcatggtggtataagcggcagaacagactttgtccagttcctccggggaagaaaagccgtactgctgataggcggtaacggtagctgccatttgctttaggttgtgctttgccgcccagcggtcatagcccacacccttgccctcggctcgcttggcttcccggtcaaccatgcgctgcaaggtgttgtctgccggggtggtttttttggctttttcctcccgcaagcgtcccttttgggtgtgggggtattcgggtatggctgtggtctgttcggcggctctgtgggcgttctgcgtgagcagggcaaggacagcagccttgtcaaaatcgtcccccagcttccgggctgtgataggctttgtcctgtctggcgtgaggtaggaaagacgcccccggctctccttgacggtcacgccctcccgcagcaaaagagaagaaaactcgtcaaagctggcggcttgggaaagtgcctgccgtatcgtccggcgcagcttcgccttgtccgtttcaaacttggtgggcttggtcggctgtcctgcggcttctctggcggcgttctctttatcaagggcaagctgccctttctttgccgcccagtattcccgttccgttatccgttccttgctgccgttcaagaggtcgatttggtaaagcccctccctgtggcacatctccatgacttcactcttgaaatattccatagcggcgttggtgcagcggtgcttgcagcccgcccgtgtgtcggctggtctgtccatgtagggcagaagcggtacttcataaatccgcagggagttgatgacgatatgcacatggatattgccgctgtggttatgcccgtccgggtgggtgcatacaagggcttggtgtccggggaaatgtgtcttgcagaactgctcgcccaactcctgcgcccggtctacggtcaagctgttgtctgtcccgtcccgtgggtcaaagctgatgatatagtggtggcttttcacatcttcccgtttttggtttttctcatagcggagattggctcgcatacaggcaacggcgaaatcctcgctcccgcagttaagggaagaaatgcgatagtcctccctcggtatcagccgcccgttttcatcaagggtgggcttcatggtaaactcgtcatgctcaaatgtgagataggcttccgctgcgccataatcggcatttttagagctgatatgtttgaatgttgccaacagcgtcacccactttctgcaagacttcaaactttagggcagcaaggtcggaaaccgccgcccgtacctccccagcaagctgcgggtaggggctgtgccactcgttcagtgtccgggctatctggtttaagttgccgccgatcctgccgtattcggcggtcagcttcccgacagcggcaagcagctcgtcattgactgccgacacatggataacagggcgtatggctgccccggttatggcttgccggataaactcggcttggctcatgttgtaagcagaaagcctttccgcaaactcggcgtattcttcctcggtcatgcgtgttttgactacccggctgcggtgcggtgtgttgtatcgttttcgcatggtaaaacctcctttctgtgcgtggtgtcctctcactaataggagaaaaacggggtgtgaagcggaactgtttttgaaaaatccgaaaaaatattttgaaggatttttaagcggcgcaagccgcataagcagggtttggggaaggcactccccaacaagattcccgcaggggcaaaatgagcgaaaagcgaattttggtactgcggtagaatcttgctctaaaaaactaccgctttcctcggcggctctggtttgcggatatactggcttgctccaccaatatagcgattgcggcggcgtgttctgcccgctgttcaccactacaacggtgaaaagggggcgttttggcaaacgcagcgaaaatttttttattttccctgtctgctccctacaacaatccggcggtgtggtttgccaaagatttttgaaaatgggcgcaaaaaaagcagtaaaccttttcaagatttactgcttatctgccgctgtgatgggcggcggtattaaattgtcagccgtttttcaaatggaatttatctgcaatcgctttctttccgctttccaattccttttctgtaatcttccataatcctaacgcaatgatctgctatcttttgcattccgagttcttcaaaaaaggcaatttgtattttcatcagttcttcacaaacagtcaacttctgctcatccatattgctaatagcaagccatgggaacgctttatatttcttagtgtccccaatgagaaaattgtaccctatcaactcattttcacggaaaacgaaatagaattgtgggcctgaacctggaactgacttttccataatttgctgcattgttctcacgccgccgtgtgccggaaaaaaacctattcgctcaagagcatttaatatgccaatccttttatctgtgggtatgtctctataattgataatctgttccatttgctctaccctcattgaagtttaatttgtcaggctctaattatacaacttttctgtttagcggtcaaagcggaacttcaacaggctttctatcagttgcctgacgatatgctcctgcatatccgtgttaatctgtccgtccattttcgcacaagagcggacatatcccgcataatgggataggacggcggcaacagcttccgggtcgccctcgcttgccttaacgattgtctcatagggaagtagctggctcataggacaaaccctccaactctgcccgtagccgccgtaaaatcatctgaatacgccgcccggttgtgttgccagcccgtccatatctccgtccaatctccctatgcgtcaatcgttggaagtagtacaagaaaatgatttcctgttccatctgtgatagtgcggacagggctgcggcaagctctgggctttccaaaagcaccatctgaccacagacgaaaagcggatagctggtcatgccggattgctccgcaaagtatttatctgtggtactgaatggatagtgtttttcttctatcagatattcaagcgagatttcccgcttgcggcggctccgtatgctccgggctgcgtctatggcagcgtggcgaataacagtcttgcaaaaggcatcgtgtgtatgccggatatgttcttgatacttttcgtgttcggtcatggaaaatccccctttctgaataatggcagagggcggcagcatcttgtgctgtcgccctcttgattaccgaacagcaaagacgggcggggctgtcaacggcggcgcatttgcgccgttcatcttgaccgttgacaggctcggctgggtttgctatctgctcacggcaattcactctcattgataggaattgcctcaagttccgtattcaaattgttccaataagagccgatatccgcacttgtgaaatacttaaaaccgcctgctgctgacttcaattcgccgtttttaaccccatagcaggcgtaaatcaaatcgtagcttgttccatctgagaggttaaatctaaagctggtcacatctgctccggcagtttcctcagttgttttgtcttttaaggataagcccttgaacttatcatacagggtctttatatcattttcagcaacaactactttcttttctgctgatgcaggcactccgtcatagtggtacatttcaacgctttcgacatcttcaacctcaaatgggaagtcgattttgacaggctcataagcaatgtttataggtaacagaaagagagctgcaaaaattgcaatgatacaaagagcgatggaaacgagaacagcaatcgttatcttttttctgcctctctgcttttcttttgcctcatggcgcataataacgctttcgctttcttcgtgaagaacatcttcgttcgtgtgagaaagcaatttctgataaattgcgttacagtcagcacaggcggtcaaatgctcttttaccatctctgcgcttgcttcgctgcaagcaccgtcaacatacagcggaagaatatctcgaacaatatcgcattgtttactcatgcttttcatccatcctttcttgaatttttagctttgcacgatgataagtaactctcgcccatgattctgtttttccaaaaattgcagcgatttgtgaaaaagatagttccccgaatacgcgaagctgaaagacttctttgtatggttcttccaaacggtgaagaacgaggtgtatgcggaacgccatgtcagaatctgcaactgagttctcaacattttcatttgatggcaagtcattgatttcactcacatcagctactcgctgacggcttcgcatttcatcatggtaaagattttttgctatggagcagagccatgtcaattcatctgacttacctttgaattgtgatgttgtagaaacagccttatagaatgtgttctgcgtgatttcctctgctatctcacgatttttggcaagagaaatagtatacgagtatacctgtaaatagtaggctttatagagcttttcatagtccatacttgtcatcacctccttcagcttcataggttagacggagaaatcggaatttcgttacaaggaagtttgaaatttttatacctttacgctactcttgctttctgcggactattggtagacgcgcattaacggcaagcaaagagattactgtgtcagcttgatatgttcaaatgctaattaagtatagcatacagctatgaatttttctattgcgttcccctgacttcggaatagtggcagggctggctgtctttgttttgctttgtgcttctctaccgtacatgagcattggcgccagggttgtcgttgccgtaaccttccaacaggttgatgacaccccagataccaagaccagcgcccagagcgataacgagagtctgaagaacggtaattgcctgttcaaaaaatgccatatagtttgttagccggaatctgattaaaaaataggtttgtcatgtttcataggcatacaaaagccggaacaatctgccgcccggtttccgggggcatgattccggctgtcctcctttttcattattttgttgatgattgcccgctttgtacgccaatggcctcaacagaggcagttgcggcaaatagatacgatcactcctttctcagcggaaccgtattacacgccctccgtgtctacttcatatacatcgcagacctcatcaggcttgagttttagtctggcagacaaaaatgcttcaatatcaaaggtatttcgcttgtctgcatcagctgtgtatttgaaattagggtgtctggtaatgtcatacttgtctgaaagaaacggacgcacaccgcgcaactgcaagatgcacttgccgccatccataactgccagctcgtcctggctcatcagctcttttcccaatttctgatagttgagcgagtgggaggtctcccgtccccggctctctccggtgttgtaagtgtctatggtctcctttcccagaacagccgccagctctttcagcgttgttggctctttgccacccaggaagatggaagtatccatattgccgatgatggtatcggcattatctttgtaaattgccttgagctggctctgtgcctgcaacaccagacaggcagagatttcacggcttcgaatggtggccaccagcttttccagcttcggaatctgcccgatgttagcacactcatcaatcaaacagcgcacatgaaccggaagcctgccgccatacacatcgtcggccttttcacaaagcaggttgaataactgggtgtagcacatggaaatgagaaagttaaaactgtcatccgtatcactcataatgaggaacagggccgtttttctgtctcccagcgtatccagttccaattcatcgtaggatgtaacctcgcgcagctccgcaatatcaaatacggccagacgcgcaccgcaggaaatcaaaattgacttggctgtttttccagagacgaaaagtcaaggactttttcatcaaattcaagaagaagttacattttgcggacttcttcacgaagcatacgcttgattttgtcctccatcgtctccttggcggtctggctgaaatggacacggacgatataggtggtcttgccaatctgctttctgacagtcgggcaagtggcggtgttggttgcggtattgttcattcaaaatcctcctgtaaatgaaaaagtgcccggtgactattcatcatcgggcggtgtcggtatgaaggaacaaggcaaggcggcaacattaaggtatctataaaaaccttgccgtctttgccacgcttgccgtgttcctgctgtcagtctcggagatagcagacccatgctgtgccgtctttctcggtcacaagcctgtctccgatacggctttttgccgttctcatggtgcgtgaggaaatcccacgctcattgactgccttttccagctctgcgctcggcatacgctttccgtctgccagcagttccagtatcagtgcttctgcctgtgcggtcttgctttcggtcttggcggtgtctgtcccggcaagaagctcgtcagcggtaatgtcataagctcctatccattcaaagcctttctcgtctcccagagaaaaggcaagggactgtccgggcggcgcaagggagcttttctcatggataagcaccctcgttgtggggctgtccttcagcttgccgataaaaagcagactgcggactgccgccgtaatgtcgatagaccctaatccccgataggtgctttgcgttcctgcggctttgttcaggtgtccaatcagcacgatagcgcacccggtagcctgtgcaatgtctcccagactgcggaatatcgggcgcacctcgtttgctctgttcatgtccacatctgcgcccagaaacgcctgtaccgggtcaatgataacaagccttgcgttgttttcccggattgcccttgctatgcgctcatcggcaagggtcagcggtgtgtccctatcgtcaatgacaagcactctttcaaggtctgcttccgcttccatcagccggggcttgacggtatcgcccagaccgtcctctgcggtctggtagatgatgttcaaaggctcaagggtctccataccgggtaaaggctttcggttggtacaagccgccgcaagacgcatggcaaagtaggtcttgccctcgccggggttgccctgtataatcgtcagctttccaaaggggatatagggaaaccatagccaatccacgctcgtcagctccacatctgccatgcggagcatgggaacaggctgggcggtgggcagctctcgcagcgtgattgtctcggctatgaatttgcggctgggaatgtccccttgctgacggagaacatcgttccagtctttccttgccgggacaaggcgaatgacggcgatctcgctgggaatggactgtgccagtcgggtacaggcttcgcttcctgcggtgtcgctgtcaaggcagaggaacactttttgggtgtccttgcgttcagaaagaaaacggtcaagagccttgcccgaaacgccgcccagggcaagataatttcttttctgccagtcctgcggataaaggcagatgaatgataacaggtcaatcggtgcttcaaagacaaagagctgattgccgtttccctcatagcggaacggataggacttgtcagccccggcaatgtcctgtctgaatgggtctgccgttcctcgcacatgggcgtatctcggcgtaccgcttcggtctctgccgacaaacacaacattgtgccgctttgcgtcctcgtaaatatccccggaaagaagaaaagtctcaacaagcgttttgttgagacctcggctttcgcaaagatattgaattgctctgtcggctgttctgttgtgcaagggcaagtggaacgctgtgggcggtgctgtggtggcttcggtctgtccctcgccgttttcgcctgtcaacatctggacagcttcgggaaaggacttgccgtaaaactccatgacgaaatcaatgggatagccgcccttgctctggctgtggcgaaaccacttgtttccccggacggtcaggctgtcatgttctttccagcggtattcccgtccgcttttgataagcgtctctccctgtgtgcggagaaaatcttccagactgacggcgtttgcccggtcaatctgcgcttgggtgtaattcatcgggatagttcctcctttttctgtcgtgtttggggtcgattttggagcttttgttcctctgtgcgctcgttaaatcgggcggcagtacctacgcatgacttgaccttccaaaggcggtgtaaatcgtctctgacggtcttaaactcgccataggtggtgttgtgcgcctgttccagctcgtcatactcttcggtcagctttttcatatccaccttgccgtccgggaactccccggtcagcttgcgtctggcggcgtagaactgtttcagttccgcttcatgctctgccttgtacttggctctgggcttctcaaacttgattttctgcaagccgtcatagacaggcttcaagctctggaaagcagcggagctgtcatagagctgcttaattgctttcattcgggcggtctgttcgtccagcgttttcttcaagctctctgtggcagcactgtgttcgctgacacggctttccaaatcttcaagggagtaaatgccgtttgcccggagataattgaaagtctcgttcatctcctttagattgctgaccttgcctttctgcgaatacgccccggctctgcgctgggtgtaataggcgttcagcagagaaacaaggtcgggtgcctgcggcttggcaatctcctcttttgcttcggcaatccaatcgaacaggagagcgattttcttcttgatgtcccggataacggcattggttgccttgatccagcggttgaactcgcccttttcggtgcgtatgcctttcttctccattgcccggacggttgcgccttcatggatagtgggaagtaaatccacgccttgccgttcatagctgcggtggtcgatacgaacatcaatacctttttccgcaaacttggcattgcacatctccgcccatgcttcacgccaatgttccagcgtttcgggactgccccagtcggtagtgggaacggcgttgaaaacaaactctccgttctggtctcggatacggttgccgtcctcgtccagttcgtacacccggcgttgctttagtccccatttgccgttctgcttgatgggacggatggggcaaagcacatgaaaatgtggattgggtatgccgccgtcctcacggtctggctggtgtacggcgaagtcaaccaccatgccccggctcacaaagttctccaacaaaaattgccttgcaagagcgatgttttcctcaagggaaaattcattctgcaaggcaatgtcaaagctgtatgcaagctgggcgttctttccacgctcggctttttccacggcattccacaaggtctgacggtctgcaaattccgggggagcatgggacggcaggagaatatcggagcagatcacgccgcccttgcgggtgtagtcgctgtattcgccgtaatactcgctatacaatcgctccccggcacggtaggcggcagaagcaatagcggactgtcctgcgcttcgcttagtctgcgtgacgctcagatgaaatagtgccatcggctttcaactccttttctctgttcgcttggctgatatgggtaatcgccatgtgacggacggctcgctggacttcggacagggaaaagatgtgttccatcagctctgtcatttcggtgcgtgtgagatctttgaccaccggggcaaggctctcaatcgtgccgcccagattgcaaagacgatgggtgcgtttctgcctttcgcctttctccagatacttctttctattctccagacgctccagcttgtgttgttcctgtgcaagctgcgtctcggctcgttccttttcggctcggagctggtcaagggttttcggttttgtcattgtgattgacctccttttttgattttggggataaaaaaagaccgtcaacttttcgcatagtgcgaccagtcaacggtctgattttcggtatttatttttccaaacttgctggcggcgaacagcattttatgctgtttgcggacggcaagtccacaggggatagccgcattagcggcgcaagggggtgtagccaccttgacggaacgaagtgacgcaactttctcggtcgggcagttttcttctgctgacagagaatgaagctccgcaggacgcacatactcccgataggagagtatagaagtgcgccctttagttcctaaagggattttcttctgacccaaattatataaaatgtagatcaagacatttctaagaggtactctcagattttcacaacataaggttcatcttcaataataccctgatcgtgggtaacaatgataaccgttttaccttcttcattgagttcgtgcaataacctcataacaatatctctatttttcttgtcaagtgagccagtaggttcatctgccaaaacaacagaacattttttcatcataagacgagctaaagcaactctctgttgttcaccaccggaaagctgataaacttttttgttaacttcctttgataaccccacacgattaagagcttctttaagtgatactttagttcggcttgattttttaatcaaacttaaattttctttaactgtcttattttcaagcagtgcaaaattctgaaaaagaaaccccactgtatccgcaaaaaaactgtttttatttttaagccgggtaatattcagcccttcgattatgatactgccgctatccggtttttcgataccaccaatcatattgagtaaagtgctttttccactgccgctatcgccgctgattactacaaaacttccatccggaatttctaaattaaagttagagaaaattattttctctccaaatgctttatttaagccacgaattataatcataaacatcctcccttcaatgactttgagatatttgttttttcaacccacataatatttgtgaaaatgattgccatttcaataatggtgagcaacgctccaatcagtaaagcaatcccgacacttgcgttagatataaaaattgaaacaatgcaaatcaatatcacaacggctatattttctaagagattaacggaaataaatcttttgtgcctttcataaaagcgatagcccaaaacctttttgagggagatttccatcgcattaagtctaaattccattttcacttcagatatgatgatagcgatatctaacagcaatactaatacgcaaagagagcttataaagccaatcagtttcacgaggaaactatgactataaatgtaatcctctccgacattcgtcagcataaaatagtgtgaaccaagctgttctgaatattttttcgcagcattacgaattgtgctttcatcgcatccgtagattacctcaccattatatgttcctgtttcgatataacttccatttaaagcaacagcctcatttgcctgataaatcacaatcggatttgttactcttgacaatccgtcaatagcctcttctctgttcgaattgagataataaaattgttctctgccagaatattctttataaacaacacgcagttcttctgcattttgggtaagagagccaatttcctcttttgcgatatctttgtatgattccgcattttttccctttggcacgaagaccacgatatcctctttttcatcatcttcagtaagcatatcagaaaacccttgcagcatatctctggcattatgatttacaaaaatataattatccgtatcgcttatccggctgcctatgcagaccaccggatttatagtgttgtattcattttcgtaaaggtcattccaaaattcgctctctttggattcctcctcattttcttcaaaaggaggttcaatctgcataactccaaaatagtaatcattataatgattttctaaaagagtagtgtttgtaagtaaattaccttgaatgctactgagatttgtagttattgtaaaaatcgtcatagcagtagcaaatactttaagaccgttcagaagataaaacataccttttttatctgaagcattggcaaaggctttttttacatcaaagcggacaaaagcagcataaggaattacggaaagaactgctccggcacaatacactgccaaaatgagatgatcttcatacgctcccgatataaattgagaaacaagcaactttgctaagacgaataatgcagcatatgaaatcatatcagccactacagcttttagagcaatcacagcagcattttcgcccagagaagctcgtacaactacttccttttgtctgcgtatcacctcaatcatattaagtacaatcatcaatatggcaaccaggccccaaacaatgaacatcatatcagtttcggttgattgccaaaactctggctgcgatatagaatattcttttgccaaatcttgatatgtggcaataatgtcatcatcgtcaccgatatagctgaccattatttcctgtccattgcctgtgttttttgcttctctaaaatcttcaaattctattacggtgattccgcctatcaaagccgtatatgttttttcctcaatatccattgtgcttttaagactatcccgaacaacggtatcatcaccataaatataaagtcttgtctgataattagaaactctctgattaaaagtcgaaaaaatatgaacaccatgcttctcagctgtatcttctgcattggctaaaaatgaatccatatcgtcattagtagttgtgtatctggacgataaataataagcaccattaaagttccagagcatattttgatatacttcagcttgcataacaaaagcaaaaataatcgtaatcaacagcaatatatttcttatatgtttcatttaaaattcttaaacctcctttgaataggtaacagacacacgattgcccaaaatactaatatggattttttcatacaaccacattctcttgttagattctaattttccgttttctttattcgcataaattgtaccataaaactcgtgaacaattctaccgcaactttggactacatgagaaaagtccgaacagttttctgcccggacttcctcgctcaatcataaatcaattccactttcacaatctcctctgcctgtgccttgcaagcgttcatctgccgcacccattccatttggttttcggctttcagttgctcggtcacgccgttttgctctgccagtgaccgcacgatcagctccatgcggtttcgtgctgtttcgtcaatctcggcgcaatgctcaaagagcttgtcggatagcaccagctcattgaacagtatcggacggtgcatttccagatacgccttgcgaagtctgccgtagtgtccgaggggcttggtcttgcggataatgatgtttgggataagataatcgccgttctgtgtgtaagtgatattcatgctgtttgtactcctttcatcggctctctctgcggtaaactgctgacagggacgaacacgccctttgcaatgtcctccgcacgaatggcggctttcttggcttcgatttctgcctttttccgctttttgattttgtcctcgtatcgcttctgtgctccgctggctttccgcttcaagtagttctggtggagcctgtccttgcgttcctcacgcttgcggatttcctctaattcctccggggtaagctccacttcgccaaacgcagggggaacgaaacgacccacgaaattgaagtaaatctcgacctcctgtgtggtctgaatactgcccttgcggtcacgctcatgcacaaggattttctcaataaactcattgagcatggcaatcgtcagcttgtcgaagttctcatacttgtcaatcagagcgataaaacggtcagcgtccttttcgtgcttctcgtagctcttgatagccttttccagaacagagatttcagcggtaagctcggtctgctccttttcatattgagcgtccagagtggcatatctgctgtcagacagctttcctaaaatgttgtcctcatagattttgcagagcaggacttccagctcggaaactctctgctttgcggtggcaaggcgtatccgctgtttcttgacctctgccgtctgctggctggactgcgcttcctgcaccactcggacaaactcggctctgtcatgcttcgcatactcggcaatagctttgagcatttcggaaacaagggacagtaccacatcttcattgatacggtgctgtgtcgtgcagagctttccaactgggactttgctgtattgggaacaggtatattgagaaatacgcttgccgttgttggtacggtggacatacatcttgccgccgcaatcggcacaatagagcaagcccgtgaggggagctgcttcgccccagccgtccgggtagcgtctgacatttccacggattttctgcacaaggtcaaaggtctgctggtcaataatggcttcgtgcgtattctcaaaaatcgtccattcgtcctccgggacataatggcttttcttgtccttgaagtgctttcgggtcttgaaattgatggtgtgtcccagatattcacgcttttcaagaatgttgcagatggtggaagaaccccagccgtacacatctttgaaagtcttatttttgttcacgccctcgccgtgttgggcaaggtaagcagacggaataagcaccttttccgatttcagtttgctggcgatctgatacggaccgtagccgtcaatcgtcatggcaaagatacgcttgaccacatcagcggcttcggggtcaaccaaccattggtctctggcttcgttccagagatagccgtaaatgaccgtgcctgtgaggtgcttgccggacttgcctttggactggaaagtggaacggattttacggctggtgtctctggcataatactcgttcatgatgttgcggaaaggggtaaaatcatcgtcccctctggcactgtccacgccgtcattgatggcgataaggcgaacgccacgctgacgcagaatttccataatctgaccgactttcagatagtcacgacccatgcggctcatgtccttgatacacaggtactccacattcccggcttcaacctctttcatcattgccaaaaatccggggcggtcaaagcaggtgccgctaatgccatcgtctgtgaaatggacaatgtttgtaaagccctgccgtgcggcgaactcctccaacatagctttttgattggaaatggaattgctctcacgctgttggtcatcatctttgccaaagtcatcacggctcagtcgttcgtacagagcagtgattttctcgttttttctcataacttgcgctcctttcttcggttttaggttgtgtgttctaagagacttcccaaccacttgattaagaagtcttttagagcatacaacaccggctgccagcttatatttcttatactgccgcactgcgaagtggtttggcttttccgattccagtgcatcaaacatcaggtctacaggatttttgaactcctcgtcatcctcccggacttccatggcgttgatgaactcgatgagggtggagaagttttgctcctccaccggagcttcatagtggatatatccaatcaacgcgcaatacagcaatgtttccgccttgacccagaaatcgtctccggccttgccctcgcctttggtattagcgatcagcgttgtcaccagcttcaaaatatccttttccgagtggatgtatgcaaaggggttatagtgcatggacttcttgaagttgatggtatttaggaccttgattcggtacggctcataaatgaccttgccgtgcttatccttcatgggctttccgtccttccacagcttgggcgcacccctttggagcatttttccgcactccaccagaattgttcccttcgggtccgtcacaacataggaactgtgcatctgcatcaggttgggtttcagccagaatcgggtcttaccggaaccggagccacccacaaccaaaacatttttattgcgcgctgttttcgggtctttcgggcggctgttcattgtcaggctctccgtttttgtaagaatcacattgttctgaaacacaggatcaacgtaaggtgcaatatcctcacgggttccccagcgggccgaaccatattccaaaccatgtcgatatttcttggcgttcttgcttttaagatacaccgccagcctcagaccgcctccacagcacagccccaccaacaaatccaatggatgcaggcttggccagaaactttgcagcgccccaggcagaaccgcaaccagcgaaagaaatttttcagaagcatccgctccttgtgccattcgccatgcctctccaaaattggtagcaaacagtcccatcaggatatacggcatattcagcaaaatgagctttttgatgtccaatgtctttttcatcgttccagctcctttcgcttggtgcgatccaccacagcatttttaaccatctctttgaactggttaagttttgccagtacggacgggcgctctgttttcgttgcctttttgacctttttgttggtgtactctgtaaaagctgctgtcagagcatctgcatcacggcctttgaaaaaaatcaggtactttggcggagaactgctgcggtcctttttcaccgcataatccacaccatatttccgggcgattttctcaaactccttgatagaggggtctgtaatctcaatgttggatattccctgattctgcccgacaagctgcttcacagtctgttttccatgcggaacaaccggcgcatcacggcttctctgtttttccagcttcttttcctttcgatgtgccatgtacttgcttatggcagccttaaacattctgccggtaaactttgttccactgacaaccagcgtcaaagttctgttttccacttcttcctgcattttctcgcctcctttccacgaagtttgcagggaatctctttttttgctaaggcggaaccaccagccgccgcagaagataacgcttcataccgccctccttagcgtaactggtcagaacggtcatagtgcagattgccctgacgtacctttgcgtggctcaaaatcttaatctgccccttttcctgactatccagtgctttttcataaccggtatccgacaggaacaggcgggttcgttcgcctttccagccaacaggggaatcgttcgtcagcacatcaaaaataatcatgtgccgggtgtcctccgcaaaacgctggaggtccatatatccatgaccgtgataattctgcgctcctgcctttgcccgcatttcttccatcagctgccctatggtctttccatcagacatcatgcttgctcctttctcccggcagttccgggcaataaaaaagcgaccatttaccagccgccatacagatcgtgatttacttgtgaggtgtaatgattgcttatcgtggtcggtgcattgaacagaacggtcagaagatactgcttcatgttacgaatttccgtggtgttcttctgtaaacagtccatgacaaactcaatgtgcgagttatccagcttcaagaacctggaacgaacgatttcatgcggaaaatcacttcctgcaatacgggtggtctttcgctttgcacagaccgtttccacgatcagctccacaatctcatccaaatcctcccgataagtttcatactgctgacacaggtattcatacccgatattctcctgaatcaattcccgataactctctatctctgtgagtgacatcgcatcccttcctttccgttccggcagacaatctgccgcacaatcccggaagggaatggaatcggtacttgatccataaatattttgtttttgagtatttgatttctctatatttaattctgcgggcttttccgtatccggtttatccatatacggattttccgtatctggtgaatccgtatccggttttctaagctgtggctgctcgtatatgacatactctgtatcgctgatgcgtccctgccgatcacgcagcttgtaccgtacaatgtaaccggcggcctccaattcccgcagcgcaccaccgatggcatccacaccctctttacagattttcgcaagtccgcgggttgtatagttccagtcctccggtaaagacagcatcatggaaagcaaccccttggcttttaacgacaggtttgcatttcgtaaatgatgattgctcatcacggtataatcacgggtccgttcaatgcgaaaaacggccatcgacctcactccttccgaatttttggtacaaaaaaaccgcaatcctcattccaaagaattgcggtgttcaacacttttcaaattttcttgcatagaaccaaaacagcggctttcgaggacgcgcctctgtaaatggcttctcctgggcgaaaggaagtgtttgcatcactcgatcaatatccgttgaatccatgtcatgctgagatttgcaatcttcccggattgcttcttgaatttcctttaccgtacacatagtcattcctttcctttcgttgtatgagtttatgaacggcgacgttttcccggtttgaaatcgaggatgtgtccctcaatcacacgagcgtaacgcttgatcttgatctcccggcactgctggctttgcagggcagcctgatacccgtcctcagtcaaaaacagccgcatttcctctccaggacttccgtaagctgtgctgggacgcaggacggaaaactcaatcatccagcgggtgttatcccaaaacctctctacggcgagaattttgtgtcctttcagctcacgggctgaaatatccctcataggcggctcctttcatcgttcctggtctctctgacgctttttctgccatgcctccagcagcttgatgatggtttcctgcatccgctggggcgtatagcttttagggaaatacttccgcaaggtgtcagaggtaaatgtcactcggtccagatcgcttttcttttcctcacccatgatgacacgcatcatatcgagggtcagatgcccctcctgactgtattttttgagccgctgggcttgagaaagagaaggggtagcctgttcgctgtccatcgcgtccaacaggtctacctgttcctcctttttgagaaaggacagctcataggcgggatttaaggcaattttcttttcatccaccatgtccagcagttcgggaatcagctcagtcaagcgaataaatctctgaacctgcctttgactttctcctgcttgatttgcaaccagctgaattgatgtctgcgacttctcgccaacttggcgagaagttaaatctgagcgttctccctgatgttttatagcctccaacttcattttataggcaaaggccctctcacttggaagcaggctttctcgttgcaggttgctgtcaaccataataattgtggcagcgtcatcgtccagatcacggacaattaccggcatggtatctttttctgccagttcacttgctctgtgccgtctgtgtccggccaccagttcataaccaccctccgggtcagggcgggcaatcgcaggaaccagcacaccatactgcttgatactgtctgctgtttccatcattgcttcgtcatccttgactttgaatggatgccctttgaacgggtgcagttccgacagcggaatttctactactttttctctctgagcatcggcacggctctcctccgtagaaaacagatcatctaccgatgccagctctacttttttcgcgctgcttttcaagtttcaacacctccttcgtcagatttcgatacccctctgccaccttgccgccaggatcatgggcgaaaatgctttttccctctgcgctgatttcctttgcgcggacagaatgagggatttccgttccaaagactttgattttacttccataggtatcccgcagcaaagcggcaatctctttagcaaagttggtgcggttatccaccatcgtcagcaggataccgtcaatctgtagctttggattgatctgccgtttcaccttactgaccgtagatagaagctgttccagccctttggcgggcagatactctgcctgaacgggaattatgatcctgttcgcagctgccagagcattgactgtgagcatccccagtgagggctgacagtcaatcaggatatgggaatattgtcccttcagcgtgtccagatattgccgcaagatagtctcacggctcatggcgtttaccagagaaacctccataccggaaagctgaatatccgcaggcatcaggtcaacgccttctgcatgatgcagaataccttctccggggcgtataggatgatccatcaaaattttgcccattgcatccgacagtgtaaatggcagcttgtccggttgcggatttcccaagctgattgtcaggcttccttgtgggtccccgtctatcagaagcactttctttccggcctgtgccagacctattcccaagtttgcacaggttgttgttttgccaacgccgcctttctggttggcgatggcgatgatttgtgtgttcatgacttcacctcatttctgattgttgctgttgtttctggaaatagaaaaagccgccacttcaaaatcgtaaagtgacggccctttctaatgccggaatctctgaaataaaaaaagcacccagttatttgttactgagtgcctgcattagaatcatatttaattgttcagatttggtcaaattatgccaaaccctccagcgaaaaatccgggatctgagagtgccaaaatcaccctcaaaaatacccccgaaattgctctctggttgtcctattttttaaccactaaggccgttttttgaccccatttttgccggttgtcctatatttaaccactaaaaattgggtgaaaacggctctcgttaggtcaaatcaagtcaaactatatcagcccgtttaggtataagaaaaccccggaaaaccttgattttccggggtttttgaaccattttgatatagtctgagcagtcgattatcgcttgctgaactgcggagcgcgacgagctgctttgagaccgtatttcttacgctctttcatacgtgggtcacgagtcaggtaacctgctgacttgagaaccggtctgtaatctgcgtctgcctcaaggagtgctctagcgattccgtgacggatagctccagcctgtcctgtgtatccaccaccacatacattaacgattacatcgaacttgtcagctgtctctgtagccacgagcggctggcgaacaacaactttcagagtttcaagtccaagatactcgtcgatatctcttttattgattgtgatctttcctgttccaggtacaagatatactcttgcgatagatttttttcttcttcctgttccgtaatattttgcgttagccactgttatttcctccttctacctaaaatgtaagaacttccggcttctgagcctgatttgcatgctctggtccagcgtatacatgaagcttcttgatcatgtctcttcccataggtcctttcggaagcattcccttaacagcaagctcgatcaccttctctggcttcttagcaagaagctcagcaagtgtagtctctttcattcctccaacatagtcagagtgattgtagtagatcttctgctgtaatttctttcctgttactttaactttctctgcattaacaacgattacataatctcctgtatcgatgtgcggagtatattccggtttgttctttcctctgagtacctttgcgatctcagatgcaagacgtccaagtgtagcgccttcagcgtcaaccacataccattttctttcaatcttatcagggttagccatataagttttcatgggtgttcctcctataaataatcattatatactattgcttatttatttgaaatcagcatactccggggctttggtgcatactgtttctccttatgtcataccttgctattatatgttgatttgtgttccgtgtcaagtgttttttacataaaatcgcattttttctttcagttctcaacagcaaagcaaaactttttcattcttttacaaaatcatctctatttcgcacttaaaaagtgccgagtcatatggatttttcctataactcagcacttttttcacattccctactcaacggttattgctccctggaacaatcaaaacctttgatttccttatttttcttcttttgcctgctctaattctttaagaatctgagctgtaagaccttttctatctgttttgaagtggaagtaaggtctttcagtaatttctctgatctctaccggatattcatgttcttccagtgtatctttcaacagttctgctacttcctcaagtgtctttgttccatcaagaatcacaaacagatatggacgataatatccttcatgctcctgatccggaacgagacagaagaatccatctttcactccaggtgttcttactgtttttgtctccattctcattacatgaagtggcttatctccgtaagctttgatttcaccacgaccaagaatatgcacaattccctgctctgtgatataagcctcgtctcctgtatgtaaccatgtgtttccatccggatgctcaacaagtgtctgctctgtcagttcttcacctctccagcctgagtaatgaagcatcatagacggacctgtcatacagagttctcctgattctccgtaatttaattcattcagatctttgtcaaatacaccaagtacagttgctgtcattggcatacctacacatccatcctccaatgggaacattgggttcggcagtgtgaggtttgagcatccctcgctctgtccataacctgcacttaattttgcctgaacgttgtgtttatggaagaattcttctacctctgcatacttacggtcattcatagcttcggcacctgcaccgattgttctcaggtgagacatatcgtaatcttccggaattctctcactggacattaacatctcgcaatagagtgggatcaatgcccagaagttcggtttacgatccatgaattcaatgtcaatattctctaacggacagaatggatcaagtgataccattaatcctgtagaaagtgggaagatcgtcattgaaactgttactgcgatcaatgccggtggaagaattggtgtccaccagacttcctgcacatctgacggcggaataaagattgacatctggtatgcagttgctactatatttgctgaagaatggattacaagtttagagattcctgttgaaccacttgtgtatgctccaaacacagctctgtcaggatctaccggtgcaagatattcacctttgaagtttcttcccagttccataaactcctgccagctcatatcgccttctgttgtctctgtctctgccggatagcgggctgtgatttcttctaatacataatccttcatctggctcttgtctgcatattcaaatggtgacactttaatcatacgtgtcatcggagttgttgtacggaataactcttcatcttcttttgaaagataatccattacaaatgctgtatctgttttacatttacggattgcaaaacaaagttcttccggttcgtcatcacgacagataattgctacaccgactctttctgctgcaagaagcagaataaaatgagctggcgtagatactaaaaaggacggaactctgtcaccttcgttaaatccgagggctttcagtgctcttgccgcaacatctacatcttcccataactgtttccatgtaatcttatttccataatactcaaatgcgatcttatcctcattcgggtttttcattttcaggaaagcttcgattgtaattcttggtatctcaagatttctgaactgttccggataaaagttcagccacggtttgtcaatacttgctttacctgtcaatttctgctctgtaaaattcatgattttattcccttcttttcttttgtttttcttgtcatttttccccaaaaatactttcaaattttatcacaggttctttcaaatgacaatttatggaaacttgaatcaacatgattcacatgaatcatcttgttttccaagcttcatttttgaaataaatacaaaatcagtaggtaaattatggttcttttattgcatttttattccctctgctctaaactaatatcatactatcaacttctttaaggtattttttaaaggaagggggacatattacaagttattctatgctctgtaatataacaaaaatatgaaagataaaaaccgtttcagcattttactagaacaccttatggctattgctgagctaaaaaatagtattcttgcaaaagctgttcagtatgatgactcctatatcagtaaatggattagcggaaaactgttgccaactgaaaaaaattatgaaaatacacttcaggctatcagtcactgcattgttgaagcactttcggaagaaagcactacccaactattacaggaatatcagctacaggatatcaaagatcttgaacctgctatttatgacaatctcgaatctgaatatatgtatgtaaaagaattacaaaactcaaccggtacagaagtagctccaaaaatttcttattatccggagcttacattagaccagttcatttttaaaatgaaacacccttcacttcgaaaagttaattctctaaacgtatacgcgattgttgatattttgaatgtcgatcccaattaccagcttttgattgcagaactcaacagtgcacacggcggccggaatcttattctacctggtgtacatttttcacttcttatggacctggaatcggctgcttccactcctgcctataccgctggtttcttaatgaatgtgatgaccaatctctctaatgttgattttaatctttattctggttcgcaggctcaacgtaagctcatttttgcaatcagagacacttatgctatctctggaatgttagtagatagcagtcactgtcttggaattaccacaattgaagacagtgatctaacgaatgaactttatcacaagatcagacttctttgtaataaagaaacactattaatccggaaaacaaccattccggaaatgattcatcgctttgaatatgaacaaacgttaatttcacagaagcaatactgtctcatcggacacctgacagaacattttcttccggaagatctatatacggagctcctggatgagtattgcctgaataacaacgatcttcagaaggaggacgtaaaaaaactaaatcacctgacacagcgcattttggagaccacatcaatccatctgatcatttatgcttccgtgttaaaagatttcacagttacaggagaacttgatttcttcggtgtaagaatatcattaactatatcccaaagactgcgttgccttaagaatctggaacagctgttaaacaaacttgatcttatgcatgtatgcgttcttccggaaggaattctttccgaccatcagcacatagcacacccgacactttttgtatcagattctttgtgttatctgcgtttaaagaagttgactccggaatataacatctgcattccaaataagattatattggatcatatcttcgaagagtttttcgatgatgtctgggattctaatattgataaaaacagccataatactgtagtagccatgattcagcatgcaattcatgcaatagaaatcatgcttgaagtcaactaaaaatgagtatcaataagcaatcccctacctgttgctatttcaaattaatctgcaaccggcaggggattatttatttattcatatgttgtctgattcggatagttaaatgcaatataactctttccgcggttaattgatatttcatttcctgattcatcataaaatgttaatcttgataattcattattttcctctttactccaatgaatcttctgttttgcaccgttcgaaatgtaatatcccatggagtcttcccagccatcccagtcaactgctttatgtcccaaatcatctttgacagagatagtggtctctaacacaaacacattggtaaaagcaagctggtttcctgtctttccgtctatctgggcatttccatcaatttcttttttataagtattgcttgcttcatcatagacaagtgtagcagactgtgcgccaaaatcaatactcactttcttacacacatcttctgatggtttcacttgttcatttaatccattaaactgaaatgctgttcctttcttatcatccgcaaggtctgttctctttccagtattttgcactacttctgcaaactttgttccatcaaagtatcctgtgtgttccaatgcatacccctgattccgacgttccatatctcgtccaaacagacctcctgcattgtaaattccatcatactgatccaggttcaaagcttccagataatctgcgatactatcatcaattccccaatttacataaaacgcatcaaatccctgagacagtgccgggaaataatatctgcaacttcgtatcgcacagatctgcggaacagttgtataatccgcataaagagccataaaacgcgtctgatcaccctctaccgggatttcaaagataatatctgctttttctactccgtactgtggcattgctgccggaatattattcaccataaccgccaccggacgtttaccgatagcagcatctgtcagatccgcaagacctgtcagcaggttttgattttccggaatcttttcttcttccggttcttccggcacttcttctactggttctggcttttccacttctattttcttagtcggtggtttttctgtttttgtctcttttttcttagagcaacctgaaagagccagaactatcatagataaaatcagtaacaggcacattccccttctttttttctgcccgcctcgtttcttcttcatacactttccctcccttacatttggaatataacgaatattaactgaattaattatatcatcccccagtgtcttacacaatcaaagaggagcatattatgcaaaaagcacagtgaataaatcactgtgctttttgcgtataatcttcacaagttaaatcctgtttataacttatgagtcagatctcattcaattattttgcttttccatatacatacttcggtgttccaccaacaaccttgtttccgttagagtccgtatggtatgggaatacccagtagaagttccaatctgtgctggatgccttcttatctgtaaatgttgtgccttttgttgtcataccgatgtaaccatatttctcgcctggatgaattccgtatacaagatatccttctgctccggctgacttcgtccatgtaagttttactccaccctttacagatgaagctttcaggtctgtaacagctgcgcatttctgtgctttaccatatacatagtgtgctgtcagtcctggatacatcttgccattttcgtctttgcagtatgcaaatacccagtaatagttgtaatcacttgtaagtgcttttacatcaacaaaagatgtcttagatgtcataccgatataaccatacttgttaccgcctccgcggattccataaatcaggtatccttctgcgtccttcacttcactccatgtaagttttaccttacctactgaagaagatgctttcaggttttctactgctgcaagtctttctttttcaactacgacttccttagttgtcggattaacaactttctttccatctggtgatgttacggatgctgtataaacaacttttccttcttttgtataagttgctttttcgactgtttcactatcaatcttaacttctggtgtctgaacatgtgttgcatcatttgcacatgtaaatgttgctgttgttgtccacttaccatctttttcttcccagtctgaccataccggatcgccgtatttgtgaccaagttttgcaattgctacttcttttgtctcttttgcaagtacagtattatcatctgttgatgttactgttgctacataaacatcttttcctgcttcttcacatgtaggtgctttatatgcatctgtatcttttactacagatacggatacatttttctgaacttctccacatacggaacacttcacttcatcaactgttactgaagtgccttctttctgatctgtcttataacctgtgatgtttccatcatcatctttaattgcagctgcatcccagttgaattttacatcactatatgtatgctgtcctgcttcgccttttacttctgtagatactaaatattttacaccgtcttcagttttatctgctgctttgtatacagctgttacaccttcatcacatgttccagcatggctgaccatcttagcatctactgttacagctttatccagtgtcttattgatagaatcacggttcgctttattagttgcattatcgtcagatgaaagcaagcaatcgagcttgtcaattttatctgcacaagattcacatgtaagattctggaatgttactgttgagtaatcatcactccattttgcatctgtcggtacatatgtatgaccctctgcttcatttttaattgctgcatcccagatagcttttctcttctcatatgtggaattcgcctgctcgtatttagatttaacaggttctgtaatacaagcaccacattccgggcatacatagttatctgcttcgtttttaacaccatctgtctttgtatagtatacttcatggaatttgatgtaatgatgttcatgtgctgtattttctttttctacacgtgtaccatctttaatcaaaccacaatcagaacaacgttcctctgtaaatgcatcacggccacaggttgcaggtacggaaactgtttcataattatgagaagtacctgtcagtgtcttcatatcaactgtatcaacgaagttagctgaccacatgaactcgtcattatcattgctctgactgcccatgaactgctgatacttcttgtagtttgtataagtcggattgtaatctgtctcttcgaattgataaccataacaaccggaacttgtatgatcaagcaagccagtcttacctgaaatgaacgcgaagtttgtaccgattgaaacaatcagtttgtcacccttcacagtcagacctgcgattggatgatttgtaacagtaaagtctgcactgtctttgcttgttgttgtaaacgccataccgccaaacagctttgtattatcacgttttgcagatactgtattgtattccttcacaacggctactgcaccgtctgcaggattgtaggatacgatatcgttggatacgttgaagtaaatcttaccatctgtgtacagcgctgctgtcagaccgatagatgggtagatgctctgttcatctacgaactgtgcatacagttttgtcagaaggtcgttcttcaccatcttgccgtctttgagaacgcttacaaatgtatcgtcatcatcgtcgttttccttgtctgtgaagttaatcagtgtctcatagtcactgtcgccatcacctgcatccttttctgtcagtttatgacgaacaatcttgtactctgcagccttctggctctgattcatgcttgaactgtttactctgtcaaacaggtctgtagaatcatacatgtagtacgcataaccgtctgcatagtaaacattgcttgccgcacgcgccatccatgctgtctcataggtcttatcagttgcttcgttttcatagagagatctcaaagaactgaaattaccatcatataattttctggcacttgtatcactgaacaggaagtatgtatggttcatatcaccgtctgtctcaacacggtcacggctcataacttctgtgtagacatctgtgtaacaaggatccacataaaaccactgtccatcaacctttactgcattccaataatggtcggatccgaagtcctcctgttcttcgccgtacattgtaacatcagactggaaggagattcttacaaggtcaactgtgtaattctttgaagtgtcaagcttgccatctgtatagtacagttctttggctgtcttccagttggagctgtcatagcctacattcgtatctttcagataaatatccttatccagacactgtacaaggtatgtgtaagctttggagtaaccaagacatacggatgtacccataccgaatgcaccaaactgagaaccttcccaataattgataacaccagttgtcataccggttgcagcctgcttcgcatagattggaatcgcctgcttaaagcttgtttccttcgttccatcaccgtccatatccaatgccggatcatcgctttctaactgctgctgagtaagctgctcaacagtcatcgtaacgccttcagaaacctcaacgcctttttcttcagcatttttgataaatttatctgcttcctgcttcaatggttctgctgcgtctggaaggttttctttcacaaatgcttccggatccttctcgatagcttctttattagcttctacatatgcattcgcatcttcctcagactgtccagccttcaccaaagtctgagcaatagcgtttttataaaattttacaagcaaatcctgcttaatgcctgcataaatctgatcatggaaattctgtttgatctgtggttcgtaaaccttatagatctcatcgtaaacttcatcctcatgctcctgcttctgaggatcctttgcaatcatcggcttgtcatcatctgattccttaccggagttcatgatgtaggacatatcaaatgtattgttatgggccaaccagtcattcagaacaagcagcttctgtgcctttgtctgtgcacctgatgctgtaactgcagcaagagcttcatctcttgcatttgttacatctggaccataatacttaatacctaacttatcaccatatgtgaaagtaaagatcatacctgtcaggtcatcgtagctcaccttgccatctctgacatcctgaacagatttgccgtctaaggcaagcatctcaccaaggataccaagaccatctgtatcatcgttgaaatccagaaagaatggattctgaacaccgagtacattagcattggctgaccactgattcagatactgctgatacataccaacaactgtattaatctggtcttctgtcagcttcttggtttcagcctgttcatctgcttcatacaggtctgctgtgctgatattagattcattggattctgtgccggcttctccgccaacaatctcaacctcttccagtgcttttctcagactctggatagcaggatcagattcatcaatttccacgtcctttgtcaactgttctgcaacagctgcattagcaccctggaagttaattgtcgggatagaaattgtataaccaccatccaccttaacttcattatctccttcttcagcagcctgagcatctgcatcagcagcttcatccgctgtatcctgctcgtccgcctcttcaggagtcgcatcgtcagctgctgtggaatcatcagttgcatcatctactgttgctgcatcatccgctacagcatcagcttcatctgttgtttcctgaacagctgcggcattgctatcttcctcttctgctacattatctgtcggttctgcataaacaggagccggaacagatgttgcaagcatagcagctgaaagaacgatacctaagagttgtgtctttttctttttcatagttctcctttatttcctttctcaaacaattttcatactctccactgagcgccctatccatttctcgcccgtcatcacccctttttcttctttggacctaccctccttccttgattcaaacgtgcctgcaataattataagtaaatgcttcaataaaaataaatagtaagtccatattaagagtagtataccacctaaaatccggagcgtcaattaaccttccataattttacaaatttacaatctgtaagattactccactcaaaataccaaaagcagatattatgccacattttcattcagctttcacttctttgtgtcataatacctgcatttatttatttctgtttgcgcatctcaccaggttctttacacaaagataatatgtactgtccgtagggtgtcttacgtaaacggcttcctaacttcttcaattgttctttatcaataaatccttttttatatgcaatctcctctatacaggatacctgcaatccctggcggttctggaatgttgccacgaaattagctgcatccataagtccatccggagttcccgtatccagccatgcaaagccacgccccagaagttccactttcagttttccctcttgaagatatctgttgttgatacttgtaatctcaagttctccacgttcggaaggctcgacttcctttgcatactgtacaacagaattatcatagaaatataatcctggtacggcatagttagactttggtactttcggtttttcttctatagaaagtacattattgtattcgtcaaattctactaccccataggcttttggattctttacataatatccaaagattgtggctccatcgcgttcattcaccctctgcaaaacaggggagaagctttgtccatagaaaatgttatctcccagaaccaatgccacgtcatcatcaccgataaaatcctctccaatgataaatgcctctgcaagtcctcttggttttttctgaactttatattcaaatctcatcccaagctgtgatccatcaccaagcagttctttgaacacactgacatctctttctgtagtaatgatcaaaacatctctgattcccgcaagcataagcacggaaagtgggtaataaatcattggcttatcataaaccggcaaaatctgttttgaaactgcctgtgtaatcggatacaatcttgttcctgatcctccggcaagaataattccttttctcttcttcatatgatctgctccattcatctactatttacagatgatacatctctttataatagttctgatattctccgcttgtaatgttctccatccagtccagattcttgagataccattttatcgttttacggattcccgtctcaaagtctgtctccggctcccagccaacttctttgcggattttatccggtgcgatcgcatatcttctgtcatgcccttttctgtcttcgacatactcgatcagattttcattaatatgttctctgcgtgggtcagtttccggaagtacatcatagagcagtttcaagattgtcttcacaatctcgatatttctgcgctcattgtgtccgccaatgttataagtctcacctagtctgcccttttcctgtaccatatcgattcccttagcatgatcttctacatacaaccagtctctgatattgagtccatctccataaaccggaattttctttccgttcaaagcattattgatgatcagtggaatcagtttctccggaaactgatatggtccatagttgttactgcaatttgtaatattggccgggaacttataagtatcaatataagcctttaccaacatgtctgaagatgctttacttgctgaatatgggctgtgtggtgaatacggtgttgtctcataaaagaatgttccatcctcttccaaagatccatatacctcatctgttgatacatggaggaactttttcccttctttataggttccgtcttcctgttcccatgcatttcttgcggcattcaaaagaactgtcgttccaattacattcgtctgcacaaaaatctccggattcttgatacttctgtctacgtggctctctgccgcaaaatgtacaactctgtcaatatcgtactcctggaaaatcttatttacagcttctgcattacagatgtcttctttaataaagacgtaattttcattgttttcaaattctttcagattttccggatttcctgcataagtaagtttatccagattgacaattttaatatccttatactttttaaacatataatgaatataattgcttccgataaatccggctccaccggttactaaatatgttttcattccctgtttccctcgtatttttactatttttatctgatctttttctaattttattttaacataccgttttttaatttaaaataattaattggagatttattgttttttctctgcaactgtttttccatcactgtttgcatatcctttgataatccctatcgtcaacacaataaataccgctccgaggatcatgactactgctgtgtaaaaaactgatattccgatcatcccatgcttttctgtgattgtttttccaccaaaaacaaacaataaaaaagctaacagatatcctatattcagcagtttttgttttcttgtgacagtaatgatcatctgaagaaaattaacaattgcaagtgcgcctcctccaattagcaaaatcacaagtgatttcttataatctgtcagatccacaccgtaaattaatgacaagacaggaattccaagtaaatatccccctatgatcgcagccacagaaagcaacaggatcaaagcgatctgtcgtaagatcagtttattgaactgactgatctttttttcatgccataaaagagccattttgctgattaccggctgatagacgaactgactcaaaagacttatcacaaagactggcataaaaatgtaggtgaaacatgcctgcgcttcacttgacatcaccttatcaatcgcatatttcggtgcatttccaatgtaaatcaccaaataagatgctataaaaagcggaaaacattctacaaatatatttttaacatttttaatttcaaatgttttcttttttatttcaaatcctcttattgccgtataattcaatatcacgaactgaataaatgatacaagcaaagccactgcagatgtcaggataaggtttttgctgaaataataacatactaagtatacaaaaatataagtacacattctgatagacaggatctttccggccacatccaggcgaagatattgctggaacattccatgaatcacatcttctaccgcatcgatcacttttgccagacagattagaattataactatagattttgaagaattatacaatcctgatgcaagattcactccgacataaacaaaagatgcagcaatcataattatactcgttatgattctcgcaattgtatattctttaaaactatatttttcttcgacatctgacacttgaaactggcgtattccatattttcctatcgccatcataagatttcctatcgcaaatgcaattgtaaatacgcccgcatcgatcaccggatcaatgcgggatataagcatcagtataaatactgtctggaatgcattcagcattgctgcacatgtattccataagtacgccgacttcattttgtccttactgccaaatagaatcttttttatcataatcctgctcttccatatacatagtgtgctgtaccgcccgctactttatttccattaccgtctgtatgatatgggaatacccagtaaaaattatactcatctcttaatgcatttttatctgtaaacgttgttcctgttgttgtcatgccaatatatccgtaacttccttctcctcgaattccatagacaagataaccttccgcaccttctgattttgtccaggtcaactttacccctccactgacagaatacgctttcaggtctgttactgcttcacatttctgagcttttccataaacatatttttccggcgcacttccggcgatcatattaccttctgaatctttacgataagcaaatacccaataaaaattataatcactcgtcaatgcttttgtatccgagaaggaagtcttgctcgtcatcccaatataaccatacttcccgctaccacggattccataaactaaatatccatctgccctctttacttctgaccaggacagattcaccgcacctatcttggaagaagcttttaaattctgaactgcttccggttttttatttgtagtttctgcaccgaaatccatgttcagatctacttttccctcaattccatcaaccgtaccagaatctgtacattgccacattgaatactctccctggtaagtacaggtagaattgtactgtgcaacccaatggtcaactgtatcaaaataagaatctgtcagataatttgtaaaccagtctttattcgcatatactgccacatcatatcctgcatcttctatgatactgcagaatgtctgtgcaacttctgcgatctcttttgtgctcagttcttccctcacactattttcttccagatcatagtaaatcggataagaaagatcatatcctttgatcagacgaagtacatgattggcttcgctttttgctgccgtcacactgtctgcataagaataaatataagtaccaaaaggaattccttcttttgtacatgcatctgcatttgtcttccaatatggatcatcctgacttgtctcatcatctccatatccacaacgtataattgcataatctacatctgttgcctttacttttgcccagtcaatgtctccattccacttacttacatcaattcctttggcaacagctcctgtgatttcttctccctggtcattatagaatttcccgtcttcttcataccacgcatccgaagaactgcgcaaatattctgctgtatcagacaaaattggggttccatctttgtatctccagctgttgcttctgtcttctcgttgtgcctgctgtggctctgttaaatcttcttgtactgatgtactttctgtttcttctgcaaatacagtaacagaaggtaatgtttccataactagaactgtagcaaccgccattgcaagtacacgtttaactcccttattcttcatactttcttcaacctttccatgtctactccgatgttgtcatactgcctgactgcttcattctcctacaatataccagttataatcataatcttcggattttgtcatatctcccggagcaagtacaatatagtaatcatttgcatattccaggcgataatcattcctgtgcaggaatttcataaaccagtctttttttccattgtactgattatataattcactttcaatcaaagcatcgtaattatattcctcaaacccataataattgtttgttctgcagaatataacaaccggtttctcctcccagttctcttttgcaagtttcaggtcttctttcagtttctcttccgtataattcggattggtaacccatggctgtacataagattccatttcattcaatgaatacatcaaaatagctccgccaaataccattaatggacgttctttctcctcatctaaatgatttatgcaatccagaacaccattgacagcatctgcttctctctctgttgtcttcatatattttaatttatcactgttaacagaatatcgaagtgaacttctatccacactgtcaaaattcattgtgcaataaagcatgtctacaaatttcactcccatgcagacaagaacaattcctgtacaggctaaaactgcaccatgtcggattttcaatccatatttttctgtcattgcattaactgcttcaagtgcagctttactgaaaacaaacctgcaaacggcggatactgcaaatggagcaataatccaaaatgcaagaatcacgtgttttgttcctgtattagaacctgcaattgtcagaagtggaagcataatggcacagattccaagaataatcagatctggatttccattcttactatacatgttaaaaaatacatagcaaaaagttactacatacaatatacctataaaaaaggacggacctgttgtcatctgcggccagtttggtactgtatttacatcatatgcataaaccaacatataaacagcaattccaatcactactgcgctgaatgcaatattcaggattattttcttcggatgaattccttttaatgaaaacaaaatattcattcctaaaagaagaatcatagaagcagcaagataaataacgcctgaagcaattgcatcaagatttccaaatataaaggtagaccagagattttccatgctgtaaccgcttccggccgtagatgcaataccagataatcgaaaaatattattgataaaatattcaacctgacctgtaattgccagaaatgctgccagaactccgaacgttgctgctactcctcccgcaaagactcccagatgcttaataaaatatttcacatcttcattgttatataaataagaaaaaacatagataaagcatgtaaccaatgctgttatactacccattctggaaaatacaaccaatgtcaggaaaattcctgcgacaaaactatatttaaacttcttctcaactacagccttaaattcaaatccaagaataagaatcaggaaaaatacattgaactggtgataattgaaaatattcaaatatgtatctgatgccataattgcaataagaattccgaataatgtctgtaaatcacccaaatatttatgaaataccttatagacagcgaatgccataaccatttccacaattacttccagaagatttaatccccagattcctaatccaccaaatatctgaagccatccccatgcaagtacatttgtcagatagcaggtaaaaccaactttatccggattgctatatatattttcatagttaaacatatgaatcccagtatcacccaggtcaatgccaaagaagctgcaaagaaatggatagagaaaaattcctgcgatcaacacaatcttcgcaattttttcaatttgttccttcttacttaacaactgctcctttttacttaacaactgttctttattcatcctctttcatccttatactctattaatcatttaagtatttttttaaacacacaatatcatatgtatcccatttatatttatcaagatactcaaaccagatatcttcctgattttcaatattttccaatttctttaagaactcttccgtatgttgttctttcggaataattacgactccggtatcatcgcatacagcaatacttccttcatatttatctctgtgttctttttcaattacactgtctaacggttgttcaatgtatttattaaaacagcccaccggactaaatcctttacaccacatcggataattctgtttaatgatatcatttgcatctctcatattggcattggatataatcgcaactgcctctcgatacagtactgcaaactttgttacaagctctccgataattgcacggtcaccacagttaaaagcttcgatcattacaacatctcctgcctgcacttcacggatctgttcatgtatgctccagtttgattcatccaatgcgtagatccattttacatttcccaccgcaaaatgccctctgttcaccgcatgagaatctttaaatacgcctgttttcccaagacagtctgctacttctgttgtagaaattcgattcattctgatttttcttatgatttcgttcttaatatccatgttttctcctatgattcgaaagataccttcaatgtattctttacttctttttcaatttcttcaattctctcttttgattctgcacgtgcaataaaaaatcccactctggaacgatcatcctgtgccttctctataatatcgccttctttaaattcaagctgaagctgtaaaatttccggaattgcattaatctgctcaacaccttcaattttggtaatcttctttccctctgattcgatatccagaaattccagaactgctgctctttctttcattttctctgcgtctgatgtatgcagatcttccacagatggagtctggccaagtgctgcattgatcagcagctgatagttgtccacccctgacataaatggaacaatatcagaagcaattctacttccacctccacgtgccgccatctcaatcagataataatctccatcttcgaacttgtattcggaatgtgtgatcgcatatttaattcctgttccgctgatcagctcgtcatttgtttttctgagcaggtcataatcaaatgtctcattgtagttcgtaaaaaacaactttgaggctatatttctgttataagcgtaatgttctttctgagagatcgccagtgtatggtgtgttccatcaatcacaataccatccactgtaaattctgtgccttcaatatatctttccacaagcacataatcgccactatttgtaaaggcttccgtctctgcgaatcgatccctcaattcctgttcggattctatcgtaaatattccacggctggactgggaatccaatggcttaataatcaccttttttcccaattctctgtagaactcgattgcttcttctacatttgtacataatctgtactccggatacttaaatttattttcccggcaatactctctcattttaaatttgtttgtaaaaagttctgccatttcatgaccaattccaggacaccccatctgttctgcaacataagctactgttggaacagcaatatcactctgatctgtcaacactgcatcaatcttatattcctttgcaagtgccagattcttctctttgtctcttacatccattacacctgtaaaatccgcgtacttaaatccaatagaatcttcataaagatttgaattcactacttcatatcccaaactttttactttcttaatcagtggaacctgccatgttccccctgcaattaccattactcttttcatcattcgctccgaccttcctttaaatctacaaccttttttacaacaggtcttctccgtcttttacaatactctctattacatactgtggctgattattgatacacatataaattcttcctgtatactctccgataattccaagcacgcccaggatcagacctcctaaaaacagtgtaacagccatctgcgatgtatatcccacttgaattgtaggtataatcagttttcttattaatgagataattcctagcaacactccgcatacagaactgataaatccaagtgcacttccgactcgtaaaggtttaattgaaaatgctgtaaatccattgatccacagttttaataatttcttaaaattatagccgctctttcctgttgctctttctctctgtttcagatgaacatttcctatctttcctgatgttctgagtagaagtcctgcaatgtaagggtatggattctgatatttgaccatctctttcactacaaatctttttgccataaaaaaagatgataatcctatctctttaggcttatcaatcatatgatacagcataaattcattcacttttgtaccaaatcttcgaacagccgatttctgtgtagtctctgtatattttgcgcagactacatcatatccttcctgcatcttgtcatagaaatcccagaccattcctaccggtgtctgtccatcatcatctgaagtcataatatactttccggatgcctggttaaaccctgccagcaatgcgtttggctgtccgaaattcttagcaaaattgattccgatgattcttccattttcttttgaaagccgattgatcaatccctttgtattatcttttgaattgtcattgaccagaataatctcatattcaaatccttctctttttttcattgcagcttcaatctcgctgatcacgccttccagattcttttctgaacaatagcatggaattacaaatgaaatatccattcaatcatttcacagatcagattttctaaagtattaaaatccgacctgtgtactcctttctctttatctcgtataagccatctctgtactttttttattttccagacagatactgcgtgccggaacatagacactatatggctctgtattctctttgacaaatgcacctgccccaaccagtgttgcatattccagcgtcctgtttccaagtaccgtactgttaattccgagaaaacaattattctttacaactgtttttcctgcgataacagaatccactgaaaagaaattataatctccaacctgcgattcatgtgaaatctggcttccgttccatataatgttggaatttccaatctttgttccatacgccaatgtaacatgttcaagaataatattcccctcgcccattgcaacactctcgtctactacactcggatgaacaaaattttcgatcctatatccttttcttttcgcatcttcaaacttctgctgtcgaatctgattcattttcttataaccaagcgcaataaccatcgtatattctgttggtggatatgctttttcaacttcttcataagccactgccggcagaccatcataggtatcactttcaagatatgctttatctaccgtatatgccacaatctgtacgtctgcatatttttcaaaataatatcgaagcattttcccaaaatctgtcgtaccaaagatcacacattttctcttcattcttttatcctctgtttttactataccggttcttttactttccactataaaatgcttttactttctccgcaatgtaatctacattttctgcttcgagtccataatacatcggcaaacgcagaagtctttcgctttcagtcgtcgtatatttatcttccccacggaattctccgtatttcatacctgccggagctgtatgcagtggaatataatggaatacggaaataataccattctctttcaagtatccaatcagtttctgacgttcctccagatctctcgctttgatatagaacatatgagcattatgtacgcaatcctcaggaataaccggcatttcaatctttcctgcttcttccagttcctttaaagcttcataatatctgttccatgttttcattcgatcatcataaatctcctgtgctttttcaagctgtgcccagagatatgctgcattcaattcacttggaagataagatgaacccgcatccatccatgtatacttatcaatctgaccacggaaaaatttacttctgtttgttcctttttctcttacgatctctgcgcgttcaatatcttccggatcacgaatcagaagtgctccaccttctcccatgctgtaattctttgtttcatgaaagctaaagcagccgtaatcaccgattgtaccaagtgcttttcccttataagaagccataactccctgtgctgcatcctctacaactttcagatcatatttctgtgcaattgcacaaatctcatccatcttacaggctacaccggcataatgaaccggaacgattgcttttgtcttctccgtaatcgcattctcaatcagcctctcatcaatattcattgtttccggatgaatatcaacaaatactgccttggcacctcttaatacaaacgcatccgctgttgatacgaatgtataggacggcatgatcacctcatcccctggtttaatatccagaaggattgctgccatctctgtagcatgtgtacaggatgtcgtcaacagtgtcttggctgttcctgtattttcttcaatccatttagaacattgttttgtaaatgctccatcaccacagattttatgattttcaattgcttgtctgatataatcgatctctgttccgacgattggtggtacattaaaattaatcattctcttttttcctcattcctttgaaaacttccatatttgatagccatctaactctttgtataattctgcctttgcttcaggataataccgttcctgcaaatactgcactttttggtctaaagttttccactctgaatccacaagatataccttctcatttattaatgcttttaatggctgttcggcatcatatgtttgtaatatctgattgcaatccgggaaatttgttgttacacctgcaagatataaaacattgtcaaattctcctgtcggaattgctttccacggattccagtcataatagaacacttgcatcattgtctgaaaatccagtaaatacaaattttccttatgtgtttctatctcattgatcagttcttccgacttcgcccctttattgactattttgcgatatttactcgctttatagttccatgactcataaaatgtattctctatatattccttgcgcccccaactatctacatcctgataggatcgatccggtaaataaagcggcaattgcaaaaatagacatactgtatttattataacacagactctcctatattcaataaattctcttttattttcacattctaatttttcccaaaagtaaaagagagttaaaaatccgcctaaaaatactgcatattccgttcgatacacggttctttcaatcaaaaaacaatataaaatataggcaaatccgattccccatatcacaattgctgtccaacaattttttctctgaaaaacaatacttaatattgtaagcaccacacaggcaaggaaaacaggatatccctgtaaaccacggttctgtatctcttctattattacctccttagatatctctacattttttttataatcctgtataatatctgcggccttctgcataatatctaaagagaagacttcattatctgcaaaattccagttacgcatcatcttataatcattttctgaaattccgattttctgtaattcttccgcgtacgcttcatatccgtaatcacttgcatctacgattgcagcccttgcttcgctatattctttgaagtatttgtattctggatccttattataagaataatcatcaaataacttgcagcctgttactactaagattaacagcagtcccgcactgataatttttctcatctttagccaaaaacgtctgtgatccgtctcatttttccacacccggacaatctctacaataagaataaataaaaggaaaccgcccgcgagataaataatattaaacctgaaccacgttccaattacgcacaaaatcgccgccgatatctctatccgcaacgatctttgttcaaacagcgcccatagaaacacaaggctgcctgccatgacagctatcattgctgttttggtgaactgcataagaatatacgcatcactgccaaacacagtcaataataaagttattaccataagcgccattgatctgttcaattttttcaataacatatatgaaagtattgtaaaactaagaaaacagagtaataactgaaaaataagataccaactgatttctggtaaaataagatagaatggggtcaacagatatccccacaggacattgataaaaatcaaatgtggatttaaactccccccataagctcctgacaaaatcgcagacatcacaaaatcatctgacacttcatatttgacatcacaaaatactaaaattgaagctaaaaaaagaagattcaatgtgatagcagacaatatttccgatttccagatcttactgatacagtttttcaaacttgtttttttcgtcttatccatacttctcaccttctttttttctatttaatcagtttcctgatctctattgttcctatttcttttcgatatagttccctacaatctcccagaccagtttttcttttgtcataaggagtacaactccataaatcccaaagaacacgcatgcgctgattgcaagcattacaaatgactgtatctccatgctccagccaaatgattctaaatcaagcaggcccttcactaaactcccaccgatggttgccactacaatcgctactccaattttcataccactgacatcccgcatgatatcctttaatatctctttcaaatacacacattgaaccagaagtaccaccaattcagctatcacagtagcaagtgctgcaccggatgatgccatcttcggaatcagaaccagattcagaaggaaatcagcaactgcaccacacacgatagaatttaacaccttctgttcctgattctgtggcgtaagaatctgaatcccggtaatattagacataccgatcaaaagtactgtcggcatcagaataatcatcggaagtaccgcgccctgatacccgtctcctgcaagaaactgaatcgattctgatgcatacagcataaaataaatggtcaatggaagtcctgctacaactacaaaattgactgctttcccgatcattctgtaaaaatcttctgttttttctttcttaatataataagaaagccttggcaaaagtactgttccaagagaagtgatcagcgtaacaagtattgtttttactttaattgctgcattatagtatccaacttctgtattcccctgcatgaaccgaagcattacaacatctagattcgtataaacactggttgcggctgccattgcaaaaaaacgcaaaatcggctttatatgtatccgaaaatcatatgtcccacttttcttaaaagaaacaaattttgttgcatacacaaagttaaacacataagatgcagagctcgcaaatacagtaattcctccatagacaatataatcttccggattatgtaccagaaggaacatcaacaccagtgataatagttttacaaccatgttgcataccgtaatatacgcgtactgctccaatgcgttatatagccatgtgatagcaaacatatttagaaccattccgattccgttaataatatataattctttttctgctgcaaactccggcactaacgctactgtaactacgaaaacgatacaggttaaaaacatcgtaattgaattgatgatcaataattcctgcactgtttttgacaatttttctttatcatctcttacttttgcgcatgcccggattccataggttggaattcccaaagatgcaaacatattgaagtatgttataacagcactcgctgttgccaccttaccatttccggttgccatcaagactcttgaaatgtacggaaatgtaatcagtggaaatacaattgaagatgctgacataataaaattcatgataaagttaaatttaacagagtgaatcttcatattacgacctttctttaaccatttcgcaccttactcaaccggacgatcaacgagtaaaatctaaatccggattttctcaagagacgaagcattccgctaaattctccggatttttcgtaaacatatgcatttttttcttttacttctgcatcaaattctttaaattttttctgtattactttatctccagaaccaaagcttataaacacatctacctgtccatgcaccatttccgctattctgcgtgccatatacaattcttttaatttatcataatctgctttttctttgtaggcattaatataatcaagtacatgaaaaataacgtcaatatgattctgcatatgtttctgatatcccagcatgctcacactctgattcacctgtgcaagacgatacatataaacaaaaatatcaaaataaatcacatttttcacatacgggattggatacaaaatgtactctacatccacatagaagctatgttcgtctaaacgaatctgattttcttttagaattgatgtttttaaaacaagcgcatgcatagagattctcgtctcatttgcaatcatctcaaacggcatctgttcttcttttctgatttctggaaaggtaaccggatttaattcgcctgttacgtcattcacttcataataattagtaaatacatagtctgcatcgcatgttttcaatctttgaatcagttctgcaaatccatcctgatctacccagtcatctccgtctacaaccttaaagtattttccttttgcttcaccaatccctctattgatcgtagaaccgtgccctccattctccttagagatcacgcgaaacgtatctggatatttttcttcatactttcttccgatttctgctgtcttatctttcgaaccatcatcgacaataagcacttcaatatcatccaacactctctcatccacaaaggagtccagagtgttctctaaaaatttttccacattataggaaggtactgtgaccgtcagtattttttccaccttttctacctgctttccgatttttacagttttgttgataccattcttctggctttagataaaagacgcatcagccaatactgtttgtaattcaatatccataaatgaagcttatcttttctactccattgatttatgtatttattattcttaacattcccaattcttgactttgtataatctctgtacttctgaagatatgtcccatcgtctccctcaagtacaagttctttcgatggttcaaaataagcatttgccaaaactagatattctaattcttcgcggtaagtttcgtattttccattttcacgatataccgacaatatatgatctattacttccattttatcatgactgcttttctcatgatttttccctgtcataattgaattttcgcgaataatataataatataatggttcttttaaataactgattctttccgctttcaggaaaaatatcggtgttgttgccagatcttcaaaatataatccttttgggaatggacaatctgctttcacgtaaaattctctgttgaacaattttgcccaggccgccggtggtgcaagcagtaattggtgttccttctctaaagaaatcacttttccaccaggaatctgtgttgtccgaacttcctctatcccattttccacgcaacaataatcaaaaagaaccatatcgcatgccattttttcagcttctgtcactgttttttcaaccagatctttcgctatgtaatcatcactgtctacaaatagcaaatatttccctgtagccagttttacgccggcatttcgtgcatcacttaatccaccattctgtttatgcaacacttgaattctattatccttttgagccagctcttcacacatttcaccgcaacgatccggcgatccatcatttacaagtataatttccagttcctgatacgtctgttcacagatgcttttcacgcaacgttccagatattgttctactttatataccggtacaactacacttaccagttccactcacattacctcctgctgactgctgccagtctgtccttcattcttctcaactgagacatcaataccatcattccatacattcgatactgtaatagtttcaagaggatcttatcttttcctgctatctgctgcacataataattcttattcatctgtggaaatttattgtatgcataatctctgaacttcttaagatattcgctttttctgtcatttaatacgatttcttttgatggcacgaaataggtattttcaaatacgagatattccagttcatttctatatgtctctataagattttctctttcaaaatattcaagaagttgattcaccgcccatgtacgatcttcataattcttttcaaaattcctgctgtgcataattgatccgtcgcgcataagataataataataaacttccggcaagtacacgatctttttcgtctttgtcataacttttggaatcgttgccaggtcttcataatatctcccctttggaaattgaaagccactttctttccaaagctctctgcgaatcagcttatttacagccgaacaggatctcatgatcaattctttttcttctgcaacctctatcacccggtttgctgaaaaaggaaatgtaaaccgatctgtcagatttccattttcctcttctccgatataatcaaagataaccatatccgcctgatttttttctgctgtctctactgtatcacgcacaagattttcatggattctatcatcactgtcaacaaataagagatactttccttctgccttttccacgcctgcgtttctcgcatctccaagtccgccattctccttgtggattacttttatacgtccatcccgctctgcatattcatcacagatcacaccacttttatctttcgaaccatcatctacaagaataatttctaatccttgatagctttgcccacatacactctgaatacatctggcaagatatttttccacattatagacaggtacaattacacttacaagctccatattttgctcctattatgatatagtaaaatgatcagttcactttttctaattatagtttagcgaatcaaactcttcaattcctgatcctgatttgcaagatcatactgttctgcattatcaaggaattctgctgattgtctttccattctgttgtctaaaatttcctcagcccagtattttgcgcctgattttagaggaataaaataacacgctttcgttattttagattcttttgttatctcatcactcataaaacacggtaaacctgctgactgtgcctcgattcctgcgattggaagtccttcaaaattagaaggtagtaaaaatgcgtccattccctgatacagatagtccgtatcacttcgtcttccaagaagttttacaacatcttccagattcttttcagcaactatttgtctgactttttcaaatctgactccgtctcctgcaagaagcagaactgtgttgggatcttttttatgaacttcttcaaatacatctagaagaaaataatgattcttctgatagcagaagtttcccacatgaccgattacaaattggtcagttatccccatactccctcggatttcttctcttttctgcacactgtacttatatttttctctatccacagcattatgaatcacacagaattttgatgaattcactatttttttgggaaataaccattcgccggctttcacagaacatccataaaattctgttccgtatcgatataaaaacaagcggcagaacttatgaatcccgttaaatagatttctctttaaagcactttcacagtcatttccactggaatgactgtgaatcattcttctctccacccccgaatgctttgcggcaattgccgcaatacagtcaatcgctgttgagatattcagataaacggcatcatactgcccctctttcataattctacacacttgccgatattgagacaccggatgtttcaaattggcaatggcatataaatttgaatggcatttttttaattccttctgtaactctacgtcgatttcgttcgtgagaaaatcgatcctcacctcttcatttgacacttttgtcaggaaattcaaaagatatttatcaattcctcctgattttccatccatgataaatcctaccagaagctttttcatcccttttcctctctacgaacctgatatgaatattgtaccagataaccactgaacacccataacgcaaaagcacttggggaattcgtatagattccgtctaataaaagcaacatacttataagtactgttcctgccacagcaagaattgcgataagatacaaactatcactgtccgatttcttaaagaccggaactaaaacatattgtataattctaaatgtgatcaaaaggaaaagaacaaatccaaggattccctgaaatgccaaagtattaaaaaatgcattgtgcatactcgtataatcacccacttcattatttacagcatatgtctccggcacatgttcttttgcatatgaaataaatgtggaatacccagctccgtatataggacttgtctgccagacttctactgcacttttccataacgagattcttccattggtagcatctttttcaatattctcatgtcttgctgtctgaatcttgtttcctttcttcgttttcgtagaaattgtagtctgaggttttgtagtcttctgtgcagttttatttgccatttcagtctgatacctggtattttctgtctttaatacctgcattcctccaactgacacaatcataatacacaatacgatcaaaagatttttaacatatctatacttcttgttttcactcttcctatgaatcaggcaaaaatataaaagaaatcctccacacaaaacaaaagcgatctcaccggttcttgaatctgaataggttacatatcccaaattaagtaatgccgcaattacataaaaaagtttctttattcctttctgctgaaatatgaataaaacagccagaataaaacctatcacactaaaaaccgctccataattagggtctgtatatacgccccataatctatcccaggtatacccggtaacaatgaattccccctccggtgttgtaagatattccgaataagattgaaccatcataacaagacttgttacagcagatacagacgttacaataatcatcaagtgtgaaagaatattaaattcttttctgtacttctccgtgtcacgatccagatcacatacgtataatgcaaaaaactgaattcctgtccagagaatccatttcagattatctgtcatgccatactgtctattcataaatgtactaagcagaaagctcagacaaaagaatatcatcaagatcagacatggcatttttctatatttcttcctgtttataatacggaccaaaatcacaaataatcctaacactaatgtcaatttcacaaggattggctgtattggtgatatataaattatagaaataaatgtcgcaaatgccagacatagataactgatcttaaatacaagttctaatatttcttcatagttctgttttaatttgtccattagatcccctttgcacttcgtgtctatctcattagtatctgtcttgctagttcctgttctgatttttctcaatcaatcctcgaattaattcttctatttttcggtaagactttggtctgtcaaactgctcttccgcaattttgcgtgccttttcacccatttttactcttgcttcttcatttttataaagcttctcaatcatatccgcaagaatatttacatcttccggaataatattcacaccaaagccatcgtttttcaccttcgcacggaattccggactcatacaggtattgatcattggttttcctgctgccagataatctccgatcttcgtgacaatgctctgcggagccttcttaacaaaagagttcaccagaatatctgatttcttaagatatgctgccatcagatcataaggtgcatatccaacaaattctacatttgatatctttcttgaatttgcaagttcttccaattcttctttcattggtccaccaccaagaatttttatcttaatctgtggcataccgcgttttgcaagttcttcacctgccaaaaccatcgtacggatatcataactcgttccgatcgttcctgcgtacgatacccagaattcttctttatcttttacaatctcagctgtccgctgtgctgctcccgcatcgaacaccgtcagttcatttcccacataaactgtttctctcggaatatctctgttccgtcttttaaacggacggtcacggtattcatccgatgtaccgatcactccacttgcaagtctgtaaactttctctgcatctcgaagcagggaataaaaaataatatcacttatcaccggaatatctattatcatcctcattgcttccggccaaagatcattcacatctgcaacaaacggaattcctttcttctttgcatattctgccgccgccagtgctacgtcattcggtggaatctcagcatataaaagatcatagtctccctctttctcaagaagattcatcaggttctttgctgcaattctatgactatagattctacgtagatcaatatttttcttatatcccggctcataaatgaacttgaccccaaatttgtatttttcatttttaattttttccagatcacgctgtgctttttcccaatgctgaaaggttgttgtaatcagatcaacctgataaccagcatctgcgagaaattcacagacagaacgaaatcttgtataccctttttcatcatccagacgaattcccattgtaataactgctactttatacattatttttctcccgcttgatatttctttctatgatctatctctccgacttcgtctttgaataaatcacaggcattcctgttcgcacaatatgcaccattcttccaagtgctgtacacaaaaatgtggaatgtgtgttcaaacattttaaagtaatcttaagtgccttactgtccttcgcttctgcttttggaagcagctgctgaaacagcggatcccggaatacttccctgcaaaattgctttcgatcttttgagttcattcctgactgatgatcgcaatttctttctaaggctgaaagaatatatcttccatacagtcctccaagaatagcgcagtgttgaggcgtatctactctccaatacctctgctgattcagtaacatttcaatacgtcttctgtgaagcggataataatccggtacaaacttagttgtcagacttcctgtcattcttttcgcataatgatacggtgcaatattcaataaattcattgaatcaatatcattacaataattaatattaaatacgatatcctcaatcaatctgaccgtttcatagcgaaatttattttctttgatatagtccagatcatacactttattccacgcataaccataaatcgtctcctgttccaatcggatcatataattatggatttcttcaatatccgtaaaatatttttcttctggccggatctcatgggcataagcaaagcttccatcttcattgtaatattcttcaagatgtccaaaaacaacaagttttgctctgtttttttctaaagaatctgccacttgttgtaaaaggtccatgtctactgtatcatccggatccataaaccagatatatcttccggctgcatgttgaatccctgtatttcttgcttcactgagccctttattctgttcatgatgtatcacccggattcttgcatccttctcttttaatttctcagccagacttcctgttttatccggagatccatcctctacgataattaattcccattcctgaaatgtctgggattctatactctctaccgctttggcaagatatttttctactccatatgccggcattacaactgtaaataatgggcgtgtcttactcatatcattttccttaatcatcttttctctataacatcacgattcccgcagacaaatttctgcctgcgggtttctctcgttgtctattactctgttgttgttccgccttccagagtttctccgttctccactttatccatagcttctttgatcgcgtctacagactcctgatttggttgcattacatataaaggcttaccggaataagaataacaatactgagtgtctcctgttccatctgctgccattgatgtaattgtccattgcgggttctcagaaagctgggttttaatcaattcctgaatctgagcttcagacatatttgtttcaacatttccacttacactattaagaattccatttgctcctgtcaaaattgccggagataccatcttcttgatcattgctgtaattaccgcctgctgatccttaccgcgctgattatctcctcctggtacattctgacgctctctcgaaaatgctaacgcctgttttccgttaaagtggttggttccctgtacaacatccatcacaagtcctgaatcttcacttgttgtaaaggcatactcagattctacatctactccaccaagtgcatctaccattgtgatcagggaggtaaagtttactcgcgcgtagaaatcaagattcgtatcatataacttctctaatgtcttcatagacttatccacgccatagattcctgcatgtgtcagtttatctttctgtccacctgaaacctcaggaatttcgacataataatcacgcggtgtggttacaagcaggatctggtgtgttgttggattgacttctgctatgatatttacatcacttcggctgtttgtctcaattgctccataaacatcaataccactgatgtatacactgaatgtatcatttttcacttcaacatcagatgaggtatcttctatctcagtcttaatgtcatgggaataaatcacttttgtattatcttcatacccttcaaatgcttcttcaagaactcctgtaaatccctgattataaataatcgcatctacttttccatcatgaagagcctcggcctgttctgccaatgtatcatactcttctgtcttaatttccgttccgagttcttcattaattgcctgaacagtctgtttaatctgatctccattcatcttatattgtacaccaaatgtgtaattttttgcatctttgattgcctctgctgaatcatctgccataacagatacaactactttatctagtttatactctccaccagagattttggaaaccgttccacttaccttgaacagataatacgaactaaaaatcaacaatacggtaatcaatacgctgataatttttcctgtaatcgcatttttcttggaaaagaactggcttgccagaataactccccaaaacagcaccaatgctacagttgctgcaacaacatactttgtcggaagcatattcaatttaaatatgcctgccataaaaatccctgtcgcaataagctgaacaattgccagaactaatccaattgttctgctgagtttattctctctctttttcacctttctccttcggcgatgtctgtcagatgtattttttctattggaatgtcttttctttcttcgcacatcatttctttcatcagaaggtctcctgcgccgagatcttttttcctgctgactcatattctttagtttccttccctgtaaatcattctctatgtttctatctgtcgctttctaatggcactgccaaacgcaatttctacgcttaacagcccatgaatactaatttaatataccatttcaaccttcatttcgcaacataagccttgtattctaaaaaaatcttaatctttttgatctatttaaaatacttttacttcctcacgaaattgttgcttttcttcacaatcattcaaactttcaatcagttctgctacaacttccgggatctccggtctgaatttcatataccagtcaagcgtctcgcggatgtatttcttgcgaaacttctcatttgcacagaatgcgctctgcagattatgaagacgatctgcccctttcactgcatatgccatagaatttgtcttaatccctgcaatataggtctccatacaatattctttttccttcgtcaccagcttcactgcttttaagacatcttctcccccgatttctacaatctcctgttctgaagcatctgtatcctctaaaagatcatgaaatactgccgcaacccgatattcaacctgcttaccatcctgccgaagaatctctgcaactgcaatcggatgtacaataaaaggagctccacctatccgaaactgtccttcatgcttcttcttcgcatactccagtgctttctggtatatctcttctcccatgatatcctcctttgaatcttccatatttctgtatcatccggccagtatcttcctgttgtttcgataattttagtatacgttgtatttctcgtaaatgcaattctatctctttaaactttttcaccaaaccgctcaacttatgttataattagaaataggttttaagagatttttatatctctgactctttatcgaaatccgataaaaatccgaatcaagaaagtgggtaacaactatgtgggcttacaatgaaactttttatcaaatctacccgatcggattctgcggtgctccggtacataatgacggagtaacagaacaccggattcttaaaattggtgaatgggcagaatatcttggtgatcttggaatcggttcaatcatcttgaatccgattttcgaatcagacaaccatgggtatgacacaagagatttccgcaagatcgactgtcgtcttggaacgaacgaagactttaaagaagtctgtgaaaagctgcatgataacaatgtaaagatcatgctggacggagtattcaatcatgttggacgtggcttctgggcctttaaagatgtgcaggagaagaaatgggactctccgtataaagactggttccatatcagcttcgacggaaacagtgcgtataacgatggtttctggtatgaaggatgggaaggtcattttgaacttgtcaaattaaatctgcagaatcctgcagttgtcgactatctgcttgactgtgtcaagatgtggattgaagagttcggcatagacggactgcgtctggatgtagcttattgcctggatcataatttcatgcgccgtctgcgcagcttctgtgaggaactgaaaccgggatttgcactgatcggtgaagttctcttcggtgactacaacctgatcgtaaatgatgagatgcttcacagctgtacaaactacgagtgctacaaaggaattttctccagcttcaactgtatgaacatgtttgagatcgcacattccctgaatcgccagttcggaccggagcagtggtgtatttatcgtggaaagcatttgatgacatttgtagataatcatgatgtcacacgtatcgcaagtatcctgacgaacaagaatcatcttccgcttgcttacggtcttctctttggtatgccgggtattccgtgtatctattatggaagtgaatggggcgaggaaggtgtgaaagcaccggataatgactatgcacttcgtccatgcttcgaagagccgaagccgaatgaactgactgatttcatcaaagaattgattgaagttcgcagaaacagtgatgctctttgcaatggttcttaccgaaatgttgtcattacaaatcatcagctgatctttgaacgccgtacagataatgaacgtgttctcgttgcgatcaacgccggtgattctgagtttactgccggaaatggagaactgcagggtaatttcacagaactgcttgcaaatgctgatgaaatagaaaatgtaactctgaacggacagctgacaatgccggcttacagtgtacagttcctgaaagctgtataagattttactgattaagtcattagaaaaaggatgagtggtaatgtatctcacatttaccattcatccttttctttttataacttcttcacaaaaagtgtacgcatcgcattgagtattgcaagtaccataactcccacatctgcaaagattgcgagccacatatttgcaattccaagtgctccgagaatcaggcacacgccctttactgcgagagcaaatacaatattctgatatacgactccgagacatttcttagaaattcggattgccttaacaatcttcagcggatcatcatccatcaggacaacatctgctgcctcaattgccgcatcggatcccattgcccccatcgcaataccgatatccgctcttccaagaaccggtgcatcgttaataccgtctccgacaaatgccagatttgccttcgccggcttctcagccagaagtctttctacctgctccaccttatctccaggaagcagttcgctgtgaacctcatcaataccaagatctgctgccacctggtctgccacctgtttcgcatctcccgtcaacatgattgtcttctgaattcctgcctgtttcagtttcgcgattgcttctttagaagtcggtttctcaacatccgaaatcacaatgtgtcctgcatattcgccatcaattgccatatgtatgattgttcctaccttatggcatgtcttatatggaataccaagacgatccatcagctttgtatttcctgctgcaacgctttttccatctactttcgctgtaattccatttccactaatctcttcaatctcgctaacacgcgaacgatccagttcttttccgtaagccctctgaatactcttgctgattggatgggacgaagcactctctgcaagtgccgcatactctaagagttgcttttcttccatctgattatgatgtactccgaccacttcaaaaattccctgtgtcaaagttcctgtcttatcaaaaacaacatattttgtcttggacagtgcctcgagataattggatcctttcaccagaattccttcatgacttgccccgccgattcctgcgaaaaagctaagtgggatgctgataaccagcgcgcacggacagctgattacaagaaatgtcagtgctctgtagatccagtcattccactgcggtgcagctcccattgcaaacattctcacaagtggtggaagcactgcaagtgcaagtgcgccatagcataccgccggtgtataatattttgcaaatttagaaataaagttctctgatcttgattttctggatgtagattcttctaccagttccagtaccttggataccgttgattctccgaactcttttgttgtacggatcttcaacacacctgtcagattgatacagccactgatgatttcatcccctgcttttgcttctcttggaatactttcaccggtcaatgcacttgtattcagtgtagcggttccctctacaaccacaccgtcgattggcactttttctcccggctgaacaatgatcactgttccgatttcaacttcatccggatccacctgctcaagctttccatcctgctctatgttcgcataatccggacggatatccatcaattcactgatatttctgcggctctttccaactgcatagctctggaaaagttcaccgatctgataaaacagcataacagcaaccgcttcattaaagtctccggacttctcataaaatgcaatcgcaatcgcaccgaccgtggcgactgccatcaggaaattctcatcaaatacctgacggtttaagattcccttccatgctttcttcaaaatatcgtaaccaacgatcagatatggaatcaaaaataatacaaatctgataattcctgttaccggaaggaaattcaatagaatcaggagcaccgccgcagcgatgatcctggtcagcatcttcttctgcttcttcgtcattcttctcaccctcttacaggtagatctcgcaatcgtcctctaccttcttacaattcttcagaacgtctttcataacgctctttgcatcctgtccctcttcaaactcaacgatcatcttctgtgtcatgaaattcactgttgcattctgaacacctgctgtgttctttgctgcatcctccatcttgttcgcacagtttgcacaatccacttcgatcttatacgtcttcttcatctttcttctcctttaatcttctttgatttttgatctttgactttcatcaaatttcttacatcttctcttatttttcattaaacaattaagcagttgtttaatctttatatttacattatagctctccaaatgaaaaagtcaatacattttgccatttttgtgttacaatacgtttatgattaaagagatactgaaggtattcttgaattgtaactgttcagagccaagcaaaatttcataaaacaggtgtaaaatgcttgcacgctatctgatttcgtccgaacttgaaaaagaatccctacgataaatctttatttttcggcaatttatagaggaaattccctcatcatttccacacaaaaagaacaatgtcatataaaatgttacatttttcacaaaagaaacctttctggtgtaaagtttttgtaaaacaagtgtcttgtcacctgtaaacgacagtgttataatgggcaagaataaatcaacagagcaatagacatgaaagtgtgttacagcagaattttatgtcaggagagaataagagaggtacgtgctatgacgatcagagaagagatagaacagttaaagaaagaaaaaaatgccgtaattctggcgcattattatgtaagaccggaagttcaggagattgcagattatgtaggagattctttctatttaagcaaagttgcggttggtctgaaagagaagacaatcgtattctgcggtgtttcattcatgggcgagagtgcaaagatcctgaatcctgagaaaacagtgcttatgccggatatggcagcagattgtccaatggcacatatggcatctgcggagacaatcgagaagattcgttcagagtatgatgatcttgcagttgtctgctacattaattcaacagcagaactgaaaagacattctgatgtctgtgtaacttcatccaatgcagtgaagattgtaaaagcacttccgaataaaaatattttctttataccggatcgtaaccttgcacattatattgcaggattggttccggaaaagaacttcatatataatgaaggcttctgtatcgtacacgaatacatggaggttgaagagattcaggaagcgaaagcagcacatccggaagcagaggttctttctcatccagaatgtccggcaaaagttttggaactttctgattttgttggaagtacttcagagattatcgagcaggcaggaaaatcagatgcgaaagaatttatcatttgtacagaaagtggtgttttgtatgaacttcagaagagaaatcctgagaagaaattttactttacagagacaactccaatctgcagaaatatgaagaaggttacacttgagaaagtgcttcatgtattaaagacaggcgagaatgaagtttttgtagacgataagcttcgtgaagaatctaagaaaccgttagagagaatgttagaactggtcaagtaaacagagggcagataggattgacagcaatcgaagatcaaagaaaaataatgagatcaaatcgacagtcgctgtcggaatggagatatttattatgaaaatggaagcagatgtagtcattgtcggaacaggtgtgggagggcttttcagcgcactgagtcttccgagagatcagaagattatcatgattacaaagtcagatttagagagcagtgattcattcctggctcagggaggaatctgcatgctgcatgacaaagatgactatgacagttattttgaagatacaatgaaagcgggacattatgagaacagaaaagaatctgtagatcttatgatccgcagctcaagagagatcattcatgacctgattggctatggtgtagatttccaaaaacaggaggcagatgagtctggaaatgaagccgcagacaacggtggtgaaaaggcagagattcaggatatttatgcatttactcgtgagggagcacattcacgtccgagaattctgtttcatgcagatattacaggaaaagaaatcacaagtaaactgcttgcacaggtaaagcagctttctaatgtaacattgcttgaatatacaacgatgtcagatatcattgtggaaaatgatgaatgtagaggaatcattgcacaggataaagatggaaatgaattcgaaatccatgcagagaatacaatctgggcaagcggtggaatcggtggacgctataagcattccacaaatttcccacatctgacaggagatgcacttactatttccgaaaaacacggaattcgtttagagcatttagattatgtacagatccatccaacaacattgtattccaagaaaccaggaagacgctttcttatttcagagtctgtccgtggagaaggtgcggttcttcttaacagcaagaaagaacgtttcgtaaatgaactccttccaagagatgttgtgactaaggcaatcagagaagagatggaaaaggaaggcacagatcatgtctggctgtccatggaaaaacttggaaaagaaaccatcatgggtcatttcccgaacatttatcaacattgtctggaagagggatatgatgtgacaaaagaatgtatcccggttgttccggcacagcattatttcatgggtggtgtctgggtagattcagacagtaaaacatccatggaacatttatatgcagtaggagagacaagttgtaacggtgtacatggtgcgaaccgtctggcaagtaattcacttctggaaagccttgtatttgccaaacgtgcggcaaataaaatctcaggtacagagaatgaagtaaaagtacgtgaattggcataataatagtgatataatattaatctatgctgaaaaaataaaagttaagagaagagtagagaaagaatatagagacagggacaggagatataaagatgaacgaaattacaatgacacttcaggcagatcatttgatccttgaagcactcaaagaagatatttcaagcgaagacgtaacaacaaattcagttatgaaagattatgtaaaaggtgaagtagaactgatctgtaaacaggacggagtaattgccggactggaagtttaccgcagagtatttgaactgttagatgcagacacaaagacagaactttactgcaaagacggagacgaagtaaagaacggtcagttgatgggaaaagtaacaggagatatccgtgtacttctttccggtgagcgtgtagcactgaactaccttcagagaatgagcggaatcgcaacttatacacattccgttgcaggacttcttgaaggaagcaaaacaaaacttcttgatacaagaaaaacaacacctaatatgagaatcttcgagaaatatgcagttcgtgttggtggcggttataaccacagatataatctttctgatggagtacttctgaaagacaatcacatcggagctgcaggaagcgtaaagaaagcggtcgagatggcaaaagactacgcaccatttgtaagaaagatcgaagtagaagttgagaatcttgagatggtaaaagaagcagtagaagccggagcagatatcatcatgcttgataacatgtcaacagaagagatgcaggaagcaatcaagatcattgacggaagagcggaaaacctgctaacaaaagtcaaggctttttagcaggtttttaaataaatttttgtataaattttttctacgacaattagaccggtggaaaatccggtctgtcgtgtcccctattctagttctttttacttctgatatacttccatcacacgtgcataataaatcctaaggaatttatttagtcctgctatttttgcggcacgttttgattttccttctttttctttcttcaaaataaatctatatactgccgcatcttccggttctttatgggtttttaggcatctcatcacttcatatccaatcttacgcaggctggaagatcctcttttagatatttttctctccgttccagtaaactgccctgattgatatggcggcgcatcgattcctgcatgggctatcaaggcttttccactatgaaatctccttacatctccaatctctgcgatcaatttaggcgcaagaacatttccaacgcctcccattgccctgacaactgggtattccggcagactcttggataatgcctgcatctgtgttagaatagtcattaaagtgttatcgatttctcgtaacacccgtactgcctcctgtaccagcattttggtcgatgaggtatcggaggatactgtggggatgccttcttttgccagcatataaatcttagcagctttatcctggctctgatggtatcccttctcttttgcccattttagatagctttctataaactgttcctccgatttctttgtaatattgtcataatgccaatattcttccacaaaatcccccagcttatctttcccatttgtttcattccaccctttcagtagcgttttaatccctggcatcgtatagtccaaaagatgagtcagttccaacacactttccactcgcatccgcatataatggcggtactgtcgacctaaaagctttagttctgcgtaaatgctttcttccggttcatattctttcagtcgataccaatgatcaattccatagttagagattgtaacggcatcttgtttatctgttttcacacgcctcaatccctgacaacggtattccttcatttcaaatggattgaccactgccacaaacaaccctttctcttgcaaatagcataataccggcagatggtagattccagtagcttccattactacacgaacatcatcatttaaacgcagaagcatagacgttaattctgataattctttctctgtatgacaaacttcaaaaggtttgctcacaatctccccatacggcttcaagatgcatatggtacttttttcttttgatacatcaattcctacacttatcatctgtaacctcctaaaaaaatctgtaattgtcccatccacacttattaccactcattttagttcgttacacgaaagcaccttgcgggtttcaacctgcttaaacgaccgcttataataaggggtggttgacggtttttatgacggatgttgttaatccaaaaagcagctcgccagaccaattactcccttatcataaaaaaataagtgcagaagataaagcactaatggtatactttatctcttacacttatatggtactaaaacaaaaatttatttaaaaacctgctaaaaagccttgacttttgttagcaggttttcatgaatacaaagaacgttactggaattccaatccccattgaaaccactggaatccaccatgcgacgattccatgtcccggctgaacccaatatacactggaatagtcaatatgatttgtaatggtacagataacgtgcagaatcagctgtacaaaaaacggaaaaatcaatacgacaattttataatctgacaaaaaacttacagacaaacaaacacaagcccaaattcctgccatcaaaaattgaagtaccaaaaaaaacgttgtatatatcataggatgcgtaaagaaaatcttataaaacagcatcaacggtgtaagtatattatctcccattgttgaaagcggtgctaagtttggcagaagaaccagactgcacattaaattaaaaatcaatggaacaagaactgcaattcccccgctcagaaaagcagcagcatattttgctttgagataatcttctctctttgttctcatataaatattttttattacgccttctttgcagtcctcaaaataagaagttccaaatggaaggcttgcaaggataggtagaattaagaagaatataaacccttccaaatttgacggacttccggccatccatatttctgctgcactatgtggcgacagaattgggaattcgttatagaaattcgtcagattagctcgatatgcggggattatttcccggattacatgtgcaattccaagcacagttcctatcagcatggataataccatcccctttccgctcattgcccgtttcatctctgtcttaaaaatctgtttcatgcttttccctctttcttaaattatattttcaaagggaagagaaaggggatgctattttgttggaaagaccacctttacgtcatcaattcagtacaatatagcgccggatatcgtaatctggattatcaatgacagctccggtcggattaatttccaaatacattgcttctgagtctaacaatgcatcatttacaacaaaaatcatcggcattactttttcttcctctggtgcaaaagtttcagcataataattatgattcaatattcgcggtttttcctcccccaaataagttacttcgcctatatagtcactgtactttgattgtgccgaaagaaacctcaggcgtatatatccccagataagatcgttttctatcgttttactactttgattttttacagaaagattgactacaacgtaagaaaaatcatttgtaatatttccttgttcatctaacactgctcccggataatctgcaagatttttcccttccggaagtgcataccccggatactcctttccttttgtccatgataaaactgtgaaactataatatgtgctttttatcgcgtttcctgttgaaactatatttttttcatcgactccgagtttgtttgcaaattctttagatacttcatctggctcctcttcttgggctaccacatcaagactttttttaaattcattttctttttctatattctctttacttatgctacctgttccgctttgtaagaaattaacagatagtaacacgaatataatgacaaaagaaacacccgcacaagttattattttcttcttcacaaatatctccttccgtcattcattcccaacataaacaactcctgtatgacacatgttttcagttatttcataacatcctcctgttccattcagattcaaatataaattcttaatatctttttcattaacaatccatgccatattgacttgaacactctcaccaggctttaacgatggaatataattcttcccttcaccatagtcatcttgtacgctggaataagtcatttcagctgttttggcaacactgtcacttatataataatcatagtcctcaccagcttctgtaccaggcatgtaaatagtatacgtgccatcattctgtttcgaaagagcaatcagcgtgcctatatagagcatatgattgagttcttcctctgatatatttgtgtatgtgacagtcaaaaacagtaatttctgatccatgttttcttctcttacaactgaatccagattatttacaccatcacctttttttatatatgataaatgattctgtaccagttttccgtttgcatcaactgccgtcttccaggctttcggaattttatcactgtctaaaagctgtaaattatctgcgatctgtactttatctacacaagctgtcaccttatctgtagtaatgttatttccgttattatcttcagcataagaatctaaattaaaagcttctccaatttgacgaaccgacagctgaccatttgttacatctattttatctgcatagactgtcggttcaataatatcactccaggcagtcatgtcagcagttttgatcatttcatcctcttccgtaatcacaagattttcagcaaatttatatgcttcttcttttgaaattgtatttccaatatagagtctcaaaacacgatattcttccggacacagaagataaattctttgatcaaacgagttttctccatttattgtattgtatttgagataaattccatcataggatccgaaaacatgattttcactttctataacatttctatccaacaatgatttatccaaactcttctcatccatcaaaacagtatcaacggttatccctgctgtatcaagtgtatctttatagcctaacttatacccttcggcgatccactccattccttctggaatatagtttgatgtaacagagatttcatgaatctcttctggaagttttacgtcttcagaattctcatctgattttatggtggttaaagtaccgtagtttccctgtttttcaaggtacatatgataaagctttgttcctgcataagcaacggttgatgttgcaataatgcacacagctgccgcagccgctaccctgcttatacttcggtttaacttgctttttctctgcattggtgtaatgtttgatgaatttacttgtttttctacttcttcctgaatcatatcgtgaataaagtccggaatatctggaaagtcgttttttaattcgtctaatctcatataaaaatctcctccaattgaatcttctttttcagcgttttcctcgcccttacaagtctcttttgtacagcgccttcggatatctcaaggatctgagcaatctctcttatattgaactcctccatataataaaggatcaccggaatccgcagttcttctttcagttcgtttacagctctatacaattcactgtaatctcgattctccttaggttgcttcatattttctgcatatccttcctccaaaggttcattgacgttgatgcgccttgcaatgttatagcattcattgattaatatccgcatcaaccaggtctttgcatagcgatctttttttaatgtatctattttagaaaatgctttcacaatcgattcttgtattgcatcagcacaatcctggtcatctgacaaaattgtttttgctgttgcatacaactgtcgctctgatgaaagaatcaattctccaagtgcctccttcgtcaatttggtaccccctttttgccagccagcttttatttacatagattagacggatttaaaatgaaaatatccccttaattttcaaaaataattgttttttgtttcaagcgagttctaacatttttgcagttttcttatattatctcatagattaactcattcatataaaagaaacatcagcaaatcattcattgatctactgattattgggacatttacttttgcttatatcattaattctactttaaacctattgaattcgatatgtttaaaattcagaaagcattttttataacatttgatttcttttattaattatgctaaaatttttatataattatcatatttatgaagggaggcattatattggcttcaacaattcgagatgttgccgctcgtgccggactttctgtcggtacagtttctaaatacattaatggcaaaactgtaaaagaaaatactcgtttagctatagaagaagcaatcaaagaacttgattttcatccaaacaatatcgcaaaaggactacgcaatgcaaaatctttctctgttgctattttgttgccaatgttagattctacattttgtacttctatgatttcatcaatcgaatcaacattattacctttaggatatagtgttattgtgtgcgaatgccacaacaatgcagaaatggaattgcgaaaaactcagtatctaattgatcgtatggttgatggaatcgttctgattccgtacgcctccgatggtaaacaaattgaaatgattcagaaaagtaatattccattgattctacttgaccaggaaatccaagatcatgcaacagattgcatcgttcttgataatgaactggcgggatatgaatctactcaacgtttaattgatttgggacataaagatattgctattatcaccggaagtccgaatcattatactagtaatggacgtctaaatggatataaaaaagcgatgacaaacgctggtttaacaattacagatgattatattcaatgcggagattactgtatagacggtggttatgaagctatgatgcgtttgtgcaaactccaaaaaagaccaacagccatattcatcagtaactatgatatgactattggtgcttatcttgcaattaactatttacgattaaaaataccagatgatatctcggttattggatttgacaactttccacttgcaaatgtagtaaatccaccactgtcttttgctgaacagcctactaatgtcatgggcacagaggctggaaaacttctttacagacgtatttgtggtgactactctgattatccaaaaacgataatgcacaaaccaaccatgcattataaggaaagcatccgtcaattaacatgattaaatccattcacaggagtgcagatctatgatttgctgctcctgtttttttaattctatttttttcgctaacttcttatttccataaaaaatatttataaactgatctacagaagaacaaagtgaaatcgaaattggttttttatttttccatgcgatatccacctcaactccacctacagccagaagaccttttacttttccgctttcccaactctctggtaatgctggaagaatagtaatttttccatcttcactactcaaaagcatttcagcaacagcacttgcacttccaaaattaccgtcgatctggaatacttcccgttctccttccgtttcacctaatggcggatgaaggtcaaaaaggttgttataaactgattgccgtaacaactcttcatagtagtaattagctttcgttccatcacctaatcttgcccacaagttaatgagccatgcacaactccatcctatttgctgtttatagtttgcaaccttttcttcaatgaacttctgacatgcttttactaattcagtatctgttttctttattgagtgtcccggatggaatccaaataccggagagaaatgtcgatgtccaacatcaaattcttcaaaatctttaatccattcctgaatctttcctgttcttccaatctgataatttggtaataacttactgcgctcattcacttgttcgatcaaatcctctttgattccaagaacattacatgcttccaaatagttagcaaataattcttttataattgctaaatccattgttgtcatgtaactcacgccacaagcatgtccttccccatctttaaatgtattttctggtgaggtagaaggtgctgtataataaaggccatcttctctttgttgtaaccaatcaagacaaaacaaaacagatcctctcaatgatggatatattttatttttcaagtactccaaatctcttgaatatctatagtattcataactttgtgagcacaaccatacaccgcccatcggccagtacgcatatttaggttcgccatctactggaccagtctgtctccatatatcaacattatgatttgctgtccaacctgaacaatgacactgtttctttgctgtttcttctccggcatgacttaattcttcgacgaaatctacaaatgctgtaaagctttcaattagattacatggcccgttaagccaatagttcatttcggtattaatattgattgtccagttactgctccatacaggtcttatactttcactccaaataccttgtaaatttgccggttgggttccttttcgtgaacatgctatcatcagataacgattataatggaaaaacagacatgacaaccccaaatcctgttttccattctgaacacgtttcaaacgttcatctgttggtaaatcattttctatttcttctaattcaagtgatacatttttataaacagattgataatctgctatatgttcttcctcaagttctttatatgtttttgaattcaacttctgaatctgattaccgcagctcttttcacacacttctggattcgtttcaatcctttgattgtatttcttatatccatccgctgctgtcaagtaaaacactacttcttcagcttcttgaattttcaaaccgtctaaatctgcactaaccgttccacctttatgagtaacctgcaaataacaacaaaatgccattcctggattcttctcatcatatacaatcggattttcgcaagcaacataattaggttgtacattagacggtgcatttccgcttacatacaaacagcaatccttttctgtcttgattgtatgctgcacttcgctatcaagcttcactttcaaatccaatttgtccattccgttggctgtaatcttaattacaagtgcttttgccggatttgatataaacatcttagagatatattctgtttcatgatttttgaattttgaagtaaatatagcattttctaggtcaaggaatcgcacatattcttttggttcatcgaccttttcaaacacataactgagaattcctaaaggcatataagattcattataaaatccgagcatattcttcttcatatactcttctgcttcccaaaatttttcttcaaagattaattttcttgcctgctcaagtgtacttgaatcaatctctttttcttctctatgtcctgttcctgaccaaaatgtgtcataatttaaagtgattttttcctccggaacgcctccataaaccattgctccaagagatccatttcctagtggtagtgcttctgtaaatgattttgccggtgaaatatattttaatgttttattcatagcattaaacctttcatgtctattcttttaccgcacctgaagtaattccatttacaataaatttctgtgcgaaagtaaatatcaagatacttggaatagatatcaatacaagagctgcattatatcgtcccaaattttgcggagtcattccataagctcccttaaatgcattcactgcaaccgttgttgtatatgccttgtctttcgtaaggaacatcaatgggaaaaggaaatcctggaaagaccacataatctgcaatacagcaaggttaatgatcgctggttttgccaatggtaaataaatactgaaaaagcaacgctggatagacgcaccatcaacatttgctgattccatcaactcagtcggaagtccatcgaagaagtttttcatcatgagtactccaaacggaattgtaatcaaacactccgaaagaataattgctaaatgtgtattatacaaatgtgcagtcttataaatatagaagaacggtataatcaaaatcggtcctgaaattgcaagacacattaaaaccagattataaatcacttttcttcccgcaaattcaattttagaaaatgcaaatcctgaaaatgaacagatcagaaccagtaatgcagatgcaaatacagcattgataatggaattcacaaagtactggtaaaatggaacaccatttacttcatttgtaagaacataccagtagttctctattccatgtacctttaaagagtctttcaacaaagaataaataggcacacaccacaaagctaacattatgataaggaagacgatcattactcttctgttcgcttttgaaattgcaaataaatcttgttcgagttcatagtctttttcttttttctttctcatatccaacacctacccattctttgatgtcatctttaactgaataaatgaaataataaatgcaacaattaatacaataatcgcagctgcacaaacgagccctatatttgatcccgctgatcgtgtagcacgataaatataggttccgataatctcagtgcttccgcctggacctccatctgtcatcaaataaacacgttccatttctctaaatccaccaagaagcatggaaagaataattgttttatgtgtatttttcaaaacagggaaaataatcaataataactgatctttcatacctgcaccatcaattgtagctgcttccaaaatacttctgctgattgttgtcaaatcagctgtgtaatacataatcggaatacctatcataaaaatagatacggaacatacagctcccattgctagttttggatctgcaagccatctctgcgcaagtgcaccaagtccaactcctcttaaaatctgattcacaataccattcttatactcgagcattgatccaaaaactgttgccatcaatgcaatcggaagcattgacggaataaaaaacaatgcatggaaaaatctttttcctttaattttgaaattcagtatgattgatataataaatccaaaagttaaaccacaaaaaatgttagccgttgataaaataaaagtatttaaaagtgatatccaaaaacttttatctttgaatattgtttgataattcgctaagccgacaaattcggatctgcgaaatgttatcgttacatctctaaaactatttaaaattagaaaataaaaactatatcctaataatcctatgaaaataacaatcaatggaagaagaaataaaaatcccgccttgttatttcttttcgtcaccttcaattttgtttttttacttgtcatgtttatatcctcaattcctgtagaaaaagggacgatcaactgctttacttgtttttcataacagtcatgcagctgaaagtcccctttttatattagcatcagattctcaattgtcttactgattaatattttccacttgtccattctttctgaagatctttcaatgcactctctgtagttgcagatccgttaagtacactctgtactgcagcaccttcgatatcagaatatcctgaaacgttatttctgtcagctgtagctgtattaatcaaatcaacaactgtatcccatccagccttggattcatctgtatcaaataaagaagcatctactgtaaaatcctttttagcggaagttcctgtaagctgttttccaaagatgtcagctccatctcctaatgtaaggtaagcaacaaacttagctgcagcttctttcttctctgaataatcaactacaccgattccggagtcgatataggaacgtactgtaagctgtccattatcctctgctgtcggaagagccattgctccaacattttcaagtttgattccatttccttctcttaatgtcttagataataatggtgcttcccatgaacccatatagtaaacaagagcatcaccatttgtaaattcctctgttgcacttgcataatccaggtcaagaacgtctgctgagaagattccttcatcaaaatatttctttaatccgttgattgcctgtttatattcttcactgtcaacaggagcaccttcatatctccacttattataataatctccctgctggccaagaactgtcagcatcatctcgtctacaacccaagagtcttttccggcaaatacacttacatatttgtcaggatatttagctttaaatgcttctgccactgctttgtactctgcaaatgtctttggaacttctgctccgatatcctttaacagagctgcattataaaatcctaccatcgaaccagaatttgtaagcacaagcatctttgtgtctccacttgtcagctgatttccctgctcaagacatttttctgaataagcatctttccaatctgcaccaacaacatctggcattaattcatccagatttgctagataatcctgaacttcttctgcaaatgctgatggctgaactccaataacatcaatatcttcctctgtacttaatgcaagcgggactttctcctggaaagctttgctttccattactgtcatatttatcttaatattaggattctctttttcaaacgcatcaactgtttcttgaatctgatctttacttgggaaccatgtccaataatttaatgtgatctgctcactatctgaaccactttctttcttctctcctgtagatccacatcctgcaagcataccaactgtcattgctgtagctaccgtcatagctaatattttttttgctttcatatacatcctcctgttattaaatggtttctgttttccaaaagtgaaccggttcatttttttgttaaataacaactgttaaattaataatatatttatatatttgttttgtcaatcactttttgtttattttgtcgtgttatacaattttcatttccttttttagtgcaatttgcacagttttaaccgtaaagaattcttaaaaaacgcactaataacatttatctttcttgtcataaatgcctccttcctaataaataaaccggtttatttatttcaaatataacaaatagaatttctgctaatcaaatcattgaaccgcttccaaatcctcccctaaataacactttctcaatataaagtcaaaaaaatctcccctcacaccgaatgaaatctaattgattccatcagatatgaggggagattctatttttctaattcacttgtcagtgtacttccaaagaagcttctatgtataatctactaacaactataattaagcgttcttcttggcaattgctgcctgtgctgctgcaagacgagcaatcggtacacggaatggtgagcaggatacatagtcaagtccgatgctgtcgcagaactctacagagcttggatctccaccgtgctctccacagatacctacatgcaggtttggattaaccggttttccgagttcgatagccatcttcatgagcttgccaacaccaacctgatccagttttgcaaatggatcgttctcgaagatcttagcatcatagtaagcatcgaggaacttaccagcgtcatcacgggagaatccgtatgtcatctgtgtaaggtcgtttgttccgaagcagaagaagtcagcttcttttgcgatatcgtcagctgtaagagcagctcttgggatctcgatcattgtaccaacctcgtactcaaggtcgcttccagctgctgcgatctcagcgtcagctgtctctacaacgaatttcttaacgtatttgagctctttgatatctccaacgagtgggatcataatctcaggttttacgttccaatccggatgagctttctttacattgattgctgcacggataacagcgcttgtctgcatcttagcaatctctgggtatgtaactgcaagacggcatccacggtgtcccatcattgggttgaactcgtgcaggctgtcgataatagctttgatctggtcaactgttttgccctgagcatcagccagtttcttgatgtcctcttcctctgtaggaacgaactcatgaagcggtggatcaaggaaacgaattgtaaccgggttaccttcaagagcttcgtaaagtttctcgaagtctccctgctgctctggaagaatcttagcaagtgctgcttctctttcttctactgtctctgcacagatcatctcacggaatgcgtcgattctgttgccttcgaagaacatatgctctgtacggcaaagtccgataccttctgcaccaagctcacgagctttcttagcgtcagccggtgtatcagcgtttgtacgaaccttcatagttctgtacttgtcagcccatcccatgattcttccgaactcaccagcgattgtagcgtctacagtcgggatgattccgtcatagatagcacctgtggatccatcaagtgagattgcatctccctcgtggaattcttttccaccaagtgtaaatttcttattagcttcgtccattgtgatgtcaccacaaccagatacgcagcatgttcccattccacgagcaactacagctgcgtgagatgtcataccaccacgaactgtcaggataccctgagcagacttcatacctgtgatatcttctggtgatgtctcaagacgaacaaggataactttctctcctcttgcagcccactctacagcgtcatcagctgtgaatacgatcttaccacaagcagctcctggtgatgctccaagtgcttttgccattggtgtagcagctttcagagctttcgcatcgaactgtgggtgaagcagggaatcaaggttacgagggtcgatcattgcaacagcctcttcctctgttctcattccttcatctacaaggtcgcaggcaatcttaagagctgcctgagctgttctcttaccattacgtgtctgaagcatgtacagtttaccgtgctctacagtgaattccatgtcctgcatatctctgtagtgagtctccagagtcttgcatacatctttgaactgtgcgaatgcttctgggaacttctgctccatctcggaaatgtgcataggtgtacgaacaccggcaacaacgtcctctccctgagcgtttgtcaggaactctccgaacagaccgttctctcctgtagctgggtcacgtgtaaatgcaacacctgtaccacagtcatctcccatgttaccgaatgccatcatctgtacgttaacagctgttccccatgaataagggatgtcattgtcacggcggtatacgttagctctcgggttatcccatgaacggaatacagccttaacagcttccataagctgtaccttaggatctgtagggaagtcctcaccgatcttctctttgtactcagccttgaactgctcagcaagtttcttaagatcatcagcatcaagatctacatcctgtttaacacctttctcttctttcatcttgtcgatcagttcttcgaagtatttcttaccaacttccataactacatcagagaacatctggatgaatcttctgtagcagtcccaagcccaacgtgggttgcctgaagcttttgccagtgtctcaacaacctcttcgttaagtccaaggttaagaattgtatccatcataccaggcatagaagctctagctcctgaacgtacggaaacgagaagcgggttctctttatctccgaatttcttacctgtaattccttccatcttatcgatagcttccatgatctgagccataatctcatcgttgatctgtctgccatcctcatagtactgtgtacaagcctctgttgttactgtgaatccctgtggtacaggaagacccagatttgtcatctctgccaggtttgcgccttttccaccgagaaggtttctcatatctgcgttaccttcagtgaacatataaacccattttgccatgatcaatgacctcctaaaataatttttacaaataaaataattttatttcgcatataatattttaatggttttatacttatgagtcaagtcttttgtccgtaattatatacaatttttacaaatgctttttgtatacttttcatattggttaacctatctttcacaaattgtaaacacattgtccatcaggctgtcattttgcatatttgcattaatctccatgcaatgtacaacatgcacaaaaaaaaatagttgtccatgctttataagaacttggaaacaactatttttttgtgattaatatacaatttacacatatcattgctatggtgtttccaccaccaacatcatgcaattttcctcaaaatcaacaagtacgtaatctttatctcatttcttcaacaaatgccttatatcccttataagcttcatacacatctgccttgcttgtcacttcccacggcgcatgcatactcaacactgcgacaccgctgtcgatgacttccatgccataatttgccataatgtaagcaattgttccaccaccgccggcatctacttttccaagttctgcgaactggtatgcaacactctgcgcatccattgcatttctgatctttgcaagatattctgcatttgcgtcattagaaccgctctttccgcgagcacctgtaaacttgttgaatacaagtccttttccaaagaatgcagacaagcattttacacctgttttatgaaattttgcttggctctgaacagttacaaattaaaatctaaggaaaattttaaaaggaaacaagggggaaaagtaaatgggaatactttataatgtacctgacttaaaaacctggggaattatgttctttatcctcgtagtcctgatcgcactgaatgaattaggacgtgaaacaaaatggggtggaatcttactgtttgtgattgttccggttgtgctgacaatctttgtatggccgacaacctgtgcgccgggaaatgagtacggaaccggaaactggttcaactgggcaaagacttactctgcacttgcaggctgtgttggtttcatgctaatgcgttatattccgaatgcgacaaagcataaatgggtaatctgcttcccgccactgattcttgcaatcaatatttgtgaggcagttttccgtgatttcgaggcatacagcttccatgcatttgcaggcgagaaggtaaacaatctctgggttatgtcaggaccgtggaatatcatgaatggaatcgcaggtattttaaatatcctgctgatctgcggatggacaggtatctacatttctaaagagaagagtaaagatatgatgtggccggatatggactggatctatatcctcggatatgacctctggaactttgcatatacatataactgtatttcagaccattctgtatactgtggtgtgattctgctgttatcctgtactatccctgcattctttatcaagaagggatgctggttacagcacagagcacacacactggcactttggattatgtttatcatgacagttccacagtttgcagacagactggcgcctgttccgacaacacataatccgaaagcattctttgctgtaagctttctttctttagttgtgaatgcggcggcagttatttaccagttcagcgtgatccgcaagaataagttgaatccatttaaggatgaaatttatacagacaaagcattttacaagaaaataaatgcagagaataaataaattgataataaaaaatccaaacaaggattttttgcggccaaaaacagaaagtatttatcaaaataaaaatatcctgaacaagttgcagagccagaaagccttgtaactgtcaggatatttttgtttggtgctgtcagctttaaaaaacgttatttaccgacagccccttctttatgtgagatacataacttactggaaaatgtcttgaaaaaataagaaaaatatttaaattatagcgtatttgcagattttggctacttttcatctggatttggcaagaaatgcacctccttttcgcctataatgcaattgtaaacgaaaaggaggtgtttagagatgatgaagagaattaaaagatggctacatgagatttatgaagaagatattaagttctttggacagatgaacggaatgtactttagataagcaatagaaaaagaaaataaaagaaaaaaggagaaagaaaattatgagaaaattagcaaaatggtttgaagaatcacttgaaagttatgtaaaattaatgggtaatacttatggatggggcggaagattgtaagccatggaatatacacaaaaatcaaatcaaataaacaataaaaaataagggtagatgtcttgagagaagatatctactcttatttttttatatatagcaattcttcacaaatgtgattctatccgtaaatgattgttttattttctcaaaaagtatatacttgtttcatatacatttacgttattttgagaaaggagcaccttttaaatggactctatattatacgaaaactatctgaatattcttaaacaggaactggtacctgcacttggatgtacagaaccgattgcaattgcctatacagcggcaaaagcacgtcagattcttggagaatttccagattctgtagaaatggaactcagtggaaatattatcaagaatgttaagggcgttacagttccgaattccggaggaatgaaaggaatggaagtggcagcagttcttggtatcgtagggggaaatgcggataaggcactggaagtgttgagtgaagtgacttgtgaagatattgcgaaaacgaaagaactgatcaatcagaaaatctgttcctgttctttagttgaaggagttgataacctctatattacagctaaagtaagaaaaggagagcattttgcttctgtaacaatcgaacatcagcacacgaatattacaagaattgaaaaggatggtgaagtgctgttggataatccttataaatcagaggttaagactaccgtagataaatcaaaacttacggttaaagatatccttgattttgcggatcaggttcgtatggaagatgtgcagccgatcattgatcgacagattaaactgaattctgcgattgctcaggaaggacttgataataactatggagcgcagattggtaaaacactgatgcatgtatggggaaagagtgttactacgagagcctgtgcaagggcagcagccggaagtgatgcgcgtatgggcggatgttctatgccggttgttatcaattcaggaagtggtaatcaaggcatgacggtgtcgcttccggttattgtgtttgcagatgaatgggaagtatctcatgagaagctttgccgttctcttgttgtcagcaatctgattgcgatccatcagaaatattatattggaagtctttcggcgtactgtggtgcagtcagtgctgcctgtggcgccggcgcagggattacctatatgtatggtggaacctatcaacaggtttccctgacaatcattaatacacttggaaatatcggaggaatcgtttgcgatggagcgaaaccatcctgtgcagcgaagatagcgacatctgttgatgctgcgcttatggcttttcagcttagtattcagaacaaaagtttcctgccgggagaaggtatcatcaaagatgatattgaagaaacaattaagagcatgggttacattggaagagttggtatgcgtgccacggatacagaaattctgaatgtaatgatagaccgtgcagacattaacgaggagtgctagaaatgaagaattttatctatgaaacaccaacaaaagtatactttggaaaagacgaggaattaaaggtcggtaagattattgcaggatttcatccaaagaaagttctggtacatttcggtggaaattcagcaagaaagagtggactgcttgataaggtggagaattgtctgagggaagaaaacatcagttttgtagagcttggcggagtagttgcgaatccggaacttccgcttgtaagagaagggattgagcttggcaaaaaagaaggcgtagactttgttcttgcagtaggaggtggatccgttctggattcatctaaggcgattgcaaatggactggcgaatccggaagtggatgtctgggattttcattgtggtaaagctgttccacagaagacacttccgaagggagcgatcctgacattggcagcagccggttccgagatgagttcttcctgtgtgatcagtaatccggaaacaggagagaaacgtggctgtaacggactctttaaccgtatgaactttgcaattgaggatccggttcttacttatacagtaagtccttatcagacagcatgcggagcagtagatattgcaatgcatacgattgaaagatatttctgtccgggggaggatacctatctgacagattcgattgcagaggctgtgattaagagtgtacgaaaagctgcaggagattgtctgaagaatccggaagattatactgcacgagcaaatatgatgtgggcatcttcacttgcacataatggactcacacagtgtggaagagagttccagctcgttgttcatcagttagagcatgaagtatccggaatgtacccggaagtagcgcatggagcaggacttgcagcgctgtggtgcagttgggcaagatatgtttataaagcaaatataaatcgctggctgcagtatgcatctaacgtatggggactggatattgattttgaacatccggagaagacaattgaaactgcaattgatatgcaggagcagtattatgcatcgatagggatgccaatcggattaaaagaacttggtgtaaaagaagatgatcttgcgaaattggcacttgactgctcaaggaacaaaacccgttcattgattggatataagccattggcatatgaggatattctggtaatttatcagatggcatatgagagaggttaataacagttaatatcgaaagcgttgcttaatgcggctgctttcgatattctcttggtgacatatggtatcgttcctggaatacgcggttgaatgttctctgactgtcgaatcctgcccggatgcagatgtcgagaatcgtatggtcgctgtgaagcaggagactacaggcgtaatccaatcttgcttcattcagataccggttaaaattcgtatgaaatgtgccggagaagacacgtgataaagaggactgactgattccaaggtcatgagccattttggaaagcgtcagttcttctgtataatgtgcagcaatataagaaacagtctggtagataatgtcattacttcccacactgctcttatctatcatttcaaataagggaagagtgcgtgcaagtataatctgaataaatgcctgatgcagaacatgcccttgtgaagcggctggatagaccagcatgcttcgcagggcataatttacgtctgggtgtacttcttgagccagaattaccggatttacaggacaaaattgctgtaattctttcgtataactaggagcaagaagcggtgaagcaagtgcataaatcgccttacaggattcactgttgaatacctgatagtggtggatcaattccggaaatacaagtgcaaaatcgcctttttccatatgatacaattcagttccgactccgatttccagtgtaccttctgtcacggatacaagttccattgatttgtgaagatgtgggggaatatggcaagaaatctgttcagcgatttccagtgtttcttcattttcttcgtaaatcggtttcattttttcctgcctccgggttaattgtttagaatagttgatctaatagtatcatcatgcgtgtatatgacatgcttcacaggcagatggtgttgttgcgcatccgcttagtgctgtctcacgcagttcaaccggaagtcgctttccgactttgtacattgcttcgagcatttcatcaaaaggaatgagctgagaaatgccggcaagggacatttcagctgcaatcagtgcattggcaaccccggctgcattacggttctggcaagggtattctaccagacctccgaccggatcacagacgagtccaagcatgttcataaggactgttgaggcggcatccagacattgcttaggagttccacccataagttcaacagcggcagacgctgccatagccgatgcaacaccgacctcagcctgacaccctccgacagcaccggcaacagtggcatttcgcatggcgaggtaaccgacagcgcccgcattgaagagaacctgctgaatctttttgtcggagaaatggtatacttcctgaaaagcgagaagcaatcccggaacgatgcctgcggaaccggcggtaggtgaagcaacgatcagtcccatggacgcatttgtctcaagggttgccatagcataagtgatagctttctcaagcagttcaccgcacagtccctgaccactggcagaatgctgggcaagtttttgcgcctctccgccgatcagcccgcccatggaacggattggtttttcaatcggagagcgggcagcttctttcatgatttcaagaacacgcgccattttttgatccacttctttagcaggacattctccggttatgatctctcgattacgcataacttcagagatagaaatattctgttccttacatagtgtaaggagttcgtttgcatttttaaaatccatataaaaaacctccttgaacacaatcacatctgtacgaccataacatccagaacatgttcgttctggcggatggtgtcggcaatttcttccggaagttttccgtcggattctacaatcgtgtaagcagtgtgtcctttcgattcacgaaacagacgcataaaagcaatattgacccggcggtcgctgagacagctggtgatccaggcaacaacacccggaacatccttctggacaacaatgatagcactgtattcaccggtgaaatctacttctacatgattgatctgtgtgatgtggactttaccgccgccaagagattctccacggatcgtcatctcctgaccggcagtattggtcataataatatcgacggtattcggatgaatatcagtttcttcctcattcggagtaaaagagtatttcagtccgttttctgtagcaatctcgaaggaattccggattcgcatatcatcagtggaaaatcccatgattcctccaagaagtgcgcggtcagtaccgtgtccgtgatacgttctggcgaaagagccgtagagaataaattctacttttgcaagcggtccgttgatcatcttctgtgcaagataagcaatgcgtgccgcaccggcagtgtgagaactggaaggaccgatcatattcggccccataacatcaaaaacgctgataaaagacattttaaatagcctcctgagtttgtatatatgagtttagtatagcaagtgcggcggtggatgtaaactatgagaaacacgatccgcgtaaatgctgttaggggcagttactgcaaaccgtaactgcccctaagtatgatacttatgcgaattagttctgatcaagtacggactggatctgcttcatcagctgatcgtagtttgactgatcatcgatgccacccatgaatggctcgccaacaatatttccgtctttatctacaagaactgttgtagggaatgccatgatgtttccggcatattttccaactgttgaattagaatcgaaagtcaggttcttgtaagaagcgccctgtgctttcagaatttcttttgcttctttgattcctgcttcattgttgtctaaagtgtcagtgttgatacctacaacttcaccgcccatttctttgagcttctcatttaattcattcagtttggaaagctctccgacgcacggcttgcatccactgaaccagaagtttacaactgtaactttgtttttagcaaaaaggctgtcgtctacatcattgccgtccagatcttttcctttgaaaccttggaatacacctgtggactcatctgatttagaggaagcgttgtcggaggattcggatgcagcgctctctttctcgagttttgcaatctcttcttcgataccgcgaattgtttcaatgtctttgctcaaagtttcatattcttcttcagagaaagagtctttattagattcaactgtacttgcaagaaagtcagcatagttttcgttcatggcatcaccggcagtgttcttgctcataagaccaaaggctttgtcccatgcatctttgtgatcagcaaaaagctggttttcctgctggtaaaggtcgtccagttttttgttcagctcgtcagtgctgcccgtttctgttgtggaagaagattcctgttttgtattggttgttgaggaagaatttccgcagcctgtaaatgcaaaaagtacagaaatggcaagtgatgcagcgattaccttttttaatttcattgcgtttgttctaagtgttttgtttttcatgattttaaatctcctttaaattacattttgtttgttttagtttatttattgtcagcctttttcttgtttgaaaacccataatgatagcagattgcgtcagtcggacaggctttcatacattctccgcagcggatacactccggatggtttggtgtgtctactacgttgacatccatcttgcagacacggctgcatttctggcagccaacacatttctcatgatcaacctggatcttaagaaaagataccttgttaaacagtgagtaaatagcgcccagcgggcagatccatttacaaaatggacggtaaaacaagatgctcaggatgatgaaaagcgcaaggattgtgaatttaaatgtaaataaatgtccaagcgcggaacggattcctgagttggcaagtgccagtgggattgcgccttcaagtactccctgcgggcaaatgtatttacagaagaaaggatctcccataccaagtgaattggttacaaatgccggaagcagtataacaaagacaaccagaatcacatatttcagataccgcagaggcttcagctttgcggtggaaagtttcttgcccggaattttatgcagcagatcctggaaccatccaaacggacagagaaatccgcagataaatcgtcctaacagaacacctaacaggatgaaaaatccagtgatgtagtaagtgaacttaaatttggaggatcctactacagcctgaaatgctccgatcggacaggcgcctgtggcggcaggacaagagtaacagtttagtcccgggacgcacatcgtctttatgtttccctgataaattttccctttaaacagattcgggatatgaatattggtcagcagcgttgcagccgcctggatccatccgcggaagcggaccagagggtttttgcttgatttcattttcttatccaattccgacacactccatacataattttattgccttgctaagcacaaccgcagcttctccgcggaagattccgacaaggaaaaatgccaaaccggctgcaagtaaaagaatcggtgttgctttttcagatttcattcatatactcctttcaatgttcaaagtcagtttattgttactgttcactcccgtgtcaatcactccgctgattgacacggaggatgcatgtcaagcattttacacctgttttatgaaattttgcttggctctgaacagttacaaatagaatatcgccatgaaaaagtgtgtagcctgtcagcgtaagtccagcttataagacaaggtgcgcactttttttgtgcagaaaagagaggagttaaaacaaaatggcggaaagcaacaaaatgaaggatatgccggtgaataagctgatggtccagatgggaatcccgatgatcttatccatggcattgcaggcggtttacaatattgtagacagtgcatttgtaggaaatatgagagtgggcagtgaggcagcattaaatgcattgacactggtattcccggttcagatgcttatggtagcagtgggaatcggaacaggtgtcggaaccaatgcacttctggcaagaacacttggacagggaaacaataaaaaagcagcaaaggtagcaggaaacagtctgttcctgggagtgatcatttatgtggtttgtttattgtttggcatctttggagtgaaagcatacatttcatcccagacagtagatgcagaagtttttcagatgggtgtcagttatctgcggatatgctgcgtgatctcttttggaattattttcttctctttattcgaaaagttattacaggcaacaggacgatccctttattccacaattggtcaggtggtcggagcagttgtaaatattattcttgatccaatcatgatctatggtattggaccttgcccggaaatgggagtgaaaggcgcggcctatgcaacggtaattggtcaggtagcgtccgcagtattgctgttcattttccatataaaattgaataaagagtttgagcatggggtgaaatatatgaagccggatggcggtgttataaaagaaatctatgcaatcggacttccggcgatcattgcacaggcattgatgtcgattatggtttatgtaatgaatctgatcctgaagttcaatccgtcagcacagacagcatatggtttgttctataaggtgcagcagtttgttctcttccttgcatttggtctgcgtgatgcgatcactccgatccttgcatttgcttatggaatgagaagtaagaagagaataaaggatggaatcaaatatggtctgatctatacgattgcattaatgattcttggaattgccattacagagattttccctggggcgttcgcgacactgtttaatgcaggacagtcaagagaatattttatcggagcaatgagggtaatctcagtcagctttctgtttgccggaattaatgttgcttatcagggtgtttatcaggcattggacggtggtatggaatcgctggttatttcacttttgagacagcttatcattatcctgccactggctggaattttttcgatatttgtcagaaatggccagatgggcgttacattaatctggtgggcatttccgattactgaaatagtttcatgttttgtgggatatatgttcttaaagaaaatcagaaaaaataaagttgatgttttaagttaaggaggaagcggagatgaaaaaaagaattattacaatcagcagagaatttggaagtggcggacgctttatcggagaagaagtagcaaagaaacttggaattgcttattatgataaaaatatcattaatgagattgcagaaaaatctggtttatctccggaatatattcaggaaaatgcagaattatcgccgaaaaaaggattattcgcatatgcatttgccggacgtgacgtcacaggaaaatcagtagaagacctggtgtacgaggcacagaggaaagttattttagagctggctgaaaaggagtcttgcgtgatcattggaagaaatgcagattatattctgaaagaccgggatgatgtactgaatgtatttatccatggggatatgccggaaaaaacacagcgaattatggggttatataatgtagaagaaaaggaagctgtcaaaatgatggtagatatagataaaagacgtatggcaaattacaatttttatacaaaccagaagtggggaaaagctgacaattatacgctgtgtttgaacagttcccagctcgggtatgacagatgtgagaagataattatggaatgtatatgactgtgaaaatatattccgaaaaagcttgctatttgtgaaacgggaaatacattttatgaaatacgaaaatgacgttatacattttgtggtaaaatgtgttcagtaaagaaactatagcataatgatacaaggagatgataggaatgaaacagcaggtatttaatccatatctgccaagctgggaatatatcccggatggagaaccctatgtgtttggtgatcgagtatatgtctatggctctcatgattcctttggagcaccgattttctgtgtgaaggattatgtttgttggtctgcacctgtgacagatctttctgattggagatatgaaggtgttatatacagaaaaaatcaggatccttctaataaattaggaattcgctgtttgtatgcaccagatgttaaacagggaccagatgaaaattaagggttgagaagtcagtgcctttggaaaaagtatgtggtaaaatatatatacgagaagtctataaatcggaattgtgcgcccagacaagggcgagtagtctagcaggtggaatgcctgtctggtaaggtctaaccaaccgccagtagcgagtcttgggtgactgccagtaatggtagttgctaagcgtagacagcgagaaaatagagagtgtgattgagccttgaaattttgacatctagaaggctgacgttttaattccagcggaaagcaacacaaatcaaatcgtcatggtaagaaatggtttgcttctgcggggtcaaagagcactttatgttttacattgtgactattcagtcaactggggacagcctattgtttcttgccattgcaagtatggcaaacaactgcaaaacaggagaatgccaaaagaatagtaggcagtcggatagcttcatagtactgaagaagttgggtaatgccaatggagggaagggagctacataataatggtctttctgaggacacatcaaccgtactcagggacgggggtattgatggaaacaaaattagaaagaatagcagaaatatcggcaagttcgccgagaccagagttcacatcgttgtatcatctaatcaataaagaaatgcttacgcaatgccacaaagaattagacggaagtaaggcagttggtatggatgagattacgaagagagaatacgagaagaatctggagcaaaacatagatgacttggtagaaagattgaaaagaaaatcatacaaaccacagccatcaattagggtatatatccctaaaagcaatggaagacttcgaccattaggaattgcgtgctatgaggacaaaatagtccaattagcattaaagaagatattggaagctatctatgaaccgagatttctgaactgcatgtacggattcagaccaaatcgaggatgccataacgcaataaaagaactgtataagagattaaacaacacgaaaatctgctatattgtggatgctgacatcaaaggattcttcgaccatatgaagcatgaatggattatcaagtttctcaaactttatattaaagaccccaacataattggtcttgtcaagaagtatcttaaagtgggagtgctggataatggtgaacttatggtaaatgaagaaggttcagctcaaggcaatatcataagtccaatcctagcaaacatatatatgcacaatgtattgacactatggtataagtttattattaccaaagaatgcaagggagataactttctaattgtatatgcagatgattttgttgcaggatttcaatacaaatgggaagcagagaattactacaagcttcttaaagaacgaatggaaaagttcggtttgcaattagaagatagtaaaagtcgtctcttacaaagcggtgcttatattgcaagggcaaagcaaaagagcggtgagtgtatcagattacaaacatttgattttctgggattcacattctattgtgggcgttcacgcaaaggtatgccatatataatgccaaagacaagttctaagaaattcggacagaaaatccgagacataaaagtgtggttatacgcaaacagagaccaaccactaaagaaactaatgggaatgcttaatctgaagctgacaggacactataggtactatgggattagttttaatggcagaatgatttcaaactacaagcaacaggtgagagaacttctgtttaaggtgttgaacagacgaagtgacagaaagagttatacaagagaaggattcattgaaaggctgaaatattatccattggcaataccaaagatttatgtcagcttgttttgaaactgtaaatattattatgaagagccgtatgcgggaaagccgcacgtacggttctgtgaggggcttatattgtgaggtgtaagtctactcgactatcagaaaatgaggaatagttgaaatggaggcgctataataacatgaagattgaaggaaaccagaaagaactggatgcaatggtagaatttcataagggaaaccgtgtcgaggggctgagactgcaagaagaatttgcagcggaatttcgtaaggagtataaagacaaagatcactgtccttgcctgaaagcctgtcgttatcacggaaactgtaaggaatgtgtagcaatccacagagcgcatcaggaacatgttcctaattgtatgcgaccattgattaataaaaaattgaaattgatgtcagaattaacagagcataccttggcaaatgaaatagaagctccacatgaggttttaagaaaataggcaagtcaaattcctgtttttaaagctgtacatgaaaatgtatggctttattttataaaaatacattgacaatcatctatgtatatgctaatctacacacatagataaatatcaatgcgaggtaaatgaaatggaactaacaaatgttgcattaatctgcaaggcacttggagattcaaacagattagaaatagtgcaaatgttgtcagatggcgaaaaatgtggatgcaggctcttggaaaaatttgaaattacacagccaaccctgtctcatcatatgaagatactggtggaatgtggattggtgaatgatcgcaaagaaggtaaatggcatcattactctttgaattgtgatactttattagaattcaagaattttattggcagtttgacatgtgagtcatgctgtgacaaaaaagatagctgttgttagaggggaaatgctaagatgaagttttttcaaaagtatttatctgtgtggggcattctatgcatgatcatcggtgtatccatagggcatttattccggttgaacttgctacagaatatctggctggggcagtattgcttggtgcagcaccatgcacagcaatggtatttgtatggagcagtctgacgcaagggaatccggtatatactgtcgttcaggttgcaacgaatgatattatcattctttttgcatttggaccgattgtgaaatttctgctgggtgtgtccaatgtagcagtgccttttaatacaatatttttaagtgtcgtactttttgtagtaataccgcttgttggtggaattattaccagaatggctgtaatcagaaaacatgatgagaattatttaaaccagcagtttttaaataaatttgattcagttacaactatagggctactattgacattagtgctgatatttatgtttcagtcggaagttattttgaaaaatcctatacacataatactgattgcaatacctttgataattcagacatttttgatctttggaatcgcatacgtagcgtgttatctgttaaaactgccacacaatattgcagcacctgcaggaatgataggagcatctaatttctttgaacttgcggtggcagtggcgattgcattgtttggaacaacaagtgaggctgcacttgctactactgtgggtgtcttaacagaagttccggtaatgcttatgcttgtaagaattgcaaataagacgaaaggaaggtttctatgacagtaagagaaaaagcagaactgattgtaaaagatataaagaaagaacagggaacaaatccggttgttatttttaagcagattgcagagaaggaatatatcagcattcatggaccggaacaccatatattagatggtgcaagtttgctagtggcctacaaaaatgcaggtggagagatagacttagaacaggcattggacaggctgatgtcagaaggacttcggatgccgggagcaatgtgcggtttatggggaatatgcggagcaatcacatccattggcgctgcacttgcaatcatcgacggaacaggtccgctttcaacagatggaacatggggaaatcatatgcagtttacttcgaaagcaatcggagaattaggagccataaacggaccaagatgctgcaagagagatgcaatgatagcatttaagaatggtattgattatgtgaatgctcattatggagtaacattgcaatacgaacaaatgcaatgtggattcacagattttaatgagcagtgtataaaggagaggtgtccatttcatgagtaatgtaaaagtggcatttatttgtgtccataattcctgccgaagtcagattgctgaggcttttggaagacatctggcatcagatgtgtttcaaagttattcggcgggtacagaaacaaaaccacagattaaccaagatgctgtccgtattatgaaggaattatataatatagatatggaagcagatgggcagttcagtaagctggttagtgatattccaaatccggatattgcaatatcaatggggtgtaatgtgggatgtccatttataggaagaccgtttgatgataactggggacttgaagatccaacaggaaaaagtgatgaggaatttaagatagtcattgaaaaaatcagaaaagatattttgaaattaaaaaatggattggataagaggtagacagcatcagattcaagtttgcagaactaatagagaagtaacatataaaacaataaatatggtcaaaaaatcatcgacatccgacctacagcacgttataatatagttaatctaataagaaaaccaagtgatcattgttacgaagctgaattgtaatggtggccaacggagtgaactcgatggaacggaatggttatatcctttgggtgctccgagcaccgaaagatgctttacagagatgaaaacaggttttcttattttgacagggagtaacagaatagttaggaaaaacaaggatttccttgacttaggttgactaatcattgtatgtatttacagtggtatctcgagcttctaagcactagatgtgggttcgattcccgcacgggacgttgcggaatgattagcagaaatcgcgaaatcattccgttttttattgcaaatgaatagctgaaaaaggacaatgtcattaacttaaaagcagaagatatttattccgaaatggattagatatcttctgcttttttgatatgcttatattgtaaaaagaatgcgaaaagcagatcagacgatgaacaccgactattcgatcctgccgttgagaaagttgtagagatcagtctggagcgtctgaggccattcgagaatcattcgttcaaggtaaaggaggatgaagcaatggcacggctcatggaaagcatcaagacaaatggagttctttcatcggtcttgatccgactggaatggacacttatgaaatgatcgccggtcacagaagactccatgctgcacagctggcggggcttactgcgattccttcaattatccgggaaatgacagatgatgaatcggtaatcgcgatggtggatgcgaatattcagagggaggagttattgccgagtgagaaggcatgggcttataagatgaaattgaatgcgatgaaacgacaagccggaagaccatcaaaagaaaatgctagtcaaaatgaccagaattgagagtgaaatcataaagctggaaagcgtagcaattagctgacaccaaaaataaaaaaatggtgtcaaaatggtgtcaaatcaagaaaaagtaatgactataaggaaaaaaagcgtaaagtcaaggtttgcaaaaaaaatcttaaaaaattagcactcacctcttgacttggctaaaaactgcgtgctatataataagtagaacaaaagaagacagagaaaaaagaaaagaaatgaacttctgaatcctccgaatgttctgacaacaactgcgaaagcagcttatataaattgtgagatcttctcacaaaaggcaacaaagttagttagcattgaaaggagaaatgacttatgatgatgcctagtatttttggagaaaacttatttgatgatgattggatgaacttcccatttgagcaggatttctggggaaagaagaatccgttatacggtaaacacgctaagaacttgatgaagacagatatccgtgagcatgacgcaggatatgaagtagatatcgatcttcctggattcaagaaagatgagatcagcattgagcttgagaatggttatttgactgtatcagctgctaagggtcttgataaggatgaggaagacaagaaaggtaaatacatccgtaaggagcgttatgccggagcaatgcagagaagcttctatgtaggtgagaaccttacacaggaagatatcaaagcaaaatacgagaatggtattctgagactgtcagtgccgaagaaagaggcaaaaccagttgagacaaagaaaacaatcgcaattgaaggatgatttgaacactgatgtgagtcaggtgtcaaatgtcgaaggggcttatgtaagccccttctttttgtatataaataagataaatatgaatcataaacgcacaaaaaatcagccgtaaatatttacgactgattttttgactttataatacatttgtaatttattcagtttccgctttgattccctgatcgaagatttcaacagcttttttatttggctcagcagtaagttttgctacaataacagcaatcagaaaacttgcaaagaatccagggacaatctcgaagatacctgtggcatctgtcattcctgtgagcagccatccgagatctacaacgaatccggagattacacctgctacagcaccctggtaattaaagcgtttccagaacagtgacaacagaatcgtaggtccgaaagaagcaccgaaagcgccccatgcattttcaaccatatccatgatagcctgagcaccgcttcccttagagtttgcgataccgaaagcaatcagggagaggatcagtacgaggatacgtccaaccatcagcgtctctttttcagaagcattttttctgaagaaaggcttgtacagatctgctgtgaaggagctggatgctaccaacagctgggaatctgcagtggagatcgaagcggcgataatcgctgcaagcagaagtccacagatgcctgccgggaagaatcttcgcgccatagcaatgaatacaagtttctgatttccctgagtgagcagttcagcgcccataaccattctgcctaagtaagcaatcaggacagcagagaacagtgagatgattacccatacaattgctacgatagaagatttcttgatcatggatggtttctcgatagacataaaacgcaccaggatatgtggcataccgaagtatcctaatccccagccaagtccgctgacgatatcctgccagctggcatcaaagataccgcctccgaaagcacactgtgttacagcgcctgtagcagcatcagtatactcatatactgtagtaagagcagtaggatccaacagatcactgtgaccgatgcagactacgagaggtacaagcatcagtgcaagcatcatcagtaatccctggaaaaagtctgtccagcaaactgcagcaaagccaccaaagaatgtgtaggcaacaatgatcagcaagaatgcgaacatagcaattttaggagaaactgtcgggaacagcgttgtgaatacagaagtaccggctaccagtgcagatgctacataaattgtataagcaaacaggaagatcagtgcacatgtcaactgcagtgatctggagtctgttgcaaaacgatttgtcagatactgtggtaatgtgattgcatcatctgcagctttagagaatgtacgcagacgttttgcgcacagaatccagttagcagctgttcctaatgcaagaccgataccgatccacatctgtccgaaaccgaaagctaagatcgatcccggaagtcccatcagcagccacgcagacatatcggacgcctgtgcggacagtgctgttacccatggtcccatagatcttccaccaaggaagaagtcctcggagttcttattggtaccgttaaagtaaaatactaatgctacgccaagcaaaatgacgaaatacgcaataaaagtaatgatttcccaattcatattcttttatcctttccttatattattttatatgatgatatcaggcaggattgtaagaaggcatagcatttgtacaatccgtaggtatcaaaatcataattgaaggcatttttaacccacaataacatttaatttaccgcaattaggcggatattgtcaatagtttgggggaaactactattgtttcaggtgtttcttatagttctgcggttagtagaaacggacagagattttttcataaattatgaaatattgatggaatcttaccttgtattgtgagataatagaaaagtaagagttctattgctgctcgtaggtaactgcgaacagtaatatatccgtatctgttcagtatcttcacagataccagtattctaaaaagtagaaaacgaggtagaacaacatgaaactgatcaaggagaagaagatttatactggggacggtgtaatcgaaaatggctatatccgctttgatgagaagattgaagaagtcggtgatatggcggggttcgagccgaaagaaggggatcttgaggtaagttgtgcaggaacaatggttgttcctggatttattgacattcatagtcatggcggttatgggaaagataacatggatgctacaccggatgagattgatgagatggttaagcagatgacaaagcaggagggaatcacaacttatttctgtacaactatgactcagacatatgagaacatcgagaaagcgatgcagaatattcatgatgcggcacagaagaacccggtgatcaaaggaatccacgtagagggaccatttatctcaactgtgtttaagggagcacaagatccttcttatattaagaaaccggatgaaaaaacactggcaaaatggaacgagatcagcggcggtctcctgcgtattgttacttatgcgccggaagaggctgatccgtcatttgagacatggtgcaaggaaaatggagttgtcttaagcgcaggacattcgaatgcattatacggggaattgaatgcaagcggagcaacacatgtgactcatctttacaatgcacagagaggactgaatcacagagagcctggtgtgacaggatatggtatgttggcagaaggggtacatgcagagctaatctgtgacggaaagcatatcgtaccggatatggtgaaactcgcatgcaaagtaagagggtatgatggaatcgagctgatcacagattccatgcgtgcgaaaggaatgccggaaggaaagagcgaactgggcggacaggtcgtaatcgtaaaagatggtatggcaaaactggaagacggaacgatcgcaggaagtatccttacatacattcaggcatttaaaaatgttatggaatttacaggtgctacagttgaagatgcagtaaagatgacctctggaaatcaggcgaaagagttcggacttgattctaagggggctattgcagcaggaaaagatgcagacatggttgtattaaatgaggactttgatttagtacagacaatcagctatggtaaactcgcataaggaataagaagttataaaatatatctacagaagcaggaagcaaatagatttgatctatgaaaatatggggtggcttccaaagcactcgatataaatataatgaaatgagagggtattaaacatggaagtaattgtaaagaagaattatgaagagatgagcaaggcagcagcaacactgtttgcagcagagattatggagaatccgaaaacaatccttggtatggcgacaggatctacaccggttggtctgtacaaagagcttgttaaaatgtatgaggctggagatcttgatttctctcaggttactacattcaaccttgacgagtatattggactggcaccggagcatgatcagagctatcattatttcatgaatgacaatcttttcaatcatgtaaatatcaacaaagagaatgtacatgtaccggatggggttggatttgaagctggagaggcaggaaaagcttacgaagaactgatggcaaagacaggacaggtagaaatccagctgcttggacttggatgcaatggacatatcggattcaacgagccggcagatgagtttacaaaagtaacaggtgagatcgacctgacagacagcacaattgaagcgaataagcgtttctttgagaagaaagaagatgtgccgagaaaagctgtttctatgggaatcggaacaattatgcgtgcaaagaagatcgtacttcttgtaaacggagagaataaagcagagatcctgaaagaagtagtaaacggaccggttacaccaaaggtacctggaagtatcttacagttccatccacatgtaacagtgatctgtgatgaagaggcagcaaagtacctgtaaaatgcctgcaagaggtcatcaactgacatacggttaaagcttatagtagcttgtgtctagagagacttcttagtaaacgataagaaccatgaagaagctgccaacggcagcttcttctaatatataaaattcttgtaactattcagagccaacctccaaaatgctatgcatttcggaggtgtggcgtatccgccaaataaaatttcaaaaacagtctaaaaaatgcaagcattttacacctttttttgaaattttgcttggctctgaacagttacaaattcttaattattaaaggaaaacagaacatatgaaaacaacaatattagaagcatgcacagattgtgtacaatcagcgatcaatgcgcagaaaggtggcgcagaccgaatcgaattatgcagcaatcttgtgatcggaggacttactccggggaaggcattatttgatcttgtcaagaaatatacagacatcaagacgagagttcttcttcgtccgagatatggagattattgctataaccaatatgaatttgaacagctgaaagaggaagttcagatgtactgtgagatgggagctgatggagttgtcatcggaatgctcaatccggatggtacattggatacagagcgaatggcagaacttatcaaggcagcaggaaataaagaaaaagcgcttcaccgtgcatttgatgtctgtatagacccgatgaaagcactcgaagaagcgattgatcttgggttcgatacgattctgacaagtggacagaaagaaactgcgtgggaagggaaagagatgctgaaagcacttcaggagaaaagtgcaggaaggattgagatccttgcggcaagcggaattggtgcagaatcaatagaaaaattacttccgtatacaggaattacttcttatcatatgtctggaaagattgtagtggacagtatgatgaaatatagaaaagaaggaatcggacttggattgtcggaacgtggagattatgcgctctggcagacttcggaagaagaaatcgtgaaagcagtaaaggttttaaaaacaacaggttaacttcaacagacgtgtcttgcacagcttcacaaaaacggttatactcataggcaaaggcaaaaaatatatttataagacaagaaagttttaacaggagaaagcggattatgatcaaagtaatagcaagtgatatggatggaacactacttggagacaatcacaaagtagcaccggagacagtagaagcgatccgtgaagcacaggcggcgggaatccgctttatgatagcaaccggaagaagttataatggagcaatggaagaattaaaaggtctggatcttggctgtgatttcattgtgggctcaggcgcagagatacgcaacccaaagggtgaaattctaaaaagcataggatttacatatgagctctgcaatgaggtggcaaaggtattggaagaatatccaatctcggtattgtattgcgccggaccttatgagtatcgtgtgggaacaccggaggaagtagaggagagtattgttcgtcagattcagctgttccatttatctgagtgcagagaccaaatagagcagtcagaactttataagcgagtgaaggcaagttcaagacgaatcgattctgtggacgaattagagaaacagggaattatgatccataagattttcctttttacaggcgatctggagatgcttgataagatcaagcgaagactgatgcagaatccggaactcgcagttgcgtcttccttctataataatctggaaatcacggtaaaaggagcggagaaaggacctgcgattcaggaatatattgaatccttaggttatacaaaagaggaagtgatggtgtttggagacagtctgaacgattactctatgttgtctatggattttggcgcaactgtcgcgatggaaaatgcagatgaggaagtgaagcgggtttcaaaatatgttacaaagtcaaatgaagacttaggggtggcatataccattcatgaactgttgaaaaagcaggggaaaatcaattcaaattgtgaataatttttcgaaaaatgaaactgtatgttgataacacaaaatgaaagcgaggcaactaagatggatgtaagacagaaaagaaacaaagtacttggagaacgtgtggtgaaagcacttgaatccagaaatatggatgcttattatgctgagacaaaggaagaagcagtgcagaaagcactggagtggattccggaaggaagtacgatcaatatgggaggtgcctcttctgtacacgaatgcggtctgattgacgcgataaaatccggaaactataatttctgtgacagagataaagcagctacaccggaagagaaacaggaaatcgcgagagcagcattttcctgtgactggtttcttggaagtgtgaatgcgatgagtgaagatggagtgttcatcaatattgacggaaatgcaaaccgtgtagcagcatatgcatttggacccaagaatgtacttctaattgttggtatgaacaaagttgtaaagacacaggaagatgcaatgagcagggcaagaaatgaagctgcacctgtaaatgcacagcgttttggaattgatacaccatgttccaaggctggaagctgctttgactgcaagagcccggaatgtatctgttgtcagattctggtaacaagattcagccgtcagaaaggtcgtttcaaaattattcttgtagatgagaatcttggtttctagtagccggagaagggaaaaagaatgggaagaaatagaaagaagccggtgcgccacagattagaaaagcgacagaaacgaagcaggcaaaagaaaaaaagcggtttatttgacaaagtaacaatagtgattctggttgtggcagtctgtgtttttgcattttcgctttatcagctggtacgcacaatggtgccatattattctggtggaaaagagtatgataagctcaaaaataaagcaatcactgtacaggagcaaacagatgatccgggagatgtatcgggagacacatttaaagtagattttgatgtgcttttgcaggaaaatccagatacggtagcctggatccggtttgatgaaccatcaatcatcagttatccggttgtaaaaagtgcagataacaaagaatatctgacaaagacgttttccgcaaatgataataaactgggtgcaattttcatggatatgaaaaataagagtgatttttcagatagaaatacaatgatttatggacataacctgaaagttggcggagaaatgttttcgcagctgaaagagtatgaggaagaatctttctataaagaacatccgaatttctatatttatacaccggatggaaaaacaaggacttataccgtgttttcagcagctgtcgtgaaggatactgcagatcagtataatctgacttatgcgacagacgaagcgtttgagagttatttgaaaatgtgtaaagaagattcagcatatgacacaggaacagaagtgaatgcgcagtctcagattgtcagtctttcaacttgtaccaatgtaagagaagatgagagattccttttgcagggagtattgacggcgacagacggaggagaaaattagaatggcagacagatttgatgtaggcgacattattaagatgaagaaaccgcatccatgcggaagtcaggagtgggagattctccgggtcggagcggatttccgtctcaaatgtatgggctgcgggcaccagattatggtgccaagaaaattggtagaaaaaaatacaagacaaattacaaaaaaggcttgaaacaacaaattctttatggtattataagaaactgtgacatgctgatggaacaattccaatcagtcattcaatttccttgttcccgggaggaaccgggggccaagagaccataaggaggtaaaataagatgaataagtatgaattagctgttgttgtaagcgcaaaactcgaagacgaagcaagagcggaagtaatcgagaaagtgaaagcaatgatcactcgtttcggcggtaatgtaacagacgttgatgagtggggcaagagaagattcgcttacgagatccagaaaatgaaagaaggattttattacttcatccacttcgaggctgaaagtacagttccagctgaagtagagcagcgtatccgcattatggacaatgtactcagatatttatgcgtgaaacaggaagcataagcggaaagaggtatatatgaataaagtagttttagtaggacggttaacaagagacccagaagtgagatattcacagggagacaatgctacagcggttgcaagatatacacttgctgtagatcgcagattcagaagagacggtgagccgacagcggattttattccgtgtgttatattcggacgttccgcagagtttgctgagaagtatttccatcagggaatgcgtgtctctatttccggacgtatccagacaggaagctacacgaacaaagatggtgtgaaagtatacacaacagaagtgatcgtggaagagcaggagtttgcagagagcagagccgaggcagaagctaacagagcaagtttccagcgtcagtctgcaccgagtccggcacctagcgcagatgcaggtgatggcttcatgaatatcccggatggtatcgatgaggagttaccgtttaactaagtcggaaaggagataaccatcatggcttacgaaaaaggaagcagaccagagggtggattcaaaagaagaggcccagctcgtagaagaaaaaaagtttgcgtgttctgtggtaaagagaacaacgaaatcgattacaaggacgttgcaaaattaaaaaaatatgtttctgaaagaggaaaaattcttcctagaagaattacaggaaactgtgctaagcaccagagagctcttacagtagcaatcaagagagctagacacatttctcttatgccttacgttcaggactaattgagataattagctaatagcaagatcgaatttttggagaaattcagaaattcgatctttttgctttttctaattcatttttgcgtgtttttttgcataatacaacctatagcatcttaggggaaaagatgctataatagattagctatattgtaattagtcacagatgatggtgattgatagtagtcccaggtgaggtattagttatgaaaaggaataaaatgcagctgaagggacagctcagaatgtacatgcgatggccgctgatcatgacacttctcttgattggcatggatgtatggatgtacatggtggacaagaaagccggacttttgatgtcagtgatcataattatatatgtaggaatcgctttttcgctgtatttctataacagatctttgatcctggcagatctgatccagttttcagtacagtataaaggtattgaaaaccggttgctcaaagaactggcaattccctatgcgattgcgctggaggatgggaggattctgtggaagaatgattgctttttgaatctgacagagggtcagagaaaagaacgttatctgaaccgtatgattccagaattacatccgggtgtgtttccaaaaaatgatgtggatcatgtagaattggaagtaacttatcgtgaaagaagttatcaggcagagcttcgaaaagtatcattggagggatttagtgagaaagaagagttgcttcagattccggaagagcaggaatattttgttgcagtttctttaagagatgtaacagaactgaatgcctacatccgagagaacgaagatcagcgaatgattgccggattgatttatattgataactatgatgaagttatggagagtgttgaggaagtcagacaatcccttcttgtggcattgatcgaccgtaagatcaataagtatatcggagatgtagatggtatcgtaaagaaactggagaaggataaatactttatcgtacttcgaaaggatgcttataaaaagctgaaagaagacaagttttctcttctggaagaggtaaaacaggttaatatcggtaattcaagatcagcaacactgagtattggtttgggattgaatacggcaacgtatgcgttgagctaccagtatgcgcgtgtggcaatcgatcttgcacttgccagaggcggagatcaggcagttattaaggactgtaacggaataacttattttggtggtaagaaggagcagacagcgaagaatacacgagtgaaggcgcgtgttaaggctgaggcacttcgagagtttattgtgaccagagacaaagttattgttatgggtcataagattgctgatccggattcttttggtgcatgtatgggtatttaccgtgcagcagtaagtctggagaaaaaggcacatattgtgatcaatgaagttacaggatctgttcgtccgttgtatgatgagattttggagagtcctgcatatgaggatgatatttttattacgtcggaacaggcattggattatgtggatgacaatgcaatggtcattgtggtagatacgaacaagccacagatgacagagtgtccggaactcttgaagaaatcaaagatgattgcagtgctggatcatcacaggcagagtagtaatattattgagaacgcggtactttcttatgtggagccgtattcttcttccacttgcgagatgatcgcagaagttctacagtatatggtagatgacatcaaattcccggcacttgaagcagagtgcatgtatgccggaattatgatcgatacgagaaactttatgaaccgtacaggtgtgagaacctttgaagcagcagcatttttgagaagatgcggtgcagatattacacgagtacgtaagatgttccgtgatgatatggcatcttatcaggcaaaggctgaggcagtccgcaatgcagaagtttatcgtaaggagtatgcgattgcagtatgtccaagcgatattgacagtcctacagtgcttgcagcacaagcggcgaatgaattgctggatattagcggaataaaggcttcttttgtattgacagaatatgaaaataagatttatatgagtgcgcgttccattgatgaagtgaatgttcagattatcgcggagaagctcggtggaggcggtcatattaattctgcgggagcacagtttgaccacacgaatatgcatgaagcagtcagtgcattgaaagagaccattgataaaatgatagaagaaggagatatttgacaatgaaagttattttattacaggatgtaaaatctcttggaaaaaaaggagagatcgtaaacgtaaatgatggatatgcaagaaactttatccttccaaagaagcttggactggaagcaacaggaaagaatctgaatgatctgaagcttcagaagaataacgagaaaaaagttgcggaggagaacctggaggcagcgaaagaacttgcagctaagatcgcagaagctaaaattgtaacacacatcaaagttggagaaggcggaagaactttcggttctgtatcaagcaaagagattgcagaggaagtaaaagcacagttgaatcttaatgttgataaaaagaagatccagttaaaagaagcgatcaagacactcggaacacacaacgtgtctgtaaagcttcatccacaggttacagcagaactgaaagtagttgtacaggaagaagcataaggagacgaaatctttatggatatggaagcagcaatgaaacgaattcctccgcatagtgcggaggcagagcaggcagtgctcggtgcgatgctgatgaacaaggaggccatcacggtggcctccgagatattatcaggggatgatttttatcagacagcatatggaatcttgtttaattctatggtggaactgtttcatgcgggaaaaccggtcgatctgatcaccttgcaggaatatctgaaagaaaaggatgtcccgccagagatcagtagcatggagtttgcaagagatttgctgatgggaacacagacttctgcgaatatcaagagctatgctgaaattgtacgtgaaaaatcaatcatgcgtcgcctgatcaaagtaaatgaagagacggcaaatgcctgttatctgcagaatcagccattagaggagattctggaagatgcacagaagcaggtttttgcacttgcagagactgggaattcagaagagtatgtaccgatcaagcaggttgtactcaatgcattggatgtaatcgagcgtgcgtctaagacaaaaggaacagtaacaggaattccgacaggattcattgatcttgattataagttgtccggtctgcagcgctcagaccttgtgctgatcgcagcccgtccttctatgggtaagacagcgtttgtattgaatatcgcacagcatgtggcatttcgtcagaataaagcagtagcaatcttcagcctcgagatgtccaaagagcagttggtaaaccgtctgttctcattggagtctcatgtggatgcacagatactaagaaccggtaatctgtcagatacggattgggagaagttgatcgaaggagccggaacaataggatcatcaagaatgatcattgatgatacgtcaggtattacgatttcagagatgcgctcaaagtgtagaaaatacaagctggagatgggacttgacctgatcattatcgactacttacagttgatgagcggaagcaattcaagaaagaatgagagccgtcagcaggagatttctgagatctcacgttctttgaaaggtcttgccagagaattgaatgtgccggtgcttgcactgtcacagctgagccgtgcggttgagcagagaacagataagcgtccgatgctttcagatctccgagagtccggagcaatcgagcaggatgccgatgtctgtatgtttatctatcgtgatgattattataatcctgacacggaagataagaacattgcagaaattattatcgcaaaacagagaaacggcccgatcggtacagtgcgtcttgcgtggatgccacagtacactcgttttggaaacgagctgcgtcagcaggatcaggagatataaaaaagaaaaggacaggcacttgttggagagcgcctgtccttttttggtatacaaatccaataaatttaccggtatgtgcagtgtgcaattagaaatcgcagaaatgctatgtaaatctttttttgaatctcagcaccggactattcttcacactttctcttcgggttgcctgttgctggcgaatcaggctgtccagtttacggaaatgttcttcttcctgccgttctttcgcctggaaaagaaaatccatctcacgtatgacatctgcggtgacctgagtgctgatttctttttctaatgctttgttattttcagtaacgacttcagtcagcacttctccgatgagtgaacgtacatgttccagctgggtctttgtgataacttcgaccggagtagtggtagtggctggtttgcactcagatgtcaggtcaggtgcgggtgttttggtaagggcattcttttccttgttttcagtgtgtctcattatctgacgtgtagatttcaactctgggatcaatggcttcagatcgcgaagcagaaccccttcattcttaagttttttaatacagcaaaagagctggatatcatcctgggtataatatcgatgtcccatctctgtgcggccgatcggaatatgaagttcctcttcccagtaccttaagacatgggattctacctgaactttcttggcggcttcagagatcataaatctgacttcacccattgattttctatcctcctgttagaatcattgcgattactgttctgatttcgctacatttattatagcatagagaaattatgaaaaaagtgctaatcgttcgtcaaattatggcaaaaaatggtaattgaagaaaggtatggaatacaaggaaaaaaagttgtaaaaaaagaaatcctgccgcatctgaatcaatcagacgggcaggacttctgcgttttgtgatcacttagcgcttataaattatgcttcagagatagcgcctgtaggacaagcagcctcacaagctccgcaatctacacaagcatcagcatcgatctcatatttgccatctccttcagaaatagcgcctactggacattcgccttcgcaagtaccacagcttacacattcatcactaattacgtgtgccattgtatgtaccctccttttttggattacgataggtttttcccttttcgttatcctcattttaatacaagacggggaaatatacaagagttcctgatgtatttatttgagtaatttatgagttagttttatgaaacttgtgaacgtggaaaatagaagatttctatactaaattagtaaaaaaacgaaaattcacgagattttaagaaattatctcttccatttttcaaggattcgtgtatcataatggattgagagttaaaaagtagaaaacatagagataaaattgtgtaaatgaaaagaaggagaaagttatgcggaaacgaaatgtaagagcagtgattgcggcagcactttgtatgacggtacttgcagccggctgcggaaagaaggcagatgatccggtttttacaggggataagacagaagcaccggtatatcaggcaaatctggatgcaattaaatcttctgcatatgcatcggcagacaatctggatctggaacctggaacttatatttctgtaatcggaaggggatcttcaacaccatattggaatcaggtaaaggcaggggtagagcaggcagcaactgacttgaatacagcacttggctattccggaaatgataaggtgaaagtattatacagtgcaccggatgagaatgataatatcgatcagcaggtgaatattctggatgaagagcttgcacgttatccggatgtgatcgcaatttccagtgtagatgcaagcgcatgctccgtccagtttgatcttgcgattgagaatggaattccgatcgtagcatttgattcaggaaacagctatcagaatatccaaagtacttgcaaaacgaataatatagaagcggcaacaacaggaacaaagaatttctgtgagaagatcggtgatagtggggagattctgttgcttgtgcatgatacagtatcagatacggcgaaagagcgtgaggcaggaatcaaaaatgaacttgcagcaaatcatccgaatgtgactgttacagagacaatttatctggatcagctggaaatgttgaagaaacagattgtagctgaacaggtcggggtaacaccagaagaactggcagccgcagaagcaggagaaaagaaggaagagacaacaggaacaggtgatgcttccgagacaattgcagatgcagcatcgaatgcggattcttcatcagcagacgaaagtgcgaatgagacagcacaggaagtggacaatgaattgtccgagaagatgcagcaggtcaacgatggcgcggcaaagatgagtgatgaagatgcaattcgatattatatggagaaacatcctgatttaaaaggatgtattgctacgaacgagacagtaacccagcttgcaattaagacgatggatcagcttgatgcaaaaaaacatattacattagtggggtttgatgcaggaaaagagcaggtcaatgcattgaaagatggaaaggtggatggacttattgtgcagaatccttttggaatgggatatgcgacagtagttgcagcggcacgtacagttcttgagattggaaatgaagctgaggtcaacacaggatatgtgtgggtgacagcagacaatatgaatgacgatacgataacaccgttcctttacgaataagttgaaaataagtcgaacaatttcataaaagaaaagagcttgtcaggtaaaataaaaacatcaggttttatacttcattctgaaattcagaaatatagaagtaataaaatcctgatgttttttattttatattaggaaagtcctttcctaataaaaaaaaacgctccgctcaggatgcgcactgcggcgtacaaggtaggtgtcgcaagcttacatactttcaaagggatgaggtagagcgggccggtgcccatggtaatagtagggctgtccttgtgtatcattctaatgaaagtattcgatttaattgtatgaatccaagttcaacaaattcctcttacttcttctgtgattctacttcctgcattttcatagcacgaactttcagaggaagtccgaacaggttgatgaatccgtcagcgtcatggtgatcatacagatctcctgttgtgaagcttgcaagggattcgctgtacagtgagtatggagatgtctctccggcacggatgatatttcctttatagagacggaacttaacttctcctgttacatactgctgtgtaacatcaacaaatgcctggattgcttcacgaagtggtgtataccattttccttcgtatacgatctgagcaaatttatttccaagatctttcttaacttcatatgtagcacggtcgagaacgagctcttcaagctggtcatgtgcttccataaggattgttccaccaggagtctcgtaaacaccacgtgatttcattccaacaacacggttctcaacgatatcaacgattccgattccatgttttcctccgagacggttcagttctgtgatgatttcagaaactttcatctcttttccgtttacgctctttggaacacctgcttcaaatgtcattgtaacgtattcatctttgtctggtgctttctctggtgttgtgctcagtacgagaagatcatcgtagtttggctcatttgccggattctcaagttcaagtccttcatggctgatgtgccacaggttacggtcacggctgtagctgtgctttgcgtcaaatggaagatcaattccatgagctttacagtaatcaatctcgtcttcacgggactgcattgtccatacatctgtcatacgccatggagcgatgatcttgatgtccggagcaagagctttgataccaagctcgaaacggatctggtcatttccttttcctgttgcaccgtggcagatagcaacagcgccttctttacgtgcaatctcaaccagttttttagcgattgccggacgagccatggaagttccgagaaggtatttgttctcgtaaacagctccggcctttacgcaaggaacgatgaagtcatcacagaattcatcaatgatattttcaatatataatttagaagctccggaaagttttgctctttcatccagtccgtccagttcttctccctgtccacaatcgatgcaacagcagataacgtcatagttaaatgtttctttcagccacgggataattgctgtagtatcaagaccacctgaatatgctaatacaactttttctttactcattttattgcctcctgaatgtattttatcaatttctgttttctcagtttcttgagttctaaagatttctgctttaacaagctaaaacatactatacaccacattttataattatgcaagtattattttaaaaaaatgaataaaatgcataaagacacacataataaacaaaaagaatgcataaaacaataggctataagaagaaatatacaagatatgatgaaaagaatgaaataagaagaaaatcaaaaaatatttaggccaatatcatcgccttttttatatatctttatatagtaggaaaatactatctacaaacttttttgaaaaaatgcttgcatattatacatggaagatgtattattatgcaagtaaagcagggaaagtgtatttttatacattcaatttcaggaaatactttacatcccgattaaagtggtatattataaggagaaatgattgcggtaacacgttaccacagtacagtaaatatgcaattcccagggaacttctattggctcccatggaaatggtaaaagaaaggacttgagaacgatgattaaggtcggaattattggagcaaccggttatgcaggcggcgagctcgtaagaatattgatgggacataaagatgcagagattgtctggtacggatccagaagttatgtagatcagaaatatgcagatgtatatagaaacatgtttcagattgtagatgcaaaatgcatggatgataacatggatgagcttgccgagcaggtagatgtgatcttcacagcaaccccgcagggactgtgtgcatctctgatcaatgaagaaatcctttcaaagacaaagatcattgatctcagtgcagatttccgtctgaaagatgtgaaggtttacgaagagtggtataaaatcgaacacaaagcaccgcagtatattgatgaagctgtctatggattgtgcgagatcaaccgggacaaagtgaaggatgcacgtatcgtggccaatccgggatgttatacaacatgttctatcctgacagcatatccgcttgcaaaggaaggactgatcgatatgagcactctgatcatcgatgcgaagtctggaacttcaggagcaggaagaggagcaaagcttccgaatctttactgtgaagtgaatgaaaatatcaaagcatatggagtagctacacatcgccatacaccggagattgaagaacagctcggatatgcagcaggagagaaagttgtattgaactttacaccgcatttagttccaatgaatcgtggaattcttgcgacagagtatgcaaagcttacgaaaaaagttacatatgaagaagtaaaagcaatttatgataaatattatgcagatgagaaatttgttcgtgttctagagaaagatcagtgtccggagaccaaatgggtagaaggaagcaattatgtagacattggatttaagatcgatgagagaacaggacggatcattatgatgggagctattgataaccttgtaaaaggtgccgcaggacaggcggttcagaatatgaatctgctgtttggtcttccagagagtgaaggacttgaactcgttccgatgttcccataggttatattgataaaggtggtatgtatgatacgtgtaatgacaatagaggattatgatgaagtatataaattatggaagaagatccggggattcggaatccgcagtatcgatgattcgaaagaaggtgtcgaacgttttctgcgacggaatccgacaacgagttttgtcgcagtgaaagaaggaaaaatcgtcggaagtattctctgtggtcatgatggaagacagggaagtctctatcatgtatgtgtggatgaggcataccgaagacatggaatcggaaaagacatggtcgtgcatagcatgaaagctcttcaggaagagaaaattaataaagtctgcctgatcgcatttgcacagaataatgtaggaaatgcattttggaatacaatcggatggacggaacgacttgatgtgaattattatgattttattttaaatgaagaaaatattacagcattcaatgaacaataagcagaaaggaagcaagttatatgaagataatcgaaggcggagttaccgcagcaaaaggatttgaagcagcagcaacagcagcaggaatcaaataccagggacgtacagatatggcgatcatttacagtgagaaaccgtgtaaagttgccggaacatttacaacgaatgtagtaaaggcagctccggtgaagtgggacagacagattgtagagagcaaacagaaatcacaggcagttattgtaaactccggaattgcaaatgcgtgtaccggagaggaaggtatgaaatactgtgaagagacagcaaaagaggcaggaaaagttcttggaatcgatgagaaaggtgttcttgtaggttctacaggagtcatcggaatgcagattccaatcgataagatcaaagccggaattacagaacttgccaagggaaagaaagctgatctggcaagtggaacagaagctgcaaaagcaatcatgacaactgatacgaagaaaaaagaagttgcggttacatttatggcaggagatacagaagtaacgatcggaggaatggcgaaaggttccggaatgatccatccgaatatgtgtacaatgcttgcatttattacaacggatgcaaaaatttccaaaaaagcacttcaggcggcaatgagcagtgatgttgaggatacttataacatgatctctgttgacggagatacttcaacaaatgatacagcacttcttctcgcgaatggaatggccggaaatgagaagatcaaagaaggcacaccggaattcgatgcattcaaagaggctcttcattatgtaaatgagacacttgcgaaggcaatggcgggagacggagaaggtgcaacagcactttttgaagtaaaggttgtcggagcacagacaaaagagcaggcaaaagttcttgcaaaatctgttgtatgctcgaatcttacaaaggctgcaatcgcaggacacgatgcaaactggggaagaatcctttgtgcaatgggatattccggagcgcagtttgatccggagcaggtagatcttttcttcgagagctgtgcaggaaagcttcagatcattgctaatggaacagcaacagattatagcgaagaaaaggcaacagagatcctttcacaggaaaaagtgacagccattgctgacttaaaagccggagatgcagaagctactgcgtggggctgtgacctgacacatggatacattgatatcaatgcggattacagaagttgatttatagagaaattattatttctttaaagacgctgaaaagataaaaaagggagacagaaaaaatgacaagcaatatgcagaaatatctggataaagcgcaggtgctgatcgaggcactgccttatatccagcgctttaaccgtaaaatcatcgtagtaaaatatggcggaagtgccatggtggatgaaagtctgaaacgcagagtaatcgaggatgttacacttctgaaactgtgtggattcaaaccgatcatcgtgcatggcggtggtaaggaaatcagcaagtgggttggaaaagtcggaaaagaagcagagtttatcaacggacttcgagtgacagatgcagagacaatggagattgctgagatggttctgggacgcgtgaataagagtcttgtacagcttgtagagagtcttggcgtgcgtgcgatcggaatcagtggaaaggatggaaatcttctccaggttgagaagaagttttcagacggacaggatatcggattcgtaggagatgttaagaaagtaaatgcagagattttgtatgaccttctggaaaaagatttccttccgatcatttgcccggttggtatggatgaggaatacaatacttataatatcaatgctgatgatgcagcttgcgcaattgcccgtgcaatgaaagttgagaagcttgcattcctgacagatattgaaggtgtttataaagatcccaaagatccttctacattgatttctgaactggagatcaaagaagccaaggaattgattgctgacggatatattggaggtggaatgcttccaaagcttcagaattgtattgatgcgattgaaagtggtgtatcccgtgttcatattctggatggaagaatcccacattgtctgttgcttgaaatctttacaaacaaaggaatcggtacagcaattttaaatcagaaagaaagcaggtattatgatggtgaacagtaaaatacaggcggcagaagagaacctgatccatgtatacaatcgatttccgattgcactggatcacggagaaggaatgtatctgtatgatacagaaggaaaagaatatcttgactttgcagcaggatttgctgtgtctggacttggatatgataataaagaactgaatcaggcattaaaagatcagattgataagttataccatacatcaaatctttatttccacgagagctgtggagaggcagcaaaagaattaaaccgcatttccggaatggacagagttttctttacaaacagtggcggagaggcaaatgaaggtgctctgaaagcggcaagaagatatgcttacacaaagaagacaggaagatatgaatttatagcgatgcagaattctttccatggaagaagcttcggagcagtttctgtgacaggacatgattcttatcgtgaaccgtttgagccggttgttccaggtgtaagatttgcagagtttaatgatcttgacagtgtgaaagcactggtaaatgataagacttgtgcaattattttggaacctctgcagggcgaaggcggaatcaatcttgcgacacaggaatttatggaaggaatccgtaagatctgtgatgaaaatggaatcctgatgatctgtgatgaagtgcagtgcggaatgggaagaaccggaaatatgtttgcatggcagggatttggtgtaaaaccggatattctgactatggcgaaagcaatcggaaacggaattccggtcggtgcatttgcaatgacagaagaagtggcaaaatattctcttcagccgggagatcacggcgcaacttatggaggaaatccactggcatgtacagctgttaagacagtgatcgagatttttgaacgtgaagatattgtaggacatgtaaatcaggttgctccatatctgacaaaaaaactggatgagcttgtggatgagctggactgtgttgtcaaaagaaaaggaaaaggtctgatgcagggaatcgagattacaaaacctcttgcagaagtaaataaaaagacaattgaagaaggacttctgattattcaggctcagggaaatgtgatccgttttgttccaccgctaatcgtagaagaaaagcatattgatgagatgatcgaaaaactgaaacgtgcacttgcataagaaatcttatacataaaaaagccggcatttgcttatactatttctatagggaggtatgagcttatggccggttttttgattgcactgctatcaggtgcgctgatgagtgtacagggagtgttcaacgcgcaggtgacaaagacgacaggaatctgggtaagcaatgggtgggtgcaactttcagcattttttttgtgtctgcttgtctggctggcaactggaagagactctgttgcagcacttatggaagtccagccgcgctatatgttgctgggaggtgtgatcggagcagggatcacatggactgtcattaaaagtgtggatgccctgggacctgcaagatcagcacttttcattgttgtttcccagctggcggttgcttatctgatctcactatccggaatgttcgggatggaaaaagaaccattttcatggagaaaactgattggattattgatcgcagccggtggaattgttcttttccaatggaaatagacagttttgcgggtattgtaacaagtctgtaacaaagtgttaaattgtctattgtatttttgagaaaaattcgttacaatatttatgtccggttttaaggggaagtctgactgtctgagaacagtgaggcaatgggatgaagaacggatggaagaaaatatgcagatgccgtaaagggcagatgctaaaaggaattgtattgactttaactttggcttttttgaccatgggattgtgtggctgtgcagagaagcatgacgcagcggaagaaattgaagagttcacactggagggagaatctgatgtaggaaagaattcccaaaattccaaaacagagtcagaaaaaggatctcagggtggcacagatgcagaagaaggactgccggagacattatatgttcatgtatgtggagctgtgaatgctccgggggtgtacgaactgaggacagatgcacggatttacgaagcattggaagcggccggtggaatgacagaagatgctgccgcagattggatcaatcaggcagaagctttgagtgatggagagcggatctatgtgccaacgcaggaagaagcagaggagtcagcacaatctgtttccggtcagtgggcagatccgaatggaaatgcaggtggatcagtcagtgataaaattaatataaatacagccgcaaaagaagaattgatgaccttgagtggaatcggagcatcaaaggcagagagtattctgaagtacaggcaggagcatggaaactttcagagtatagaagatctcaagaagatcgagggaatcaaggatggtgtatttaataagataaaagacgatattacggtataggagcaggcagaagaacggccagaaagaggagtatgagcaagaagatattagttgttgatgatgaaaaattaatcgtaaaggggatccggttcagtctggaacaggaaggaatggaagtggattgcgcttatgatggagaagaagcattagaatatgcgagaagatgtgagtatgatcttgtacttcttgatgtcatgcttccgaaactggatggtttccaggtatgtcagcagattcgtgaattttcagatatgccgattgttatgttgactgccaagagtgaggatatggataagatccttggtctggagtatggtgcggatgattatatcacaaagccgttcaatattcttgaagtgaaggcaagaatcaaggcaatcatgcgcaggacagcgaaacgcaaggaagagccggccggaagtccggtgcttgtgaaaggtaatatgaagattgattgtgaaggacgccgtgttttcatcggagaacgtgagatcaatcttacagcgaaggaatttgatgtgcttgagcttctggcaatgaatccgaataaggtttacagtagagagaatctgctgaatctgatctggggatatgattatccgggtgatgcaagaactgtagatgtacatatccgtcgtttacgagagaagatagaacagaatccaagtgaaccaaaatacgtacatacgaagtggggagtgggttattatttccaggggtaagaatacattttcatttaagaaaaagatctttaacaatcttagattccgaatttttattatggtgcttcttgccgggcttgtgcccagcgtagtagcactatttggaatcgtaaaagtctatgagtcacgtgctgtgtcacttcgaacagcagaaattcagaatcaatgtacaattttaacgaatcagatcagtgcgagccattattttgaggacacctcacaagaggtggtcaatgacagcctgaatcagctgactaacatttataacggaagagttatggtaattgacgatcagctgagggtagtcaaggatacttacagtctggatgagggaaagctggatgtatctgaaagtgtagtgcgctgtatgaaggggacgagcacgaataattatgataagaagaatcattatatcgaggtgactgcaccgattgcaatacccggagatgatcagattcgcggtgtaatgctggcaagtgtttcaactgatagtattgaggattctctggatgtattatatacacaggggagcgtgattattggtcttgtgatgatttttctgacgattgttgcagtgtttgcagcagatcgtgtagtacgtccgctgcatcagattgcagctacgatcgagaatgtaagtgcagggtatagcgacgatgttttgcatgtggatacatttacagaaacgaaaagtatcagtgaagcaattaataagatgatgggaaggctgaagcttttggatgattccagggaagaatttgtatccaatgtatctcacgaactgaagaccccgatgacatcgatgaaagtactggccgattcacttctggagcaggagaaccttccggttgagatgtatcaggaattcatgggtgatattgcaaaagagattgaccgtgagaataagatcattacagatcttttatcacttgtgaagatggacaagaaggggcagacgctgaatattgaatccattaatatcaatgaacttctggaacagattttgaagagattaaaaccaattgcagagaaaaagaatgtggagatcgtaatggagagctttcgtccggttacggcggagattgatgagacaaagctgtcacttgcgatttccaatctggtagaaaatgcagtaaagtataatcatgataatggatgggttcatgtatcattgaatgcagaccacaaatttttctatgtaaaagtagaagattcaggaattggaattccgaaagaggatcaggcgcatgtttttgaacgtttcttccgtgtggataaatctcattccagagaaatcggaggaacaggacttggacttgcaattgcgcgaaatgctgtgattgcacatagaggtgcgatcaaagtattcagtgaagaaggcgaaggaacaacatttactgtgagaattccattgatctatacagcttcttaggagaaaagttatgaaaaaaagaaaagggatcgcagtgttgcttattctgattttttctctcgcagtaactgcgtgtggggatcgttatggagtaaaggaaggcgaatcttacatttactgtatgaatacagataagacaggacttgtaaaggttgcagctaagatcagcggcaattctgcgataaaaaaggcggaatctgtaatcgatgagatgaagaaaccaacgaatgaaattgaatatacacaggcaattccggaacaggtgaaattgctcgactgtgctttaaagggcagtatccttgagattaatttcagcgaagaatattatgaagtgaaatccttagatgagaaactgatgcgggcagcaattgtgcagtcactgcttcagattgacggaattgatgcggtatctgtccgtgtggaaggagaaccactcaaagacgatgaaggaaatgaggtcggtctgatgaatgaggacgatattgttgacacgacaggttcttcgttaagttcttatcagagtgatacattgaagttatattttgcagatcagaatggatccaaactggtcaaacaaaaggtggacgttcattacagcagtaatgtcttgaaagaaaaactgattgtagaaaagctgatgcaaggcccatctgaggagggcgcatatccaacgatcaatccggcggctaatctgttgagtgtaacgacaaaggatggaatctgttatgtgaattttgacagcacatttctgatcagtgcgtatgatgtactgcctgagatcacgatttattctattgtggattctcttgtagagggaacaggagtaaggcaggtacagattacgatcaatggtgaatcgaatgcaaaatacatggagaaggtggacttgtcacagccattgaatgaagagcaggactggatagcagcagataacaaagaatgagaaaacgcccgctctgtatggtatgtcttatactgcttgccatacagcttgtaagagtgagttttttacagaatacaaaagatcagaaaccgtcccttgcagaaacattgatttcagatgagaaagatgtgatttgcgagggcacggtttataaaattgaaaataaatcacaatcaactgcaatttatctgaaagatgcggttgtttcttgtacagatcaaaagagtaagaatcagataatcaaagaaaagaaaatccttgtaacaataaaaaataataaatccggtaaaaaaatcagaatgaaaataggacagaagctgaatgtgtgggggacaaaacagtcgtttcatccgccaaggaatccgggtaattttaaccaaaaaagttattatcaaaaacagggaatccatgttggggttttaacaaaggcagaacaggttgagatagttttgtctgaaaaagacaagaactggattgtatcacgatggaatagcatacggaatcagctggaccggctgaaaaattactggaactggaagattgtaagccagatgggaaaaacacatggcgcgatgctttctgcaatcttgttgggagaaaaaagcggacttgatccggagatgaaaaaattgtatcagaagaacggattaggacatctgctcgcaatttcgggattacacatgtcactgatcggaatgtctgtttaccggttattaagaagaatgggaaattcatttctgttttccggaattgccggaggagggattctgtttttttatttggttatgacaggtccacaggtatccagtcttcgtgcacttcttatgttttttatccgcatgggggcagaaattaccgggagagatgtggatcaacctacaagcctggcggttacagcagctattttaggcatatatcaaccgctgtatctgttagatgcagcatttttactttcgtttggtgcaattcttgggattttattattgtatccaatttttgaacagaaaacacgtttgaaagcatgggaaggatttaagattagtttagctgttaatggaatgcttctgggaatcatgctgtattattattttgaggtgccgccgtatgcactcgttttgaatgttattttaattccgttgtttccatttgttatgttgacaggtataggtggaattttgttttcagaattatcgggaaccgtaggaaaaattggattcagaagctgtgattgcctgttgtccttctatgataaattatgtgagctgacatcagcgcttccgggcagcaggatcgtgaccggacagccagagttatggtgggtgcttatttactatggtgtgctgttgtttttgtgcttcctgtttcatgcaatgaaaaataagacagataaccggagaaaacaggcgggattttcacttcttgtttgtattgtcatagcaggatcgatctgcggatgcggaatactcaataatgattcaaaaaaccttcaggtgactgttctggatgttggacagggggactgtatttttataagagacagggaaggaaagaaaatgctggtggatggagggagcagtgatctgtcttctgtcggtacttaccggatagagccgtttctattatcgcagggggtcagaaaactggagtatgtttttgtgacacatggtgatgcggatcacatcaatggaattcaggaacttctgcaaaatcagaaacagggagtggaaatcgatgcgcttgttctgccgccggaagaatatatggatgagaaattactccatcttgcagaaatagcgaaagaaaatgggacgagagtgttgacaatttatgccggagaaaaagtaggaacgtatttaaaatgcatcgctccgttgacaacgaggaaaaacgagcgtattcgtggcaaggaagaggaggtacctcgtctggaagcgggaaatgaagcatctgttgtacttgaattgaaggatggggcgtttcaaatgcttctgacaggagatttggaaggaagaggagaggaacagctggtggaaagcggagcattggaaagctgtccaatcttaaaagcaggacatcatgggtcgaagaattcgggaagtgaagaatttcttcagattgtgaaacccagcttaacattaatctcagcggggatagaaaaccgctacggacatccacatgaggagacgctggaacgcctgcaggaaatcggaagtgaagtattgtccacgcaggaatgcggtgcaattacactaaggagcgatggacgaaaaataaaggttcacaagtatttataaaacaggaataggtgataaaaaggctcttgtcaaagtgttggttattcatttataatagaatagttatgaagaccttaaatgaagatttaaaatcaggacaatttaagcaggtatatcttctatgtggagaagaaggatatctgaagaaacagtataagaaccgttttgtgaaggcaatgattccggaaggtgatacgatgaactattcgtattatgaagggaagaatacgccagtgaaagaagcaatcgatcttgcagagaccttacctttctttgcagagcgcagactgatcgtatttgagaatacgggattttttaaaactgcggcaggggcagatctggcggattatattaaggacatgccagagacaacctgttttatctttgtggaagaagagattgataagagaaataagctctataaagcagtgaaatcaaaaggatatattgcagagctgtccacgcaggatgcaggaactttgaaacgctgggttgcaggtctggtccgaaaagagcagaagcagatttcggagtctgtgatagtttattttctggataaagttggaacagatatggaaaatatccagggagagctggagaaagtattctgttatgcactggagagggatacgatcacgaaggaagatattgatgctgtctgtgtgacgcagattacgaatcatattttcgagatggtagatgcggttgcagccggaaatcagcagaaagcactggatctgtattatgaactgctggctttaaaagaaccgccgatgcgtattctttttctgctggtgcgtcagtacaggatgcttttccatgtcaaggcacttgcaaatcagggatatggaagaaaagagattgcgtctaaagcaggcttacatccatttgtggcaggaaagaacatggaacaggcgaagcggtttaagatgggacagctgcgccgtgtgatggaagaaggggcacagttggagcaggatgtaaagacaggattgctgacagacaatcttgcggtagaactttttattgtaaaacagtcagaaagatagatggaggtaagaagtattgtcaacaattgatcagagtcatattagaaatttttgtattatagcacatatcgatcacggtaagtctacactggcggatcgtatcattgagcagacaggacttttgactagcagagaaatgcagtcacaggttctcgataacatggatctggagagagagcgtggaatcacgatcaaagcacaggcagtccgtactgtatatcaggcagatgacggagaagagtatattttcaacttgatcgatacacctggacacgtcgatttcaactatgaggtatcccgaagtctggcagcctgtgatggagcaattcttgttgttgatgcagcacagggagttgaggcacagacgcttgcgaatgtatatcttgcactggatcatgatctggatgttatgccggttatcaacaagattgatctaccaagcgcagagccggagcgtgtaaaagaagagatagaagatgtgatcggaatcgatgcggagaatgcaccactgatttctgctaagacaggactgaatgtacatgaagttctcgagcagattgtacagcagattccgtcaccggtcggaaatccggatgcaccgcttcaggcactgatctttgattccaagtacgattcttacaagggagttattgtattctgccgtatcaaggaaggtactgttaaaaaaggtacaccgatgcttatgatggcaacaggtgcgaaagcagaagttgtagaagttggaacttttggagcgggacagttcattccatgtgacgcacttgaagcaggaatggtaggatatatcacagccagtcttaagaatgtaaaggatacccgtgtcggagatacgatcacgaatgcagagaatccttgtgcagaaccacttccgggatataagaaagtaaacccaatggtatattgtggactctatccggcagacggagcaaagtatccggacttgagagatgcacttgagaaactgcagcttaatgatgctgcgcttcagtttgaggcagagacatcagtagcacttggattcggattccgttgtggattcttaggactccttcatttggagatcattcaggaacgtctggaaagagagtacaatcttgatcttgttacaacagcaccgagtgttatttacaagatccataagacaaacggtgatgtgatcgatctgacaaacccgacaaatatgccggatcctgcagagattgaatatatggaagagcctatggtaaaggcagagatcatggtgacatccgagtacatcggagcgatcatggatctgtgtcaggaacgccgtggaatctatcagggaatggaatatattgaagagacaagagccgtgttgacatatcatctgccactcaacgagattatttatgatttctttgacgcattgaaatcaagatccagaggatacgcatcttttgattatgagatgcttggttatgtacgttccgagcttgtcaaacttgacattctgatcaacaaagaagaagtagatgctctttcctttattgtattcgaaggaagcgcttatgagcgtggaagaaagatgtgcgagaagctgaaagaagagattccaagacagcttttcgagattccgatccaggcagcagtcggaagtaagattattgcgagagagacagttaaggcaatgcgtaaggacgttcttgcgaaatgttacggcggtgatatttcacgtaagaagaaactgcttgaaaagcagaaagaaggaaagaagagaatgcgtcaggttggaaacgtagagattccacagagtgcattcatgagtgtcctgaagctggatgagaactagataaaagaaggaaggaaaagatactgtttttatcagacagtatctttctgtatttaaagatgaaaaagagaaatttagaattatatctccatattccgttctgcgtaagaaaatgcaattattgtgattttttttcagcaagtggaacagaggaagaacaggcagcttatgtcagtgctatggttcaggagattcagagttatcaggaattatctggagagtatgaagttcagaccattttcctgggaggcggaacaccgtctcttctgacaccggaacagatagaacagatttttaatgcaatttatcatacattttcagtaaatgagaatgcagagatcacaatggaaatgaatccgggaacagttgatatcgagaaacttcatgccatgaaagcagcaggggtgaacagactgagtattggacttcagtcggcacaaaatgaagaactgaaaatgctaggaagaatccatacatttgaagaattccttgagacttggaaactggtagaacaggctggattcaaaaaccgaaatatcgatctcatgtctgcgcttccgggacagacgatagaaagctacgaagatacactttcaaaagttctggcacttgagccggaacatatatccgcatatagtctgatcttagaggaaggtactgtattctatgactggtatgaaaaaggaaagttagatcgtggtgcatggaaacttccatctgaggaagaagaatatgcgatgggagagttgacaatactaagactcgcagaagccggaatgtatcgatatgagatttccaattatgcaaagccgggaaaagaatgcagacataatctgggatactgggacagaacggaataccttgggattggagcagggtcctcctcattgatcaaaggagagcggtttgatcatattcgagatcggaaagcatatattgaaaagattagaaatggcgagtcgattcttattgacagagaaattctttccgtggaatcgcagatggaagagttcatgtatctggggcttcgaaaagtagagggagtttcgagaacagattttcagaactgttttggaaagaatgcaaatgatgtatatggaaaaattcttgataaattagaagaagaacaattgctggaatttagtggagatcgaatccgactgacgcatcgggggatggatgtcagcaattgtgtgctggcggagttcttgttttaaaggctgaaaaccaaaattgtgcaaaatcaaccaaaaacagtcatgaaatttgttgattagtttgattgactatgaacgagtttgaacgtataatacaagcataaagaaaaacaatggtcagagagaaggagaatgcaaaatgatttacacagtaacatttaatccgtcattggattacattgtctctgttgaggactttaagcttggacttacgaatcgaacgagttcagagctgatccttccaggtggaaagggcatcaatgtttctacagtgcttggtaatcttggtatcgagaatactgcacttggatttttagccggatttaccggaaaagagattgaaagaagactcaaagagatgggagttgcatctgattttattgagatcaatgaaggtgtatctcgaatcaacctgaagttaaaatcaatcgacggaacagagattaacggaagtggaccggtgatttctccggaagatgtagagaagctgatggagaagcttgacaaacttggagaaggtgatgttttattcctggcaggaagcattccgacttctatgccggatgacatgtatcagaagattatggcgaagcttgatggcaaaggtgtcatgatcgttgtagacgcaacgagagatctgctgttgaacgttcttgaatatcatccatttttaataaaaccgaacaatcatgaacttggagagatttttgatgtggaacttctgacaagagaatctgttgtaccatatgcaaagaaactgcaggaaaaaggagcaagaaatgttcttgtatccatggcaggagaaggtgccgttcttgtagcagaagatggaagtgtttatgacactccggcgccgaaaggggaattaaaaaacggtgttggagcaggagactctatggtagccggatttatggcaggctggatggagaaacatgaatacagacatgcattccacatgggagttgcatcaggaagtgcaagtgcattttcagagaatttggcaacaaaagaggagattgccggagtatatcaacaggttgtaaaggaggagcggtaggatgagaattacagatttactcgataaaagaagcattgcctttgacaagaatccggcgaataagcaggaaactttggatatggccgtggatttgatgtgtgcaagtggtaagatcaatgacacagaagcctacagaaaacaggtttacttaagagaagaggaaagcacaacaggaattggtgagggaattgctattccacatggaaaaggtgattgcgtaagcaagccgggacttgcagcaatggtcattaaaaatggtgttgatttcgattctctggatggagaaccggtaacattgttatttctgattgcagcaccaaatacagaggataatgttcatctggaagtacttagtaaattgtcaatgatgctgatggatgagcagtttacagaagctctgagaaatgcaacctctgcggaggaattcctttctattattgataaagcagatgatgagagagctgacattgatgagcagctggcagatacaggaaatgcagagagtgatttcaagattcttgcagtaacagcatgcccgacaggtatcgcacacacatatatggcagcagaaggaatcgagaaagcagcaaaagctgccgactgtttcgtgaaaatcgagacaagaggaagcggtggagcgaaaaatgtgctgacagatcaggaaattgctgatgcggattgtattatcgttgcagcagatacacaggttccgatggatcgttttgacggaaagaaagtaatcatttgtcaggtatcagacggaatcagtaaagcagatgaactggtagctcaggcgaaagccggaaatgttccggtcttccacggaaacaatccggctgcagcatcttcttccgcaggaaagaaaagcggcggagtcggacatcagatttacatgcagttaatgaacggtgtttctcatatgcttccacttgttgttggaggtggtattctgatcgcgatcgcatttctgattgacggattgtgcgtagatctgaatgcacttccggctgaccagagagcaaattttggtatgatcactccggttgcggcagtatttaaacagatcggtggaacagcatttggattcatgcttccggtacttgcaggatttatcgcaatggcaatcggtgaccgaccggcgcttgcagttggtcttgtaggcggtatgatggcagcaagcggaaaatccggattcctcggagctcttgtagccggattccttgcaggatatatcattgtacttcttcgtaaagtatgcgacaagcttccggatgcactggaaaaaatcgcaccggtacttatttatccattgatcggagttctcctgatcggacttgcgatgatgtttgtaatcgagccaatcatgggtggaatcaacacaggcctgaataatgcattgacaggtatgggagattcaagtaaagtagtattaggactgattcttggaggaatgatgtccatcgatatgggtggtccgttcaacaaggcagcttatgtattcggtacagcatcaatcgcagctggtaattatgatattatggcagcagttatggttgcaggaatggttccgccatgtgccatcgccctttccacactgttgtttaaggataagtttacaaaagaagaaagagatgcaggtccgacaaactttatcatgggtcttgcatttatcacagaaggagcaatcccatttgcagcatctgatccgctgcacgtacttccatcttgtatcatcggttcagcaattgccggtggaatgtcaatgctgtttggatgtacactgatggcaccacatggtggaatcttcgtattcccggttgttggaaatgcagtaatgtatcttgtttccctcgtagtaggaacagtcatctccgcagtactgcttggactccttaagaagaaagttgcataaaacaataatcatttggatgaaatgccgaataaaataatttgtcaaaaccaataaaagaaatataagaatcaggacctgaagttgtggatctggaagcggatgcttaagattcatggcttcaggttcttttttaaaaggagatactaaaatgcttacagaacaaagatatcagattatattggatttgctgaaagagaagaaaagtgtcacagcgacagaattaaaagaaatcttagatacatcagagtctacggtaagaagagatattactgcacttcataaagccggaaagcttatcaaggtatttggcggagcggttgcgctagaagatgaaggcactgtctctgcttatgaaccgacagttgagcagaagagcgaactctatgtgaaagagaaaagaaaaatcgctcaatatgcggcagaactgatcgaggaggaagactttatttatctcgatgcaggaacaacgacaggttatatgattgatgctcttggacataccaatgcagtttttgtgacaaatgctgtttcacatgcacagaggctggcagctaagggaatcaaagtgtttctgattggcggagaacttaagaattctacagaggcagtgatcggtgcccgggctatgaagaatctgcaggaatatcattttaccaaaggattctttggagcaaatggaatcacaaaagcagaaggattcacgacaccggatgcgaatgaggctctggtgaaacaaacggcgatcgagagatgcaggaacaggtttgttcttgcagatcattcaaaattcggatctatcagttcagtgacattttctgcttttgcgaatgcaaagattctgacagattgctgtccggcagattatcaggagatggattgtgtgataggggtggaagaaagctcgttaatttgagttcatttcttagtgggcaaggtgaaataaaaatggatacaagtactgaaaaacataattttccacattcgaaattagagaaagaagaggatatcttagagcagttgtgtatctggaagacacagaatatctcattagatctggaacgaatctgtcagcatttcagaatggagaaaagagatatagtggtgtgtctcaagaggatgcaaaaggaaggatatcttgaaaaattaattgcaggacaggagatacaattgacagattatgggctatctgtaggaaatgattgtatttaccggcataattcaatcagtcagatgttacagtttattggtgtaaatgaaaagacggcagaccaggatgcatgtcggattgaacacattgtaaccgatgaatctacgagagcaatctgccagtttatcaattatgaaaacatgtactatgagagaagaataagaaattcagaactgacagaccgttatgaaaaaggaaactatattttttcaatgcagatgtatagtctggagcaacgctgtcctagaaaattaaagaaggaatattattgttattccaggaatgtaattcttgaaataacaaaaaagggttattttaaattacagaaagtgagcagtctgggaaacaaaagattatggtataagaactatgataaacagtgggttttagctgaacaaggagcacaaggagaacagattccatccagagtctttgaatttattataaagccgaatgacagagtgattgagggaaaacttctgattgcatttatgccggagaatcagacagaaccggaagtgtgggactgtggacaactagaagtggaaatatggtagaggaattgagtcatgaccaggaaccagacagtagaaattaatcatctgacagtattacaaattcagtatctgacagaattggaacaactggaaaagggaagagggacaattggtgcagttgctgcaaaatgtggcgtaaaacatccaacagtaagccgattctttaaaagttgtatagaaaaaggatatctgaccgaaagtcttgaattcacggataaagggaaaaagatgctccgttggcatcagaaagtccaaaaagacgttagggagtatctggaacgcagtgggattacagaaggaatcgatgatgttctgaaaggaatgatcgaaaatattgattacagaagactggaagaacttacaaaaagccatatgcgaatcaataaagaaattcgaatgcaaaaagaacagaatcagattagaaacatagaagaacttgtggagtatggcaatcatccagttgtgatttctatcctgcagacagatgggagtcgtcgatccatggcagaaaatggattcgaacctctcgggattgtgaaacataataaaagaggctgttatctcgaattgacaatcagagaaatgcatgcggtatctcggattaatggaaaacagatgaaagggcatcttacctgtctgaaatatttgcaaggggatatgtataaaattgcagatgtaaagaacggaaggataaaaatacctttgaatgcatgtggttttcagaattttgaccatggaacgttacgtggaaatcttttgattactgtgtccagttcggttggagaagcacatatgccagagagtacagcacgattgatttttaagctgtaagtgttaaaaatgcgagaggttaacagataatagatttgataaatatgtcttaaaagaagtaatgtatgtaaaatcaggagcatatagtacttctttttttatggtataatgccgctgttttacaatttattaacaagtaaaaagaaaaaaatattgataaaaattatcaaataatatgaaaaataacgtatttataaggagattagaaaatgaagatttcgtacttaagggtacgaaataagtggaaaaatattgacagtcagaaagagtataatatatattttaacaggataatagtcataactaacaacaaatggaagaaactaaccttgcgtgttcggaaatgaccatcattatcttataaatacagatgaaaataagtgataaaggagaggagtatggagaagaaaaataaaacgagaaaaaatcctttaaaaatagtatggattgtgcttggatttctttgcctgggacttggtacgataggaattgtacttcctatcctgccaaccgttccgttttatatggcaacactattttgctttgcaaagagttctaagaaattgcacgactggttcataggaacgaatttatataagaaacatctagatagttttgttcagaaaagagctatgaccatgggaacaaaatgcaagattatcggaatggtaacggtagtcatggcaatcggctttatctgtatgaagaatgtaccaattggaagaatctgcatcgcagtggtttgggtatgtcatttgttatatttcttcctgaaaattcaaacgataaagcctggggaacaggaactggaggcagcagaataaatggattcaatcgaaaagaagcggcagaaggaacagcgcgttgtggaagaaatgatccggctgtactgccggaagaatcataaggaatatgacaaaacgacaggaaagatgtgtccttcctgtcaggaactttcggattatgccagactcagaagccagaaatgtccctttatggaagagaaaacattctgtgcgaactgtaaggtgcattgctacaagccggagatgagggagaagattcggaaggttatgcggttttccggaccgaggatgcttctgtatcatccggcacttgcagtgtggcatttgatatgcagtaaaaaagaatcgaagaaataaacaaaaggataagatttttatgattaaaacaagactggtgggacttttatcccacgcaaaaaagtatattgtttacaccatcctgtggcagtgggcagcattgctctcacaggtgctggcagtatttacgattgctgacctgttggagcgcgtagtctatcgtgcggtgacagtgccggtgattgagaagacaatcatgatcctcgcactggtggtgaccatacgatttgtatgcgaacggatgggggcaaggtcttcgtatcttgcatgtgtagatgtaaagagaattttaagagaaaagatttatgacaagatgttgaaactgggggcatcctacagtgagcaggtatcttcatcagaagtggtacaggtttcgacagaaggtgtggagcagttggaaacgtattttggaaaataccttccgcagttgttctacagcctgattgcaccgttgacattatttctcattctttgcagagtgagtgtaaaggcaagtgtgatcttgttgatctgtgtgccactgatcccgatctcaatcgtagtggtacagaagatcgcaaagagattattaaataactattggagcatctataccggattgggagattcgttccttgagaatttacagggacttaccactctgaagatttatcaggcagaccagcagaaagcagacgagatggatgtggaatcccagaacttccgcaggattacgatgaaggtgctgaccatgcagctcaattcaaccagcgtgatggatattgtggcgtatggtggagctgcgatcggtatggcagtggctgtatctgaattcttaaagggaaatattagtgtagcaggaacattatgtatcgttctgcttgccagcgagtttttcctgccgctcaggctgcttggttcgttctttcatatcgcaatgaatggtatggcagcgagtgataagattttcaagattttagatttaccagaaccacaggcaggagaaaaaacactgccggacggagcgttagatattacattaaaagatgttcatttttcttatgaagaggacagagagattttaaaagaaatcaacttaaatcttccggcaggaagttttgtatcactggttggtgaatccggatgtggtaagagtacaatcgctggaatgcttgcagcaaagaaccggggatacagcggagaaatcaccgtcggtggtgtaccgcttaacgaagtgaatgaaacaaatctgatgcagagggttgttctggttcgccataacagttatctgttcaaaggtacagtagaagaaaatttgaagatggcaaaaccggacgcaacgaaagaagagatggaagctgttcttcagaaagtcaatctcttagggttcttgcagacacaggatggcttacagacacagttattggaaaaagcaagtaacctgtccggaggtcagtgtcagagactggtgattgcaagagctttattaaaagaagatagcaaggtttacatttttgatgaagctgcatctaatatcgatgtggaaagtgaagaactgatcatgaatgtgattcatgatctggcaaaaacaaagacggtgcttctgatctcccatagactggcaaatgttgtgaagtctgataagatttatttcttaaaagacggagaaatcaaggaaagcggaaagcatgaagaactgatgagccagaatggtgcgtacagacatctgtatgaaagtcagatggcattggaaaactatggaaaaggagaagtggcataatgagtgaaaatacgaatacaaccaaacgcagaagtgccatccagatcatgggaagtctgattggtctggtaaaacccctgctccatatcatgctggcagcaatcatccttggaacattaggttacttgtgtgcaatcttcctgacgatactggcagggcaggtcatcatgcatggacttctgacaggggtagccggaatgattgttccggtgaacaatatgtggttagtatttaccccggtaaaaacgattatcacagttatgatcgtaattgcagtgcttcgtggaatcctacattatatggaacagtattgtaatcattttattgcatttaagctgttggcaattatccgccacaaagtgtttgctgccttacgaaagctctgtccggcgaagctggaaggacgagataaaggaaacttgatttccattattacaaccgatattgaattactggaagtgttctatgcacataccatttcgccgattgcgattgcaacattgacttctatcattatggtgatttttattggaagatatcactggttgacaggtctgcttgcactggcagcttatcttattgtcggtgtagctatcccaatgtggaatggaaaacgtggcagtcagaagggaatggaatttagaacaaactttggagaactgaatagttttgtcctggattccctacgtggactggacgagaccattcagtatggacagggtgaaaagagaagagagcagatgagcaagcaatccaaaaatcttgcaggaatgcaggaatcattaagcaaaatggaaggctcacagcgttcatttacgaatatggttatcctgcttgcatcttttgggatgctggcattgacgatctggctgtacgacaaaggtgcgatgggattcgagggaatcttaacctgtaccatcgcaatgatgggttctttcggaccggtagtagcattatcaagcctttccaacaacctgaaccagacactggcaagtggtgagcgtgtcctttctcttctggaagagacaccgcttgtggaagaaattccgggtgatgtggaaacttctggtgatcagggtgtgaattctgaggagagtgcaaatcatgcattcacaggagtagaggcagaaaacgtaacatttgcatacggagaagaggttattttagataactattcactgaaattacagccgggtaaaatcacagggattcatggtgtgagcggttccggaaaatctacacttttaaaactgttgatgcgtttttgggatgtgcagggtggaagcatgtcggtagacggtacagatgtccgaaagattccgaccaggcatttaagagatatggaaagttatgtcacgcaggagacacacctgttccatgattccattgcaaataatatcgcaatcgcaaagccgggagcatccagagaagagattatggaagccgcaaagaaagcgtctatccacgattttattatgacacttccgaaaggatatgatacggaagtcggagaactaggggatacattatctggcggtgagaaacagagaatcggaattgcaagagcatttctccatgatgcaccgataattctgatggatgagccaaccagcaatctggactcgctgaacgaaggaatcattttgaaatcattaaaagaatcagccagaaagaaaaccgttgtcctggtatcccaccgagtatccacaatgaacgtggcagatgtggtatatgaaatggagaatggaagaatttcatagctaaaacatttgaaatagcatcactaaaagcggcatggtaacaatagaaaacagtgttgtaacaacattgatcgcactggcatattgagaatcatttccgtatacttgacacatctgggttacagttgaggcagatggagtaatgattgcaagaaatacaatgagcatgattttatctccatctgctgaaaaagcagcgagatggctcaacttaatcagaatcagtgcaaatacgggtaatacgattaaccgaagaatagagataaaatatactttcttatttgtaaaaatctgtttcagatccataccggcgaaaagcatacctgttacgatcatgcttgcaggtccgatcatattaccgacagaacttatcgaatcatttatgatttccggtaaatggatttttgtaaagaaaagcaggattccaataaaaatagaaatcatatttatattgaggacaatctttttccagtcataagaagcctcttggctgataattttcttacagtgagtccatataaaaatgagttgcacgctcatgaatacacatccatataatacccactcttttcccaagataaaagttacgattggtacgatcagattaccagaatttgagtaatagatagaggcaatttctacttcgtttaaatgaaaaagtttccctaaaacagagacaacaataagaaggacaatttgtgtgagaacagatgctataaaagccagtagtaatcctctcacagtgtcagaagtatagtcaacttgaaaagcgtttataattacacaagggatgaccagataaaggatgattttggataataccttactgtcggtatcttcaacaatacctgtttttacaattaagtatcccataaagatcataagaaaaagctgtgcaatttgtttcatgagaagtatactgatggtcataaaattatctccgtattcttgtaaagtctttcataatagaactgatttaaaccataaataagtatagtactttttcaagaaaagtaaagtgtgtaagtaaaatctgtatcgcatacgaaaatgctccttgatatgttgcgcaatgatccaacaattacgcaaaaagaaattattgaacgagtctctttgtcgagaagcactgtaggaaaaaatatttgattaaatttgtcacttttttaaattttgaaacgttttattataaaaggaattgagtaggatatcgggggaggaatgtgaaaggtatgcttgaacaagcttcagttgaggagatgtttcagaaatatggagaaatgctatataaaatatgtatcgtaatgcttaaaaatacgtatgatgcagaagatacagtgcaagatgtattaataaaatatatgacaaaaaagcctctttttgaaacttatgaacatgaaaaggcatggttaattagagttacaataaatctttgtaaagataaattgcgtttctataaacaacatccatatataaatatcgaaacaattaagactacatatcctgaggatagtatagataatcagatacttgctatccttttagaattaccatctaaatataaggaagtacttttattgtattatgtagaaggatataaatgctttgaaataagtaagattttgaaaattacggaatcgactgtgaaaaagcgtttggaacgaggtcgaaaattattaaaaaagaagttgggagtgaatgagtgtggataaaaattcaattaaaagtgctgtgactggaattgaatttacagaagaatccaaacagagaatttttgatgggattgaaagaagaaaaaatttgaaacagaaaattcacataaagagaattacaacggggatagttgcaactgccatagtttttttgtgtgtgtttacaaatatcttgcaaaaaaataaatcaataatcacagtttatgcgatgacgcaagatggaaatgagaaaggttctgttttaataccagaacataaagaaactttaaaattgatggaaacgccggtaggaaatggttatatttttcagatagatataccagagaattatatgtataattgcaagtcatcagaaaaagaaaatagtatttttacaatttaccaaaaagggaaaaaaatatattggattcccgagtcaaatacatttggacaaatttatagtagcgaaaatgagaagttaacaaatagtagtccaaattgtgtgaacgaatgtgaatttgaaatagtagtttacaatgaaaataaagaaatttcatatgaggaggttataaaatttgaattagtaaatggagaatgtattgttacattaaaaaagtaaattattgtttggaaataaaaatatgtttttggggtagaatatgaaaataaaaattaaatttatggtaacttttatggcattggttttaagtatttttacagctatttctgtatgtgctgcatcagaagatccgtatcagacagtgattgataaattgaataaagagtattcgatggatattcattttatgaactcggaagaattacgcacatattcaatggagaaacagcaaaagatagatattacaccagaggaattcgaaaagaatttgagggaacaaattattgaaaacaaccgggctaaagctgaagctgataaaaaatttgcagaattagaagcgaaggatattattgaaagtggaagtggagtttgtaaacctacaaatacaactacagcaacagctactgttacaaagaggtaaagcggttccaagagcaacagtatatgtggagctttgggcaggcagtggaatgtagaacaagatttatgtagaaaaaattatagaaggctttgggtcatttctattgacccaaagccttcttcttaatcaatcccatctgtctcaataataaaccgtacttccccggtctgttcttctaacttaccgcaataattatcgtattcagcgtccgcttctttgacagctttcattcttttggagagattcttcagatcatccccgcctagtttttcaagttcctgaattccttctttatcaaagagagtaagtccttcagaaagagaagagattccttcggcaagggttgtgtatccttcttttagttctttcccggctgtgcccagtttagtagctccttgagagagcgttgagctgccttcagacaattgactgattccctgttggaaagaggtaagtccctgagtgagctgtaaactgccggcagataaagctgaaagtgagctctgcaaagtctttaatgtctcactgagagaagaaagactctgcattgcctcagtaaaggaaccggcaccggaagacatctggtcaagcgtagtatggcaggaagcaatcagttccgtcaggctgtttaatgttccttccgtggcggatttcagctgatcgatatctgtggaggaagaagaaagatcaaggttctgatcaattgcagatgcaatcgtatcatttatttcattcttcaattgtgacatcttatcgttgacagcatttttagattcttctgataattctgaatctgatgcagtttcagaaacaatctgatcgatcgcagactggacagcatctgtcgcagcagttttggactgttcttttgcatcttctgtgatagaagatttcagagtatcccagttgatggatgcgaaagaagattttgcctctgcaagagaggagtcaacagaatccagctgttggctgagtgatttgatctgttcctgaagtgctgaaagtgtctcagcagacggaagagaaccagaatccgtgcttatctggacagagagagcagaattcagctgttcaagaccattttgaagagaagaagcacctgaaaccagctttccagaattttcattaagtgcagttacaccgtcatctagagtgtctgttccttcggcaagttgtgagacaccgtctacatattgcccaagataagtttgataagtagaagcaccgcccagcagctgcgctgctccgtcagcaagtttgccggatgcatctccgagttcctgcaggctgtcagcggcatcctccatatcgtcaaaggaatcctcttcgagatcttcaaacagaccggaggagaccacagttgcagtaaagtccatctcaaaatctgttacatctgcagttacttccactgactctgggatagagacatctttcgtaggttcgtaatcagtgagtttcagactgtctttgagtcccgggcaggcataaccgacaacaacgctctggtcattcatggtaaatattttaccatttgttacctggatattagaagcggtgtcttccggaaggatcatggcggagatcactgcgaatggaaccggagaagtcatctcttcaccatttacggttacattttcttcggtagtattttcataatcaaaacgaattccaagtttgccgctttttccggagagatcttccggttgtatagattttccatccagtgtgtaactgatttttacatttacaggaagttcttctgtagaagtaccttcataatgaatgtcctcccctttgttttcccaggtaatcgttccgtcagaggactgggtgaaggactcatttcctttcgtattttttatgtctttcagagttgagaagtctttgatttcctttgatgttccgttatttttcaagtctgtctggactttgatctcatttatcgttccgcttgcatcagcttttacatataccgtttctgatttgtcagcatctgaagctgtggcagctgtctttgtgtcagtggagcatccggtcagacttgtggcagaaaccaggacaagactggcgcacagaccgggaactaatttttgtaatagttttcttttcacgagaaatcctcctttcaaatggtacctgcactgttatgcctaacttagaagtttgcaggttactgttcactcccgtgtcaatcacttcgctgattgacacggaggatgcatggcgatttaaaatggcgagatgcgttgctggtcgcacatcgtgtgaacagtaacgtccttaggcagcagatgcaggtacagtcacgattattcaatattttttagggcctgatccataggaactttcttgattctgcggtattcaatcaatgcaacaagcaggtaagttccaaatcctagcaggaacatttttacatacaggaccggatcaatatacaacgggatccaaccggaaatactgctgatcataattccgcggaagagagcgttcatgagaactgtttctatcggaaaactcagaagcaggaagatcacgaccataatggttgtagacagcagatacagactgctgatctcccggtcagagtatccaagtatttttgtcatagagattgactgtgcattcttttcgataatgatctttgacaaaagatagatcagaatcataaagagcacgattgaaaatccgtctaacagatacatcatgcttcccatcgaaacattcaattgtctggagattttagacagactgtcgaggtcgatcacagagccgatgtatttctggtcaatatcggttatctcgctgtcagagagataaccactgaagtaatcggaaccaaggtcaaacagttcattgaatgtatcctgtggaagaaaaacggtcagaccaccttcataatcgtagattccttcaatagaaaacgtgtatgtatcatcttcataagcttcctttaaagtaatttcatcaccgatatccagaagatatttatctgcataagcagaagagatgtatgcaggagttgcatcagaagcatcctctttctttgaaacatctttgtcagatacagtttcctgaaaatcaatcggaagatagcggctgttatctgcaagtccatagagcaggatttcctcttccttatatttcttatctgttgttttcagtgaataagcgctgaatttctccgcatcagggttatcggtttctacctcgtgctgaaaatagagcatatttacaaggctttcaagtttatgatcttcgtccatggcgttgatcggtatctgcaaaatgtactggtagttacaaagcagattatcttttagaacagtctgataatgatcgagtacagcagggaagagcagaccgaacatcaacagaaggtttgcaaataagattccgaggaacagcagaaggtaattgctgacattctggaaaatcacacgcagtcggaaacgactgaaaaatggaattcttctgttcagtgataatgcatgcttttgttgccttctctttaagtctctgcggaggaacttcaaaggagaaagcgatagtcttctgcgaagtactgtgtaattgacgagaagcattagcaagattggaatgatcgtggtaagcagaaatgcttctgcgttccatacggtcacataagttggtagactgtagcttccgtaatacatgccggcgcagatatctttcatgatcgtatagccaagaacatttccaatcaaagcaccgaccagtgtgacaaggatcggcatggccatataatggcggatcagttcatatctggtgtagccgctggcaagaagagttccaatgacatttgcctcttttgcaatggtgttgctgatcgtaatgccaaagacaaacgccatgatcgcaattacaatataaagaaatacgatcatcattgcgcggtcgcttcccatatcatcccgggtaaatatgattgcctggttgagataacgcggaacgaattcttccagagaaacctccttgttgattgctttcatcagatcatcagatacttctttttcttctttctctgtcgtaggttcatcgttgtatttccacgcatagcagtattttacaagtggagaatccaatgattcaaatgcttcggacgttacaactccaattccgaatttgacagaatcaaacatggaatcgttgttgttctgaaagagacagctgtaatccggaagagcaatgaatccggttaccttccagttctgtgtatcacttttcagtgtgtctccgatggaaatcttattgttgtcagcatacatacggtcgatggcgatttcatttgccgcttttggaaattctccttccatgaggcaggcaagattcacctgctccctgtttgcaaaaatacgcattgtgctgccatttgttaaatcctgttccagatagaaattgtcatagatacggataccattttcttccacagactgaatctgcgcatcattcattttttcagaagtacggaaatgtccgttctctgtattatagttatcaattccttcattataagctttgatcatgctgccatcggcaacaagaaatccggagacgaatccgatggttattacaagaagaaggaagataacaagatacttaccaaagtctttccggaattctctggggagacgtttattcaatggatttttcattgtctgcagcctcctttaccagtcgagttcctgtgcactgaccttatgatcgttcagataattttttcgtaccataccgtcacggatccggacaacacggtcagccatatctttgatcgcatcattgtgtgttaccattacaattgtattaccgtacttttgattgaccgtctcgatcagtttaagtatctctttcgatgttttataatcaagcgcgccggttggctcatcacagagcagaatatcaggatttttaacaatcgcccgcccaattgcagtacgttgctgttgacctccggagagctgattcggcagtttcttctgatgtgcagaaagaccaagggtatcaagaagttcatctacatctaacgcgtgatcacttaagtaagcaccgacttcaatattctcgcgcacggtaagattcggaatcagattatacatctggaaaacatatccgagatgcttccttcggtattgactcaagcgttttgcagtcattttttccatcagttcgccttcaattgtgatctgcccgctgtctgcccggtcaatgccaccgatgatattcagcaaagtggattttcctgagccggaaggtccaagaagaacacagaattctcctttttcaatcgatagatcaatgccttttaagacttctacacgactgtcgccctgcccaaaagattttttgatattagttaaggataaaaacatagtccgccccctgttctgtgtgaaaattgagtttatcttagttaggtataccctggcttcaaataagatagatgaaactcacacatattagaaaagaatagttcatgttagttacatctaacgaaattatatcatagagatgtgagaaaggcattataaaaaatgtacaaaattacgtctttttgatataatgaccttgcacgaaacaatccgcaggtatcgtagttggggataaaagcaaaaaaacaaaacggtgtccgacaccagggggagaacgcatggaaaaagcaaaagtaatagaattaaaagagacaattcttgaagacaacaatgcagatgcacaggtactgcgtcaggaattaaaggcgcagaagacttgtctgatgaatctgatgtccagtccgggcagcggaaagacaagtacgcttctggcattgaaaccttatttcgatggaaagatcaagtggggtgtgatggaagcagatattgattctgatgtggatgcgaatacattgatcgaagcggggatcccatcgattcagctgcataccggaggaatgtgccatctggatgcagatatgacacggcagggaataagagcatttgaaagagacgagctggattttgttgtgcttgagaatatcggtaatctggtttgtccggccgagttcgatacaggggcgaattttaatttgacgattctttcagttccagaaggagatgacaagccggccaagtatccgctgatgtatgaagtgtcagatgtgttggtaataaataaaatcgatgcactacctgtttttgattttcgaaaagactatgttgaggcatgtgcaagaaggctgaacccacagattaagattttttatatctctgcaaagacaggcaagggtgtaaaagaactagctgattatctgctggaacagatagagaaaataaatgcataaacatacagatgaaggggaagaatatgggaaaagtcagagtaattgagattaaagaaagcgtatttgcggataatgatgctacttcaaaggcaatccgcgagaaaatgagtgcgcagagaacactatttttaaatgttatgtccggaccagggagtgggaaaactacacttctaagtgcattgatcaacagaatgaaagatcagatgagaatcggtgagatggatgtagatattgagaccagtttagatgcacagagagtcgcagatttgacaggagtagaatctattcagatccataactgtggattgtgccatattgatgcagatatggtatcccgtgcattgcttgaatatgatacagagaatctggatctgttaattcttgaaaatatcgggaatctcgtctgtccggcagaatttgatactggggcgcataagaatgtgatgcttcttagtgtgccggagggagatgataaaccactgaaatatccgttgatgtttcaggtaagtgatctggtattgatcaataaaatagatactctggagtattttgattttgacttcgaagttgcgaaacaacggattctgaaattaaatccaaatgcagttgttcttccagtcagcgcgaagacgggagaaggaattgagagagtgatggactggattatggaagaaagagaaaagttataattatttcagatataaaaagggcttcccatgattgaagggaggtcctttttgaaaaacggattgattattatatcttatacatgcgtgcagtcaggttcaggttgaagtcgttttgccacaaaagaaagcatgctttcgagtacctgacatttattgttacagacagggcagaggatggaagatacattttcttctgattgggtcgggacggtttcttgtgataagaaaataaaatcgtataaatattcaaaaaattctttattcgttggttttctgtccatataggttctgttgaaaatcatttcaagaatagttttattttccgaagtccagattgcattgaccgtgttgcggatgtttttttctacacaagaccagcttgtctcataatgggcagcaatatcgatgtacaaagctttggtaatattggatacacgagtctgatcctcgtttatcaagagtaatccatacacaatgtaatcataaccaagactagttctggcagcaataagtttatcaagtgtagatttgatttcaattacgagtgtattgtggttcatgagagtcccccttaaaaagtaatgtagataagaaggaagagcctgttcttgatatcatatctattatatacgtatttattatatttgtaatgacaaaatttatgagtgacttaacaaatttttaaggggaattatcacttgatttttcaagaagaaatgatataattaaaaagatgtctgtcaaggcagaaaatatcatatggagttgtatcgaagtggtcataacggggcgcactcgaaatgcgttagccctccggggcacgtgggttcgaatcccaccaactccgcttgtatgtttagtggaaaatccttgtaaaacaagggttttctgcttttttattgctcggaaataaaattatgttgctgtcacgttttgtcacgttttcgttttctacatttctatatgttgtggtgacactagattctggattatcttctaaagcatttaaaatagctttctttgtttcttcctcgttatttgtatcaaacagataattttttattgttgttcgttcgtctgcatgtcctgcgattctgcttgctgttgttattggaactccattgtttactaaagttgaaacaaaggtctttctgattctgtgcgttccctttacaggaatattaatacatcgcttacaagcatctttaaggagagtatacagcctattaggatttaatatatagccatcttttacgaatagaaaatcttgatatgattcgccagtttctttatttatccgctgtatctgtttgatatactcttgtgccttttgtgttaatgggatgtatctgtctcctgcatccgacttagtgtactctaccgcatggtatccgatacgtttcagactgtctaaattagatatatcaaaatcttctacaacctgcctgtgaatatgtatttcaccattctttatatctgaattcttaatagcaagtatttcccctctacgtgttcctagttcaaaatcaagcattatagcaagtatacatgtattagtcggattattttgcaatctgcgactcatttcatcaagtagtaattgtttttcggaattattatatacttcctgtgtactcgctttcttcctagttggaataatcttctttcgatttacttcaactctgtatggattctcatttgctgaaatatatcttgctgatactgcataaccaaaagtttgttttaggattccacacatgttacagaacgccttgtctttgatctttgttgtattcactatgttattcagaaaatcatcaatgtcaatgggggtaacgtctttatatggtttctgaatgaactctggatttgttttataatactttttccaatcgaatgacattcgccttattgttcctgcactaactttttctttcttatgatccatgaattcatagaatagctgttcaaaagttgctgtatcctttccaatggaattctgtttttctttttcaataaaataatcacataatgcagattctatttcttctttggttttctttttcctacgaaatgcaccacctttgattgttttgtttggaatacggaaataatagtaactgtcttttccagttccataatgttttattaagtgtccgtattttgctaaaatatctattcttttcatgttgtctgtactttccagtacacctgttacatttatcatactattagaacaagcagaaatgcaagcatctgttttgaaaagcaaagcgaattaaggaagaaaacataagatatttgacacaaacatattttgaaaacaagtatgtttatttgagatattttatatattaacgtataaaataatataggtatatcgattatggttttaaataccgctcggtatgcctattttttttacgattttatcacacctgctgctttgatttttttcaaaaaatacgctaaaagcattgtaaaataaaggtttttgcgatatagggttcgataagatagtggtaagaagtgatgcttagaaaatgcttgatttacaagtgaattgtggtattatgattgtattgaggtaaaacgctaaaagtgttgattttccgtataaaaacgttggtgtagatcaagagatgatatcgatatagggaaattttttataaatgtaacagtcaatttaacacgttactactttgatgtaccaaagcgaataacatttcaaaatcacctttcctctttctttaaagataatcctttgcgacttccaaatttacaacaacaaatattttcctctttcatatctatggtagtactgtattatacgagcttttatttcaagaaatgttaattatcccccacctattataatatgtatatcctttgctttaaacaacgaaattgtaccctagaatccattctaactatcttgatgctaattcctttgggttgaataaaataaacggaatatggctgaattacataaggaattattaagcagactataatagaataagcaccggagcaaaaatccagtgctttatttttttagatgaaattcatctttcatatttctaaatttataacagctgatcttcttcggacggtacatatctagccacatctttaatatcacagtgtaatatcctgcacaagtcattcaaggttttagtggagacatctttattatgctttaatcggtgaagcgtgctgttagacagatgatgcttgcttgtcagtgtataccaattttcagttgatttttctaacgtttcccagaaaggactataatcaatcatctgctgcctcctacatattctatgtaataagcataaaatatattctaaggattgaatatcttcgctaaaacgaatataataaatcataagaacaaggttatatttgtggtgaatattaccaaaagagaaggaggaaaaggaatatgagagagtggaggtattgtgtatggcgttaatcaagtgtccaaattgcggagaaaagatatccgatcaggctatagaatgtccaaagtgtggaataaaaatgaattcgctacaagatacggcgtgtctaaagcaaaaatccaaaaagaaagctcataaaaagaaggggaaaatattctggtttataatgggatttctattgggatttgttgctggcgtgatcgccataattgctgtatcatttgcgtccgtaaaagacgaagatataaataattatagctcttctataaataatactaggtattatgtaggaaaccaaataaagcagccaattataaaaaatgagatagtgggggaaaagagatgattagatgtcctgaatgtaaaaaaatagtagatgaaaaaaataattcatgtcaatattgtggttatccatttaatggaacagaagaaaaaattacaattaaatattgtacggaatgtggtgcgcctattgaagaaggattagaaaaatgcccggaatgcggtaaattaatagatagtgaaattttaaacgatagtttagaagatacagcaagtcaagaatcagaaaatgagatacagaataatgaagccattgaggatacagactccaacattgaacctgtagaactagaagcagatagcgaaaaaaagattgatatacctaaaaaatttaattttgaatttaataaaaagaatatgatatatatggttggcggagcggtgcttttagtttcacttatcggaaactgttcgttatattcaaaatactcaaagtgtcttaacaattataatgatatggtttcacaaaacaagacattaaatgataacttaacaaaacaaaaggatgagaatacgaagttatccaatcaactctcagaattgcaaggtgaaaatgatgagcttaagaatggtgcaagcaaacaattagttgatattaaaaatgcttacgagcaaggcgattggcagaaggttattgacttggcgagcgcattacattctaagtacaatggaacagatgaagatactcaagcgcaggctttagctactgaaagtcaggctaaaatcgatgaggagaaggctgcacaagcagcaaaagaagcacagggatatgaaactggaattacttacgatcaattggcacgaacaccagatgattataaaggagagaaagttaagttttatggaaaagtagtgcaagttatagaaggagacacttcgacacaaattagattggcagttaatgatgactacaatacagtcttgtttggagagtttgataaatccattatttcttctagggttttggaaaaagattatattactgtatacggtaaatctgccggtacaattagttatcaatcaacaggtagtggaacaataactattccagctgtatatattgaaaaaatagatcagtaggtattattatgaacaagattaagaagaatactataattttcggaattattattggagtaatcattatcggatgcgtaatcttttttgcaacaggtgatttaagacagtataacgaaggaaaaaccttacttagctctggtaaatatgaagatgcaaagaaaatatttgcagaattaaaagactataaagattctgaaaatcaaatacttgaatgtgattatcaaattggaaaaaaggaattatcagaagagaattatattatttcatcaaaaatatttaaagaacttgcagatgtgaaatatagtgatagtgaagagttttataaggaatcccaatataatttaggaaaaaaatatatagaagtaaaggattacgaaaatgcagtatcatgtttgcaaggactgaattttgaagacagtgaagaattgcttgatccgattataaatggtgagaattccataaacaaatttgttgagagatacaataatgtggttgatgctttgaacaatggaaagaatcttggattgaaaaagattgatgctaataacttgaaagataataagataaccactggcataggtggaacaatcgaattcaacattaattcagaggaagattgtagatacaacattgtgtcatttaagtggtctaagacaccatgggtattgacaggaagtgatctattgacaggtgaaatgttttgttgttgttctgcttatttggtggatgaatcaccggatactgcaatgggcatcattacatctgcaattgaaaatggtaattatggcatatatggttctgaaacatataaagataatttctttacaatttcaaaaactaaaaaaattgttacttttgcaggacagaaaaattaataatttctcaaatgtgggtactctattttagagtacctctttttctggatgtaatatactccccctcccatttgatgctgcttgaaccatgagacacagaaggtcgagagcttggggtgtgagattaatgattacgaaaaattgactccacaattctgtggcgtgaatcgtataaaaatagcaccctggttaggtgctaaacttttataagtttttcagtttcgcttgaagttctgcgatttgctgttctacttcctcctttgccttttgtttttctatataatctgcatcagggatgaattccattatctcatctggcatacagtggaagtaatcgcagactttacagatggtttccgttgtgatagactcgtttcctcttagttttttaaacgtagtccctccaattccaactgaatccctaaattgtttttgagttatcccttctgcctttagtttttcaaaaagtctgttaaactctactttcattctatatgcctccatttgtatattcacctaggagaaacaccaccgccctgaaatggatgcttcatagaccattgaacacttttagggacagtaacacgtttcgttccatgcttattttctttatgttgataacgttttttgaaaattcttttaggatttattttttcctcatttttcttataataatcccacatgagatctgtatacttgtttttcatttcaccttgaacccatgtttttttatcggggagatataataaaacatgtaggttatgtttctttgaatagaagttggatttgttacaaaaaatttcaattccattgtctaggtgtagtacgattgtaccgattgaaaattccctgtcgtgtataagatactgtccacccagtgtatgatatatacgcatatgtaacaccttcctatatattatttccctttattatatcatgagttgtaaaaataaaaaactgcgagaataggcattttatataaagtcaatgaagaatatcttattacgaaaatttgactcagtgtgtggatgaactacattataggtttccggaaaaacaaaaatatttttcaaattttaactccccccaccgaaccaatagcaccgccaaagatacagcgactacagacaatttaccggagtaaacaacagacaatctacacagcaagatatattaaaatctctgtcatcctgttcaattactccacaagttccccaaagctatagaaaaatgatttaaggaatgcttatagcagaaaaataaacagacaaaagaaaaggctagaggactttcaaaatcctttagccttttttacgcttattagagtcacttaagaaaagtatctgctctatacattatatcatcaacataattatttgatggattgtaaaccaataccgtctccatcgtgtctcctgtttgtacatcatccgcagaatattttatataacttccatctgctgtaatccttgcatctccattatcagaaatgataaccgcacgaacgacttcaataattatcttgccatttctattctgtactgcgtaggtgcatctgtcgaaatcttcaacagaattgatataatatatttctgtctcaaatcctgttgtatcaagtccattcaatgaactattaaccgttgtttctgttgttgtctcttgtctgcgttgtgttgctgtcttggtgctttcagcatcaatcatgtgcggtattgtcattcctgttatcatgcttgttattatccatgttatcaatgttcttttcatatctctttaaacctctttcttatgtgataatagggtgtagcctatacactacacccttatttattattgttcattcagtatgtatttaactgctttctctgctttgctacttgctgatacaatgaacttgttatcattttttaatgcttgtaaccagttctgtatatatgcacttgagtttctaaagctcttttctgtctcaattcccaacatattgacaagtgtagcacttccaagctctgcaacgagttcttcctttgaatagctttcacttccaaaatgtgcgcttgctcctgtttccaatctgtcgagcctgttcttatgtcccgtgctatgaatcatttcatgaaacagtgtagaataaaattcttctatattctgatactgttctttacacggtacttcaatataatcgaaagttggagtgtaaaaagctttgtttgttaccttttcaaatatctttaagcgttctctgttcatgtattctgttttgattttctcggcttcttcaattggttcaagttctgatattttcaattgctcttttggttcaactccatcgacttgagaaatatgaaagacgttgtaatatcttaataaaggtatctgtttaattaccttttcaccgttttcatttttttcttcatatggctgaatcttccaaaatgtaacgacttctgctttctcaccttttctaatcttaccgcctaagtcactccattgtttgaatgttgcatactctccaccatgttttaaaatcatctgattcaataatgaataaggcttattacttattctattgtaagctccgctgtgtgttccgctccaaggtttctgccatggtatcacaccattttctaactgttcaataattcgttctgtaatcatttcatatactgatttcttcatatatttgaacctcctctgtatttatttgttaatataatattaacatgggtacatgttatatgtcaagcatgggtacatgtacaaaattaacaaaaacatgggtacatgtttgtatgatttgccaatttacaacggcatgggtacatgctaagatatagtcacaaacaaaacaacagagcaaacagcgaagggtgaaaacgaagtggcgaaagcgtaccgaagacaccaacataataccgggcaagggtaaggggataatgagacggtcgagatacctaagatagctttaagacctgccggagctgaaagctcttataaaaagaaagagaggaaaaaacatatgtgtattacaaagaacgaattggaaaagaagattgaagaattaagaagtttaaaagcattgaaagaagagactgagaacgagctgaaagcattagagaatgaagtcattttctatatgaaagaacacaatctgacagaagaaattacgaacaatgcgaaagtaacttataaatcacagagcagaacaacgcttgacagaaagaaactagaggaagatttaggagagagcttgaaaccatatgaaaaagttacattcttttcagtcctcagaatcaaataacagtcacggcggagaaatccgccaagctgtaatgctaccgcctacatggtgagagttccaagtctctttaaagcagaggacagcagacagaacgaaagtgaggtaaaaattatgaagttaggaaacattttaatagtaatggacgaaagtaaaaatatgtatgtatgggatgatggagaagtcattgcaagctacgacagcagaaattctattccatttgaactgaatgacagagaagttgaaatggttgattgtgaaaacaatgagtttcacatctatcttgaatgcgaataagggggtgaaaaacatgagatataaaacaatcgcagattttggtgcttatacagtagttgagccgacagaaccagtgaaaaagattcagactatcaacatctgtcgaaagccagtacagatgaacagacaacagcataaacagattagccataagcgcagaaaaaaagttgagaaagaattaaatcattctgcatacaggacaacagcagttacatttttttctattgtaagcatggttgcttggtgggtagcagttggttattaggagaggagaacagcagttatgatgtacagtgagtttgtagaaatgagtggcaagagtgagagctacatatctttgacggaatacacagaagaaattgagccgatctatatgaactgtgatattccaaataagcaggagtttatagagctttttaaagatgtattcaaaaagatagtatatccgattatcaacaatttgatatcaacaatgccaatagaggacaagttgacatatattcattcggaatgttcggacattgaaaaccacatcaaattagttgatttacaagcaagaaaacttgcatatcagtatatgagattgtatctcggagtttaggaggagtgaagcagatgaaaaaatcaataacagaatttgcagttgagacagacaagagcggagtagttaaaagaattgggaagagtgttgtattacagccaaggacacacttttgcagagaacgaataaaatggtttgatgattccaaacttttgaaaaagaagaaataaaataaaggtaattgttgagtagtggtcatttaataagaagaggagaaaaaatgtatagagttttcttaacacgaactaatattacagttcaaattcttcagacagaatcacaagcagagaaagtctgtgaggaatggggatggaaatatgacggttcagagggttcaggattcattgattatgaagagattaaagaggagaaagaaaatgtttagttcaaaatacttcatacttggaagacaggtggtaagtcagaaaattagcgtagagattttagaaagtaagatttttgcaattgaaatctttaaggcattggaaagattttgtgataaagactggggagaaatgggcgaagaagataaggcagccaatgaacaagcattaatagagggaaacagattaattggagcatatcagacttgcaaaggaaagatatggattattactgaagcagacagatcagctacaacagtgttattccccgatgaatattagagaaaggaagttaaaacatggcacttgtgattacaaatggagattattatatccacttcaacgaaaatggaaggcatcggaaaacagaagatgttaataaagcaattcgatacgacagtgtaaatcaagcaaaaaattatatgaagaaagctccggctaaaacaaagggatattacattttcgatacggaaacaaaaaagattgtatggagacatacaagaagaaaaaagagaagtccagaaacaagaaagatgttatatcacaagtttgatggaagatgccagttgtgcggaaaaaaattgacattggaaaatatgacattagatcatattattcctttagatttaggtggagaggatgaattgagtaatattcaaattgcttgtgcgtcctgcaataaattgaaaagaaatattcttccagatgatttcgcgaatcgtgttacaaacatcttcatgtatcagatggacaaaaagcgaaaagggaattttatgtgggaaatatcatctgcaatattgcgaaaaattatttaagatgacagcactgacggaaattatttctgtcggtgctaatcttaaatatgacagaacagaggacttatgatatactattaaaaaggctggagatcagttcttgataatagagaaagtgaggacggaatgttggctttaagtgataaaaaaagagattccaataataattatttaaaacagttggaagatattaaaataagagttcctaaaggatatagagatgtaattaaaaatcttgcaaaagaagaaggctatgatggagtgaatccttttgtaattaatcttgtaaatggtgtcttaagagaaaagggaagagaagagattccaacaggcgtaaaagaaacaaaagctaaatgataagagaaaattaacagcagatgaaacgggactttcaaatttgaaattgtaccaccagtaaaccccaatatggtagcaggtttcattcaggtaatatagcatataatataaagctgtaaaggatggtgaaaacatgaatcttgatcctaaaaaaataaaagagttgattactttgtattcagagttagacgatgagtatcaagaggagttattttcaaaggcaaaagttttatccattaagcaaacgcaaaaaaatcaaatattaaaatctaaagaaaaatttaagactaaagaggatcttgataagaagatagatgaaaaaacatgtagaagattagaagaagtaaaggaaatgctggatatatatgacagtaagatgaacgactcgcaaagagctgaaatagttgctttacttgataagctaacagatggtggattaacagagaaaacagatattgaaataacaatcaatcataagaatgtagatcttattgaatatttagaagagcagttcccggatgtaaatgttaaagaagcgaataagaatgcaaatcgtttattgaaagagttttataataactaagaattataaaaacatattgacgtacagaatgttgtacgttataatttaagtacaaaaaactgtacggaggtgaatgatatgttagctgtaaattatacgtctttaagagataatatgaaaagttatatggatcaagtgacggatgattatgagacaatgattgttactcgcaaaaataataaaaatgttgttatgatgtctgaagaagcttacaataacttaatggaaaatgtttatgttatgggaaataaagcaaattatgactggttaatggaatccaaagtgcagctggaaaatggaaattttacttctcatgcattgtctgaggtattagaagatgaataaagtatttactgataatggctgggaagactatacttactggcagacagaagataaaaagacattgaaaaaaataaataatcttttaaaagatattgaccgaaatggaaatgaaggcataggaaagccagagccattatcgggaaacttggctggtttctggagtagacggattaatgataaagatcgcttgatttataagattgatgagaaaaatatttacatcttggcatgtaggtatcattatagcgacaaataaaataagaaaggcactgacggaagataaaattgatcttctgaaggtgcttttcttttatcctgccaattacatggttcgtccgattggatgtaagattaaaaatttttgatatattttggtaatcataaaatttgattgaaaatactaataaaattctgaaaatacaacatcatgataaaataacttgatttcttctatatagtgtgttagggtagtaagcaccttgaagatgtataaaaaagaaagaagatgtttagcaaatgaaaagagcaacattagaagctacggatgaaaatattttacagtcaattaaagaacagaatggaacgagaaatacagaaatcaaagattttatagaagcattagaacttatcgaaggaaatatgtttattagtcttgacgcaagatggggagaggggaaaacattttatgttcggcaaatagaaaaaacattggaatatcagacaatgaaaaattttagtacagatgatacccaagatgaactggataaaatgaagctatattttactggtacaacattagaagaaattgatttaaaacattcatatcttccagtatattataatgcatggttatatgataatcacggtgatccattaatgtcattactttatgtgattgttaaaaaatgtggcatttggatagattctaaacttacaaaagataaaaccgaaaaattgaaagatttgattaaatcagtacaagtgagtttaggaatgttttcaataggtggcgataaagtaatagattcatttatagaaaaggacatttttaaagacattcaattagctgaagatattagacaaaaagtgaaagaaatatttaatgagataatagaagaacagacacagaaattagttatttttattgatgaattggatagatgcaagccaagttatgctttggaaatgttggaacgtataaaacattattttgatgatgatagaataatatttattgtatctgtaaataaagagcagctaatacatacaatcttgaactattatggaaatggttttgattcaacgggatatttaaataaattttttgatctcgaagcgcatttgccggaattacaaacatttgatacagaaatatatcaaaataataaaaatcaatattttttcatatctatttctaatatgttggtcagatactttaaattaagtagaagagatttcttgatatatcgagacaagataaataaacttcaaaactgcaatgctttaaatgataattcgtccgaaggtatatgtatatctctttttgtacctattattattattttagatatgaaaaatatggaagaaaaaagaaaatttttagatggaaatagtaaatttttagaaatagtgaaaatgcttccagaaggacaatatttatataaacgttttgcatcatcagaatgtggtgaaaacaatgaattagaggatggatgtaaaagattcaaagttgcttataagtttttatttggtgatgctgaaataagtgaattaactgcgatagggctaaatattagtcgtagctgtaaagaaaaaattctttcatattgtggacagatgtagttgcgctaaattgacgcaatggattggatgcttactcatcagctatcatccaaaaatctttctaccggtgaaaaacttgctatgacagaagaatttcaaaaagaagttgctttggagaacgaaaagaaaaagtcagaagctcaaaaaacttttcaaggaaatcaacatgtggatttcactccaattggagtgaatagcaaaattggtggaagaaaagattcttggacagattcacaaacagcaaagaaacttggtagatgtatcaaagaacttgaaagaatttatggaattgagcatggcaataatcagtttgataggactccgaaagtttcggactctttgaatcaagaacaattagcggaaatgattgggatttcggtagatactctcaataattataaaaaacttacaaaacttattcctgaattagaagatttagttgatactggtatccttgcaccaactactgcacttgcaataatatctttacttgacaataacaggaactcatagcgatttgttttaaagtgaaaaccctccggttattgcgccggagggaattaactcttaaagatatattttatatttttctttaaaaagccgtttcaaatcttgaagaacatttataaattgtaaatgaagtgagttaatatctccttgacaaggatgtatgccagatggaagtgatatatcaatatcatagttcaaccttgttctatttacgaatgtggttaaatattgtttggcaacattgtatattttgtgaaaatcaacttctttttccatagaatatctaaatgataaattgacatatttgaatacgtcagataaataaaattctatgttttctaagtaagaggataaatcagttgcttcttctcgtggagttaaccggtggtcatattcgttatagaaatcatcttcctgttcaaagagagtatctgtctcatttgtagaaaagtattcgtatacagttgcttttgcattatgcagttcaaaccattttgtattttcatcaattcggtcattaatttcaagagttattttttccccatatgaattggttttatttgaataataattttccccaaataaatcaacattaagaaatctaaaagttattaaaaaatcattttttaaattttcttccatttttttaatagagtctagtactaaggactgatcatcatcagacaaatgaatgtactcatctataatctcacccgttatctgttctaaatgcgctttaaaattacttatatattgttgagtttgaatatcttccatatattcaggagagatttctcctgttgtatgtggagctgatatatttagttttgattgtaaaagaaaacaaggtgcttgtgtaccattatctaattcgacaactgcgtttgggtgaagatattttataatatatttctccgtatccatatgttcttcatcagcaaagtcattaaatataagaagtaaattttctttggaaagattttttgttctatggttttctatgtttggtatccaagatttattttttccaagtttttcagacagttcgtatgcggtataatagtgttcttttcgttttttgacaattagatcaatatagtcttgtgttattcgtattttattggcaaacataatttatcacctcgattatgtacatatttacagctatattatataagaaatagttttaaaagtaaagaaagaacaaatgttctacataaatatgtataaaagtgttgacataaaaatagagtagtgatagtatagacttacaaacaaaaaagagactccgatatttggtagatatcaaagtctcaaaagtttgtggtttgaacgttggtagcattcaaacaaaatatgtaagtacagactcacaaagaatctatactgttccctgaacaagaacaagtataacatcaaattctaattgtggcaagtctgtcacacattttccaatacaaaaatcaactaaatattgcaagaatagagcctgttgaggagtttctatagcatttttgcatccattaacatctatttttgcacaacctgcaccttgaaaactgaacatagaggaattaatacatgcacaaaaaagactgtataaaacgggaatgtaatggatgtaagcaatataatgccgaatatagaagtggaatatgcttctggcagcagagtacaagaaagattactattgtaaagaaagatacgggataacatcccatttatttttacactttagagaacaggtaagacatgtataagacttattttataaaaagtatgaatacagaaggagaagatgataaatggaactaaacagagtagactatgcactgttaaaagttctaatgaagaacgacagtgtaagttttttcaaaggaatgacgatatatgaaatattggatgtccttggtggttcaagagtaactacatataaaaagctaaatcgtcttgtgaagttgggatatgtagaaaaaggctgcaaagatatcaatgcagacacatatctccttacaacaaaaggaatcggtttaataaaagaatcagaacatggaggaaaagaagatgttaaagaatgatgtagcagttgttggcgcaggacttggtggtgcaacagtggcttatggattgcaacagaagaattaccgagcatatcttattaacggatcagagcaagataaccggacaattccagatgcgaaaaatgttcttatattagaaggatatgacggacttgcaggagatagaagtcttgcattagaagcattacagaggaacaagcagattttgaaaaccatttcagagattgagcagaagattgtcttgtgcgttgcatcaggcggcggctctactggttctggcaatctcccatacatttgcgacattcttgcagctaattcagagagaattgttgttccaattgtgttgatgccaaggaaagacgaaccgattcaaaaaaggctgaatgcttacaatcttgcaaaagagttaatggatactgatggaattggagcaattatcttcgtgaacaatgaatcttatgatgatctgaaaagaatcaatgcagtacttgtaaatatgctcgatgcatttttcagtgattcatctgcatccagcggttctaactttgatgactcggagaaaatgaaaatgctgaaagagccgggagcttttgttattgcaatgctttctgataagcgtgcggaagaaaagaagactacaacacaggatatgataaatgcgctgacagcaaagaacatatttcttcctattaataatgatggcattgtcggaaacattggaatcatcaatcaaaagaacaataagctggacgagcatgaactgattaaagcaattggaacaccggaaaacgtgtttattggatacaacggtaatgtcaatattgcttgtgcttctggattgagttatccggttgaatatattaaaaaacttggtcagtcagcggtagaagaacagaaagagcgcatagagaaaagaaaaacaatatctgtcttggacgatttgaatacagaggaaattgttattcctgaagtcaaaaagaaaacaaccaaaggtaagcggaacagaatttcacttgattttctgaatagcttataggaaaggagtagaacaatatgagaacacctgccgcatataacaataatctaaagaatcatattatcaccatgcaaatgcttgtggattgtttatacagttctaacaaaagagcaaagaattggagagataaacagcgtgagtacagagaaagaagaagttaccactatgataagtatgataatgaaggaaaagccaaagagaagaaggaagaatactatcatcagaaagaaatcatgctctctgcactgaagccagtgtgcatccacaaagagtgttacggatatgaaagaacaagaatctatgattatgaatcagattacattaaatattatgatgaatttgtttggagaaatagcttctatgataaggttgaggatgcttatgtttgttttggggatatcgaggataagagtaaaccactttatcattactatcttttttatgatgtaggatataatagaacatttcatacaccaatcaaagagagtgaagtgtcattatatgacgatcttgaagtagtagagattgataaattggatacaaaaggatatgacattgcagatctactttcaaatcagtttgtaacaaaggtaattaatctaatcgagtcagaagactttagattagtagaaaatatttaaaagcacaggaggattaaacaaatgaaaggaacagtaaaatggtttaacacacagaaaggctatggattcattgtaggggatgatggaacggattatttcgttcattactccaaaattaaagtcagtgaattccgacacttagatgcaggagatcacgtagagtttgatgtggaaacaaatgacaaaggcattcaggcaatcaatgtagttccagtgcttactatgagcatgattaaagaaagagctgcaagacacaatatgcaccttgaagaagctgtcggatgcggtgcaatgggatggatggtcgtggatcagaacaatgtcattcagacggatgaacacggaatgtcccttgaagaactggatgaatatttcaaggagtaatttaagaagaaaaaaattttaatttaaaaattaaggagaatgattatgaacaaaattgtaaaagcagtaaaagaaggacaagagattgagacaaagaacttatttaacgtggtaaatgatttttatcttacaagacttagagtttcaaaagatggggagagtgtcgtgtctatgcaagtaaacgtgtgcgaagaacacgcagaggaatatgaatttttacagtcctgtaccatgtttgatgacgtggcatatcatctgagaaaggctgatattgattctgttaccagtgagtacaatgcgaaagtagatacattgtacgttacatgtgaactgaaaaacggattaacggtattgcttatgattatcaacattactggaagtgaaaatgatgttaaagattatagagagatggatgtatatgaactgaaagatttcttggaagatgtcatcaataagaaaaatggttattactgtatggtgacaagaattacagatgtattcggatttgatttaaaaatgcacaattccgttcgtacttacattaatacgcttgatgaagatgattggaaactacatattagtgatgattttacaaaatttgaagttccaatcacagacgattcaataaatgagatttatgtcaaagataatgaacagtcagaatcgaaatctattgttattaagcccttcaatcagccattcatggaaatagatatgcttttcttgaaacgacacgactaatcgagggaataagcataataggaactgcgaccgttgtgtcgtggttcctggataaaagaaaggacaaaaaacatatgcatgcaatcacaagtaaacagctatacgatttaatcatatcagaaaagttgaatgtaaaactggtaacaagcagacacttcaacgcggtaggaatggcagatattattgaaaaagaagattttatgacagaccttgagaaagctacacatgctggacgtttcgatattgttgagtggaaatgtaatgtgaatataaacagaacagttattttgacggctgatttacatgataaatatgctggcgaatacattgaagtttttggaactgtgccaatccacgtgtcaatcaagcagcttgaagaagaactggattaaaaagaagtaatttgagcgtttacagagtctataaaggggattaaagttcatcctctttataaaaacaagataggagaggaatgacatatgaataacgagattaaaaatattaccatttttaatcaaagaatggcgggttacttgatgcagaaaggctatgtactaatagatatgcgaccagatatgaagagtggcagtagaaaaaatgttttcttcttcaaagatacaccacagcttagaaagtctatgagtgactacattaaccgatagccggaggtgtaccaatgaagaaaacagatgttataaaaaataatttttctgaattaatcggagatgtatacaaatcttgggataatacaagagtaattcttgatggtggaactggtactggaaaaacatactttactcttaacgtacttggaaaatacgcacagcaaaacaataaaataattttatatttgtgtaacagatcaaagttaaaagaacagacatataaagatgtgaaaaaactgaaattacacagtacagtttatgttacaacatatcaatcacttcaaaacagaattaaacataaagagaagctactgcattatgattatatcattgccgatgaatgccattactttacaaatgatgcattatttaatgaatacacagatttagcttatagatatctaaagaagcaacaggacaatgttgtgatttatattagtgcaacagcaaaagtatattttcattggatgaaacagaaagaaatggttgtaccggaacattatttcttaattccaaaagattattcatatgttgacaaagtatatttctatgataagaaatatcttattccgcagatggataagattctagaagaggaacaggatagtaaaatccttgtgttttgcaattctgtgaaacgtatgcttgagctgcatgaaaaatatggcaatttagcaaaatattttgcttctaaaaatgcaaaaaaagttgaatcaatacgtgatgaaaactgcatatatgaacattcagatggaactattacctttgatagccgaattcttattacaacaaaagttcttgataatggggtaaacattaaggataaaagggtaaaacatatattttctgaaattcttgatgcagattcagctatacaagcattaggaaggaaacggcaaatttcagaagatgatacatgtacattttatctgaaagattattctggacaggcgatacaaggtctgataaatacaaatgaatatcaattagaccctgttatgacatatagaatcaagtatgatgaattcttgaaaaaatacagtcagaatcgtaagcgtattaggaataataagattttttatgctaatttcgttaatgaaaaagaaaagagtagtatagcttttaatgaaatgcgattaaacaaatatttgatagataatacgattctgaatgacatgaaagaaagctcatataagatagttatgactgagttattgggatacactgtggctgataaaattggagatttagagctaaacattgaagaaaaagatgaattcttagaatatttgaattctatagaaggtaaatggctatattcagatgaacgaaaagaagttgtaaagagatttgaagatattggagtaaagctgagaagacaggggatcaatactttaaatggtgctttgcaagataattatggaagtaaatataaatgtcgttttagggataaaaccttagatgaaaaaggagaactcactaagaaatttctagtagataaaaagagaaatttagaagatggttctaaaaatccgaatagagataaaaaatattggattcttgaagaagtatcttgggggcgaattggcacttcactataatatatagtgagatgtcaatctgaccccagacataagattctaaaaatttgtaattgattctcttatgtaataatatgcaaaaatgaaatgctatgcaaaaaaggatactacagaactaaataatttttggggtatgtttcctaatatatatgtattagagaatctacccctaaaatgaaaaaatatgtgtaataaaaatatttaaaacgtagttgtgattttctgcattacgccacacttggcggaatgcatcaattatcaatcttcgcaggacatccccttgtggatggcaggagaagatgagaattgacaacagggagtgggagaatcccacaagacatatatggagaaagaaacatatgtcagggggttagcctaacagaaatacacaaagtcttactatgcaatctgctgcgttttcctttcggggaaaacttgcatcttgcaagtgcgactatattgtgtcttatctgttagtccgtgtgccaccccccgaacccccggcacagattaaatcttaaacttatgaaaaataatttaaaggtgtgtgaatatatgaaaaacagattgcaggaattaagatgggaaaaagattggtcacaaacacagcttgctatgaaaagcaatgtgtcacattctacaataagtttgatagagaataatcctcttgaaaacccacatgtttatactgctatcaaacttgctcatgctcttggtgtgtctgttgaagatatattcatactttgagatggatgcagaaatcagtaaggcacatgaggaatatatctaagatctgaagagattgactccacaaaattgcgaaataaggtcaaatcttggcagatgaaatcgaagtttcatttatcacaaaaagtgatgtatgtgcttgcttaaattaagtaaaatcgaccctatttcagttcattgaattgcaggtaagttcttcttggcttggttggttacaaaaggaatttactaaggattttaacgaataaatacaaggataacatgatttttgtatatggtaatgaacgaaaatgaagctgaaaaagatgatgatttttgaaatgtgttccttgagaattgaatattgatggttgaaggagtatgataaataaaaagatgttttttgcaagtcttttttgcataaaattgcaaaaggtttttgtagattgttacacctacattttgggtctgcaactttctatatttttattttacgataaacaataaaaggagagaacggatgatgaacgagagatttgatgatttaatattaacaagtgatatagtacaaggagtgatagaaacgtgtattcgtctttttgctatggcatttattttgatgctagtattttcggtttttatgaagctgtcaaaatttaaaattaaaataccaataatgtggtattttaaccttccgaagttttttatttccttgttcgcaatattattagttttttgttatgattatgaagaaaaacatattataatgtttcatttttatgatatgactgcagcgacattttttgtgggttctttagctattatagaaattatatttactgcaatatctatggcgaaggaattcatagaatgtaatagaaagtaaattttatttgtttaccaaccatcaaattaaaccgatggttggtatttttttacctttttcaaaaatcagtcggagaatagtataagtataagaacaaaagattggagtgattattataaaaatcaattataaaaagaaattgaatccgttgactattgagtccatagaagccagcatggtacatattcatgatatagcaggagataacaaaggagttcaatacaaaatggggaaagagtgggtggatttcaggaaaatcttcacacgtgaagcagtattggatgatagtttatttttgcgatttatgagaacaagtattacaagaaatagcaacgacttttcaaaagattttattgtgatgaaattttcgtatgatgcggaatataggcttgaagatggcgaagaacaaaaaatgagcaaagaagagttacgaacattttattataaaaatggagtaacatttcaatcagcacatacgggaaaacatggtaaaacagaacctattcattacaagatgctatatagaacgtcaggaaaagcaaagaaaggtgagtgtatttttgttcgtgacaatctgtttcataaagcaattaattatttgacgatgggattttatgatcttatggaagaaaaagcaaaagctgatccggataccgtatttaagttagtagagctatctgcatatcttagcttgactacagcgtgtgcaattggatatatccatattccattaaaaaacattttggttgtagaagatcaaagcgcatacacaaaaccaatggcagcggagattgttaaagttgcaaatgttccttatgaaaatgatgaatttgttttagaatttaacgatccacgtatggagacaatccttaataatcatcaatgtactttagacaaagacaaggctgctgaaaaaggatggtcatatattaaggaaagaacgaaagaggaattgaagaaaaacggtatccgtattaacggtaaatatcctggacaccatgagagtattccctatactgtaaaagaatgtgttgtggaagaagtagaagatgcaaagattgaaaatattttgtgggatggaatgggacttattgatgaatctatctttccaaagtatgcaaatggatttgtttattgtcgctctcatttctttaaaagctgtttgtttcgaggaaatgtgcaggaatattttaaagattattgcaaggaacatgaacttgattttgaaacatatgaagtaacggatatgtttggtaataaaaagaaagtgtcagatattaaagttgttattactgataaatcattgaagtggttgaaatttacagatatgatgggtggaacaaaacaaaaagcatatcgtacatatcaaaaattaatgaatgaatatgagaacgtttttgcagtagtaaagaccgcacataaaagcaaatgggatgatttgcagttatcaacttatcaaatgaataattctttaccatgtacagataaaaagatattgggagaaattgttggacaagcaataggctttatcaatgggttgaaggatgatgataaaaattacttgaagtatcttgagatgacaaagaaccaattcaatttgaatgaattccttgtggatttggtgaattggaatccagagtttgtaaagacggagttttttagaaaaaagaagaaaaaggatgtttacaaattggtggatgatttcaagaaaggtcgattaccgcagcaaggagataatcttacaattatgggaaatccgattgcacttctaatgaaagcggttggagaaaatccattggaagaaaacatttttgatgtagaagaggatgcaattcaatgttacacagaaagatttatggacggagaaaatttagctgcatttcgtagtcctcacaattctcccaataatattctgcattttcataatatcaaatcagaaaagatttcaaaatattttcccaacttaggagaaaacataataatcatcaatttgattggtacagatgcacaggcaaggggcagcggatttgatgaagattcagattttgtgtttgtgactaatcaatcagaggtggtagaacttgcaagacaggcatatgttgaatatccaactattattaatgcagtagaagaaatgaagagtagtgattatcatttccggttggaagattatgcattgatggataataaaattgctgatgcacagtcttcaataggattgtctacagatacagcacagttagccttatcatattattacaatgaaggaacgtgcagtaaagaactaagagaatgctttattattttgtctgtgatcggtcaaatatcgatcgatctagcaaaaaaggaattcgatttagatgaaaaaaatgaaatccgtagaattaaaaatctttcctgcatgaaaggaaaagatatacctcaattctatgcagataataaaaagtcccggaacaataaagactttgggaaaaaggttaagacattgaattgtccaatggacattatggctgaactgatagaaaagaatattcttggttattcaccaaggatttatcatgaaccgataaataaatttttgaataaagctttatcgtgtaaaaaagtagataatcgatataagaagcaaaaaataattgatgaagcccaaaaatataatgatgcaattaaggcgttagagtattcagcaagaaaagatactttatctgatgatatgctttatcagttgaaatcacggcagatgaaaatgttcttacaaaaagtaaagaatgaattaagtcaagaaacagttatgcatctagttatatatgcatttggagatgaaaattcagatgttagaactactattttaaatggtctgtttcatacacataaggaattgttaatgaattgctttgtgaaaaataaccaaaaaatatgataaaaatttgcacaaaatcaccaaaaacgcagtaaaattcagtgaattgaaagtcccgttatgaaagagaagagtagcttacttcaatttcgtgactgcatgaaagaagcgtaagtcgagtagtgcggtcaaattatcaagtcgaggtatggatgccaatacgtatctcggcttgaaatagtaaaatgttcttagctgtgtatgtcagctattttctacaaagaaatatttttatataaatttttatttacgtgggaggtgaaaaagtgactcaggaagaattacgagaactatacaatgaaagagttcagagagaaaaacagtgttatatcagtaagcagacaaacattaacagtggattactttcacagttcaaaacaggaaaaatcgatctctatccgcatctctttaagcgtttagaggaatatcttttaaataactaaaattcaaaaatcaattaaattcaacggcatttcagccaatatttcacacaaaaaaggaataaaaacatatgagcaaaacattcaattcgtttaatgctctgaaaaaagcaattcaaaaagaagttcaagctgcaatgaatgaagtggtcaatacttcatttgtcaacgcacattctaatgtagatcaattctacaactcaccagagggaagatataacagaacaggacagttagcagaaagtccagagatgtcattgttaggtggtggggattcatatcatggagaaataagtcttgatactggatttcgttataatccatctggcagagacacacagacaatctatggatatgcagaagaaggtggacttcttggaaatggtggcttttgggagcagacagagcaggatgtagaaaaaaatatcaatgaagcatttggtaaaagattcaattaatgaaaggaaatttattattatggacgaattaaaaaataaaattaatcattgggtttatggaaaatttgaagacggtacaggagtatttggaaaagtttttaatgttaaaaaggtagaagaaacaacagaagaaaaaccatactatgaattaagtgttaatttgggaaatatatactgtgttgttcttgatactagagagattacaaatttatatgactttaccgaaacatattcgaatgaaaaaaataagtttgaggattttgggattgattccaccatgaataatgtggaaattatggatgaaataatacagaattggaatgcatacgaagaagaggaaaagaaaaatcttagcagtctagttcgttctcaaatggatgatgatacaattatggaatttatgaataaggtgtcaaatctaattacagagacagaacatcttaatcataaaatacgtagaatggagttggcatcttgctgtcttataggagaaccagcaggagtattaacatttaatcatagcacaaaggaagatgaggattaataatgtcacaagattttaagataaatatagatgcggatttgaataccgcagaagcagaacaaaaattaaatgctctattgaaagaaaagcataagcttacaatagatgtagatgtgagcggtcagaacacagcgaagaaactaaaacagaatatagaaaacggattaaaaaatgtaaaaattgatacgtctgctatggggaaatctctggcagacgcttttaatattacggataaatcaacaattagcaaacttcagaaacagctcaattcaatgatgacaagcctcggaaagtcatgggacgggcagaagtttaatattggagatggatttgagacatcaatgacaagtgtagtaaatacactcaagaaaaatgcaaagacactccgttcttccgggacgtttgatgatttctacgactatttcaaaaatcagaaaattcttgttaccgatgctttgaagaaagagcttggtgattcaaattacaaatcccttttaaatcaaaatattggaaaactcgttaccgatacaaagaaatctacagcgaccattaactctatgtggtcagaactcaatggtaaattccctaatttattcccggacaacatcactaatcaagcagatcagttaaatcatgcgctgtcagtttggaaacaagcacaggctgatatcaagaagatttcagcagaaaatatgaatatttttgaagcaggaaatgttgattcaagagcatgggattctgtcattaatatggcttctaagatggaatcagcactaaaacatagtatattagaagcaacagagattggaaaaactacgatcgatttagatgtcaatatcaattcggaacaaatcacttcacagattcgagaagcaatcagttctgcgtcagcttcagcaggtgaagcattaaatattgacttgaagtttaatcaagaagagttgttatccaatcttcgaagtgcaattaataagattgcaacaggagatgaaccagtaaaagtagacattgatgttgataaaaatggacttcaggagaagttgaatgcagcgtgtcacgacatggaaatccctgttgacttcaaaattgattctgaagatattgcaagtaagattaaagaagcagttaatagtattgcggatatcgagttagatttaagcgtcaatactgattctatgaaaaaggctgtagatgaaagtattaatattgggtcagacattgacaactcaagtattaatcagttacagaacgctttgcaaggtgtaaataatgcaggacggcagattcagaatatcttttcttcacttggaggaagtgtaaaagaagcattcacaagtatctataatgtctctaacttgcttcaggatggaatgtataagatgtttgaagcaggaaagaaagctacggaaacagtcaaagaattcaatgacattaaaacgaaccttgctatggctacaaatgccgattcagactacattgataatctgatgaatgactataacagtcttgcacaggaacttggaagtctgacaagtagtgtggctgaatcagcagatagtttccttagacagggacgttctatggcagataccaattctctgattaaagactctcttgtgttatcaaaagatgctgaattaagttctacagatgcttcagagattcttactgcaacattaaacggattccaattgtcagcagaccaggcaagcagaattaatgatattctaacaagtattgacttggaaagtgcatcaggagctgacagtattggaaaagcattgatgaaggtagcatcacaagctaacaatgcaggggtaagcttggaaaagacaagtgctatcattgctacaattaaggacgtaacacaggatagcgatgagtcaattggtacagccttgaagtctgttttatcccgtatgaaccagattaaggcagggaagtttgtagatgcagaaacaggagaaagcctaaacgatacggaaaaagtattgaagaaaatcggtgtatctatgcgtgacaacactggaatgttcagagatagtgaaggggttcttgatgatatcgcaaagaaatggaagacattagatagcaatagtcagaaagccgttgcgaccgcaacagccggaacttatcaatacaacaaatttattgcggcaatggacaactgggacaaagttgagaagttaacgaatgtggcttataactcagagggaacagctcaaaagaaatttcaagacaattacctcaattctcttgaagcaaaaacaaatcagttaaagtcttctcttgagggattatctacatccttaatttcagatgatatgtatgcaggattcctagatggttctaaagcaattgtagattttgtggacaaaaccaatcttcttaaaggcgcacttgctggacttggaactttcggtggggcatttgttttcaaaaatcttacatccatgattcaaggtacagtgcgtgaattctctaacttaggaaatgcaatgaatcttgtgaagagcggaacaattgacacgaaaggattcaaagaacttctgaacttaacacagggattgtctgaatctcagatgcagttggttctttctagtacatctttgtcggacgcacagagagtacaattacttaccaattcaggagtcgcacaggctgaagcagaagctacagtagcagcgatgggattatctactgcaaatggagcagccacagcaagtacagtctcttttagttctgcgttagaaggattgttcgcaacgatgatggcgaatccaattatcttattaactgcggcagtatcagccgaagtaatggtgtggcagtcctacaagcagtcagtagaagatgcggttaatagtgcatcttcagccggacagaagttttctgaaaatacatcatcattgaatgaacagatttcaaaggtcgaagaattaagagagtctattgcttcaggtgttctttctgatgaagaggcttacaatgctaaatctcagttattagacattcagaaccaattagcatctacatacggagagagtgcaagttccattgatcttgtgaacggtaaaatggaagaacagattgctcttatgcaacagcttcaggttgaagatgcaaagaaaactctgaatgaaaacaagacaggttttgataaaatcaaatctgaaatgacaaagacacgcgcatctggaattgctcaatttaatagtggctcaaaagatgcagaagcggtagcagagatagcaaaaaattatgttgacaaaggtttgtctcttcagaaagactcgacaggagcttatacgattacattcaaaggtgatgtgacacaagcagaatctacattgaattcctttatgaatgacgtacagaatcgtattgatactgttggagataataacggaattttagaaggagttattgattccacatcatctgaactatctaaattcaaaagaataattgatgaatatggagatgattacaataactttcttcaggcagatttgatatcaaaaggagtaggagagggaagtcctgctgccattttagaagactataaacaggcgattaatgattataacgaggctttatctagtggcgatacatctgcgattgatcgtgcaaagaattcttttgatgtaatgtcatcaaccgtagatggagtattagagaagtattcccaatataagtcgttattcgatgacgttggaaattcacttgatacaaatgcaatcaaagtaaacgattttaaaaattccgtcaaagatatgttccaaggtggaattgatgaagagtataagaagattaagggttggggacttgacaagtacgaagatcaaatcaaaaatggtactcttccaacaacattcggaaatgttgacatggacaacagaaaagttatcaaatggaatactgatgaacttgagagattcaagacacaattacaagatattcagtattttgatgcagatggtaattttatcgagtcttattacgatcaattaagagcaagtgcagacaatattgatactgtatttggagatgtcattaacaaaatagaaggatatgatggtgtcacagatattgcattctctcatattgtaaacaatgatgatggtacttatcaattcttaggtcaaaaatctgctcaagaatatatttatggaatccttgacgctgcgaaagaagatggtgatttatctctttctcatatccttgatttggacaaaaaaggaattgaagatgcagcactgtttaatgcaaatggagaacaggttggacaagcgtatatacatggaatcatttctggattcaatgaaaatgcaacagatatatccatgcttactcactttgcaggtaaagaaggtgcgcttggaataataaaagataaaaatatctttaaagacttaacagatgtagatttaaaaagcattgatattacgaaaggtaacttggatgaagttggatcatcattaaaagatgttgtagacaaagcaattgaaatcggtgttgtttctgatgattctgctgaatcagttgcaaaagtggttgatattcttactgatatgggattgaccggctctgtatcaattgacaatttaacaaagtcatttacagaagcacaagattctatcaataagacaacttctaatatggaatctctgaaatcaattctctcggaatctgtttccggtgctggaatgtctgcggatagcgttaaagcatttaaggatatgtttggtgatgatgctgataaagcattggaaaagacagcaaatggatatcacttaaatcagaaagcgttagctcaattacaggaacagcaaaagcagagtacaaaaacagattatttgggttcattagccgatcaacaagaagcacttagaaaagtcgaagaatctatttcaaaaggatcgcttgcaggacaagatgtcagtgcatatgcaacacagagagatagcattaagcaaaacatagagactcttcaagatttagcatatcagtatgaaaatgcactctccgcctataatcaatggcaagctgctatgtctggtggcgaagaaggtgatatgtataattccattcaaggaaatcttgaatctgcaaaggaattgtatgataaaggactgacaggcacaaataagttccgtgaatttgttgatttgatgagtaatcaagacttatcaactgcttcaaatgaaaagattgtttctgcatatgaatctgcaatgcctaagattaaacgttacttcactgaaggtcaagaaggtgctgtaaatttcttaaaggatattcaagacatcaattctgaatgggcgcatatgaatgatgatggttcatggaaaattgatttcggagtaggcaacgaccaagaaattgcagataaacttggtattgatgtagaagcagtccaagcggtaataagaaaactcaaagattatggctttgatattaatttagatcagccagtacaatcattggatgaattaaaaacatctgctgaatctgcaaaagaatctctagttgatatgaatgaaacatctttcaatggtattaatcttgattcttcttcatttagtgaagttacggatgagattgaaaaggttcaaagctacattgaaactattcaagaagattctgagatagatcctaatgtaaagacagaaaagcttcaacatgcaaatgagatacttgaataccttgttcaaaagcagcaagaacttggacagtcagatattgaaatcacagttaatgcagatgaattagaatccaaaataaatgatgccaaatcagcattgggtgaatttaagaacgaaggtggaactgtagatatctctcttagtggtgcgcaggatgcggttgataatttacagacacttctctatcagaaagaaacgctcactaacacttctgcggttatgtcaattgatacaagtcaagttgatggggaaatcggagaagccattgccctgttgcaagagtatcaaacagctgtaaacaacttaaatgcacagaatgagcttggcaaagctggcgtggacatagatacaactgaagcacagcagaaagttcaagaccttgcaagtaagattcaaggattagatgggaacacaaaagcatctttgtcattggatacttctgaagtacaatctgctcttacgaccttgacagaaacgaaagttaatgttaatgcaggagtaaatcttgatacggctgctcttggaacgattcaatcttctatttcagcaattacaccacagatgttagtaaatgcaaaagtagacaagacacttgttgatggatatgatcctgaagataaggatgcaaaggttaagtttactgcggaacattcggatgtagatgcttacaaaccatcaaataagaatgcaaaagtaaattatactgtacacgtatctggacttgagaatcttccaggaaataaggaaagaagccttacatataatgtcaaaacaaatggtagtgtatctccggcaaatggtacagctcattctattggtacagctcatgcagcaggaacaactaacgtatcagcaaataagaattggggattaaagcggaatgagccacatgcacttgtcaatgagttaaaacctgaaattattgtaagagatggacagccattcatagtaaatagtggagatcctgcatttacaagtttgaagcaaggggacattgtgtttaatggagaacagtcagaagctctattaaagaatggatatgtaactggttctcatggaaaattagcttatgagggggcgcattctttaggtacagcgttctctaatggaactggtaaatttaatgtcggcagtagtggaagtaaatcatcttcttcctccaaaaagaaatcctcatcttccacttcatcatctagaaactcaggttcatcctccagctcatcctcttcttcaaactccagttcatcttccgcagatgatgcttcagaaaaagtaattgattggattgaaactctgctttcaagagttaagagaattacagatcttgctgtaaattctattgatcgtgctatcggattagtcaacaagcaggttaaagctgctgatgctatttccaaagtacaggcagaaattggagcaaaccaagaagctgctcaagcttacttggataaagcaaattcaattgatctttctgatgtttataaagaaaaaatcatgaacggcgaactgaccgtggagacaattaatgacgagacactacagaagaacatcgaagattacaagagttactatgaatcttatctatctgcgatggacaatgtactcaatcttgaggataaactcactgaccttgctgaaaaacgtctatccattattgaggatcagtatgatgctattggagatcttaaagaagcgattaaatctggacaggaagaaaatcgtacacttcttgaaaatcttggaacatcaattaacagcgatgcaaacaagaatagccttaaacagtctattactgcccaatctcaactctactcttctctcactaagaagttagaagcttatgaggcagaagttgagtcacaactgaaatcaggacttatgaaaaaaggttctgaacagtggtacaatgctcagaagaatatccaggaatttgcaacgaacattaccaaagcttcaagcgaattaattgaattacaagataagctaagacagattcaatatgatgttcttcagaattctattgattcttatgctcgtcagacaaataagatgaatgcatatattgatttgcttggtgcgcaggatagacaagttccggagaacttgtatcagcaacagattaaactgaataataaccaaattgcaaagcaatataatctaagagcaaagtataagaaagagcaagaaaaatatgatgtcaattccaagagatatcaagagcttgcagaaaagatcaacgatgccgatgttgagattctaaatcttcgtaaagacaacgaatccctcaaagattccatctacgaacttcgctttactaatatagataaggcaatccagaaatattcagaccttgaggatgaattgtctaacttccgtgatttgttaaatgatgatgcgtttgttgataaacagggcggaattacagatgaaggacttgctaatattgcattattatctcaaagtatcggaaatgcaaagcagaaaatagctgattatacgacaggacttacaaaactgtatcagacttataagaatggtgtaatttctgcggatgaatataatgaaaaagcacaggaatacagacagggcattcaagaagctacaaaggatgttaaatcatatcagaattcattgactgatttgtacatgaaagcaatgcagactgaggttgattatcttgggaaaataatcgacaagaggaagaaagctttatctcaacaaaaagaggcgtatgaattttcaaagaaagttaattctcagagcaaagatatcaatagtctaaaggcacagtatgaagcaatcaagaattcaaacaatttggctgacaaggcgaaagcaaagcaattagctgctcagataaaagaaaaagaagatgaacttgcagatacaaagcgtgaccatgagtatgatatgcgttctcaaggctatgacaaaatgtcagatgagttgagcgaacttcttgaaaatacagagtacgagatttcacataatgctgataaacagcttgagattattaactccatgttagacaaggaagttgcatcttatgaggctgcatatgcaaagattaattctattattcgtgaaactggattcaatggtagttcagatttccgtaatgagcagaaagaacttagcacagagcaaggagcgcagaatcagaagaatgaagcaacgcagtctcaagcatctgctaacaagaacccatcttctgctgcttcaggaacaaagacagataagatctacgagggcaaaagtcagaatgataaaataacccatgagattttaaagccagaagaaacaaaacgtaaggttgctgaacttactgtagataaaacttctgttagtctcgaagagggaaaatctattggcattaaaacatccgtacgtccaaatgatgccgccaataaaactttatcatggacttccagtaatacttcaattgcgactgcttctaatggaacgattaaggcaattaaacctggttcttgtactattactgttgctacgacagatggtggtggaatctctaaaacaattggagtaactgtaacaaagaagcctgaacctccaaagccagcgaaaaaacctacagcttctacttctaatggtaaagacggaatcttaagagttggagatactgcgactctaagtggtaggtattattatgattcttggggtcaacgtcctgccggaagtaaatatgctggtgttcgagatggtgtaactgtagatagttatacttcttccgaatacggtggaaacggtaaaagtacaggtgattataaagttcatattggcggtacagatggtgtttacaaagaccttggatgggtaagacctgaccaattaagtggttacaaggatggtattgagcgtgtaccttatgaccaagttgccgagattaacgaaggtaataaggatgaaacaatcattactccaaaagggcatacgctgacactccttacaaggaacagttctgttcttaagaatgaagcgcagagaactctttgagacattgctaataatccacaattgtttgcaaagaatttgattgctgagaatttggtaaattctatgccacagggatttagtggatttgttaatgatgttaaattacctgatgttacaacgaataatcggagtattgtatttaacctaaatgatttagtcaatattgaacagatgacaaatactgatttaccagatcttcagacaatcattgagaaatcatatgacaatatggttaagaggactactcaagaagcaagaaaattaggaattaaaaggacaagataaaaataacagggcattggagaaatctgatgctctgaattaaaataaggagaattacgtgaaacaacaggaaaaattaaaattgtcgtgcgtcaaagaaaagaaaatgcttattgcttatgaaatatcacatactgatatgacaattacaagcaagtcagtaaaagaattatggcttgaatggtatccggaggatgctacatattttgatatgttaccttacaaatgggacacttgttataactggatcagtaaatatattaataagcatgattcgaagtttatatgtgaagcaattaaaaagcaacgtattcgccaaaaaagagagttaaataaaaaactaaagtatacgaatacgaatgcatatatcatcttaatcaaatctaatattaaaagaaatcaattagcaaaatatctttatgttaatggagcggaaaaaagaacaggtgatttcggctcaatagttgcatatattaaaggtttaaaagaaattccaaaaaaataattgaatagaaattaaatgaaggcggtgtaaataccgtcttttttaatgcaaaaaaatcccgtgtagtccggaatgaataatagactgcacctgcctgagaaataggttcatgtaggtaaaagaatggaggacattttgagaaaaaataaaaaaataaaatataatggaacaaaagtgtgtaaagtgtgcggaagagaattactaataaatgagtttccacttaaagggggaagaatatgcaaagaatgtaagaataagaagaatcgagatcttactgcacaaaagagaatcgagcaatatctttctgatgaatccatgcacttcaagaggaaatataagaaaattgactcttcaagaatactgagaaagaatgattctggaatagatttgattgctagagatgaacgatttgtaaagttgttatattacaaggatacgtggtatagcagtcatggacgtgtagttgaatatagagatggaaaatatagagttcagcgtggaagtaaagataaaagaactggaaaaaggatgtttacacttgagaaggaaaaatatgttaagcctaccaaaatattcaagtatgtaaaacacagggtatctgcggaagaattagcagtagaaacgtttatcgttaattatgacaagacgaataatacaagaatatggcatcaattgaacaatgagaacgatttatattataaaaatctgtatccagttacggaaaaacaatataatcgattgacggaattgcaggaagaatctgtctttctgttatctgaagatcttataatgcaggtaataaatgcagtggaatacaagcaagatggatggaatccggcacattacagaagaggaatgtgcggaatagggtacagcggaatggctgttggaacagaaggttatcatgaaaaatcatatactaagtggaaggacatgatgcagagatgtcatgataaagaagtgcataaaaaatacaagccagaatatgcggataaatgcgtgtgtgaagagtggcagaattatgcgaatttcaagctttggtatgacgagcatcatgtgtttggaaatcgaattgatttagataaggatatactgaagccgggaaataaggagtattcccctgaaacatgtgtattgattgaacactatattaatacaatatttgagcgtcacgtatcggacaacatatacgaaaatgaagatggaaaatactttgttggcagtaatagaaaaaaagtatatgagacatatgatgaagtgtttgaatttgcttgtaacaagaaaaaagagcgtatagaaaaggttgcagaaaagaatcttggaagaataccaaagtgtgcttatgacgcaatgctaagatatgatgttgaagcattgataagacgagatgttatagcagcataataatatcataaggaaaactattctatggaactagcagcagagggttttattaacaggtgtattggaaatgctccttcccatatttgtatctatatgttgtatagtgtcacaaagttgtaacgtttacgttatttgttctgaaaatcctttatttaatgcgttagccctccggggcacgtgggttcgaatcccaccaactccgtaaaaaacaaagaaaaatgccggaacatatctcgaaaagagtgtgtttcggcatttttagtccattaagaatgagaaacaatatgcttcttaatcgcattgaaactttcctcactgatcacatgttccatacgacacgcatcatcagctgcaacctgtggatcaacaccgagtctttcaagccaggaagagagaagtgtgtgacgctcatatatcatgtcagcaatcgcctgtccggattctgtcaatgtaatatagccctcgcgagatacgataatatgttcgctttctctgagctttttcattgccacgctgacacttgatttcttaaagttaagctctgctgcaatgtcgacggcacgtacgacaggaagcttcttgcttaacatgaggattgtctccagataattttcagatgattcatttacatgcataggtaatggcctcctctatataaattataatttatccgtatcactatttacagtgaattttcatgtctttgcttagtatatcataatttattcccgacagcaaatgatttgccggacaaattttgatttccacggaacagaaaaataaaaaaaatataaattagtcattgacaactaatgaagattagcatatactaacttacgaataggagagaaaatgaaaaaaattatcaatctcaactgtttttaataatctatatcaattgaaatcaattgaaaatagattccaatatcattttagaaagaagcgtgagattatgccacttacaatggccaacattggcgaaaccaatacaattaaaagagtaagcggaaatgatgagacgaagcgttttcttgcgaaccttggattcgtaccgggagcagaagtgatcgtgctttctgcaatcggcggtaatgtaattgttaatattaaagattcaagagttgcagtaaatgctgatatggcgcgccatattatgatctgatcaagacgctgaaagaagtgatgagtgaagtaagaaaggagtatgtgttatgactttaggtgatgcaaaggtaggaactactgttgtagttacaaaaatcgaaggagacagtgcttacaaacgtcgcatcatggacatggggattacaaaaggaagtgaactttttatcagaaaagttgcaccgcttggtgatccggttgagattacagtccgtggatacgagcttactgtcagaaaagcagatgcacagtgtgtggaggttaaataagcctacagatacaaaaaacctgatgagagattctagaatttaaggaggcaaagagagtaatggcaatcacaattgcacttgcaggaaacccgaactgcggtaagacaacattgtttaatgctcttacaggagcaaaccagtatgttggaaactggccgggagtaacggtagagaaaaaagaaggtaagatcaagaacaagaaatacaaaaaggaagatattacagtaactgaccttccgggaatctattccctttctccatatacacttgaggaggttgtcagccgtgattatgttctgaatgagaacccggatgtaatcgttgaccttgttgatgcaacaaacattgaacgtaacctgtatcttacaacacagcttattgagacaggggtaccggttgtaatcgcattgaatatgtgcgatcttcttgctaagagaggcattaagattgatgtcaaacgtctttccatgctgatcggatgcccgatcattgagatttcagcactgaaacagaaaggcctgaatgaactgatcgatgaagcaatcaaagttgcgaagcagaaagaagtaaagcttcctggtgagatttttgcaaaagacatggaagcagcagtagaaagcgtaaaagaaatccttcctgatacaatcacagaagataaaaaaagatggtacgctgtaaagttccttgaaaatgacagcaaagttgtagatcagataaagctctcaggtgcagcaaaagcagttgttgaagatgaaagaacaaaactggaaaagaaacatgatgacgatatggaaagtattgtaactgacggacgttatcagtttatccagaagattgtcggaactactgttaaaaaagcaaaagaaaaactgacaacatcggataagattgaccgtatcgttacaaaccgaatccttggtattccgatttttatcgcagttatgtggcttgtatattacatatctgtcacaacagtaggtacatttgtaacagactggacaaatgatacattcgttggagcaatccagaatgcagtcggaggattccttacgaatatcggagcaagtgacctgattaacggacttgtagtggatggtatcatcggcggacttggagcagtacttggattcgttccacagatggcaatcctgttccttttcctgtctattcttgaagactgtggatacatggtacgtattgcattcgtcatggaccgtgtgttcagacatttcggactttcaggcaagagctttattcctcttctgatttcttcaggatgtggaatccctggaatcatggcttccaagacaattgagcaggacaacgacagacgtcttacaatcatgacagcaacatttattccatgtggagcaaaacttccggttatcgctatgatgggtggagttattgccggtgaagtagcaggatatcaggagagctccttcattgcaccactgatgtactttgtaggaatcgttgcagtacttgtttctgcaatcatcctgaagaagacaaaacctttctcaggaaaaccggctccgttcgtaatggagcttccacagtaccatattccacaggctaagacagttctccttcatgtttgggagagactgaaaggattcatcatcaaagccggaacaatcctgttccttgcatgcgtagtaatgtggttccttggaggattcggatttacagcagatggattcggacttgtagaagacagcgcagacagcttaatggcagcaatcggcggagtgatcgctccactgttcgcaccacttggatttggtgagtggcagcctgtagcagcatctatctcaggatttacagcgaaagaagcaatcgtttctacaatgggagttcttgcaaatgtgtccggagatacagaagacgcagtgacagtagcgcagggagttgcttcctggttcccgtcaacaattgcagcatttacattccttctgttcaacctgcttgactcaccttgtcttgcagcaatcgcgacaatggcacagcagatgcagtccagaaaatggttctggtttgcaatcctgttccagaatgtatttgcttatgttgtttgcctgatcgtataccaggtaggatctttcgtaacaggcggagcatttggcgtaggtacagcagtaggatttatcttattgatcttccttctgttcatgctcttcagaccagatccgtacaaagatcagaaagtatactcaaaacgttctgtgcaggcagcgtaatatgagagaaacaagaacgtgaaagcgttcttgaaaaatagagctggatgcaggaaatgtatccggctctctgttataataagagaaaaaagaggtgttgatgacaatgatagcaaatattgtaataataactttaattatcggatattgtatttttctcatttataaaggatataagaaccataaagaagggaaacatgtcggatgcgccggatgcagcggcaattgtggaagctgcggcggatgcagtgcggcagctggaaaatctcaatatacaaagaaaaagtaaaaggtgattagaatgggaaattcaacaggttctatgttttacgcatttggtgcatttcttttgatttaccttgttggtgtatccatctatcagatttatctgtggatcaagaaatggcgagaaaacagagaagagaaagaagactaaaagagggatcacaaaatggcagatattatcattatattaattgtaatcatcttgcttgggttggctctgaaaggatcaatcaaacattttaaaggagaaggtccttgttgcggaggcggttcaggaagtagcaagaaagcaaaaacaaagtttttagacggtccggtgattggcagaaagacgttgaagatttcaggaatgcactgcgagcattgtgcaaataccgtaacgaatgcattgaatggattggatggtgttactgcaaaggtgagtttgaaggaaaatagtgcagaagtttcctatgacagagaaattgatctggcagatttaaaaaatgcagtaaaaaatgcaggttatgaggtcacctctatctcatgagagcgaaactctctgtgagatggcgaagtaactgatacagcgaagaccagaaagcaggaggtgtaccgtgagtaagaaagagcaaattattgaaaaattaaaagaaaacggatgccggatcacaaaacagcgtaagatgttgattgatattattttggaaaatgaatgctcaagctgtaaagaaatcttttataaggcatcccaggcagatgaaaagatcggtgtggcaactgtttacagaatgatcaatgcattagaagaaatcggagcaatcaacagaaaaaatatgtataaagttgattgtgcgcaggattgtccggaagatgggggatgtatcatcatgctggatgatgatacgatctttaaacttacggaaacagggtggaacaaggtgatccgcgaaggactgaaacattgcggttatgtaaaagatcaaaaagtaacatcaattaaattaccggataataaacgataaaatttatcgataaatgcagttagaattgactatctgtatagtgagttgatatgatgtataaaaattttaggaggttttatacaatgtgggatatatttaaattgaaaaaagcaggaatctttgcaggaggtgttcttttcggaacagcgggagtgaaaattcttgcaagtgatgatgcaaagaaagtttacacaaactgtacagcagcagttttaagagcaaaagactgtgtgatgaagacagctacaactgttcaggagaacgcagaggatattcttgcagaggctcagcagatcaatgagtcacgtgcagcaaaagaggctgaggctgtttacgaagcagaagaagcagaagagacagaaactcaggaagagaatacaggtgcgcaggatttcaaagaggaagaagtttaaatctctatgaaatttattgtaaagcatgagattaatggccgccttcgtatccatgttgtccagaaaaggatgacatatacggaggcggatactctatcctggtttctctccaatcagaagaatgtaacagatgtaaaagtatatgaacgcaccgcagatgctgtgatctgttatgttggagataaggaagaggtcttgaatttattgaagcagttttcttatgaaaatgcaattcttccggaacatgttgctgcaggttctggaagagagctgaatgctgtttatcaggaaaagctggtcatgaagacagttcttcattatggaagtaagttattccttccgatgccggtccgtgcagtgattacatctgtaaaatcagtgaaatatatctggcacggaatccgttgcctgatgcatggtaagatagaggttcctgtcctggatgctacagcaatcagcgtttccgtattccgtagagattatgctacagctggatctgtcatgttcctgcttggaattggtgagatcatagaagaatggacgcataaaaagtctgtcggagatcttgcgcgcagtatgtcacttaatgtcaataaagtgtggctgaagagaaatgaacaggagattcttgtaaaatcatcagatattgagccgggcgaccatgttgtgatccgtatgggaaatgtgatcccgtttgatggggaagtagttactggtgaaggaatggtcaatcaggcatctcttacaggtgagtcacttcctgtaagaagaagtgtaggacagtctgttttcgctggaacagttctcgaagaaggtgagattgaagttcttgtcaaagcggtatcaggctctacgagatttgagaagattgtgacaatgatcgaggattctgaaaaactgaagtcttctgtagaaggtaaggcagaacatcttgcagatagacttgttccatatacattactggggacaggtgcagtctggcttctgacaagaaatattacgaagacactgtctgttctgatggtagatttctcctgtgcattgaagcttgcgatgccgatcactgtactttcggcaatccgtgaggcaggcgagaacaatatcacagtaaagggtggtaagttcttagaggccgtggccgatgcagatacaatcgttttcgataagacaggaacattgacaaaggcaacgccgacagtgaaagagattgttgctttcagtgaatactcagaaaatgatctgctttgtattgcagcatgtctggaagaacattttcctcattctatggcaaaggctgttgtagatgcagcgaaagaaagacatttgtctcatgaagaaatgcactcaaaggtagaatatgttgtggcacatggaatctcttcctctattgatgataaaaaggttctgatcggaagcagtcatttcattttcgaagatgaaggatgtacgattccatccgaatatcaggatagatacgattcattaaaaccagaatactctcatctgtatctggcaatcgagaaacaacttgttgcagttatctgcattgaagacccactccgcgaagaggcggcggaaatggttcgtgatctgaagaaagccggtatccgtaaagttgttatgatgacaggtgacagtgaacgtacagcggcggcaattgcgaaacgcgttggcgttgatgaatattatgctgaggttcttccggaagataaagcgaatttcgttgagaaagaaaaagcagaaggaagaaaagtaattatgatcggtgatgggatcaatgattcacctgctctttcagcagcggatgcggggattgcgatcagtgacggcgcagagattgcaagagagattgcagatatcacgattgcggcagatgacctgcgtgaagttgtgacgctgaaacttctggcaaatgccatgatgaagcggatacataagaattacagaaatatcgtcggaattaattcaggactgattctgcttggcgtgacaggaattgtccagccgacagtatctgcacttttgcacaatgtgtctacattgatgataagccttggaagtatgaagaatctgctggatgaaaataaaagaacagaacttgagtagttactggccgcatatcgtgtgaacagtaatgttgagtgagacatcataaaataagataagtaaggcaggaactgccgggaacagcttttgtaaaggctggacccggcagctctttattttaatgagaaacattatcagcaaataatattgatattacgtttccgttatagtatagtaaatacataggttagacacaactaacaaacaaggaagatatgtggaaatgaattcataaaacatacaggaaagtaataagtaaagcaatagataatcagatcttaatttcaggaggttcagtatgagtgtagtaatcattggaggacatgacagaatggtatgtcagtataagaaagtctgtaaacagtttaactgtaaggcgaagatcttcacccagatgtcagcaagtttaagcaaacagattggaagtcctgatctgattgttcttttcacaaacacagtatcccataaaatggttcgctgtgcggtagaagaggccggcagatgtaatgcggatgtgattcgttgtcacacgagttccaagaatgcgttagaagagattctggagaatgcttgtgcataataaatatatctgaattattgaaaaagtgaaactatgagaaacacgcttcgcgagtttctcaagttatcgcggcagtcgccaaggtctcgtgcaagcacggcacgcatcctccgtgtcaatcagcggagtgattgacacgggagtgaacagtaactgtcaaccatcagaaaaagaccttctgccggcagatcaaccacttgcaaaaggtctttataaaatgctgttatttattttgtctcaaggatcttatcaacacttgccagttttacactcaatacaaatacttcagcggcaactgcaagttcttccggtgtcggataagacggtgcaatacggatattgctgtcatgtggatcttttccataagggaatgttgctcccgctcctgtcataacaacgcctgcctctttcgccttcgcaacgattgccttcgcacatccgtccagcgcatcaaaggagatgaaatatcctccgcgtggcgcgatccaggatccaatctcaagtccgccaagttctctttcaagaacttcaagaacagtctcaaacttcggacgcaggatatctgcatgtttcttcatatgttctacaattccgtgaatatctccgaagaatcttacatgacgcagctgatttaccttatcatgtccgatcgtctgcacacgcattgtgcttctgatatcctccaggttcgcatcagatgctgccattgctgcaattcctgatcccgggaaactgatcttggatgtagaagaaaacttgtaaaccatatccgggttacctgccttcttacactccatcagaatctcaatcagataatcctgtttatcttcatataaatgatgtacacagtaagcattatcccagaagatacggaaatcttctgctgccggcttcaggttcgcaaaacggaacactgtctcatcagaatatgtgattccctgtgggttagagtacttcggtacacaccagattcctttgattgccggatcactgcttacaagtttctcaaccatatccatatccggtcctgttgatgtcatcggtacattgatcatctcaattccgaaatgctctgtaatcgcgaaatgtctgtcatatcccggaaccggacataagaattttaccttatcaagcttacaccatggagtacttcccatgataccatgtgtcattgcacgtgctaccgtatcatacatcacattcagacttgagtttccgaaaatgatcacgttatctttcggaacttccatcatatctgcaagaagctgttttgcttcatcaattccatcaagtccgccatagttacggcagtcaacaccatcttcacaagtcagatcaacaccacttgtcagtgtatccatcatccccattgacagattcagctggtctgctgacggttttcctctggacatatccagtttcagaccttttgccttcacttcttcaaactgcgcctccaggccactctttaattccaataactcttctttgctcaaatctttatatgcagtcattgcaggaatcctccactttctttattttttcacttttgttattgtatataatttttgacgtttcgtcaatgggttcttgcattcttttttattttcttgtttttttcagctttatttccacatgttttgcatttcaaaaatgtttttcattcatttttcactgtattctgtgttatcactctatcccatcaggttttatctatgcattattgatttttcctctcctcctgtgatatccttagaaagtagattccagtcatcattccacttgactgtgaataaaaatcttatgattctatggaggtaataaaatgaattttacatttgcacacaataacctgaatgtatatgatcttgaaaaatcactggatttttaccagaaagctctgaatttaaaagtagaacgtgaaaaacttgccgatgacgaaagttttaagcttgtatatctcacagacggtgtgaccccgcatcttttagagctcacctggctgcgtgatatggatcgaccatatgaactgggagataatgagatccatcttgcatttgctgtcgatgatttcgatgctgcttacaaaaaacataaagagatgggatgtatctgcttcgaaaatccatctatgggaatttattttattgaagatcctgacggatactggctggaaattgtaccgggcaaataaaaaaagttttaaaaaaaggaatcagcatcactgattccttttttggttctaatatcttacataatatgtaacacgtacagaacttaccttaaccggtactcctgtctgctgtgcttcgatcatctgtccgccgccaatgtaaatcgctacatgtcccggtgtccagcagatatctcccggctgtggatcatttacgattgttcctgctgcaagaatatctccacttgttcttggaattgaaattcctgcctgtctatagcaatactgtacaagtcctgaacagtcaagtccaactcccggtgtagatccgccccatacatacggaactccgatctgtgaataagctgcatttacaataatgcttcccttatctgcactatagcttgggcttggcgaggaagaacttgagctgcttgagcttgaactgctggaagaactactgcttgagctactggagcttgagctgcttgaacttcctgagcttgagctgcttgagcttgaactactggaagaactattacttgagttatttctattagaagaactactgcttgagttattcttcttagctgcttcctcggcagctttctttgctgcttctgctgcctttctcttagcttcttcttccgctgctttctttacagctgcatcaatcttaacatcgagatttgcgatttcactactcttctctgtgattgttgtattcagttcatccttctgcgcatcatactctgtctgtgtctcctgcagatcagccatctttgtctcaagcgttgtcttaagatcttctactttctgaactgtcgcaacatactcttcgagcttatctctgtcataagaatgtacctgctgggaatattctgcctgcgtcagtacactagaaatatctccggatgtcagtaccttctccactgtagcagtgcctgttccttcttcatacatgtacttaatacgaagcttcatagctgcatactgctgttcctgttcctcctgcgctgtcttcagatcttcctctgtctgagagatttcctcacctgtttcgatcagatcattctcaagatcagagatcttggtcataagtgaattcagctgtgtctgaagattacttacctgattctgtgtctcctgcttcttctgcttcagatcactgacctcgtcagcaagtaccggtgtaacagtcattgtacatgcaagtgttactgcaagaatcatactgcttactttttttaacttcatctttccacctatccttatttttatctagtcccccatgtgatgcattataatttttcgtatcacaattcattgtaaatagttacattataattccacatactcatatgttataatacaacatctattgtgttttttcaacatatttctcgtaacaagagggtattttatttacattctacgctcaatattatagcgtatttatgtaatattttcaatagtttcccttacttttttcattttttcgtaacatttttgtaacaaaaaaatctggaaagttctctttattcttagataaactttccagattcctgtttcactgtatgatcttttattttctactgaatatataagtttgtatatcccatcaggctttcatctacttctcttgccacttcacgaccttcacggatagcccatacaacaagagactgtcctctgtgcatatccccggctgtaaatacatccttcacatttgtagaatattttcctgtctctgtctttacatttgtgcgttcattcacttctacaccgaatgcttttgttacataatcctgacttccaaggaatccagctgcgatcagaacaagatctgcatctacggtatactcgcttccttctaccggaaccatcattttccgtccggtcttcccatctgtcttactctcaagcttgataagaactgccttacagagatttcctttcttgtcttttacgaattctttcactgtcgttgtgtaaacgcgaggatcagaaccaaacacagcgattgcttcctgctggccataatctgtcttgcagactcttggccactccggccatgggttcagcggtgtcctctcgtccggtgctttcggcatcatctccagctggagaacgctctttgctccatgacggatagatgttccgacacagtcatttcctgtatctccacctccgattacaattacattttttccttttgcagaaatgtagcttcctgttttaagcttcatgtcatttgcccataatgctttcgttgttgatttcaggaaatctactgcaaaataaattccctgtgcatctcttcccggtgctttgatatctcttggatttgatgctccacatgcaaggatcacgcggtcatattctttcaggatatctgccgccttcacgtcttttccgacattacatccagtctggaagataattccctcttcttccataatcgcaatcttacggtcgataatctgtttctccagcttcatattcggaattccgtagcggagcaatccgcccggtttgtcctcacgttcaaaaacagttacctgatgacctcttctgttcagaagatctgctgccgcaagtccggacggaccggaaccgatcactgcgactttctttcctgtacgcactttcggtggatttgcctttgcatatcccatctcatatgcattttcaataattgcatattcattactttttgatgcaactgcttcctgattcagtccacaggtacatgcattttcacacagtgccggacatacacgggaagtaaattccggaaaattgtttgtctttttcagacgtaaataagcttccttccaatttccattgtagatcaagtcattccactctggcacaaggttgtgcagtggacatccactggccattcctgcaagcggctttccagactgacagaacggaactccgcacgccatacagcgtgcgccctgaagttcctgttcttctttgctaagaggcgtatggaactcattgaaatgtttgatgcgttccaatgggctctctgccggtttatcctgtctttcataatccataaatcctgtcggttttcccatctctatgcctcctatcttccgttcttgatcatattaaatgcttcgatttttgctttttctctactaagtcctttttcttccatctggatgatcgtggacatcattctctcatagtcttccggaatgatcttcttgaattttggcagatattctttgaaattatcaagaatcttcttacctacctcagagtttgtataagcaacatgctcctggatcattccttttaattcctgtacatcatacttatctgtgacacgttcaatgttgaccattgctttatttactttacgatacaggctgttatcgagatcgattacataggcaataccgccgctcattccggctgcaaagttctttccaacctgtccaagtacaacaacacatccacctgtcatatattcacatccgtgatctccgacaccttctacaactgcgcgtgcaccagagtttcttaccgcaaaacgttctccggcaacacctcctacaaatactttaccacttgtagctccgtaaagagcaacatttccgatgataatattctcatctgatttgaatttcacacctttcggctggcaaacaaccagttttccaccggaaagtccttttccaaaatagtcattactgtctcctgtcagttccagtgtcagtcctcttgggataaatgctccaaagctctgaccgccggcacctttacactggatcacatagctgtcttcttccagtccttccggatatcttcttgtgatctcagatccgaaaattgttccgaaagtacggtctgtatttgtaacatctacttcaaggcctctcttttctcctctttcaagggctgggagaagctgtttcaatagtactttttcatccaacgtcttgttaagttcaaaatcatagactttctttggattaaagataacacctttcttctctttcgcatatggattgtacagaatctgtgacagatccagtgttgcggcacgctctgatgtcggaacgtcttttactttcagaagatctgtacgtcctaccagttcatccactgtgcggacaccaagttttgccatatattctcttaattcttctgcaataaaacgcataaagttgacaacatattccggttttccgctgaaacgttttctaagctccggattctgagttgcaacacccaccggacaagtatccaggttgcagacacgcatcataacacatcccattgttacaagcggagctgttgcaaatccaaactcttctgctccaaggattgctgcgattgcaacatcacgaccactcatgagcttaccatctgtctcaatacggacacgctcacgcagaccattctgaatcaatgtctgatgagtttctgcaagtccaagttcccacggaagtcctgcattctgaatcgagcttctcggtgctgctcctgttcctccgtcatatcctgagatcaggataactccggctccggcttttgcaacacctgcagcaactgttccaacacctgcttctgataccagtttcacagaaattcttgcatttttatttgcatttttacagtcatagatcaactgtgcaagatcctcgattgaataaatatcatgatgcggcggtggtgagatcagacttacacctggtgttgagtgacgtgtcttcgcgatccatggatatacctttccacccggaagatgtcctccttctcctggttttgctccctgcgccatcttgatctggatttcctgtgcactgaccagatatctggatgtaactccgaatcggccggaagcaacctgcttgattgcagagcatctgtttgtgtcaagacgttcaatatcctctccaccttcaccggaatttgatttaccatgaagcatattcatggcgatcgccattgtctcatgtgcttcttttgaaatagatccataggacatcgcacctgtcttgaatcttgttacgattgaatctacgctttctacttcatcaagcggtacactcttctttgggaaattgaaatcaagctgacctctcagattgatcttctcgccttcctcatcaaccatctctgtatactgcttgaacatttcataatcaccacgtcttgtggactgctgaagcatatggattgtctgtggattatagagatgttcttctccgccacttttatatttatgttttccaacactgtccagtgtcgtatcaacctgcagtccaagcggatcaaatgcttctgtatggaatgctgtgtaatcttctgcaatttcttcaataccgataccaccaacacggctgactgtatctgtaaaatagcggttaataaaatctgtctcgagaccaattgcctcgaagatctttgctccctgataggactggatcgttgaaattcccatcttggatgcaatcttaataattccatgaattactgctgagttataatcatctactgctgcataataatctttgtgaagcagattagactcaatcagctgacggattgactcatgcgcaagatatggattaatcgcacatgctccatatccaagcagtgttgcaaaatgatgaacctctctaggctctccactttccagaatcatcgcgactgaggttctcttctttgtacgtaccagatgctgctgcagtccggatactgccagaagtgacgggattgcaacgtgatattcgtctacctcacggtctgtcagaatcaaaatgttagcaccctcgcggatcacacggtctacttcaataaacagatactcgattgccttctcaagacttgtgtttttataataagtgattggaatctctgcaaccttgaatccatccactttcatatttttaattttcagaagatctgtattggtcagaatcgggttattgactctgagcatcttacagttctcttccttctgctccagaaggttaccgtctgttccgacataaattgttgtagatgttacaacttcctcacggattgcatcgatcggtgggtttgttacctgtgcaaacaactgtttaaaatatccgaacagtggctgacgtttctgcgaaaggactgaaatcggtgcatccattcccatcgctgcggttccttcggcaccgttctttgccattgtcagaatagaagttttcacgtcttcataagaatagccaaatgctttctgaagctgtgtacactcttcggcagtatactttggcacatccttattcggaattttcaaatccttcagctgaatcagattactgtccagccattctccatatgggaactgatttgcatatttttcttttaattcctcatcatcgatcacgcgtcctgcaacagtatcaacaagaagcattttgcctggatgaagtctttctttcatcacgatcttggatggatcgatatccagaactccaacctctgaagaaagaatcagattatcatcatctgtaatgtaatatctggaagggcgaagtccgttacggtcaagtactgctcccataacatctccatctgagaacaagattgacgccggtccatcccatggctccatcattgttgcataatactgatagaaatctttcttgttctgggacatctctttattgttgatccaaggttccggaatacagatcataactgcaagcggaagatccattccactcatcaccatgaattctaatgcgttgtcaagcattgcggagtcagaacctgaaatattgattgctggaagtactttgtgaagttcgcctttcagacatcctgcctccatcgtttcctcacgggcacgcatcttatctgcattaccacggatcgtattgatctctccgttgtggaccataaagcggttcggatgcgctctctgccagctcggtgcagtattcgtactgaatctggaatgtaccattgcaattgcagaaataaattcttcatcctgcagatcttcaaagaaaagtctcagctgtcctacaaggaacattcctttgtaaacgattgttctgctggaaagtgaaacaacataagtatcatcactgctctgttcgaagattcttctgactacatacagtcgacggtcaaagtcgattcctttctcgtattttgcaggacgttcaataaatgcctgcataatacatggcatgcaatctactgctgtctttccaagaatgtccggatgaatcggaacttctctccagcccaagaacttcaatccttctttttttacaataacctcgaaaatctttttcgcctgattgcgttttaattcatcctgcggaagaaagaacatacctacaccgtaatctctttcatctttcagcttgatcccaagtggctgacagacttttttgaaaaatccatgaggaatctgtgtcagaatacccacgccatctcctgtctttccttctgcatcttttccggctctgtgctcaagttgttctacaatactcaaggctcctgccactgtactatgtgtctttttgcctttgatattgacaattgcaccaataccacagttatcatgttcaaaactttcgcggtaaagaccacgattctgactttccatttctttcctcatagtcgctatcctttcttcctgtaatctaaagtttactttaaaatcttctttgtccggcgcattcaatcatttctttctcacgtcgtgtaaaactttttctagaatatacacccttttacctaggctgtaaatagggaaactcttgcaaattgtctgattatttgatttttcattatttttcttttaatagtcagattattttgattttcttataaaaataatattaattattaagatttctgtttttctttgattttatttaataaaatactgaattaaaaagaaaatgcgcgacaaggtttcgcacctcatcgcgcacaatttaagattgtatttttattagtacaatttatttcattcgtattttttcactattcttctgttttctgagtactcaccggatcaccgcttctctgaatccacacaaaacaagctgcacagataaatgtgctgatgatcactgccactgccattttaaacggttctctggcaagccagttaaatactccgatatctgtaaagatcaaagagcccagattcaaaacaacgtgaagcataatcggagctttcattgaaccaaatttctcataaatatagcacagaagaattcctaggaggaaagtgtaaatcatctgtaccgtgttggtatgtgtgactgagaaaaacagtgctgaccagattgccgcataataaaatcctctggtctcccggtacctctgatagagcactccgcggaacataaactcctctgcaatcggaattacaaatccaaatacaataatctggaccacaaaatctgctgaatacatattctgtgcggtctggatatactccggatcaaccaaaacggcctgtgccatagcggacagacatgtaacaccaatacttccgatcactcccatcacaaaaagtgaccagtaattcttcagtggcttttgaacccccatccgctgtatccctgcaatctgctctttctttcgatcgataacaaacaatgtaactgtcagaaacaacgttgctgctgtagcaatccctgcaatcgcaatctggcctcctatgattttatcaaacgcaggacttaacacttcatagtacttattcatcatgtcctgataattaagaacttctccactttgtgtcatcttggaagatgcttcccccataaaaggaagaatgattataaactcaatcacaaattccatcaccagctggattccccagaatccaagtaaaggaccggcagctctccagaaggagcgtctcggattatttttcataagacaattcctccgctatcttctgaatccactctctgatctttccggcttcaccttttacagttccctgaaccatctccggctttccgcctccccgtccttcgaatgcagcatttaacattttggaaaatgcacgaagatcctgggttctgcttccgatcacataacggtatcccgctgcatcatttccataaaacacagcacaaagaattctttctttttcaagcacttcattcacatactgacgcatagcatccgcactgatatcctccgaaaacatacagaccgttttttcttcttccgaaacagactgcgcccagacgtgtacaagctggcgttctttctccaccagtgtccgtttcaaagaatccagctcttctttcaagtgtcccactgcctctgctgtatcatattctttcgcacagagcaacgctgaaattttcctgttctgttcctgcttcttctcataatctgtaagtgcacggcttccacagagcattgtcacacgaacgccgcctttgtatcgctgcatattaacaagcttgatcataccgatctctcctgtgcgttcaacatgcggcgcacagcacgcacagatatcatatcccggaaccgatacgatacgaacctgtccctcaatctcaatcttactgcggtaatccagttcttccagctcttctttggatggataggacacttctattgtcagattcttccacactgcacgatttgcttcaagttcaatctcctgcagtgcttcttttgatatctctccatcaaaatccatcgtacaatcttctgttccaagatgaaatccgacattgttgaaaccgtatcttgcatgcacgattccggaaacaatatgctctccggtgtgctgctgcatcttcataaatctggtctcccagtcgatctcgccttcaacaatctctcctgcttcaaacggctgatctgtaatatgcagaattcttccattcttttcccgaacatcagataccttcgcatccttcagttttcctgtatctgcatactgtccgccgccttccggaaagaatgctgtacggtcaagttctaccgcatagcatccttcctttttctcatgcggctcacattccagaaccattgcagtaaattttgaaagatggctgtcattgtaaaacaatttttctgttcttgtaccatccatcaatccattttctgtcataattcgtattacatcctttccggagctgtaaatccaagaagatcaatacaagtctcaagcacttgcttcgcaagtgtgagaagtgcaagataacctttcttcttctcttcgtcttcttctgtaagaatctttgtctcatgatagaacttattaaagtcgttcgcaagatcatagatatatgcacacaacttatgaggagctgtctctttatatacattatcgatcacttcattgaatttcactacctgaagcatcagagacttctctgcatcattctcagccggtctgatcgttccgtcaagaactccgccattctcagcatatttcttgagaatagacttaattctaacgattgtataaagaatatacggtcctgtatttccctcaaaggaagtaaatctgtcaacatcaaagatataatccttagaagcctggttagaaagatctccgtacttgatcgctgcaagtccaacttcttctgctgtacgtcttgcatcttcttcctctactgtacggttgtccatgatcttcttatacatctcatcatcaatctcacggatcagattctcaagacgcataacaccgccttctcttgtcttaaacggcttaccgtcttttccgttcattgtaccaaatccaaggaatgtaagttctgtctccggttttacaattcctgtcttcttcgcacaacggaatacctgcacaaaatgcagttcctgacgcttatcaacaacatagatcacctgatccggatcatacagtttctcacgttctaccagtgtagcaagatctgttgtatcatacagcgcagctccgtcagatttcagaatcatacacggaggaatctctttcttatctgtctcttctgcaacgtctactacaagcgcaccctcatcataatgtgcgaatcctttctccttgagcatctcaaccatatccggaatatatgcctgggcatctgcttcacctttccagagatcaaaatctacactcagtcgctcgtagttcttcttcaagtcagttacagacacattcatgatatgtttccagattgcacgatatcctttatatccattctgtaacagataagttgcatgaagtgcttcttctctataatcgtcgtgctcttttgcataagcacttgctgtaggataaatctcttccagttcactgatcgtaaatggtgcttcttccggatattctccttcaaaactctcatcaaaatacgggagttccggtttacgttttttcagctctgtgatgatcagacccatctgatatccccagtctcccagatggatatctcctgttacatcatttcctttaaaacggataatacgtttaatgctctctccgataatcgcagaacgaagatgtccgacatgcaacggttttgccacgttcggtccgccgtaatcaataataacttttttcggattcttttctttttcaacaccaagattctcatctgctgccatctcattcaaatactctgcaacaacttccggtgccagcttcaggttgataaatcccggattcaccgcttctgctgatgcaaaatacttgctatctgcaagttcttccacaactgcattcgcaatcatgattggagccttcttatatttcttcgcacctgccattgcaccattacactgatattcacagagatccgggcggttggaaagcgtaactcttgcaagctcttcatcatatcctgctgctttgaacgcttctttcatttctattgtgatcatttccagtaatgtcttcaaagtttcacactcctctttacttttcgtttgtcttttctgcctgacggcaattttattaaaacaagtctgcctcccaacttttctggagacaaacagccactatttattctatcatgtatcctgcggaacagcaagcgttactgtgaacagtaacggcaacgattcaaattgatccggactgcccccgaaaccaattgacataaaaataaccaatacttataatgtaaccacagctttacacatacagtttctacatcctgtatgatataacatcagacagaaaggatatccaacaatgttaaaattaggttcacacgttggcatgagtggaaaagaaatgcttcttggttctgcgaaagaagccgtttcttacggtgccaatacatttatgttttataccggagccccacagaatacccgccgaaaagaaatcagtgaattgaatatcgaaccagcatgggaatatatgaaagaacacggaattgatgaaattgtcgttcatgcaccttatatcatcaacctcggtaattcagtaaaaccagaaacgttctctcttgccgtagaatttctggcaaaagaaatcgaccgcacgattgcctgcagaagccacactctgatccttcatccaggtgctcatgtaggtgccggtgtcgaaatcggaactgcacagatcatcaaaggactcaatgaagttctcactgctgagactgactgctgtattgcccttgaaacaatggccggaaagggatcagaaatcggacggaattttgaagaacttgcccggatttatgatggagttgtccagaatgataaattgagagtctgctttgacacttgtcatacaagcgacagcggatatgatatcatccatcattttgatgatgttatggagtcttttgaccgtctgcttggaaaagatcagattgcagtcttccacatcaatgacagtaaaaatattccaggagccgcgaaagaccggcatgaaaatattggctttggagaaatcggttttgatgcaatttctacaattgtccatcacccggatttcgaatctgtaccgaagatccttgagactccttatattccttctgtaacaaaagcaaagaaatcttatgccccttataagtatgagattgaaatgctaagaaacaaccggtttgatcctgaaatgaaagaccacatccttgcagattgtgaataaaaaactatatgaaaaaagtcctgttattctcagccatctgaatgcgctgaaataacaggacttttttatcctatagcgtctgagcggagtcgaaccgccgcacatgcctccggagggcatcgctctatccactgagctacagacgcatctcggttgttagtaggaaaatttaatttcgtacagctaacaaccttttttatcctagcacaattctgtataaatgtaaagtggcaaataaacctctaactttctacggttaatcttttttcactgcaagcagaagaattaatatccctgccccaagacaaagcattgcccatgcacctgcctgttgtgaatctccggtctttgcagcctcttcccttatcgtttgttttggacataccctgacattccagttcattgcccctttgtcctcttcccattttggcagctggacaagaaccggctgaacctcgtattctgattcatcttcaacatagatcagataaactcctgccctcagattcgtaagggttgcttttccatcacaatccgtcctgcacaatccatcactataatgatatttactcaaagtccgcgccagctcttcctgttctctggcataccttacctcattgagatccacgcctttatcttcatatcttttctccatctcgtaagcaccatcaacaagagatgccactttggaatactggaatgtaacaccttctctcttaatttgttctccggtatcttcaatacagatttctatatttcctgtttctgtttctgcaaacgccgggttctttactgctaccaccagaaaacatatcaaaagaagaagaattccgcatttgattttcccattttgccgtcttttgcatctttcttttttgtctcctgcttttctttcttttacgtttctttctcctgtagtgcttacatttccttttctggtttctgtttctttttctctttccctcacaatttcttttttctcgctttctttttattctttcaatcacaacatataccaaaaagagaattggaatcattgtgaagatcatttctctgacagacggacgtttctttttgattccctcttcttttttctcttcatacacaacccgctttccagtaatcactaaccgatgggtattaattccatatggggtacatgtgacaagcgaaaccagatcttctcccggtctgatttccagactttctacctcttctggtaagattacatttatttcttctactttatatgcgagtttttctcccagtacttccagaaagaactcatcgccttcctttaattcatccagacgagtgaaaagtctcgcacttgcaagcccacggtgtcccgtcatcacacaatgcgtattttctccccctatcggaagactactgtccatcaaatgccctacaccttccttaagtactgcctcgctggttccatgataaaccggaagcctgagatctattgacggaatttccagtacacacatcattcctgtctgtattttttcggcatttaacagaccttcatactcttccatctggtcagactcgctttgttccctgactcctttcgattctgcccaaagctttttattatattcatcagcctgattccttaattgttcaatttcatctcctgttgtctgttccacaacctgttcatatgttgccaacacattttgtgttttcttctgactataccagccagtcaaaagaggtatactacacaaaagaactcctatccatagtaaaagatctgactgtaatctattgtttttcctttgcattttttctgtttcttctcattgctcctgcaagaacaagaacacttccggttgtaatacagataacagctgctgaagaacctgttaccggcagtttttttccaactgtattaattactgtcagattagcagatccttcgccttcatttgttgtcagactgacttctgattctttccagtttccgttaataaattctttgatctgcgcagatgtctccagttttttcaatcctttgtctgtttttccgtctccttttacatatgcgtttctatcatttggaaaacttgcttttatatttaccacaatcggctctgtcagcagacggtatcctgccggtgcctctgtttctttcagataataggtgccactatctaatccatagatcacaaatgttccatcctgactggatttcatctccaccgcattttccagctgctttccacctgtatggtcgtttcctccaagactgtcccggttaattacaatgtacccaccttctccctgttttacatatacttcattttttaatccagcgtcagaataaagtctgaacctggcattttccagactttgtccatggttatttgatttcaatgcattgattttataagtgaaacaaacaactgtatcccacggtgtatatcctgtacttcctctcaccgctgaatccggatcatttgaaaattccagccgaacatcgttttcaaatcctggacgtcctgtatttttcgctgccttttcattcaatgttgcctgataggtaagcactattttctgtccatatttattttctcctgcttcatttttacgattaaactctctgtctatgatttttttcatatcagaaacaatgacctgaaacgtatctcctcctcccggagcttcctttacttcaaattcaccctctttcaattcataataatttcttgcatttgaactttcataaatccggatggctacagaatcctttttgaaagtaagtgcttcactcatcacatcatgccatgcgtaataataggtgttgtatccgttaacatcaggcatatttgactcataccgatacggaacagtctgcccgatttcaaaatcagccaaatcattccatccctgatttccaactttgtcctgatcatcatcttcccggatcttttttgtcacaaccggatagtctgattttatgttgagattcatttccggattagctgtacttaccatacacaaagaggccgccgaattcgttccttttacctctgtcacttcatcaataatataatatccatacggcaatcccttaatttcaaatgaattgtctgcttttgtacttgtcacttcaacagattgacctgtttttccatttctctgtagatgggttcttaattcttctacaaaaacacgatattcactgtatgctccttccttttcctgagcggtctgcgcaccttctgtctgatgcgtattcaaagactgaatatagtcgatcacctcatactctgttacatttctctcatccttatgaatccgctgtcccacgatataacaaacaaatttcttgtattccggattaaatgtataattaatggattccattcctttcgcattttctgcctgaaacaactgatataccagaaatctttttcctttcaggctctgtccgtcatttcctttgattgtaatacttgccggtccattattaagatttaaaaccccatttgtagttgctgctctttcctgtacttcattttccgctgcatatacagatttgattccagtcacacctgttgttccagaagtacagagtaccgcagctaaagtcattatataacaaattttcatcattctttttttcattttgtcatctcctcattttcaccgttttactactatcttttttgctctttttttctgtaaatcattgccatgattcctacagctaaaattcctgtaagtaacacaggttttcctgccgatccagtatctggaagcttctttcccgtctgatttatgatcttcattttcacattccactccttaattgaaccttcaatacttatcttgctgtctgcagtatctttgctgctgtattcttttccattcacaaccaacagacacttcccttcttccggattactttccagacagatttcatatacaatatctgcatcatctgatgttttcggaattctgtaacctgtcggcgcttttgtttctttcatatagtattttttctttacttccagattttcgaacattgcaattccattcccatccgtcaacacccggtcaatttctttctggcatgcctggtcttcatataaagtaaactcagctcctgcaagtgcaacacctttttcattttcctttttcagctcaatcttgtaacaggccggcttatcttctatcgtcactaccgcaattccatcctctgtatattcgataataacctctccttcttctgtatttacctcagataaaaattctgttttcccgctctcatcaacttgaaaaatcagttcattattatttggccgatacccgtccggtgcttttacttcttttaatttgtgcgttccctgagataatggcattactttcagagtccctttttcatccgttgtgagaatcttttcacttccatccggtctgatatgcttaaattgcgctcccgaaagaggatgtcctgtctctgttgcttttttcaccaaatggatctggaaaaccctgtccggtatcgtagggttctgatatacatttattttttctcccgtaccttctggttttatctggcaaacaaagacttcctcattcaggaaatacccttttggcggttttatctcctgaattgttacagttcccagcggaagtgcttctgttccgtctgtcgctttatacaatgcatcgccttttaccttatacttctcctgataacggcaaactgcttttgcatctgtttgaaagacccagcttctgactggctttttccctgctttttccggattttttcccggatccagaagttctgcatagaatttcactaaaaactgtgctccttgatacgctgctgttcccgacggatcaacatattcctgttccatacctgttttctttaacaaaagttccacaggattcatctgcggcgggtctgaaaatgtcactgtcgcttcctgcccggattttactgtaaccgttttcacttcatctacaagtgcataacctttaggagcttttagttcctttacgtaataagttcctgcgttcagcgcaactgatgacgaatttcctgccgcatccgttctaaacgttcctgctcttgatgcacccgaaagagtaggactactataaacaccatactctgctccctccaaagaatagcaactattcttttctgtcacagaagtattcgctgacaccttctttaatctgcctgttccggtcggctggtatgttccgccccatttactgagcggctggccattgccttcataaataaccccatatgcatccggaaaatatttataattctctttcgcccatgcaatccctttttgataatactcagatttgtgtgctgaaatccaatgaccattcccacaggctacattatttcctgtttctatctggaccatatctccataccaatgatgtacttcattcatgatccaccatactgcgcattgttttaagagataatcgtaattcgaactcacaccgttgcatttattcttatcgtagtaatagaacattgccgcgatcatctgaatggtctgtttgttataacgttttgaagcatctactgctgttttattgccctcctgaaactttaatgttggattggtgcaatacagactttctcctgatttcgtaccaagtcttccttcattccagtgctgcagcacaggccagtttgggtcattatagtcaactacatcgattgcaccgattcccctttcgatcgcctttgtataaacagtttctcctgcccttgccgctgcatatacgcctatgctttgtatcttcttttcatctgtctgatcaaaagtttcttccttgtcttcctcctgtttatcctccatttcgtcgcaaaatcccacaccgatatctttcaggattttttttacttcttctgcccatcgcagttcttcttcaatatcaacctccgttttttctccggcctcttcaggctgtttttcaagttcttcggccttgacaatgcctccatatgtcattgcatagagaatacagatcaaaaagactgacatgcagaggattgttataatctctccgcgtcctttcattcattgtcctccctgtcgatacacatctctttccccagctgaagtttcccttcctgtgcataataaaaataagcatgattgcttaagatttcttcctcaggcacctgcgtttcattgatttcccgcaccattctttctaattctgactgacggattcgagaggattccggtacgatgatcacttcatggacactgcttggaagaacatagaaattttcctttaagactcctgcaagcatgtccagaatataagggtatgcaatacaggccgccccataatttttcagtttattagacaaaacatacattttatctttttccggaagttccagttcttcatgaatatgccaggttcttcttaacaaattctcccgatcatgttcccccggagttgatctgctgagcagttcatacactgcaaaattcattccgaaacattctgccggaagcagacgctttgtattttcttttgccacattccaaagctgttcttttgtcaccttccattgtctcatatgcagatctttgatcagcatcactgccgtcccatcattgtccgcttctacaagtactgcaaacacaagtgacagatccaaaaattctctatgtggaacatccagaagtaattccttgtttttctctgtgttgatcagtcgaaagatgattctgtcttttaccccttcgaaagaaagcattctctcataatcccatgatttttcctgtcggatttcttcatatagccccaccagatcttcaatgatccaatccatctgtttccctttttcatatagttcaaaaaattcttccagatagattgtcggcgatatattaacacccggcgtctccaggattagtcctgtacgctctgttgcattattttttttcgtcgtatagacgtttaccctgacacctccatttaactcctgagtcagtttttcctttaccgcatttacaaattctgtataattcactcttctccttcctgattgcggttcataaaattaaaatgagaaaccagtacgaaatgtactatttcaattgagttagaatttcccggagagttcagaatctctccaaatagaatttcttaaaatttagaacaaatattatgtgttctttattatagacaggccttccttaaaaagcaagccagaattttgcataaatccgaattgatttttttagtgaaaacagagaatttcatctgattttgtcaaagaaaaaaggaacctgcataatacagattcctttttgaaatacagcttaaactgtactaaattcgtaattaaactcttgacagatactcgcctgtacgtgtatcgatcttaagaacatcacctgtctcaacaaacagcggtaccataacagtagctcctgtctcaacgattgcaggctttgtagctccctgagctgtgtcacccttgaatcccggttctgtctctgtgattgccagttctacgaacagcggcggctcaactgagaatacgttacccttatgggaacagatcttaacattctcattctcttttacaaatttcagagcgtctccaactacatcagcgttgagagcgatctgatcatatgtctctacatccatgaagttatacagatctccatcctgatacagatactgcatttcctttctctcgatgtgtgcattctcgaacttctctgtcggacggaatgtcttctctactacaccaccactgatgatgtttttcagttttgttcttacgaacgctgcacctttaccaggtttaacgtgctggaattccaaaatctggaaaatatttccctcaatctcaattgttaaaccattcttaaaatctcctgctgaaaccatgtataatcctccttaattgcatttcgttcagacaatgtaactgttcgttacagactttttgcttctaccattctatactaatttgcgacttttttcaatctttttttgctcttcttatagaaatgaagcacaatcttctctaaataccgctttaaaacgatctgaatctcttcttttggattgatcggatgcactaaaatgttgtgtattccgaccctctttgcgccccatacgtctgtaaaaagctgatcgccgacaaacagcgtgttcgtctgatctgttcccatgatctccatcgcatgaagataattctttcttgcaggcttcagcgcattataaatataatgtgtctggatctcctgattaaacatctctacacgttttttctgattgttggacaacagacagctttcaaaaccaatctctctcagtctctgaaacagtctctttgcacgttcatctgccggtgcaccgtgaggaactaatgtattatcaatatcaaagattaccccccggtatccttgctcatatagtttttcaaaagggatcttataagtcgatcccaaatattcatctggaaaaaatttttcaaacattattttcatctaactccgtaagctttgaaatcaattcttctatgatcccaagaattgatttcattataacaattcagtgaaatgatgtctactgtttttccaacgcatcctgcacatttctcctgaattctacccatgcgtcctcatcctctacaaaatatttcggacagatttttccggttacatcatagtgacggatcacctgatctgctgtcagatcatattttgcacaaagccatgctgtaagttgtacaagtgagcggtatgttgcatcagtaaactttccattctcatccggatgacaacattcaatcgaaatcgtatccgcattgcggtcatttgaagcatatgccatctcccaggtcggaatacactgaataatctctccttccaatcctatcacaaaattactgcttgccgaagtctcatggctatctttgagaccattaaaataatctctgttatcctgcgctgtactccccggattcgctgtgtaatggacaacaatcccattcacatggtcaattgttgtccctggtctggaatacggatttatatctaacaactgtacatccatctccggctgcgtagcatccacatcagcatattgatttttcttttgtatacaggatttaaaaagaagaaaaagtaataaaatcattaatgggatcattatgatccgcagcattttcctgcctcgctttttcttccttcgtgtattcttcggcaatgttttccgccctgccagctgatttcgtcttgacgtactcattcggtatttctcctgatttttaattctctcatttccatcgtttaaaacaaacatcttcttatttcagctattataccatatgtttcttaaccatttatgaattttgtcttaactgttttatattcgtataaaagagaaattcccggcagatccagctctcactgaacctccgggaattcctcaaggcgttcctatatattattttattatatcagggatgtgatttttcatcccgtcaggtaatgcggaatatccgcagtacttccaaattatcagtctgcataaaatctgcaaacttcccaattactcgtctacactgtagttcggagcttcttttgtaatatgaatgtcatgtggatgactttctttcaatgatgccgcagagatcttcacaaatcttccgttctctttgagttcttcgattgtgtgtgttccgcaatatcccattcctgaacgaagtccacccatgagctggaataccgtatcttctacagatcccttgtaagctacacgtccttctactccttccggaacaagtttctttgcattctcctggaaataacggtctttacttccgttctccatcgctgcgatggatcccattccacgatatactttatattttcttccctggtacaattcgaatgttcctgggctttcatcacatcctgcaaagatgcttcccatcatacatacattcgcacctgctgcgattgcctttgtcatatctcctgagtacttgataccaccatctgcaatgatcggaataccatactctttagcaacttcgtaacaatccataacagctgaaacctgaggtacaccaatacctgcaacgatacgtgttgtacagatagatccaggtccaataccaactttaactgcatctacaccagcttcgatcagtgctcttgcagcctctcctgtagccacatttccagcgatcacctgaagatccgggaatgcatccttaaccatcttcactgtgcggataacattcgctgaatgaccatgtgctgagtccataacaacaacatctacatgagatttcacaagtgcttctacacgctccagacagtttgctgtgataccaacagctgctccacagagaagtcttccctgctcatcctttgctgacagtgggtacttgatctgtttctcaatatctttaatcgtgataagtcctttcagattaccttcatcatctacgatcggaagtttctcttttcttgctttggcaagaatcttttttgcatcctctaatgtgattccttcttttgctgtaacaagtccttctgaagtcatggattctttgatcttcttagagaaatctgtctcaaacttcaggtcacggtttgtgatgattccgacaagtttacgtccctctgtaatcggcacacctgaaatacggtattttgccatcaggtcatttgcatcttcaagtgtatgctccggtgaaagaaagaaaggatctgtaataacaccattctcagaacgtttcaccttatcaacttcctctgcctgtgcttcaatagacatattcttatggatgattccgattccaccctggcgagccatagcgattgccattctatgttctgtaacagtatccattcctgcactcatcatcggaatattcaatacgattttctttgtcagatgtgttgacagatctacctgattcggaattacttctgaataagccggtacaagaagaacatcatcaaatgtaataccttcccctataatcttacccattatactttacctctctttcttaagaacccatgaaactgctttgaaatggcagttaatgtatctaaaaatcttttgtaattattaactgatatactacagaaattcccgaaggatgtcaagagtattttccctgatgtgctcataatttgtattgatttattttaacctctattattaagttttacttataagtactcctttatttattatctatgcgacaaactgagccttttttagaacaaacaaaaggttctatctgacattacgaaaatgtgatagaaccctctgttcctgctgctacagatctctatgtaacagctcttttattctattcttatagaaattctgcaaatcttcctgatggatagattacatcattcccattccacctgctccgcctgctggcatagccggtgtatcctctttaattgtagatacaacagactctgttgtaagaagtgtagaagcaacacttgttgcgttctgaagagcacttcttgtaaccttcgccggatcaaggattcccttctcaaccatatctacatatgtctcattgtaagcatcaaatcctgttcctacttcagactctcttactttgtttacaataactgctccctcaagtcctgcattctttgcgatctgagccagaggagcttccagtgctttcaggataatcttggcacctgtcttctcatctccctcaagagtctctgcgaattcttttaccttcttagaaacatggatgtatgcggatccaccaccaccgatgattccttcttcaactgctgcttttgtagcattcagagcatcttccatacgaagtttagcttctttcatctctgtctctgtagctgcacctacacggataacagcaactccgcctgcaagttttgcaagtctctcctgaagtttctctctgtcgaaatcagatgttgtctcttcgattgctttcttgatctgtccaacacgatctgcgattgcgttcttgtctccacatccgtcaacgataactgtattctctttctgaaccttaacagattttgcacgtccaagctgatccattgtagtttctttaaggtcgaatccgagttcttcagaaatcacctgtccacctgtcagaattgcgatatcctgaagcatctcttttcttctgtcaccatatccaggtgcttttactgctacaacgttgaatgttccacgcagtttattcacgatcagagttgtgagtgcctcaccctcgatatcttcagcgataataagaagtcttgctccagactgaacgatctgctcaagaaccggaagaatctcctggatattggaaatcttcttatctgtgatcagaatatatggatcatccagaactgcttccatcttctccatatctgttgccatatatgcggaaatgtatccacggtcaaactgcataccttctacaaggtcaagctctgtctgcattgtcttagactcttcgattgtgataactccgtcgttggatactttttccattgcatctgcaaccatctgtccaacttcatcatctcctgaagaaactgcagcaactcttgcaatctgctcttttccgttgactttgctgctcatctcacggattgcttctactgctttatctgtagctttcttcattccttttctcagaacgatcgggtttgctcctgcctcaaggttcttcattccttcgtgaaccattgcctgtgcaagaactgtagctgttgttgtaccatctccggcaacatcatttgtcttagctgcaacttctctgatcagctgtgcacccatgttctcaaatccatcttccagttcaatctctttcgcgattgttacaccatcatttgtaataagcggagcaccgaatgatttatcaagtactacgtttcttccttttggtcctaatgttactttaactgtatcagctaactgattcacacctctttcaagtgctgctcttgcttctgatccgtatttgatttcctttgccattttaactgcatctcctttatatttgtctgggtattactctacaattgcaagaatatcattctgctttacaatgatgtatttctctccttcaagctctacatctgttccggcatatttggaataaattactttatctccaaccttaacctgcattacaacttcttttccatccacaactccgccaggtccgactgcgattacttctgcttcctgtggtttctcttttgcctgtcccggtaatacgattccggactttgttgtctcttctgcttctaactgttttaaaacgatcttgtcacctaatggtactaatttcattgtaattcctccttactttattagcactcatttctcttgagtgctaacccatgaatataaaatagcactccccatttcatttgtcaacacagtttacatattttttataaaagaaaagccatggggctttctctgcctcacagcttttctttcgtctctaaaacttctctatgatcttctttcgttcatctcatagaatccgttctcaattttaaacttcagtagattcctgtcttccgactggtatctctctttcacaacaccggagcagcacaacagctctgtccccgttgaaatataacatctgtattttgcatccagcagaatcgttgtcagaggatcttccatcacttcaagataaatgtaatcttcttctgtatcataatgatccaccttacagactcttgttgtatcatcaaaaatagcatctgctgaaatcactttttccatctgcagatcaaccggatttccctcgtacatcttgtcttctccttctgcttacatccgctctttctcaatcctctcgagctctgtaaatacataatcattcagaactttaatataagttcctttcattcctgaagaacgtgattcaattactcctgcactttcaaacttgcgaagtgcattcacgataaccgatcttgtaattcccacacgatccgctaccttgctggcaaccaggattccctctgtaccatcaagttctttaaagatatgaatgattgcttccagctctgagaaagaaagtgtgctgattgctgcctgaacgacatgttcttttcttgtctcttccgcactttcttcattcactgaacgaagcatctcaagtcctactacagcagtaccatattcactgagaataatatcatcaatagaatacgttgcatcctgtttgtagataaacaatgttccgagacgctccccggcaatatcgatcggtgtgatgattgcctgacatccttccacagcatctgaagaaaaaccaagtgtctccagattaacattctcttttgtagacagaacactcagcaatctttcattaagcatattatcaatatgagatcctacggattctgtgatcagttcactgatttctctcaccttattgcttttgctgactccaagaatctttcccttcttgctgactaccagcacatttgagtccaaaatctctgtcagtaccgcacagatatcattaaacacaactttgctggagttattattatgcagcaacttattaatctttctggtcttatccaataattgtacgctcattgtctcctccacatgatttgctcttattcactacttctagcaaacagtaactattatttcccaagttgtatacacaaatcaaatttcaaattccttactagcttatattatcatacaattcagaaaatagcaacgttgtgtttttctgttttttgaaatatttaatcttctttcttaattgtttccacatatccgcacttttcatcagcacaaactaatttattgcctttttctaccatgtatccaccacattcaggacatttcttactggatggcttctgccaggacataaattcgcattccggattatcctcacatccataatactttcttccctttttcgttttgcggataacaacttcttttccacacacaggacacggaactccgatcttttccagatatggttttgtatttctgcattccgggaatcccgggcatgcaaggaatttaccatgcggaccgtatttgatcaccatgttacgaccgcactcttcacagatcacatctgttacttcatcttcaatcttaacttcctcaagctctttctctgcaatttcaacagcttcctcaagatccggatagaaattacggattacttccttccacggaacctttccttcttcaaccatatcaagaagaccttccatattcgctgtaaaatgaacatctacaatacttgggaatgactgtttcataatattattaacaacttcaccaatctctgtcagataaagattcttgccttcttttgtaatatatcttcttccaaggatcagagaaatggttggggcataggtacttggacgtccgatcccaagctcttccattgtctttacaagactcgcctctgtataatgtgccggcggctgcgtaaaatgttgctttggatcaaattcttcttttgtaagaacagaatccatgctaagatgtccgaccagtacattgctctcttccttctcttcctctgcctctacatacacagagcgaaatccatcaaatgcaacccttgctgttgatacagtaaagcagtactcaccggctccgatcttgactgctgttgtctcatacttcgccggctgcatgcggcttgctgtgaagcgtttccagatcagctgatacagacggaactgatctctgcttaatgaatccttgattgctgccggtgtgcgtgtaatatctgtcgggcggatcgcctcatgcgcatcctgaatcttcttatctgcagactttgtttttgttccttctgctacatatgcttccccgtaagtctcagcaatatagcttcttgctgctgcatcagcttcctctgaaatacgtgtagaatccgtacgaagataagtaatcacaccgactgttccattccctttaatgtccacaccttcatacagctgctgtgcaatacgcattgtcttctgtgtaccaaagttcaatgccttggcagcttcctgctgcagcgtacttgtcgtaaatgggagtggtgctttacgcgtcctctcactgttcttgatatctgtaatctggaactcttcgttctctaatttctttaagatctcgtccatctcttcttttgaatggatcgtcatctttttcttctctgttccgtagaacttcgctgtcagaggacggttctcaccttttactttcagttgtgcatccaatgaccagtactcttccggaataaatgcatcaatctctgcttccctgtctgcaacaatacgaagtgcgactgactgtacacgtccggcactcaacccacgctttacctttgcccaaagcaatggactgatcttatatccaaccatacggtcaagctctcttcttgcctgctgtgcatctacaagatccatgtcaatatcgcgtggtgctttcaaagatgctttcacagcattctttgtaatctcattaaatgtaatacggcgcattttcttctcgtccagcttcaaggcagcagcaagatgccaggaaatagcctctccttcacggtcagggtcggttgcaagataaactttgtctgatttcttcgcctcttttctgagcgttgcaagaatctctccttttccacgaatggtaatatattttggttcgtaatcattctccacgtcaattccaagctgacttttcggcagatccctgacgtgtccctgtgacgctgcaactgtataattgcttcctagaaactttttaatcgtcttcacctttgcaggagactccacgattacaagataatgtgccataaaaactatactcctattttattctgatataataattctttgttatttcacgaatgtatccctgcagttccagtgtaacaagaatgctcatcaattttctgatctccacccgagattcctgcgcaatctgatccacattcttaggatacaaaccgacacaactatacaccaaatcatctgtactttcaagcacttttttatttttctcgttttttatctccgtgtttctgcacaaaacatttgtttcaatcccccattcttccagcagatttttaggattcagaaggattccggcaccctgttggatcaggtgattacacccggcactcaaaggactgtccagcggtcccggaagggcataaacatcctttccctgctccagtgccatatctgctgtaatcaaagagccacttcttatccgggcctccattaccagaaccgcatctgacaggccgctgatgatccggttcctcattggaaaattcattgcaagcggaggggttcccggtggaaattccgaaaggattccacctccgtgttctatgatatccatatataaaccgatatgatcccttggataacagacatctactccactccctaaaacagcatacgattttccccctgcattcaatgctgccctttgtcctgttccatcgattcctttcgccatgccactgatgatatcaacacctgctgccgccagtacttccgcaaattctcttgtataatgttctccatatccactacaaccccttgctccgacaattgctgccctcttcttggctcccggacacgttcctttcacaaaaagagcaaacggtggatctggtatctcagccagccccggaggatattcttttgaaaaaaatggaataaattcgattccatgttcctgcattttgtaaaactcttcttttaattgttctttcgttttctctttccgggctttttttaatccctctttttcttcctctgtaaggaattcaattcctgtaatttcagtttcttctatataatatatcttctttccacttcctatgagttctcggagcagatacttttttcttgcagatagttttcgaatcgtagaaaaccagtattcaaaaatcatctcttcacacatcatacatacctcccccaatatttcctgtccaatgtccgataaccgatcgcctcctgtaaatgttccagttttatctcctcactgtaatctaaatctgcaatcgttctcgcaacctttaagattcggtgataagacctcgccgtcagattcagtacatcataagcctgccccatcagtcgcatttcttctccgtttaatctgcaatacttactcaattctgcaccatgaagcattgcgttacaccgaatcttcgcgttttggtagcgaatcttctgtctctttcttgcttcacatacccgcgctttaatcaccgccgaagactccggacaggaaacagactctttcaccagatcccgatattccactttagaagcttcaacactaaggtcaatccgatcgagaaacggttgactgatcttacttaaatatgcctgaatctgtgccggcgtacatgtacaggctgtcgatggaaattttccacatggacacgtattcatggcagatacaagcataaaatcagccggaaagatataatttccgctggttcttgtgatctgtatgctgcgttgttccagtggctgcctgagcacttcaagaacacttctcttaaattcaggaagttcatccaaaaatagaataccactatgcgccaggctgatctctcctggtcttggaacaatcccaccaccaatcagcgctgctctcgttgcagtatgatgtacctctcgaaaaggtcttctggaaatcagtggttcccttccatccagcattcccataacactataaagctttgtaagctccatactttcttcataattcatcggcggcagaattcctgccatacattttgcggtcactgtcttcccgcttccgggtggtccgaccataagcagattatgccctcccgccacagcaatttccgctgcccgacgaacattctcctgaccatataagtctgcgaaatcaggtacttcttctcccacttttcctctgtcttctattttatcagcctctttttcaccaagatatctctgttctccacctgttctgtctccatcttccaaataactgatacattccctgagacttccaactgcaatgatccgaaccccttctacaagttctgcctcctttttattttctctcggaacaatacagcttgtaactttttgtgcctttgcctctgataccatagaaagaatcccgggaacttttctaacttgtccatccaatcccagttctccgatgatcatacagtctttcattcttctattctgttgtaaaacgccaagtgacgtcagaatcgacactgcgattggaagatcaaatgacgctcctcttttcctcatagttgccggcgaaagattgatcaccacacgtttcgccggaaattcaagacctgaattccggactgcagaccgtacgcgttctgctgcttctttcacctctgatgacagatatcccaccatgtgaaaaatcggaagtccattgctgacatccgcctccacatagaccatttctaccgcaagcccttccattgctgcggattttactgtactaaaactcatatgcgctccttccttttcccagtcacaagcgcacctgttcttcttacaccccattgtaagctgctgaaattctggctgaatcagccggatttgattttcggaactgacattccgagaatgtatagatatcataacttccgaatatcgatttgtcaatcagtttccgagaacttgagcatatggaaaagcacaattttcacattttttcataaactatattaaatgcatccagaggtgctgtcttgaaagcatttcctaatcccctcacaccggcggaagagaaaaaatacattcagagatacaccgagggcgatctggaagccaagcatattttaattgaacgcaatctccgtctcgttgcccatgttatacggaaataccaaaataccagtgaagatccggaagatctgatttccatcggcacgattggcctgatcaaagctgtaattacgttcgatcctgaaaagggaaatcgtctggctgcctatgcctcccgctgtgtagaaaatgaagtcctgatgtatctgcgcgccagaaaaaaatgcagccatgaaatctctctttatgaaccgattggcacagatcgggaaggaaatgaagtcaacctctacgatatcatcgaatctacagaaacagatattccagagcggattcatctgaaggacaatattcaaaagctttatgaaaaactggaaaatgaactttcttcaagagaaaaacttgtactgaaaatgcgatacggactgtatcagggagaagaatacacgcagcgggagattgccgcacaactgggcatctcccgctcctatgtatcccgtatcgaaaaaagtgctatcggaaaactccgacaatatttttgaactttctaagactcttctatgaattaacttctttatcctcttcctgtcttctgagaagatcgtactgagctggtgtctcgctcagttctacatgaagaacctgctttgaatgcggtgcactttcctgttcctctccatcctcattcaggatccggagaacctttgcctcaacattacttccgtccggcttcatgatctcaattgtctcacctacagaaaacttattgcgctgttcaattcttgcaagcccattctcaacagccccgacaattccaagataagtatactctcggatatatgtgttattgtcataaatctgtgtctcatgatctggttttccaaagaaaaatccagtcgtaaactgacgataagtacagtttgaaatctgatccagataccaaggcatgttcttcttgtaaagctctggatctttctgataatcatcaattgctttacggtaagttcttgccactgttgcaacataaagtgctgttttcattcgtccttcgatcttaaaactgtcaattcccgcatcaattaattccggaatatgctcgatcatacaaagatcttttgaattaaagatgtaagttccgcgttcattctcatagaccggcagatattctcccggtctcttttcctcgactactgcatacttccaacggcatggatgtgtacatgccccctggtttgcgtcccttcctgtaaaataattactcagaaggcaacgtccggaataagagatacacattgctccatggacaaatgtctcaatttcaagatcttccggaattctttctctgatctccttaatctctttcagagacaattctcttgctgaaaccacacgacttgcaccctggcgataccaaaagttataagttgcatagtttgtgttattcgcctgtgtactgatatgacgctcaatctcaggacatacctcttttgcaatctcaaacacccccggatctgcaatgatcagtgcatcaggtttaatctctctcaactcttcaaaatattctcttaccccttcaagatcatcgttgtgggcaagaatatttgctgtaacatacacttttacatcatgtgcatgtgcgaattctattccctctttcatttcttccatagagaaattttttgctttcgcacgcaacccaaaggcttctcctccgatatatactgcatcagcaccgaaaattacagctgtttttaacacttccaggctgctcgccgggatcaatagttcgatcggtctactcatttttctactccttgttttatgctcactgccacaccatctccaagcggaataatagatgtgaccagatcctctctgtgtttcaattcatacagatattcccgcattctcgcatgtattgtacgatttctgcgttctaccgcaaaacgagattctatgatatccccatcctgcatcacattgtctgacacaagacagcctccatccgaaagcagtcgcaacacattcggaagataatgaatatattgccctttcgcggcatccataaagataaaatcaaaagttccttccatttccgcaagtacttctgtcgcatctccttcaatcagagtaatcttatcttcctttcccgctctgcggaaattctccctcgcaatcgggattctcttctcataattctctattgttgttatatgtccaccttccggcaggtaatcactcatcaataacgcagagaaacctacggcagttccgacttccagaacgcgcataggttttttcatcaaaaggagaacctccaggaagctctgcatctctcgtcggatgatcggtacatccgccgccagagcttcctgttcaattgtctccagtatttcactgttctctgtatccatagaattgatgaatgtaataatacgttcatctactatcatatcttacacatccacatccatgatgatcgggatcaccattggtcttctctttgtcttcttccagatatagtcattcattgcatcacggatcacaagcttgatcttattccagtctgtatgtcttcctttcaggcatttctcaagtgcttctgaaacagcctttcttgcatcatccatcagctcctctgactctctgacatagacaaatcctcttgatacgatatccggtcctgcaagcaggcggttcgttcttctctctaatgtaagaactacaataatgataccatcttctgcaagatgctgtctgtctcgaagaacgatatttccaacatctccaacaccaagcccgtctaccaggattgctcctgtatgaaccttatctacaaccttagcgtaatcatcacacaattcaagtacttcaccggactgcataataaatacattctccttcggaattccaaggctcttcgcaacacctgcgtttgctttcagatggcggtattcaccatgcaccggaatcgcatatttcggttttacgagcgaatagatcaacttcaattcttcctgacaggcatgtcctgatacatgggcatcctggaaaataacttctgctccctttgcagagagttcattgatcacacgtgaaaccgatttctcgtttccaggaatcgggttggagctgaaaatgatcgtatcattcggctgaattgtaaccttgcggtgtacgtcagctgccattcttgacagtgcagccatagattctccctggcttcctgttgtgatcagcaccatcttctccggtggataattcttcatctgatcaatctcaatcaatgtattatccggtacattcagataccctaattctgatgctgtagaaatgatattcaccatactacgaccttctacaacaacctttctgccatacttataagcagagttgatgatctgctgtacacggtcaacattcgaagcaaatgtcgcaatgatcagtcttgtattctgatgctctgcaaaaatgtgatcaaatgtgatacctactgtacgttctgactgcgtaaatccttttcgctctgcattcgtactgtcagacatcagtgccagcacgcctttcttaccgatctcagcaaaacgctgcaggtcgatcgcatctccaaataccggagtataatcaaccttgaagtctcctgtgtggacaacaacacctgccggtgaatagattgccagtgcggacgcatcctggatactgtggttcgtcttgataaattcaatccggaactttccaagattgattgactgaccgtgacgtacaacctttctcttcgttccacgaagcagattatgctccttcagcttgttctcaatgattcccattgtaagcttggttgtataaatcggaatgttgatctctttgagtacatacggcaatgcaccgatatggtcctcatgaccgtgcgtgataacaaatccctttaccttggaaatattatctttcaggtaggttacatccggaattacaaggtcgattccaagcatatcatcttccgggaacgcaagaccacagtctacaacaacaatactgtcttcatactcaaacgcagtaatgttcataccgatctgttccagacctccaagcggtatgatacgcaattttccattattctgttttttcaaaaaatatacacctccactatctctgtttcttcatacagtctttacacagtccgtagaatttcagttcgtggtccaggacatggaagccggttgccttctcgatatgatcttccagactctccagaaggtcatcatcaaacggcattaccttgttacatctcttacaaatcaggtgatgatgattgtgctttgtctccccattcagtaaatgtccgatctcatagcgcacacatccatccccaaaattaatcctgtctaccagctgcatatcccacaaaagctgtaatgttctgtatactgtggcaagcccaatctccggataatcctctgataccagatcatagatatcttccgctgtcatatgactcccactgttctcttcaagtacggacagaacaagcagtctctggtgagtcaccttcagccccttttcctttaacctctctttcagaagcttctgtgtcttatctgcttccatctgtctgcctcctatctatattgtaaaaagaactccagacttttttctgacacttctgcaaaagtgagaaaagtattcctgtctgcagtttctcttacattcgtatttctttcatgtaattacatctcaatatcgacgtcttccaacaattcctcaaatactttggaaactgccatcagctctgtatcgtcttccacgatctcatacgtcttctctgcgtcttttgattcttcaacttctctgagaatcaggcattctgcgtcatcttcttctgaatcaactacaagaatatacgcggaaccattgatctttgtctcttcaagtacaaagaactcatctgctccacttccatcactgaaagtaaactttgccttttccatatgattttcctctattctgctgttttctgcatataaatcgaatctaaatatccctggagaatgaacacagcagcaatcttatcgacatattgctttctgttttctcttctcacaccactctcgatcagtgtctgctctgccgctactgtcgtaagtctctcgtcccacatgatcacttccagtcctgtacgacgaaccagcatgtcacgaaattccaatgacttctgtgcacgctccccgatatcattattcatatgttttggaaatccaagcacgatcttctctacctgatattctttgatcaattcttcaatcctcgcacaggtacggcgcagcttgttctcctctttccgttgtattgtctcaattccctgggccgtaagtccgagcgggtcgctgatagcaacacctacagtcttcgtcccatagtccagtcccattactctcattgtctgattattcccacgcattatgctcaatatacgctttcaacagttcttctaccagttcatcacgttccaccttcatgatcaggcttcttgctccgttaaaacttgtaatgtatgtcggatctcctgacatgatatatccaacgatctgattcaccggattgtatcctttttctttcagagccttgtatacgatctcaaaaatatccttcgcagaaatctgcggacccggctctacctgaaagaactgagtactacttaaatcactcatctttcttcctccttctctttcttgtatctatttccttcttccgaagggctttgctgttgttctgtcaaacagcgcaaaacgctctggaaacccagaaaccctacttataattctaatataaccgaattcaaaattcaatgtataatttgcgaatccttcccaatttgaacttttacgatactattcttgagattttcatttgtctctagtgcaattttcatatattccttcgtatgacctgtctgtacttcttttccattcagttccagattctcttctacaagtacttccacttcttttccctggaaactctgttcatatgctgcacgctttttctcaccaagttcaattaattgtgcacttctcttcgccttgatctgttcatctacctgatctggcatcacagctgcttttgtcccctcacggcgggagtatttaaaaatatgtgtctcatagaaatctatgctgtctacaaaatcatatgactctttgaactcttcttctgtctctcctgggaatcccacaatcacatcggttgtcaatgccggatttgggaagtattttctgagaagttcacatttttccgcatattcactgcttgtatatctacggttcatacgctttaatgttgcatcacatccgctctgcagagacaggtggaaatgcggacacatcttcggaagctttgcaatcccttctgcaaattcttctgtgatgatccccggttccaaagagccaagacggattctttcaattccatcaatctcatggactgcccggatcaattccagaaggtgatattctttatcaaaatcaattccatatgagctcagatgaattcctgtcagtacaacctccttatatccgttatctgccagtgtacgtacttcatcaagcacatcttccatggaacggctgcggactcttccacgggcatatggaatgatacaatatgtgcagaactgattacatccatcctgaactttaatataagctcttgtatgatctcccggcttcgtcaggtgaagattctcgtactcttttgtttttccgatctcttccatcttgatctctgcttttctgtcgttttcctggttctttgcattcttttcattttctgttacgttacaatctgcattgtgtgttctttcatactcttccaatgcttcgatcagattctgcttcttattattaccaagcacaatgtcaatgcaatcatccacctgaatctctttttccttcgcctggacataacatcctgcagcgacaacaactgcatccggattcatttttctcgcccggtgcagcatctgtctcgacttgcggtccgcgatatttgtaacagtacatgtattgattacataaaggtctgccccttccttgaaaggaacgatctcataccctgctttttcaagcatttcctgcatggcttccgtctcataggcatttactttgcatcccaaattatgcagtgctgctttcttcatttatttctacctcttttttccttttatctcgttaatttcttgacttttgaaactgcatcccgtagaatatacctaggcttagaagccaactttattgtataattcaaggagggatttcaaatgaaaacagtacagatttcattaaactcaatcgacaaagtcaaatcattcgttaacactatcacaaaatatgataatgatttcgatttagtatccggaagatatgttatagatgccaaatcaatcatgggtattttcagccttgatctttccaaaccgatcgacctgaacatccacgctgacagcaatgttgatgacattcttgctgcacttgatgcttacatcatcaaataattctatctgaatacaactcatgcggactttgtttttgtagcttgtccgcatattttttagagtaaagaaaagctgttccattggagcagcttttctttttcctattattctccctgcttcacttcaatgatctcaacagtatcaattgctgtctgcatcagttcgtcaatcttttctgcaaggttcaactcagacttctcaattcgttcaatattcggctttgtcaccggatgttttgcaacgaaaattgtacaacaatcctcaaatggctggattgaagtttcataggtattgatcttctcagaaatttctacaatatccttcttatcaaatccgatcagcggacgataaaccggaagtgtacatactgcattcgtcgctgcaagactctgcattgtctggcttgctacctgaccgatactctctcctgtgatcagaccaagacatccgtctttctttgcaaaatgttctgcgatcttcatcatgtagcgacgcataatgattgtcagttcatcatgtggacacttctcatagatataaagctgaatatctgtaaagttgacaacatgaagcttaatcggtcctgaataagcagaaacgagtcttgcaagatcaactaccttctcttttgctctttcacttgtgtacggtggtgcatggaaataagttgcctcgagttcaacaccacgcttggataccatatatccggcaaccggactgtcaattcctcctgacaggagcagcattgcgcttccgtttgtcccgattggcatacctcccggtcccggaatgattctggaatagatataaacttcttcacggatctccacattgatacgaagttccggcttatgaacatctactttcatttccggaaatgcctccaggattgcttctccgacttcacagttgatctccatagagttcgcaggatagctcttctttgctcttcttgcatcaactttaaatgtcatgttcttctcttcgtaagcttcatctacataagctacaacatcttttctcagctgttccagctctgcaaccggcacacggactaccggacagattccaacaataccgaataccttctgaaggctttctactgtctcatcaaaatcataatctccatcacaatccacgtagactcttccgtgacatttgtgtacaaggaattctccgtctacgccctgcagagcataacgaatctgacgtaccagtgcatcttcaaagatataacggttctttcccttaattccgatctcgccgtattttatcagaaatgaatgaaatttcatgctttttctcctttatgaatcaacgtcaattaatgacgcgtatattttctcagcatcggtatacaattatatagtgtttccagcgtgtagtcaatttcttcttttgtagtaaattctgacatactgaaacgaatcgttgcatccagatattcctgtgccgccccaatgcttctgagaacaccgcttactgccggatgattcgatgcacatgcagatcctgatgagacataaatccccttatcttccagtgtatgaagaagaacctcacttcggattcctgcaattccaagactgatgatatgtggtgcacttccttcatctttcagaccatggactgttgtattctcaatctttcctgcctgctcaataaaataatccttcagttcacgcatcagagctactttcatatccaaatcattatagatcatctttgttgcaagtccaagccctgcaattcccggaacattttctgtacccgaacggagatccttctgttgtcctcctccgaaaagaatcggtttaatcttcaccttttcacccacataaaggaatcctgttcccttcggtccatgaatcttatgtccactcgcacttaacaggtcgatcttctgacgttttggataaatgtgatattttccaaatccctgcactgcatccgaatggaaaagaatagaagaattatactcttttacaatctttaccgcttcatcaatcggttgaagtgttccaacctcattgttcacatacataactgatacgagaattgtctccggacaaagtgcttctttcaatgcttccagattcactcttccactcgcatctaccggaagatatgtcacacggaagccttcctcttcttccagataacgcattgtatttaagattgcaggatgctcgattgaagttgtgatcaggtgatttcccgctcttctgtttgctcttgcacatccgatcagtgcaagattatcactctctgttcctcctgatgtaaagtaaatatctttcgcatttaccttaagaacctttgcgatcgtttccttggcttcctttacataatgctccgcatctacaccttttcggtgcatggaggatggattgccataatcctgacacattactttatatacaagatctcccacttccggatatgctctggttgtggctgaattatccaaatatacttccattttatcttcccttttctaactctgttgccattcacaggcgtctgcaaccggcaacgtctttctattatcttatgtttttatcgtccaactgttcccggcattctaaatgatacatcagaattgacaatgttgtaagtcctgctgtctctgttcttaaaatacgttttccaagtgtgatcgggattgctccggcctctttcgcctgctcgatctcgctctcgtcaaacccgccttctggtccgataaagataccaacagactgtcccggttcaatcttacttatgacagcttctgttgctttcatcccttcctgcagttcataaggaacaagcactacatccagctctttcgcgtaattcatcgcttcctgaaagctcatcacatcctgcacttgtggcacaattcctctcttcgattgttccgcagcccccttggcgattgcctgccagcgttctctcttctttccggctttcttctgatctagctttacaaccgaacgctttgccgcaaacggaacaatacgataagctccaagctctactgccttctgcacgatccattccatcttatcccctttcggaagtccctggaataagatcagacgggaagccagttctgtctgagacacttcttttttcacaacgcgaaggactgcctccttctcctcataaccttccacactgcagaagtaatccattccttctccatcactgacccacacttcttctccgggtttcattcggagtacattcttcatatgattcacatcacttcctgccagacggatctgttctccgtccacgcaggatggatctgcaaaaaaatgttgcatcttatttctccttatgcgttcttgcgcgctgtcacacatacccattcaccctgatgtgtaacctccagaagttccagcccggcttttgcaacagcttcttttaccatctcttctttatcatcaataattccacttgtgatatagattccgcctggtttcagctggttcacgatcactggtgtgagttctacaagaaccggtgcaaggatattcgctgccacaatatcgtagcactcatatccaaccttatcctgaacttctttgtcatcgataatatttccgatcatcacttcatatttatctctggaaattccgttgttctccatgttctcatatgtagcatcgattgcacacggatccagatctgttccaacagaatactctgctccgaacttcagcgcaagcattccaagaattccgcttccgcatcccacgtcaagaatctttgtcgtctctgttgtatactttctgatctgacggatacaaagttgtgttgtctcatgcattcctgtaccaaatgctgtacctggatcaatatggatcaccatcttatcttcatccgaaggcttcacatcttcccaggatggaataatcagaatatcatccacatagaactgatgaaaatacttcttccagttattcacccagtctacatcctctgtctgggattcttcaatttcgcaggctccgacatttacataagcagacatctcctccagttctttcttcacatttgccagaactttttctttgtcctcatcctcttccagataaaaacttaagtaagccacaccatcatctgcctcgatctccggtaaaatatcaacaaacatctgctctttatcagactctgtcagcgggatcttatcctcgatctcaacaccttcaatcccaagatctgccagcatactgcttacaatatcctctgcctctgttgttgtcttcaatctgaatttattccatttcatctagttttcctcctgaaaccacaaatctaaatctacgcttgcacgaattcccggaaccgtaccgacctcactgtactgccacatcttataatcatatggacactgcggaagttcatgataatccgcataccagaaatcatattctgtcagctcttccatcttcaaggtaaatgccatccatttcatattagcataaatcatcggttgatatccagcctgtttcactccgtcacaaaagactttacaaaaattcgtaaagtcttcccttgtattctggtctgttcttgctgtatcatctttgatttcttctgtgtcatagacaacaggtcctgtaatctgatacggctggatatgttccaaaacaaagtcagtctcttcgactgcctccgttgctgagattgcctgggaaaagaaatagacaccgacttccagaccggcatccaatgcgccttgtacattctgttcaaacatggcatcttcaactaacgcgccgctctctccatatgcacggtatccaagtcttacgatcacgaattcgattccgctttccttcacctgctgccagtcgatcgtctctccctggaactccgaaacatcaattccttttttcgctgacacttttcccttcgtatctttatacgaaagatatcctgtctcttcatctaataccagattgctaaaatcataagaattcctcggtacttgttccagaagccttgctctgtaattattctctttcacatcctggaagtcatagtacttctttccgtcttctgtaacaatctgaactccactgacaatctgcgtgttttcctgcttgtctttcttcgtctgtcttgtcttcacgttgccggaacccacgccgacaagaataactgcaagccccacaagagccgccgccatccattgcttctttctcattcatttccttccaatcgcatctgttccgtaccgttgcagaaatgttgttactgttcacacgatgtgcgaccagcaacgcatctcgccattttaaatcgcgatttgttctttttttcttccaatcacttatggaactctctgcaattcctgttctctgggcaaattctttctgactcatccccttttcttttaataactcaaaaatcttatcactaattgtcttcatttcctttttcgcctcttttctcttctttttattctgcccatccctacacatgacgtgagggctggacacttattctaattttggtgttttcataaatctatcactttatattctgtttgtaaatacgaatttatatgtttataaaaatttaatagtgcctgacaccaatgtgaacgttttcatccagatcacgacatgaaagtactttttcaatatcttcttttcgaattttttctactccgtctaaatctgcacttgttcttgcaagacgcaataatttgtggattactcttgcactatatccatatttttcacttgtttcttttaataatttcaggctatccgcatctaattcgcagtatttttgaatcattgatgttgtcatttgtgcattacagcttatgccctcttcatccttgtatctgtcttgttggattcttcttgctgattctactttctctcgcaattccattgaagaatatgttgcattctagttctcaatatcaaagaatcctaccggatgtacttctttttgaatatctattcgatccatgatcggacctgatatttttccccgatacttgataatttcatagtctgtacatctgcatttcggacctggataatatccacatggacatggattcatagctgtaacaaacataaaaccagcaggatatgtatgtgttccgtttacccttgcaacagaaactttcttatcttctattggctgacgcagagcatccaatgtccttctagaaaactccgctaattcatctaaaaacaaaacaccgttatgtgccagtgatacttcaccgggcattgcattcaccctcatacttttcgtttacttatttcatcatttcttcgtttatgcgtattgtataggtaaattttttatgaaagttctttgagtgcttccaaatatccaatcaatcctcttatggaagaatgttagcacagttaaagaaagagatgctgaatgaggattctaaggcatccacgcacttgattgaattgcttaccagtattcgttccgatgaactggaaaaacagctattggatgaaagtgaagaatatcaaaactgcatcaaggaagaagagaacagtgaagcggaagtaaaaagaaagttatcatcaaaagagtggaaattggttgatcattatgtgaccgccgtcaacaatcgttggctgtgttgtggagactacctttatcaatcggggatgaaagatatattgctgctcctggaaaacagttaaacagaaatatagatatacataagtaaaaagcaggcagggaattacagattcgcttgcctgttttttactaaaaccatcaaaaactaaaataaagtattataataccaaaaaagtgattaacaatacactgatatcgttattagatataaataacaaatctgtaagagatgtggcaaagtattatttgtcttaccgggatggatttgaagccatcagagctgagttgagtacgcatggtgcagtatccagcaatgaagttaatggatatgtgtatgtggcagacttatagacttattacagatccaaagaataagacagggctatgccctaagtgtcagaagaaagcaaatggcgcagaatgctccagggattcgacatgtgaaagtgtatgaaactagtggatacaaatataagtctatacttgatgtgtaacgatggatgggagcagggatggcacgagagaaacggcggcaacctgtcttaccgcattaaagacgaggatgtggcggaggtaaaagagttccttcattatgaaaatgaatggaaaccgattggcaccaaagtccctggacttgcgagcgaatatttcctcgtaacaggcagcgggaaatatttccgcaatgtcatcattgatccggaggatagtatctgcatcatcgaactgatgaaaaaggagagaattaccgcatcctttggggtctggtaaacggaggcagaccgaccagtgagctaccgagccacctgatgaaccatgaagtgaaaaaaggcgttaccaatggagcgcaccgggtgatttatcatgcacataccacgaatgtgatcgcactgacatttgtactgccgttggaggataaagtatttactagagaactctgggagatggtgaccgagtgcccggttgtatttccttccggaattggtgtagtaggatggatggtgccgggcggccgtgagatcgcagtggcgacaagtgccctgatgaaagaatatgatgtggcaatctgggcgcatcacggcatgttctgctcaggggaagactttgatcttacattcggattaatgcacaccgtagagaaatccgcggaaatccttgtaaagatgctgtccatgagaccggataaaagacagacaatctcacctcagaatttcagagatttggcgaaagcttttaaagtaactttaccggaaaagtttctatatgacaaataatgtacatatcacatatttggcgtatcagaagcatgaagcatgtttcgatattccataggcgtacatccgtatttcttgcggaacagctgaaagaaaaagctggtattctgatatccgacggcaaggctgatatcatttgtggaaagtgcggtgctccttaacaattttgccgcctgagagagccgctgtgtctgaaccagctctttgtaagtggttccggtatgttggcgtatgtaggcagagagatagtttgggtgcatattaaaaaactcagctgtagaagaaagggtacagtccgcaaagtttgtttcgatatatcggagtatggtataaatctgatccacagaggcgtgatccagaaccataccgtgctggaacagattgatcatctcgcaggtaatcagcgtaaaaagactgtctaaaaaaggtccggatgttacggacggagaataaaattcacagagaaactggttggtaagatctgccagccggttttgtttttgttccggggaaaagacaatatacctgctttcctgcatcgtggtgttcagagcctcaatgaaaaagtgtgtaaggtaattatcctgagacaggcgttcaaaaaaagtaccgttcagatattcgcgcgtcagcagaaaattgatgataatatcattttctgaacatcttttgacagaatgaggtgcattttggctgatcagaaccatctgcccggcttttagcctgaatgtagtcttatttatcgtcattgtgcaggcaccagaataaatataactcaattccagccactcatggatatgcagaggtacgttttcaaaacgatcctgttttacaacagcgaagttgtaataactcggaagaactttctttgaaagaaataaagaacgcagatcttcaaggttcgtatcaaaacggtaacagggtgtatcaaacttacctctcgcaacaggaaattgtgaataatctttctttacaccgttcagacgctgggtttcttcgggagtgtgctgcttcagaaattgattcaatgcagataatgtcatcatatatattctctccttttcaagatatgaatgaactgtgattatagtcatcagcagtttatttaacctgtctaaaatataccatattgggggcaaaggtgtacagagtaatctcggatatttattaagtttggtcggtaaatcacttatgtttcgttgatgtaattttagtctgtataatgtaagatatcagtaagaaaaggaggcataggttaggatgaagatattttttgcagtagtggtgattgttttattatttgtaatcggtgcgacattatatgtctacaaaaaaggtgccatgtttttaccggcacttcttggcatctgcggatttccaaaaataaatgaaagcagttattacgatgaaaacggacatttccgtccgggaacgggggaggacaaagttggatttttcatgcagcatccagtattcggcggttttaaacatatgtttttcaatgtggaggacaacgtgctgaaagctattgcgcctgtaaagtataaggattttttaaaggcgcagggtcgtgaggaacaattggatgcagccttggaatctttcaattatctaaccggacttgttgagaaaggtcaggcaaggctggtgccggatctgtatcctgcggaagcagtgaatagtcatccgtacaggtcacatctgacgggaatgttttatcagggacaacagggaaaaccacttgccattgtagttccgggaggcggatttatcagtaatgtaactgattgcgaggggtatcctgtggcgatgaagctgcataaaatgggatattctgttttcgtcgtaagttatccggtcggcagacagctgggtgagacagaacaggtaaagcagggacaggctgccgcgagggaactgacacaagtgatccgatatctgacggagcatcaaaaacagttttctgtaaatatggatgattatgccatctttggtttttcagcaggaggacttatgaccacggcgtattcatttgccaattatgaggactgctgccacaagaatcatctgccaagaccgaaggtgatcttccctatgtatggtctggactgggatatcaaagctttgccggaggacaagggactggcggtattttctatcgtagggcgggatgatgagttcggttttgcaaatgtggaagataaactgccggaattagagaaggtactgggcaaagaaaatgtgtcggtcagaatcgttgacggactgggacatggatttggaataggaaatgaaacaaaagtgaaaaactggcttcaggaagcagtcatcttctgggaagcccacagataggaacagataagaatttatttaaggaggatttcataatgagcagaaacctgaaagaattgatcagacagatgacactggaggaaaaagcaggactttgttcgggagcggatttctggaacacgatgggaatcgaaaggttagggattccttccgttatgatgacagacggcccgcacggcttgcgcaaacaggaaggcgaggcagatcatctcggcctgaataaaagtgtgaatgcagtctgctttccggcagcctgcgccacggcatccagctttgacgtggaactgatggaacgtatgggacagatccttggggatgagtgtcaggctgagaacgtgagcatgctcctcggccctgcagttaatatcaaacgcagtcctctctgcggaaggaattttgaatatatgtccgaagatccatatctgacaggaaagatggcgtcagcatatatccggggcgtacagtcgaaaggcatcggaaccagtatgaaacacttcgccgcgaataatcaggaaacagaccgtatgcagatatcgtcggaagtatcggaacgggctttccgggaaatttatctgccggcttttgaggaggcggtgaagaaagcgcagccaaagactgtgatgtgcagctacaataagatcaacggagtattttcttcagagaataaggagcttctgacagatatcctgcgggatgagtggggatttgaaggatatgtggtcagtgactggggagctgtaaatgaccgggtgaaaggactgaaagccggtcttgacttggagatgccgggatcagagggatataacacaagaaagattatccaggcagtggaaaatggagaattggaagaggagattcttgacagaacggtggaacgcatactgaaagtagtcttctcctacacagataacaggaaagcggagactgtatttgacagggaaacggatcacaaagcagcggcagatatcgaaacagagtgcgccgtacttctggaaaacaggggagtgctgccgctgaaaaaagaacagaaagtagtctatatcggagaatttgcaaagaaaccgcgataccagggcgggggatcgagtcacatcaatacggacagcgtagtgtcggctctggaaactgcgatgagaaaaggcagggcagtggagtacgtgaaaggcttctcgtcagagcgtgacgagatgacagaagaggagctgaaacaggcgtgtgaagcggcagcgggcgcagatgtagttgtaatctttgccggactgccggacagctttgagtcggaaggatatgacagaacatccatggaactgccaaagtgtcagaatcgccttatagaggctgtggctgagatacagaaaaatgtggtagtggttcttcataacggaagtcccgtagaaactccatgggcggagtctgtaaatgccattctggagatgtatctgggaggagaaggcattggggaggccagtgaccggctgttatttggggaggcaaatccgggaggacgtctggcggagacgttcccatatcgtctggaagacaatccgagttacctgaatttccccggagacggcaggactgttctctatggagaagatatctttgtcggataccgttactatgatgcgaagaaagtaccggtgcgctgggcattcggccatggactgtcatatacggaattcagctacagcaatatgaaactctcttctgcggaaatgaaagatggagatattctgaaggtgagcactgatgtggagaatacagggaagagggcaggaagtgaagtggttcagctctatgtcagcggcaaaaacagtacagtgccaagagcagtgaaagaactaaaagggtttgcgaaagtatttctgaatccgggtgagaagaagactgttacaatggagctttgcgcgagagattttgcttactacgagacaaagattcacgactggtatactccgtcaggtacatatgagatccagatcgggcatgccagcgatgagatcagagaggctgcagaacttatatttacgactgatgtgctgctgccgttcactgtggatatgaccactacaatgggggaattgatgaaccacccgaagacagcagggaaaatgatggagtatcttgagggaatatcacagggagaagaacctaagaaagaagatggggatgtacaacttgtgactccggaaattattgcgcagatgccgctgaaatcatttttaagcgttattccgggcgaagtgatcgagcagatgatcgtggagttaaatgctctgtgtgcagaagagggaaagtgaggataaaattatgaatcaagataagataaaaatgagagaaaagctgtcatttgcaatggcaaactttggaaacattccggttatgacactgatcaacggatatttactaattttttataccaatatatgcggcttgagtcctgctgcatgtgcgacactgttcctgatcgcacgctttctagatgccattaacgatccgttagttggatttatgatcgaccatcttccgaccagaaagatgggacatttccgaccgacattgattctgggaacaattctgtgtagcgccaatttccttctactttggtttggacctatgttatcaacatcggggaaactggcaatcgcatatgtatcgtatattctgcttggtgtgttgttcccagtcatggatatttcgctgaacagtcttctgccggttatgacagaagatatgaaagaaaggaacagcttaagttcaatcaaagggcttgcatacgtgatcggggcgcttgtaatcggtgtggcagctccacttattcttggagatacttctaacaaacagggatatattaatcttgttctgatcatgacagcagtgatttttttcttctctattataggaaccatgggagtaaaagaacgtgtaaaaccacagatggagaacagctattctgtaaaagaattattcaagattctcagtcagaagccggtgtacattacattccttgctgtactgttatattcgattggaagcaatatcgtgaatgcagcaaatacatacttttatacatatatttttgaagatctgacgttggcgtctattattacgcttattacatgtgttactgtttttccggctacaatggtcattggtaatctgattggaaggtttggaaagaagaaaatgtatgcgattggacttgcacttgcaggactggcaccaatcatccgtctgttggatgtgaggagcattccccttcttattgtctctgtattgattgcaggaataggagccggctttgcagcacctcttaattatggaatacaggcagataatacagattatatcgaagtgtctatgggaattagggcagaaggtgctgtcgcatctctttccagctttgtctccaagtgtgcaatgggaatcggtggtgcgattccggggtatctgctgcagttagcaggatttgacagtaaggcggcagtacagaatgacaatgtgattaatgtgatcgtcttctgtgtgctaatattgccggcaatcgtaaatgtggtggccattgtgatcttctcaaaaggttatcctattaccaaggaaaaattgaatgagcagatatgtctgatgagggagaaacggtcaaaagcgggtataagtgaataagaatgatagagaaggagtatcagcatgggaaagatttatgcagcaaaaacaaatcatatcacaaatccgatagggtttaatatggattctgttgcattttcatggaaagtgaaaggatgcagaggacaggaacagaaatatgcaaggattgtaatcagcaagaacaaaacctttacagatatctgttacgatacaggtgaaacagagttggacagcctctctacaagagtagaatttgaaatacagccgtatacaagatattactggaaggtcattgtgacaacagatgtagaggaagtaatcgaatcagatgtacagttttttgagactgccaaaatggatgaaccatggactggaagatggattacctgtgacagcagtcaggaacggcatccgattttctcaaagagaattcgtccggcaaaagaagtgaaaagcgcaagactgtacatttgcggcctgggattgtatgaggcatattttctcggggaaaataaagaaaatccggagaaaatcggcgatgagtatctgactccgtactgcaataattatgaccggtggatccagtatcagacgtatgacatcacagaacaggcagaacgaggaggtgtgctgtctgttcttctcggaaacggttggtataaaggcaggttcggtttcaatgatccggagcgggaagcatattacggtgacgagtggaagctgattgcggaggttcacatagagtacaaagacggaacgaaagatgtgatcagttctgatgaaacctggtcagttacaagaagcaatttgtggttttccaatatctatgacggtgagagaagagatgatacgctgccgccggttgaggagtctcctgcgcggatcgcaaaggctccgaaaggccggcttatggaacggttatcgcttccggtcaaggtgcaggagcagataaaaccggtggaactaattcatactcctgccggagaattggtatttgatctggggcaggagataacaggaatcttccaattgcgtgtaaatgaaccttcggggacaataatcaggatacagacaggggaaatacttcaggacggatgcttttataacgagaatttaagaactgcgctttctgagtatgtctatgtttccgatggtacggaaaaggtgattattccacattttacttattatggataccgttacgtaaaagtcagtggtgttaccaatctgtcatgcgaggactttatggcaattgtgctatacagtgattatgagagtatcggtacagtcgaaacgggcagtgagcttgtgaataaactgatttccaatattgaatggggaatgaaagggaactttctggatgtgcctacagattgtccacagcgcgatgagagaatggggtggacaggggacacacaggtattttctgcgactgcaagctacttggctgatacctatgcgttttacagaaaatatttatatgacctgtatcaggaacagcttctggcggacggaatggttccagagattgtccctacattcggaccgacaaaatgttcctgcgcatggggagacgccgcatgtatcatcccctggaacgtatatttgttcagcggggacaaaacaatactcgaaaaccagattgagagcatgaaagcgtgggtcgattatatccggagaattgacggagaccatcatggatggagacaggttttccattatggggactggcttgctcttgaccgtacaggtgccgctgcgaacagcgtgtatggagcgactgatgaagcatacattgcagacatctactacgcggcaagtgcacagattgttgcaaaagcagcagaggtgcttggactggaagaaacgagacaggaatatcagaaaatcgcagaccgtcagtggcaggtcgtgaaagaagaatattttactgctacaggcagatgtgcggtgaagacgcagacagggcttattcttgcactgaaatatcatctgtctgaaaatgaagaactgacaaagcagatgctgcaaaagcttctcagggataataaaaataaattaaataccggatttgtaggaacaccgcttttgtgcaatgtcctgactgatcatggaatgacagatgcggcatacaggctgcttctgaatgaagaatatccgggttggctccatgaagtgaagttgggagcaacgacggtgtgggaacgttggaattcactggatgagagcggacatgtttctagtacggggatgaacagtctgaatcattattcgtacggagctatattggagtggatcttccgccatgcagctggaattgatgtgatggaacagagcccgggaggcagggtgatgcgaatcagcccgaaagtgaataatggacttaaatatgtaaaagctgtttatgattcggcaaccggatgctatcagtgcggctgggagatattagaggggaataaaatcaccatcactgttacagttccgtttggaggcaaggcagaagtggttctcccttatgcaccagaatgcatatatgaggatatagaaaatccattatttgaagctgtggaaaacggaatttgccatgtgaaagccggagaatatgaagttgtatatgaagcatcagaaccattaaaaaagagatatagcatagactcgacaatggaagaactgctgaaccatccggatatccgcgcgtttctttctcaaatggtggaagtagatatgatccccgatattgcatatgggctttcgcttagagatgtcgcaaaaacattcgcaggagaaatcaaaccagacgaggcacaaatgttggataaagcactggcgaaattctaatcaggagggctgctttggagcttataagacttaaagtaaacagtcaatatagaccatgcgtggacgaagcaccttatttttcatgggtaatcactagtgatgaaaagaatgtgatgcaaacatcctatcatatcacagtgaaaaatatggacgaagtaatgtgggattctggaatggtagaaagtgataaaagtatttttgtggagtactccgggaaaccattacaaagtctcagtgactatagctggacagtggaagtgacagttaataacggagaaaaggcggcggcatcctcatcctttgagacaggatttatgaagaaagaatggacggccgagtgggtgaaatctccgtttccgatgaaaaaggtaaaacccggaaccggcgggcagaacccggcagaatattttcgcaaagaatttggtgtacgagacggcataaaacgagcgcgcgtttacgccacctgtcacggagcatatcagctcagcatgaacggaatgcgtccggatgacagagagtttgcgccggaatttaccgtctattcccaatatctgtgttaccagacctatgatgtgaccccgtttttgagagagggagagaatgtcatagggatgctggtaggggatggttggtatgacagcgcgaactttaaaccgagaagcaggaagtttaaagccgaacattctgtgttatttcagataaagattgattatgaagacggaacgagtgaaatggttgtgtccgatgatgcggtgaaagtttcggaaagtccggttcggtcttccgatctgtttgcaggtgaactctatgacgcacggatggaacaggaaaactggaactgttgcggattcgatgacagcagctggaaagcaggtatcccatgcaaaaaatcttacgccaacctggtagctcagtacggggaaccggtgcgcccggtaaaggaagtaccggcagtcggaatgacggtcagcccgaaaggcgagacgatcattgacttcgggcagaatctggcgggggttctgcgggtaaaaatcaaactgccggccggaacaaaaatggtattagatcattttgaaactctggatcaatatggaaactatttcaacaatattttcatgtcagagaaaacagggcacaagcaaagtgatatttatatctcaaacgggaaattcacagaatacataccgcattttacatatcatggattccgctatgtgagagtgacatgcgatcagccggtgagcccggaggatttcacagcgattgtcctgtcttctgacaatgaggatctgggaacttttgagacatccaacgaagatataaaccggctttacgaaaatacaagatggtctcagcggtcgaatctgttttcaatccccacggattgcccgcagagagaaaaaggcggatggaccggagatatccagatttatgcaagaacagccatgctcaacgaaaatgtaaccccgtttctgacaagatggctgcgtaatatgacctgcagtcagcagaaaaatggggcaattcccaatgtaatcccccttaccggaatctatgaattactggagaaactgaatcggatcgtataccgcaattttgaaccggtgggagaagcaggatggggagatgccgcctgtatcgtaccgtggagcatgtatcagcttacaggaaatatcaggatactgagagaacagtatgacacaatgaaaaagtggtgcgactatatcatcaacactgcaaagaagcgtagaggcaagatgaaacatccaaaagaaattgatcagtatctgtggaatacaggacatcagtacggggagtggctcataccgagccagacagtagatggagcagaccaaagcgctgcaaaacctgtcaatacttctgcatactgcgcgccaatctttggatggaattcctgccggatcatggcagatacggcagcactccttgggtatacatcagacgaattatactatgatgacattgcgtccagaatgaaatctgccattcaaaaaggactgatcgatgatgacgggaagatgcctcttgattttatgggcagttatgtgctggcaatcgcatttgatcttgctcctgaaaggaagaaaaaaagtatcgccggacatttgattcgcaagatagaagaaaacggggattgtctggatacagggttcctgacgacgccgtatctgctggatgcactctgtaagatcggcaggatggacaaggcatataaaatcctgcttcagacaaagtgcccgtcatggctttatgaggtgaagcagggagcgacaacaatctgggaaaactacatttcttataaggaggacgggtctccggttatgacaagcctgaaccattatgcctttggatgcgtggacgattggatgttccggaagataagcggcattgatatggctgctcccggatttaagaagattgtgattgcgccggagacggatgaggcgtttaccagtgcaaagcgtacctatatgagtgagtacggtaaagtacggacagagtggagcgtggaagagggaaaatttgagttgaaggtggagatcccttgcaacacgactgccactgtaaagatgccggatggcagattgtatgaggtaggaagtggaacatatgagtttgaatgtaaggaataactgccgaaaatcagcaggatatctggaatggtggactcctaagatggaagaatacttatatcagttttcagaaagatgattagtatattaagtttcgtcggtaaactgcttatatatcgttgatgatttgtcctttgggattatttataattgaatcaaacaatgaaagggtggataacgaaatggaaaatgcagttacaaaaagagaaaaaatcagttatggtttgtattttatgggacagaatgtattctatggactgataggatatatgactacatattttacagatatcggcataacggcagcattggttgcaatcgtggcgcttatcacgaaagtgtgggatgccatcaacgatccgatcttcggcatgatcatggataaggtaaattttaagaaagggaaattcctgccgtggcttcgaatatctgttatagcgattccggtggcaaccattcttctttttataatacctaccgggattccgatgatggctaaaatcatatgggcaacacttgcttatatgttatgggatacagcctataccctttgcgatgtgccgatttttggtattgttaccacgatgacaatagaccagaaggaacgtatttcactaaacagcataggaagaatgtttgttatttttgcagggattgttacaggaattgtcctgccgttggtacggcagcggttgggcggctggtcaacaacagtgattgtgttatctcttctgtcggctgttatgatgattccgatatgtctgttcgcaaaggagagagtaattgaaaaagaaagagtactggatgacggggcagaagaaagttatacattgcgagatatggcagaatgtctgcggaagaacaaatatttattgattttctttgcagctccgctcattagcggcctgcttaatgttggggcaaattggggcttatacgttgcccggtactgccttggcggtgaagaagttgcctcatatgtttcgatgacagtgattattccgacgataatcggtgcggttatggcagtagaattatgcaagaaatatgataaatttaaagtcttctatatttcatatgttttcgctttacttttgggaatcgtaagattcattgctgggtatgagaatatgacggtgtttgtgattttaaatgccttaggaggaattccgctgggaatagcagttatactgcagtatcagtttacgccggactgctacgagtatggacagtacaagacaggattaaaaatgcgtggtgtaacgtttgcagcgcagacgttttttacaaaattaaatggagcgatcgcaacaggagtcagtgtgtttgcgttaactttaatcggcttccgagagggagaaggtgttgttcaggcggcaggatttgccgataaactatggatattcagctgtcttggcagcattatcgggggtatttgtactctgcttatacttcgcttttacaagctgaatgaccatgatgtccagctgatggcaaaatgcaacaatggcgaaatcagccgtgaagaggcagaggcacagatgatcaatcagtattaagaaaagaatggaggacttttgcgatggacagaataaaggaactgatttcaaaaatgacgctggaagagaaggcaagtctctgttcaggagctgataactggcatacgaaagaaatcaaacgactgaatattccgtcagttatgatggtggacggccctcacggactgagaaagcaggaaggggaaacggatcatctgggattgaatgaaagtgtgaaagccgtttgtttcccggcagcctgtgcaacagcctccagcttcgatgttgacttgatggaacggatgggagagacgctgggagcggagtgtcaggccgcgaatgtaagcatgctgctcggcccggcggtgaatattaaaaggagcccgttatgcgggcggaactttgagtatctgtcggaggatccatatctggcaggtaggatggcatcggcatatatccgcggagtacagagtcagggcgtggggacaagcattaagcacttcgcactgaataaccaggaaacactccgtatgacgatatcttccgaggtgtcagaacgtgcgctcagggaaatctacctgcctgcgtttgaggaagcggtgaaagaatcagctccaagaaccgtcatgtgcagctacaacaaaataaatggagaatatgcttcggaaaacagatatcttctgacagatatcctgagaaaagaatggggatacaaaggctgtgtcgtcagtgactggggcgctgtaaataaccgtgtgaaaggactgcaggccggactggatctggagatgccttattccggaggatacaatgacagacagattgtgaaagcagtacaggagggaagactggacgaagctgtgctggatgaagcggtggagcgggtattgaatgttgtatttgccggtgaagagcagcatcgtccggaagttatatctgataaggaaacagatcataaaaaagcagcggatatagagactgaatgtgcggttctgctggaaaataacggtatacttccgctgaatacagacagaaaggttgcctatataggggaatttgccgaaaagccgcggtatcagggcggcggctccagccatatcaatccgttcagggttgtttcggcattggatgctgccggagaaaaagggcgcagcgtgacttatgcaaaaggattttctatggaaaatgacgcgatgacggaacaggagctggaaaaagcacttcggactgctgcagaagcagacgtcgcggtgatctttgccggtctgcctgagatatttgagtcggaagggtatgacagaacatctatgaagttgccccaatgccaggaccgtctgatcgaagaagtgttgaaagtacagcctaatgttgtagttgtactccacaatggaagcccggtagaactgccctgggctgataaagtaagcgcgatccttgaaatgtatctcggaggtcagggcgttggcgaagcctgtgaccagctgttatacggagaagcgaatccgtccggcaggctggcggagacattcccgtaccggctggaagataatccgagctaccttcatttcccaggaaatggaaagcgggtgttatatggtgaggatatctttgtcgggtaccgctattatgatacaaagaaggttccggtgcggtatgcattcggacatgggctgtcttacacggaatttgcttatggggacttgaatttgtcatcggctcaaatgacggatgaggatatcctgacggtctccttcaaggtgaaaaatacaggaaagacagaaggaaaagaagtcgtacagctgtacgtggctgacctgtgcggcatatcggagagaccggtcaaggaattgaaaggatttgccaaagttcatctcctgccgggagaagaaaaaacggtgtcgatggaaattttggcgagggatctttcctattatgaagaacgtctcggggactggtatgcgccatccggaacataccggatcctgatcggccatgcttctgatgacatccgattacatgctgatattgtatttgaaacacagaaagaactgccccttcgcgtagatttcacaacaacgttcggagaattattggatcatacgaaaaccgctcccgttattacggaactgctggctccattggcagcagcagccgcatcagcagaaggtatgagtgacgaatacaagaagctgggagagcaagttatccgggaaatgccaatgaaatctctgctgggacagatgccgggagaacaggtggaacagctgatcggtcagttgaattgcttacttgcacaataggataattgagaaaggatgttcaaaaaatgaaaaaagaacacgaaattttatttgaaccatttaaaattggaacggtaatgattaaaaaccgttttgttttggaaccaatggaaggtacaaacatgatagactgcttacctatttttaaaattggtgaggatatctatgattattatgtggagcgtgcaaagaatcatgtaggtttaattattcccggaatggttactctgcgtagtatggtggggaaacagtggctttatgagcagaaagaaatattcgaaggactaaagccgcttttagcagaaattcatagttacggtgcaaaagtgtttttgcagattggtgcaggatggggacgaacatttaccatgccactggcattaaaggaactttatgaaaaagagaaggaaaccggacaaaagtccatgtttgactgggataatcttcttgtagcccctagtgaactgcctaaccgttggcttccagaaattatacatagaccactgacggaaggtgaaattcttgagtatgtggatgcctatggtaagacagccaaactttgtatggagacagggtttgacggtgtggaagtgcatgccgtgcatgaaggctatctgctggatcagtttacaacgaagtatacgaatcggagaacagatcagtatggggggacttttgataaccgctacaggtttgcgaaagaagttgtagaggagattaagcgacagtgcggtgacacattccctgtatcccttcggtattccgtaaccagtaagacaatcggctttggtatcggggcagtttatggtgagaaatttacagaagccggcagagatcttgaggaagggctgaaagccgcaaaatatcttcaggatgcaggatatgatatgcttaatgcggacaatgggacttacgattcatggtactgggcgcatccgcctgtatatatgcctttaaactgtaacatggcggaggtgacacgattaaaagaagtggtagaaattcctgtggtatgtgcaggaagaatgcagccggatgaagcttcagcatctatatcagaaggaaaactggatgctatgggaatcggacgtcagttcctggcggatccggaatacattgtaaaactggaacaggagaaatttagtgacattcttccttgcattgcatgtcataatgcatgtcttccgatttatcattatgaaggcgttggctgtgaaatagatgaagaggatggaaaaacacaagggcattgtgcgttgaaccctaggacattctgtgagcagaaatatgattttgagaaaaaagcagctataacgaaaagtattgcggtcatcggcgggggtatcgctgggatgactgtagcccgaattgcggcaatacgaggtcatgaggtaactatttatgaaaagagtgaccggctctgtggtgtgtttaatgctgcagcagcacctgaattcaaagaaaaagataaagaatttataagatggattcaacaagaaatagaaagactgccgattaaagtggaatacaactgtgaaattacaactctggctgagctgacagaagatgaaattatcattgctacgggcgcaaaacctagaaagctagatgttccgggacaggaaaaagctattgaagcaacggaatatctgctggggggaaaagtaggaaaggacgtcgctgtaatcggcggaggtttgacgggctgcgagattgcctatgaccttgtgctgaaaggaaaacgaccggttattgtggaaatggcagacgatattttaaagaccaagggactctgcatggcaaactccagttgtatgagagacttattgcggtattatgaagttcctatttataaaaacgcaaagctcttagaaatcattgaaaatggaattgttattgagacagcggaaaagacaatacagttggaatgcgacgacgtgataatgagctgtggttatatgccagacacgaggcttgttgacggcggaacacaacaggggaaaacgaatattcatatagtcggcgatgttaaaaaggttggaaatttgaaaacagcaatctgggaggcttatgatttagcattttctttgtaagattaaactcttaagcggacaaagaggcttttaatatattatagaaacactgctataagaattattgataccattaggctgtcgatttttgagggatgtcatatacagaattatactgactaatattaagttttaatcggtatttcaatttgtgtgatgtaatcatcaaaggagtcaatgaagagttcattgattcctttttcatatgcaaaatcgcaaaatgtaataccatgcttgttgggccggctctatcaaagatgataagccctttttcctgctgtaatttatttatttcttaccgcccatttaacgatttcgtgtccatgggatagtgaagggaaaagatagaagaccttcaaattatgtggaggtgaatcacatgaacgatatgcaaagacaacagataaaagagcttcgtgaaactggtcatagttatggacggattgcacagaggcttggcttgagtgagaacaccataaaaacatattgcaaaagacatggacttggtggtgtggcaaaagggattgattaccgattcagaactgcaggtaattgaaacaataatgcgccagaaatatcatccagaaaaaaagcaggacaaagatctgataaatctgccggttctggttgtggatgatgataagatatgctgtgaaagcacagttgccacattgaaggagattggtattacaggcgaatgggttctctctggcagagaagccgttgagcactgttatgcacgtcatgagctaaaaaatgattactttgctgttatcctggattggaagatgccggatatggacggcatagaaacagccagacaaatccggaaacggataggaaaagagattaccattattgttctgacatcttatgaattcagtgaaatcgaagaagaagcaaaggctgcaggagtagatgcttttattgcaaaaccgctattccgttcccggttgacagcaacgctgcggcagtttacttcaggcagaaaagaaaaaacagcaagaaattatctggatgagctgtcagaagcagattactcaggaaaaaggattctgctggtcgaggacaatgagctgaacagagaaattgctggtgaaattctgcagatgacaggggcagaagtggaaacggcagaaaatgggaaaattgcagttgaaaaagtggaggcttctccgaaaggctcgtatgatcttgtttttatggatatccaaatgcctgtcatgaatggttatgaggcaaccgcagcaatcagaagccttccaggtgaacagggaaaattgccgattgttgccatgactgccaatgcttttgcggaagatgtacagctggcaaaaaatacaggcatgaatggacatctcgcgaaaccgttggatatgaataagctgaatgatgttttggaaaactggctgtaataggataatatacagcattctctggcagctggtatgaatacccatatttcaaaaccagttaacatgaagacgttagaaaagacgataagaagcataaaaactggcggggtaccgaaactcaggtcactgaacagtgataaatggatataaaaaatagaaaatatgttaaacggaagcaacctgctgggtatctgaaaagaagattcccaagcaggttttatttttctgcctggaaagtcaaaaaaataaaacaatgtgcaaaatagataaattttaccactaatccctaacaatgcatgctgacataaggttatacgctccaaaagcccgatgaaagcaagttataaaatcgttaaaaggttgttttgtttgaattatacctctcaaaagtatcatcgttcagtaagtaacgttgccatggtactggttgccgctgtagcgctgggatcaagtacgtatgcttggtttgtaacgaataataaggttgatgcaacaaccacaaatatcagtgcgcagtcaaatgcagcatttatgactatcacgaatggtgctacaggtgcaagcaaagtagacacgacaagtgcaacaacattaggaaaagatacagatctttatcctgcgacatttggagaagaaacaaattctaccaaagataagttcatgacaggatatggaacagatcttgacaatggaactttggatggaactcttaaacttgttggaactgaaggtactcctgatgaagcaaatacagcaaaatatgctctgaaagagcagtttaatatcagctccaaaggtcagaatctgagtgatttaaaagtagaaagcattgaaacagcaacagacgctgctaccgatcagcttttaaaaacagcacttcgtgttttagttactaattctgatgcaagtaaatgggttgtatatggtttggattccgcaggaacaaagtatgaaatcaagctttcttcggatacatccaatgcaaatgtagcccttggagatgtaacagctggagcagatacattggttaatgtttatctgtattatgaaggaaaagacacaaatgtcaaaacaagaaaccttcaggatggaaagcttgatgcttcacaaagcgtaaagattaactttacagcaactgctgacaatcagtaataaacctagctcttgtagcttcttcagtaggacataaaataagtccttcttcgaccaatgatttaaaagactggtatgcttctctgacatgggggcaggatggattggtgcactcttatatgcaggcagatgtaaatgaaacaggtgaatacacacaggataaaaccggaacatataccattaatccggcacgttatgcttttatcaaaagcgaatatgttatttatactgttaagcagacaggtacttgtgatgtatatcttgccgctgaggatggagtacctgctgttcaggttactgcgacaggagcagctacatctgatattattccgaaatctctcagagtcggtattaccatgcaggatttggatggaaccactccaagcggagatgaagaattagtattggtgtatgcaccatatgatgaaaccggaaaaggaaacgatggcacaggaattgacggttggacttatgtagcggacactgcaaatgtggctcctgttacctatcctcatgtttatggtgaaaattatatctggatggaaggtactgatgaacagtgtgttaataattccagtgaagaagatccatcaacctatcaggttacagtatcgcttgcaggagtagcaaaataatacgattttcagaaggtcatggttcccaagccgtggcttttcttttgccccgatatccccatattgtcaactatccccaatctccttcacgtattttcggtacatctgatgaattgctattttccacacttctggtatagtcatgtaactgaaaagaaaacactcagaagggagaaatgcaatatgcgaaaaaagcaggatatcatgtgggagcaaagcggcagtcgccaaggtctcgtgcaagcacggactttggctcgttgctcgcgtaaaatagaaaagtcccttcagaagaaataaacttctgaaagggactttttctgtatcatgctgccaattacgcagattatcaatctgaacaggatcacagcaccaatttctataactggatatttttaaagagatctccaaggtttgttccgatatcttccgctttcgggatcacaaccttttcagctttctcttcagccttctctttgtcttcttcgagagctttcatgctcaggctgatcttgccatctttgataccgatgactttcacttcaacttcatcgccaactgtgagaacatcagaaggcatttttacacgtttctgggagatctgtgaaacatgaaccagaccggaaagtccgttctccaactttacaaatgctccatagttctgaagtgtttctacagttcctttcagaacagttccaaccttcatacttgcaatttgtgcatcacgtgctgctttttccttttccttcagaagctcacgtgcagaaaggacaagacgattattcgcctggtcaacatcaatcacctgtacttcgatatccttgagaagataatcttccagattctcgatataggaaagggacagcttagaagccggaacgaatccgcgaagtccttctaccattacaattacgccaccgttgacaacaccttcaattttaacaggaagaacagttttcttatccatataatcctggactctgttccatggattcgcatcatcgaaatgatcttcatagtctgccattgtttctgttacttcatttgtctgtaattctttcatttcttcgctcattaaaagcacctcattttctttttctcgttaatcaaaagtataacatatgtatgagaaaaaatacaacaaaagagccaaaatccgtgaagaaaatgaaaaatgcggttggattaatagaaaaaaaatgttactctacttattgaatagtaaattgtcaggtttaatacttaatgaagaagctgttcatgtaaaatgacagaatacagagataaattgatgtgagtgtaaaagtaaataagagataaatttgagaaggagagatagaaaaaatggctgagaataaaaaggtgtatgttgtaggtcataagaatccggatacagattctatttgtacagcaattgcttatgcaaatcttaagacaaagattaccggagaaacgtatgagcctcgtcgtgcagggcagcttaacgaggagacacaatatgtactggaacactttggcgtaaaagttccgttattactttctgatcttagagaacagattaaaaatgtggaattgaaagaaagtcaggaaattcagggaagcctctcaatccgtacagcatgggaaaagatgtcagagatgaatactcatacgattccaatcacacgtaatggtgtgctggaaggtgtgatcacaaaaggtgatattgcgaaatcctatatggaagtctatgataacacaatgcttgcgaaggcaagaacacagtaccgtaatattgcagcggcagtagaaggtgaaattgtaacaggaaatgaacatggttatttttataaaggaaaagtaactgttgcagcatcaagcaaagagttgatgacaagctttatcgagaaagatgatcttgttatcattggggatcgaattgatgcacagcagtgtgcagttgatctggatgcaagctgtatggtagtctgccagaatgatccgatctcagaagatattctgcgtcaggcagaggcaaaagaaattgtcgttatctggacacagcatgatacatttacggcagcgcagcatatcagccagagtattccggtaagatctttcatgacaaaggatcaactcgtaacattccgcaagaatgattatgtagatgatgtgaaagaagtgatggcacgcaagcgtttccgcgacttccctgttgtagatgaagatggaaagttcttaggtcttgtttccagacgaagacttctcaatgtcagcaagaaacaggtgatccttgtcgatcataatgagaagaaccaggcagtagacggagtggaagaggcagatgtccaggagattattgatcaccacagattgagcagtatcgagacgatcggacctgtatttttcagaaatcagccggttggatgtacagcaacaattgtatctcagatgtacgaggaaaatggtgtcgaaatagatccggtgaatgcaggacttctttgttccgcgatcatttccgatacattgatgttccgttccccaacttgtacaccacttgatgaaagcacagcgaaaaggcttgcagagcttgccgggatcaatatagagaaacttgcacaggcgatgttcaaggcaggaagcaacctcaaaggaaagacagccgaggagattctcttccttgatttcaaacagtttacagtgaatgatacggtatttggtgttggtcaggtgaattcaatgagcgaagaagagcttgaagagattaaggcaacagtacttccggagatggaaaagacaagacaaaatcacagtctggatatgattttctttatgctgacaaatattattacagaatcttctgaactgatctgctgtggtaatgagtcaagagaaaagattatcggagcttatgatctggaagataatgcacagaaactgatgctcaaaggtgtcgtatcacgtaagaaacagctcgttccggcacttgtatcagcactgcagcagtaagaagcccaagatattttcaaatagaaagtcagaaccgtctccgtaacaggggacggttttcaggaggaaagagaaatggcgaaacaggtatggaaagccggtaatatggtctacccgcttccggcagttatggtaagtacggcagataaagaaggaaatacgaacatttttaccgttgcatggacaggaactgtatgtacaaatccggcgatggtatacatttccgtaagaccggaaagatattcgtatcatatgattgaagagagcggagagtttgtgatcaatctgacaaccgaacagctcgctcatgcgactgattactgtggtgtgcgctccggtcgggatgtggataaatggaaagagtgtcatctgactgcgaaaaaggcagagaagcttacttacgcaccggtcattgaagaagcaccggtcaatattgaatgtgtagtgacaaaaattgagaaacttggaagtcaccatatgtttcttgcagaagtgaaagcggttcaggtggacgagtcctatatggatgagaagggcaaattcgaactcaataagacaggtcttctggcatattcccatggagaatatcttggacttggaaaaaagatcggaacgtttggatacagcgtgagaaaaaagaagaccgttgacaaacgaactgctaagaagatcacaacaaaaaatgaatcaaggagcaagaaatctccagagaaaagaactgcaaataaaaatacaacattcagaaagaagggaaaagttaaaaaatgatttcatttgaaaatgactattcagaaggcgcacatgaggaaatcctgcgcagactggcagaagtaaataaagaaggaattacaggatacggaaatgattcatattgtgaatccgcaaaggaaaagatccgtcaggcatgtaaatgcccggaggcagacatttacttccttgtgggaggaacacagacaaatcagacagtaattgattccgtgctccagagctatgaaggcgttatcgcggctgagacaggtcatgttgcatcacacgaggcgggtgcgattgaagcatccggtcataaagtactggcccttccgcagctggaaggaaagattcagcccaaagatgtggcagattatttgaatcagttttatagtgatgggaatcatgaacacatggttttcccggggatggtctacatctctcacccaacagagtatggcacactgtatacacgtggcgagctcgcagagctttctgatatctgtcagcagtaccatattccactgtatctcgatggagcacgtcttggatatggtcttgcagtagaagatacagatgtgacaatggaagatattgcagaatactgtgacattttctatattggtggaacaaaggtaggtgccttctgtggagaggctgtagtatttacaaaagaaaatgcaccgagacattttgtgactctgatcaaacagcacggagcactgcttgccaaaggctggttccttggtgttcagtttgatacgttatttacagatgatctgtatatgaaaatcagtaagaatgcaatcacaacagctgcgagactaaaagaaatcctgaaagaaaaaggatatgacttctatattgattctccgacgaaccagatctttgttgagatggaagatgagaagctgaaagaacttgagaagaatgtcagggtcagcttctggtagaagacggatgagaagcatacggtagtcagatttgccactagctgggcgacagatatggagaaggttgagaagctgagggagtatttataaaaaagtaagaatataaataatagcaaatacagataatatatagaagcccataaaatgagaatcattatcatgtagaaatattgcgttttgcaaagaaacttgatagaatacatatggttagagaaaactaactgtgtgaataaatcatgtatactcctttgtctgtaatacctgaacacaggcgagggagtcctcagaaaggatggacaactatgaattatctggaaattgaaaaagtaattggaagagaaattatcgactcacgcggaaatccaacggttgaggcagaagtgcatcttgtagatggaactgtagcaagaggtgcagctccaagtggtgcttctaccggagaatttgaggcacttgaacttcgtgatggagacaagtcaaaattcggtggaaaaggtgtttcccgtgcagtagaaaatattaatacaacaatcaacagtgcattggttggaatggatgcaggagacacttatgcaattgatcaggcaatgatccaggcagatggaacaaaagataaatcgaatcttggcgcaaatgcaattcttgcggtttcaatcgcatgtgcaagagcggcagcagatgcacttgagattccgctgtaccgtttccttggaggagtgaatggaaacagacttcctgttccaatgatgaacattgtaaatggtgggtgtcatgcactttcttccggactggatgtgcaggagttcatgatcatgccggtgggagcgccgtcttttaaagaatgcatccgctggtgtacagaggtattccatgcacttgcaggaatcttgaaagacagaggacttgcaacatctgtaggcgatgagggtggatttgccccggcactgaaatcagacgaagaagcaatcgagacaattcttgaggctgtgaaaaaggccggatatgagcctggaaaagacttcaagatcgcgatggatgcggcatcttcagaatggaagacagggacgattggagagtataaacttccaaaggcaggaacagtctatacttcagaacagctcattgaccactggaagaaactggtagagaaatatccgatcatctcaatcgaagatgcacttgatgaggaagactgggaaggctggaaaaagctgacagcagagctgggagataaagttcagctggttggagatgatctttttgtcacaaacacagagagactggcgaaaggaattaagcttggatgcggaaattctattctgatcaaactgaatcagattggatctgtatctgagactcttgaagcaatcaagatggcacacaaagctggttacacagcaatttcttcccaccgttccggtgagacagaggacacaacgattgcagatcttgcagtagcgctgaatacctgccagatcaagaccggagcgccgagccgttcggagcgtgtagcgaaatataatcagttactccgcatcgaggaagaacttggaacaagcgcagtatatccgggaaatgacgcatttaatgtgagataacatcagtaaaataacctgacagtcaggaaaatccatgcattttatgatcccagtgggatgaaatgcatggatttttgtgcatgtatttctttgatttccatctagatttttttagctatatgtcatacaatagaaatgtaattgccatcaggcaacataatatttaataatatttggaggatttcattatgaagaaaccggttctggtcattatggcagcaggaatgggaagcagatatggcgggctgaagcagattgacccggtagatcaggaaggacatattattatggatttctcgatctttgatgcaaaacgcgcaggatttgagaaagtcgtatttattattaagaaagaaaatgaagcagattttaaagaggctgttggaaagagaattgagaagatcatggatgtagcgtatgtattccaggatctgaacaatctcccggaaggttacgaagttccggaaggacgtgtaaagccttggggaacagcacatgctgttttaagtgcgatcgatgaggtggatggaccatttgcagtaatcaacgcggacgattattacggacgtcatgcatttgagacaatctatgaattccttacaacacatgaagatgatgataagtaccgttatacaatggtaggttatcgtctgaagaatacagttacagataacggacatgttgctcgtggcgtatgtgaactcaatgaggcgaaagagctggttggaatcacagagcgtacaaagatcgagaagcgtgatggtggaatcgctttctcagaagacgacggagagacatggacaactatcgacggagatactcttgtatccatgaatatgtggggattcacaagaagtattttagatgagatcaaagcaggattcccggcattccttgataaaggtattaaggagaatccaatgaaatgtgagtacttcctgccatccgtagtcagtgaccttctggcagagggcagagcaaccgtaagagtgcttgaatccgaagataaatggtatggagttacatacaaagaggacaagccggttgtagtcgcagcggtacaggctttgaaagacgaaggtctttatccacagaaattgtgggattagattatgtgttgtcagttacagaatttgtgaatcataatgattatgcaacatttttaccataagaggaactattcgtataaagatttttgtggtggatgtgttataatcagagacaacaaagcaaagataagcaagctgctgaacacagttactgtgaggagcagcaatttgagcaataaagctcagaggaggaattttaaaatggcaattttagtaacaggaggcgccggatttatcggaagccacacatgtgtagaacttttgaatgcaggatatgatgttgtaatcgcagataacctttacaacgcatcagagaaagctgtagacagagtaaaacagatcacaggaaaagacctgaagttctataaagcagatatccgcgacaaagaagcaatgaacgagatctttgagaaagaagagatcgagtcagtgattcatttcgcaggactcaaggcagtaggtgaatcagttgttaaaccactcgaatactacgagaataacattgccggaactttagttctctgtgatgtaatgagaaatcacggcgtgaagaatatcatcttcagttcttctgcaacagtatatggtgacccggcatttatcccgatcacagaagagtgcccgaagggaacatgtacaaacccatacggatggacaaaatggatgctggagcagattctgacagatcttcatacagcagatccggagtggaatgttgtacttcttcgttacttcaatccaatcggagctcatgagagcggactgatcggagaagatccgaagggaatcccgaacaacctgattccatacattacacaggtcgcaatcggtaaacttgagtgcctcggtgtgtttggagatgattatgatacacctgacggaacaggtgtccgcgattacatccacgtagttgatctcgcagtgggacatgtccgcgcagtagagaaattgaaagagaaagcaggagtttccgtatataatcttggaacaggaaacggatattccgtacttgacatggtgaaagcattctccaaagcttgtggaaaagagatcccttaccagatcaagccacgccgtgcaggagacattgctacatgttactgtgatgcttccaaggcaaaggaagaactgcactgggtagctgagagagatctgaacaagatgtgtgaagattcctggagatggcagagcatgaatccaaacggatacgaggattaagtttgattaatcatttataatgtgaaataaaaagttgttgatgagcaggggcgcacgatgatagtgcggtttcctgtgctatcaacaacttttttgtatcatttgtaaattatgttaaccaaccgcgaacagcaacacagctcttgcaaccaacagtccatctgtattatactaatagaacacgattaaattcagaagaaattggagatagaaaaatgaagcgcgaagtagatcttaatgaaatttcagacggacgtctgtattcctccggagatatggttaaggtgaactgtcatgattgtgaaggctgctctgcatgctgccagggaatgggaaattccatcatattggatccaatggatctgtggagattgcaactcggaaaaaaagagaattttgatacactgcttgcaaactatctggaattgaatgtagttgacgggatggtacttcctaatttaaagatggcaggagaggaagaagcctgtctgttcttgaaagatggaagatgttctattcatggatacagaccgggaatctgccgtttgttccctcttggacgtatttatgaggagaatggattcaagtattttatccaggtccatgagtgtaagaagcaggaacgtggtaaagtgaagattaagaagtggcttggaattgcagatcagaagagatacgaagatttcgtgtggagatggcatacatttcttaagaactgtgaagaaggaatgaaagaacttgatgagcagaacgcgaaagtactgacggttgtggttctccgcaacttttatcaaatgccttatcaggcagaggaagaagcacagttttatccggaatttgaagaaagactggaaagactgaatgcaatgtttggattttagaagtgaaagttaacaacaggtgaaaggcagcagtagatggaaagcaacagtagaaaaacacagatattaaaagaaatttttggatacgattctttccgtaaaggacaggaggagattgtagatcagattttgaatggaagagatgtgttagcaatcatgccgaccggagcgggaaagtcactttgttatcaggttccggcacttctgatgtctgggatcacgatcgtagtatcaccgctgatttcattgatgatcgatcaggtgaaggcactgaatgaagcaggagttcatgcagcgtatattaacagtgcactgacagaacggcagattacaaaagcattagaactggcagtggcaggcagatataagatgatctatgtcgctccggaacgcttgttgacaccacggtttctggactttgcatgtcatacagaactttctatggtgacgatcgatgaggctcactgtatttcccagtggggacaggatttccgcccaagttatgtgaagatcacagaattcatccgtcagcttccaagacgcccggttgtcagtgcatttacagcaactgcgacacagaaagtaagagaagacattcttgaagtacttgatcttgaatctccttatataaatgtatccggttttgacagagagaacctttacttcgaagtaagaccggcgcgtgggaagaaggaagcaatcaaggaatatctcacacagcacagagaagacagcggaattatttactgtgcgacaagaaaaaatgtagatgaactctatttggaattgcagaatgccggattttctgtcggaagatatcacgcaggaatggggacagaggcaagaaatgaaagtcaggaagatttcatttatgacaggatagagattataatcgcaacgaatgcatttggaatgggaatagataagtcaaatgtccgttttgtacttcattataatatgccgcagagcatggaaaattattaccaggaggcaggcagagccggacgagacggagaaccggcagaatgtatccttttctattcaccgcaggatatcatgattaatcagctcctgctggatagtaaagagcaggttggagaatacacagaagaagaactccgggtgatccgggaacaggatgttctccggctgcgtaagatgagtaattattgtacgacaagcatgtgtcttagaaaatacatattgaattatttcggacaggagacagaagaacattgtgggaattgttccaattgtctggaagaattcgtagagcttgatgtcggagagattgtggcagacgtgatcgagtgtgtgcgcgaatccagacagagatacggtatgacaatgatcctttctacactggcgggagcgaatacagcgaagatcagaagtgcagggatgaatgaactttccatttatggaagacagagtaaatgttctcagcagagactgaaagacgtagtttatacactgctcgaacacggataccttcaacagagcgcagatcgttatgcaatcctgaaactgacagaccggtcagaagaattactgaaatcgagagaattgaaacttcgctgcaagaagtcagaacttacagaaaagaaaaagtccggaagtggaaagaaagcgtctcatagaaagggagagagtttcgggaatcttacagataaaagccgagaattattcgaagaattgcgctctgtgcgttattctttggcaaagaaaaaaggaattccgccatatatggtcgcttcagatcgtacattacatgagatgtgtgtacttgttccatttgaaaaagaggaactgcttgaagtacacggtatgggatttaagaaatatgaacagtacggagcagtttttcttgataagattcaagaagtgacagcaggtgataaaaaaggttacggtatatcagaagatgctgaggggacagacgcagttcagaaccagaatcctctggacatcggaccatttggaagcgtagagaattaacagcaaaaaagaagtaaaagaaagaagtgacataaaagtgtctgtaaaaatatttccaacattaaaaaattataaaaaagaatatttgccaaaagatattttaagcggaattatcatggcagcggtctcaattccaatttctatggggtatgcacaaatcgcaggtgttccggcggtgtatggactttatggatctgttctgccgatcctgctatttgccatgctctcaacttcaaaacagtttatcttcggagtagatgcggcaccggcggcaattgtcggagctgcactggcaacacttggagtgacggcagaatcagcccaggcattgcagtatgtaccattgatcgcattgtttacgggactctggttattgttgttttatcttttacatgcagataagattgttgattttatctcgacaccggttatgggcggatttatcagtggtattgcagtgacaattattatgatgcagattccgaaactgatgggaagcccggcggggactggagaattcatagaacttgcagaacacatttttctggcaattacaaagataaactggttgtcctttggaatgggaattggagcacttgtaatcttgattgtatccaaaaaactgattccaaagttcccgatggcaatcgttattatgattgccggagttctctcgacaattgtctttcatgtaaaccagtatggtgtagttctcctgcaggcagttcaaccagggcttccgcggcttattttcccggattttacaggaatcaatcttacacaggccgtgggaagagcacttatggttgctgttgtgatcatggcagagacacttttgtcagagaacaattttgcatccaaaaacggatatgaactggatgaccgtcaggaaatccttgcctgtgccgcaggaaatcttgctgccggtgcagttggatgctgcccggtaaatggaagtatttccaggacttccatgaatgaacagtatggaggaaagacacaggttgtatccattacagcgggactgaccatggcagttgtacttataggtgcaaccggatttatcgaatatcttccggttccggtattgacggcaattgtaatctctgcactgatgaatgttgtagagacacatcttgcagtacgcttgtttaaagtaagcagaaatgaattctatatttttattgcagcagggatcggtgtgctgttccttggtacgatttacggagttgtgatcggaattttgttatcttttgtagcagtgattttaagggctacaaaccctccgagatctttccgtggaatgattccgggaaaagaagtttattatgatctggagagaaaccgttttgcatatccaatcaagcatgtgattatttacagatttagcgagaaccttttctttgcaaataacaaagtgctggtttcagatattgaaaacagcatcaaagaggatacaaaggtcgtaattctggacgcatcagcaatcaacagcctggatattacagcggcagatgcactcgaaatgcttgcagcaagcctgaaaaaacgtggaattaagttctatatcacagaacattccagagaagttaacgatcagatgagaaagcttggaatcggacatctgatcaaagaaggtgctgtgcgaagaacaattcttgcggcacttcatgatgcgggaattgagcagccttgcccattggatattccagaagaagatctcgaaaaacttaagcgaagagaatatttttcccttcctgcagaagaagaaaatacactggaagagtttgcatgggcatttggtgatgatgcagtcaaagaaattgagaaacgagtgctttctattgtgaagcagatccatgagattacagatctcgagaaactttccgaagaaggaatcaaagaaaaactggaatcttggaattcacttggagcacttgatgaagatgagttgctccgcagaatggaacttcacttagatgatcttccaagtgatgtaaaagaaaacaaaaaactcgtcattgaattaatcgagcgtagaagaagaaaacttagagatcgtcttctgaaagagcatccagagattgttgagcatattgaagagcgaagagagcggctggaacgaagacttgagaaacagaatccagatgcagtaaagcgtctgaaacactggaaagatgaagaattctaaagaacaatctttaagattcttaataaatcattaggattgttaaagtccccttgtttctgcaaaaaaggaatgctatgattaatatggaagaaaaagtcaggggacaattttgattgtcccctgattttaagaatagaaaagaaaaaagggataagcatgtggtctagagaaacaaaagaagaaaaagaacgcaagaaagaacaagcgttttatgaacattatagcgcgatgggaaaaagcacagattccattagaaaagagtgggagagacgcaagaggaatgaacaacgcattcgacgcctcaagagacgaaggagaattgcaatcatattgattctgttcgttgtattaattccggcagtttcaacatttacttattttaaaatgaatccgattgtattacggagtaaagtgattgcgcaggaaaagaaagaaagtatggatctaatgtccaacatccgtttcgttgttggtggaaaagcgaaagatgtgaagacagaagggaaagtagatacgaataaagaaggaaaatatacggtttactatgtctacggtaaacaaaaagtaaaagcggaagtcgaagttaaggatacaaaagcacctgagcttaaaatgaaagacagttatacaacagaacttccgaaagatatcaagccggaagattttgtagaatcagtaaaagatgcatcagatgtcacacttgaatttgtcggacaggattcctgggagaagaaaggaaaatacggagtaactgttgctgcaacagatagtgacggtcataaaacagaaggtaaatcaacactgaatctggaagaggatacaacaggaccgactattgaaggagcagatgataaagaacttgcacagggcgatacgatggactttaatgaaggggttacgataaaggatgatatggatccagagccaacattggaagtacagggtgctgacaaagtggattttgcgacaccgggaacctatattgtcacctatcttgcaaaagaccgttccggaaatgagacaaagattgagcgaaagatcaaagtgaaagagaatccggattggaatgagaaagttgtttatctgacttttgatgatggtccttcagagaataccggagagattcttgatatcctgaaagagaaaaatgcgaaggcaaccttcttcgtcacaggaaataatcaggaacatgatgatatgataaaaagagccttttccgaaggacattcgatcggacttcatacctatacacacgattatgcaacagtttacgcatccgaagatgcatacttcgcagatctgcagaaagtatcggatctggtagagagtatcacaggaacgaaatccatgatcattcgttttccgggaggatccagcaacaccgtcagtgcaaaatatgtcaaaggattgatgacaacacttacgaaagcagtgagagaccaaggatatcagtattttgactggaactgtgattctactgacgcaagcggaaataatgttccggtagaaaagctggtttccaacgcaacatcctgcacggcaaatcatgttgatattctgatgcatgatacagatgcaaaagatacaaccgtacaggcattgccacagattattgattactatagaagtcagggatacacattcaaaggactgaccgttgatagtgtggcagcgcaccatggagtgaataattgataaatattagaaagagccaggacaggcacaacacacggtgtctgttctggctcttaattatatcttaatcctcatcatctgtctgtacagagtaagtctgtctctttcttgccatctcatcgctctcaagatattcatcataagttgtgatcttatcgatcagcttaccgcccggaacaatctccatgatacggttcgctgttgtctgtacgatctggtggtctctggaagtaaagagaagtactccagggaacttgatcagaccattgttgagtgctgtgatagactccatatccaggtggtttgttggctcatcaagaagcagtacatttgctcctgagatcatcatcttggagagcaggcagcgaaccttctcaccaccggaaagtacagcaactttcttcactccgtcttcaccggagaagagcattcttccaaggaatccacgaacataagttacatccttttcctcagagtactgtgtcagccactctgtgatattgtagtcattgtcgaattctccgccgaaatccttcgggaagtaggcctgagaagttgtaactccccatttatatgttccctcatccggttccatctcgccgatcaggatcttgaagaggattgtcttagcaaactcatttccaccaacaaaagcaactttatcctcgcggccaagtgtgaatgtaagattatcaagaatcttctcgccgtcaattgtcttggaaagtccttctacagtgagaacttcattaccaatctcacggttcggacggaagtcgatgtaaggatatttacggctggaaggtctgatctcatcaagctggatcttctccagggcacgctttctggaagtagcctgtttggacttggaagcgttcgcactgaatcgagaaataaattcctgcagctctttgatcttttcttcttttttcttgttggcctctttcatctgacggatcagcagctggcttgactcgtaccagaagtcgtagtttcctgcgtaaagctggatcttgccgtaatcgatatcggcaatctgtgtacataccttgttcaggaagtaacggtcatgggatacaacgataacagtgttgtcaaagttgatcaggaattcttccagccatgcgatcgcatcaagatccaagtggttggtaggctcgtcaagaagcaggatatccgggtttccgaacagtgcctgtgcaagaagaaccttgaccttctcagaacctgtcaggtctttcatcagtttataatgaagctctgtctcgataccaagtccgttcagaagattggcagcatcagattctgcttcccatccatccattgtagcgaactcagcttccagctcacttgctttgattccgtcttcatctgtgaaatcttcttttgcgtaaatttcttctttctctttcatgatttcatacagacgtgcatttcccatgataactgtatcaagaacagggaattcgtcatatttgaaatgatcctgctgaaggaaagaaagtctctcgcccggggagataactacatcaccggatgtcggctcaagctgtccggagagaatcttaagaaatgtagatttaccggcaccattcgcaccgatcattccgtagcagttcccctctgtgaatttgatgttaacatcttcgaacagcgcctttttcccgacgcgaagggttacgttatttgcactaatcatttgaaagtctccttgtaaataaattagaattgtgattacgttgttataattgtcctttttcaaatacgtgtgaataagaacataccaatccatatattaacatagaagaaagggtgctgacaagtactgaaatagaaaaatgcatacgaaaaagcagggcaaactgtgtgaaaatgtataagaactaatccttgttctttccattgtaaaaagttataatgttactaagaatctcacaatataaatagcagtagaaaagaggagaaaccatggcacttaagaaagcaacaatcgtactggaaggtggagcaacaagaggcatatttacttctggtgctctggattaccttatggaacaggatatttatttttcagatgtgatcggtgtgtctgccggcgcatgtaatgcagtagattatgtttccagacagccgggacgtacaagagactgtatgattccgaatacaaaagatatgaagtatattaatggagtgaaagatacgatcagggagaaaagtctgatgaatatggatttgatttttgataaatatccgaatgaactgatcccatttgattttgatgcatattttcagtcagagatgcactgtgagctggtaacgacaaactgtctgactggaaatgcagaatatatgacggaaacagaagatcctgaccgattgatgaagatctgtcgtgcatcaagcagtatgccgcttgtgactccgatggtgaatattgacggtgtcccgtatctggatggcggacttgcagattctgttccgatccgtcgtgcacagaagcttgggaatgagaagatcatagtgatcctgacgagaaatcagggctatcgtaagaaagtaatctcaccggcagtgcagaagctttacagacaggcatataagtcctatccgaatgcagtccggacaatcttcagaagaagttttatctataataagacgatgaattatctggaccagcttgagaagcgtggagaaatttatgtccttcgtccacatgtaaaaccagtatcacggctcgaacagcatccggatgtcctgcatgcattttatgagcatggatatcatctgatggagcgaaagacagaagaaatgctgaagtatcttgaacagtaataataataaatcgacttgttaaaagaagagagaaaagggagttgagttatatgagagagattttagaagaaactcagaaccgtgaattatcgtggcttcggttcaatcagcgcgttctcgaagaagcacgggacgagacagttcctttgatggaacgtatgaaattcgtagctattttcacaagtaacttagacgagttttttatgatccgcgtaggaagtctgtatgatatggcatcagcagacagcaaaaagatcgatcagcgatccggtatgacagcaaaacagcagttagatgcaatttatcgagctgtttccccactttacaaggaacgggataagacatatgcagagatcaagaaacagttaagtccgtatggtgtctgcggtcttgacttcaaggaactggaacagcaggagaagaagtttgtaaagaaatatttcaaagaagaagtaatgccggtgctttccccacagatcgtagatgcgaaccatccgttcccacatctgttaagtaaagaactgtatgtggttgcgaatctgaagcagggagacaagacgatgctcggaatcatcccggtaccacaatatatttctaatattctctatcttccggggtatgacatccgttatatccgtatggaaaagattatcctggaatttattgatcttgtttttgaccagtatcagatctcagacaagaactatatccgtgtaacgagaaatgcagatgtatcaccggatgatgaagcttatgcagatagcggagatttccgtcatgtgatgcaggagacacttcataagagaagaaggatggctgttgtccgtcttgaggcagccaattctctgagtaaagagatggagaaatatttctgtgagaaattcaatatccgtccggaatgtattttccgaacaaagatgccgatgaagctggactttatctttgcaatcgctgataaacttccggattcgaagaaaaaaacgctcgtggatgtaccattttctccgcaaccgtcttccatgcttgcagagggtaaggtgattccgcagataaagaagaaagacgtactcctttgctatccatacgaaagcatggaaccgttccttcagctgatcaaagaagcatcaacagacccggaagttctgacaatcaagatcacaatctaccgtctggcaaagaaagcacgacttgtagaatatctctgcgcagcggctgagaatggaaaagaggttacggtcctgatcgagctgagagcacgttttgatgagcagaacaacattgactggtccgagcgtctggaagaagccggatgccgtgttctgtacggattcgagggttataaggtacactccaagatctgcctgatcacatacagaaaccgtaccggaattcattacattacacagattggaaccggaaattataacgaaaagacagcgaagatgtataccgattactcgttgatgacaagcagacaagagattggtgaagacgcagcagtctttttccagaatatgtcgatcagcaatctgaatggagtttacaagcatctgattgtttcaccgacaagcctgaaacagaaagtacttgccttgatggatgaagaaattgcaaaaggtgagaacggaagaatcattatgaaaatgaattctgttacggacatggatttcattcgcaaagtaacagaagcatctcaggcaggggtgaagatagatctgatcgtgcgtgggatctgctgtatcctcccgggaatcaagggaaagacagagaatctgcgtgtgacaagtatcgtcggaagatatctggagcatccaagacttttcgtcttcggaaaaggagcagatgcaacagtttatattggatctgctgatatgatgacaagaaatacagagaagcgtgtagaagtcgcgtgcccggtctatgatgtagagatccggaaacgcctgttccatcagcttcatgtaatgctttctgacaatgtgaaagcccgtgcgatgacaagtgacggaacatatgtgaagaaaccggtggaagacggagcgagtcttgtgaatgcacaggagacctttatgagagaagcatcacaggcaaaacgtccggctgcagccgctgtaccgaagaagaaaaaagaaggattcttaacaaccgtactgaagattttcagaaaaaagcaatagaaggacgagagatggaggagcagagaaagatgaaaccgttacagaaaaaagactttggaaagacatcgaaaggggaattggctgccgtatatacactggaaaatgaagcaggaatgcagatcagcgtatccgacttcggagcaacactgacaagcgtacttgttccggataaagataacaatccggtagaagtgacacttggatatgatgatgcaaccggatatgaagccggacttggaaatgcattcggagcatctgtcggacgtaacgcaaatcgtatcgccggagcagtgatcgagatcaatggaacagaatatcatttgacaaagaatgacggagagaacaacttgcacagcggacttgatttctatcacggaagaatgtggaaggttgcggatgcagatgatactcgtgtaacatttgagatggacagcccggatggagatcagggatatccgggagcacttgttatgaaagtgacctattctctggatgaagagaatactttgatgatccactacgaagcagagccggatcaggatacgatcatcaatatgacaaatcacagttactttaacctgaacggacataagagcggagatgttctgaatcatacattatggctgaatgcggatgcatttacaccggcagacgcagcatccattccgacaggtgagattcgcagtgtggaaggaactccgatggatttcagaacagataagacaatcggaaaagacattggggtagactatgaaccgctggtattcggaaatggatacgaccacaactgggtattgaaaaatgaaggcgaatttgataaagtagcagaagtggccggggatgaaagtggaatccatatgagcgtactgacagatcttccgggtgtgcagatctatactgcgaacttccttgacggagtgaaaggaagagacggagcggtttatgagatgagagatgcaatctgtctggagacacagtactatccggatgcaatccaccatgaaaactttccgggaccgatctgtaagaaaggtgagaaatatgatactcgtactgcttacagatttcgtgtaaaataattgaatggaagataaataattaatttatgggaaaatcagtatacattgcggagaaaccgagcgttgcccaggaattcgcaaaagcattgaaactaaatacaaaacgacgggacggatatcttgagtcagacgaagccatcgtcacctggtgtgttggccatctagtgacgatgagctatccggaggaatatgatccggcacttaagagatggaacttgcagacactgccgtttatcccggaagaattcaaatacgaagtcattccgtcagtggcgaaacagtttcagatcgtcagtgggatcctgaaccgggaagatgtcgatacgatttatgtctgtaccgactccgggcgagagggagaatatatctaccgtcttgtagaacaggaagcacacgttgagggaaaaaagcgccggagagtgtggatcgattcccagacagaagaagagattcttcgaggaatccgtgaagccaaagatctgtcagagtatgataacctcggagcatctgcatacctgcgcgccaaagaagattatctgatgggaatcaacttctcccgtctgctgactttgaaatatggcaacagtatttcaaattttctgcaaacgaagtattccgttgtatctgtaggacgcgttatgacatgtgttcttggcatggttgtgcgcagagaacgcgagatccgtgatttcgtcaagacaccgttttaccgcgtactcagtacgatcgatgcacaggggcatacgttcgatggtgagtggagagcagtcaaaggttcccgctattttgagtcctatgacctttataaggaaaatggattcaaggagcgcaagaaagcagaagaattgattcaatacctgcagacaccggatgacgagtctgtaaatgtagcaggaatacagggacagtcaggattgaactgcaggatcgagtcgattgagaaaaagaaagagaagaagaatccccctcttttatataacctggcggagcttcagaacgactgttctaagagatttaagatcagtccggatgagacactgcgaatcgtgcaggagctgtatgagaaaaaacttgtgacttatccaagaacagatgcccgtgttctgtctaccgcagtggcaaaggaaatcacaagaaatctgaacgggttgtcaaagtatccgatggctgcaccgtatatgccggatatcctgaatttcggaagctataagacacttgcaaagacacgctatgtgaatgacaagcagatcacagatcattatgcaatcattcctacaggacaagggttgaatgcattgagtactgtttcatctactgcgaagggtgtgtacgacctgatcgtgcgaagattcctgagtatcttttatccgccgacagtttaccagaaggttgctatcgtgacgaagatcaaagaagaaagcttcttctcaagcttcaaagtacttgcagaggaaggttatctgaaagtggcaggcattccgaagaagaaagcttctcagacagccacaaaagatagcagtaatggaaacagtgagaataataacaatgatacaaatgacgaggcaggttccgattcttccgatcaaaacctggacaccggattgttcgaagtgatcaagtcattaaagaagggtgcagtccttcaggtcagagcattggatatcaaagaaggagagacatcacctccgaagcgctacaattccggttccatgatcctggcaatggagaatgcaggacagctgatcgaggacgaagaactccgtgcccagatcaaaggaagcgggatcggaacaagtgcgacaagagcagagattctgaaaaagcttgtgaatatcaagtatctcgcattgaacaagaaaacacaggtgatcacaccgacgctgcagggagagatgatctatgatgttgttgatcattccatccggtcactcctgaacccggaacttacagcaagctgggagaagggactgaactatgtggcagaaggttccatcacatcagatgaatatatgagaaaactagatcatttcatcaccagcagaaccgttggggtgaaagggctgaacaatcaatatcagctcagagcctgctatgaaaaagccgctgggttttatccgtctgtaaataataataaaacgacaggtagaacaaaaacaggaaacaaaagtaaatgacacaataataagacataaatgtaagtcggttctaaccggcagaaaggaattatcatgttagaagcattaacagtaaaagaaaattattcattagaccagacaatcgcaaaagatatcttcaacggagttacttatccgtgggaagtacttccgaagatcagcaacttcatccttgaacttggagctacattgagcgaggatgaatacgagaaacgcggagaaaatgtatgggtagcgaaatctgcaaaggttgctccgactgcatttatcaatggaccggcaatcatcggaaaggatgcagaggttcgtcactgtgcatttatccgtggaaatgcgatcgtaggagaaggagctgttgtaggaaattccacagagcttaaaaacgtgatcctttttaataaagttcaggttccgcactataattatgtaggtgattctgttcttggatacaaatctcatatgggagccggatcaattacatctaacgtaaaatcagataagaagcttgttgtggtaaaagccggagatgagaagattgaaacaggtatgaagaaattcggcgcaatgctcggagatgaagtagaagtaggatgcggaagcgttctgaatccgggaacagttgttggaaatcacagcaacatctatccactttcttctgtacgtggattcgttccggcaaacagcatttacaaaaaacagggcgaagttgtgacaaaagaagaaagatagttgaaaatagaaaatgataagaatggctcctatgtggtaacatgggagctatcttagacaggaggaataaagcagatgaataaagtaggttttatcggtgtaggaatcatgggaaaatccatggtcagaaatctcatgaaagccggatttgaattacatatctatgcaagaacaaagagtaaagtagaagatgtgatcggcgaaggagcacagttccatgagtcgatcaaggattgcgtgcaggattgtgatgcagttatcacaattgtcggtttcccacaggatgtagaagaagtatactttgatgaggggaatatcttagacagtgcaaaggaaggcgcttatctgatcgatatgacaacaacaagtccgcagattgctgagaagatctacgcggaaggcacaaagcggggcttccatgtgatggatgcacctgtcacaggcggagatacaggagcgaaagccggaacattgtccatccttgttggcggagagaaagaagattacgaagcctgtatgccactctttgaggcaatgggaacaaacattaattatcagggtaaggctggatgcggacagcactgcaagctggcgaatcagatcatgatcgccggaacactgtccggtgtgtgcgaggcacttacttacgcaaaagaacagggactggatccggaagtattcatgaagtccgttgcgactggggcagcaggaagcaagcagcttgacacattcggaccaaagatcttaaaagatgattatgcaccgggattctttatgaaacacttcatcaaagatatgaagcttgcactgatcgaagcgaacagaaaaggactttcccttgatgtactcagtatggttcttgccaattacgaagaacttgagcaggaaggatacggagatctcggaacacaggcgttgatgaaattctacgatgaagaacatcgaaatacggaagagtaaaaatctgcgaacgataaccgtaaaagttctgttaagaatcaacaaaacagattgaagtaacagggaaaagaaaatataatagacatcagaggaaaaactgttgaagaagataaaaaaatcaacaacaggaagacttgaaggaggacacaaaatgcttacagataattttgtaacaatggaaattggaaaagcaaaacacattgcacttgtagcccatgatggaaaaaagaaagaactgattgaatggtgcgatagaaataaagaagtattacagggacatttcctctgcggaacaggaacaacagctcgtctgatcgcagagaaaacaggacttccggtaaaaggatactgcagtggtccacttggtggagaccagcagatcggtgcgaagatcgtagaaggacagattgatttcatgatcttcctgtgggatccgttagaggcacagccacatgacccggacgttaaggcacttcttagaattgcagtagtatatgatattccggttgcgaacaaccttgcaacagcagacttcatgctgaacagcaagttcatgaatgagtcctattccagacagattgagaatttcaataagacgattcaggaccgtgttgcggagatgaaataaaataattcaagtattaaaaaaatacctgcagatatcaattttgacatcttgcaggtatttttatggatttttacagaagtcctttttcacgcttctcaagaagagcatgaatcttatctgtcgggctgataacagagctgatcggcacatcatggttcagggaatcaatgatcagtgcgataaatttactcatatcagcttttacaaagtaaggcttctcataaagttctggtgggagatatgtaaggtttgttgtaataactttactgatatatcccttattgtaatactcatcgaatttatcaaatccgtctgtgaacagtccgaatgttgtacatacaaagacacgtccggcgttacgctctttcagctgttttgcaacatcaagcatactttctccggaagagatcatatcgtcaacgataagaacatcttttcctgtcacatcatcaccaaggaactcatgggcaacgatcgggttctttccgtttacaactgtagagtagtcacggcgtttgtagaacatacccatatcaacaccaagtacattagagaagtaaactgcacggtgcatagctccctcgtccgggctgatgatcatcaggtgttctttgtcagctttcagatccggtacttcacggaacagtgcttttaagaactgatactgtgggttaaagctgtcaaatccactaagtggaattgcattctgtacacgtgggtcatgagcatcaaatgtaatgatgttggaaacgcccattgcgtccagttcttccagtgcaagagcacagtccagagactctcttcttgtacgcttgtgctgtctgctttcgtaaaggaaaggcatgataacattgatacggcgagccttacctgttgcagcagcaataattctcttcagatcctgataatggtcatctggagacatatggttaagatgtccgtttactgtgtaagtcaggctgtagttgcatacatcagtcatgataaaaaggtcagtaccacggattgtctctttcaggatacccttagcttcaccggaaccgaatctcggacaactacagtctacctggtaattgttggccttatagtttctgtaaagtggggattctgttacttcgttgatcgtgttctcacggaaggaaacaatataatcatttaccttctgtcccagaggtttgcagctctccatagcaatcagtttcagaggtgcaatcgggagtgtgttttctaacatttcgatgttcgtcattttcttctcctcagtgtgaattagtttttaactgtcttaagaaatcagacagtaacgtgaattgattaattagaattaacagattaatcattatacatttaacgttataccatttttcaggagaaaattcaaggagggcagggcggagagtggacgataaaatgtattttttgcagaacaagacagaaaataacaaacttgccttttataaggtgcaatggtagaatcttaagtaggaaaacgtgcaggacgaaaaggagcgataatatgccgaaagtattcaataatcaagtatttattgattttttagcacaattaagacccgatgaacaacatcagtataacagtccatggaatattgcagcagagtttaatattgatatgagctgtctgcatgcttttatcagaagaaagaaatcggagtgcagcaggtagaagtagattctaagacgatcatagaagctgtggtataagaaaaataaaagaaataaaaagagctttaatatctgaacgatacagtagtattgcagaagatattaaggctctttctatgtataagggaaaatggtaactggccagagccaacctccaaaatgctatgcattttaaacctgttttttgaaattttgcttggctctgaacagttataaatttcgtagagtatacaactctacgaaaaaaatgaaattaagttgaatttatgggggttttaaaagatatgaccaattatttgacggtaaatacagcgtttagcttatccatattttgctgtttctgctccatagaaggatgcacataccggtttagagttgtgttaatattggagtgtcctaaaatctcacttaatgtcttcatatcgaacccaagttctacgcaacgggttgcaaaagtatgtcgcagacaatgaaaatgaagtggttcgatctgacattttttcaaagtttttttgaaataatattcgatcgaccgcggctcgcgaaaactcatcttctttccagtgaggatatatgcttcaggatctatcgtgtgagattggacgtattgctgcaagatctcaaacaggaaatccggaatcggaatattacggatggagctttctgtttttggtggagtgataatgatttttgtattatgttccgaatcatctgtgtgatccttaactctgtgtaaagtcttagatatctccaaatattgttcctgaaaatgaatatccttccactgcattgcgcaaagttccccaagacgtactcctgtatatagtgcaatcagcgttccgatatttttatgtgtcagattccctaataagtagtcctgtaaggcctgctgttcctttaaagagagaatccgaagcggttttctgacaggcttaacaggacaaagttccggattgcaaagagacagttccccttccttttcagcagtttttaaaatcaatttgacaacagaacggatatcggtaactgttttcggagccaatccggaaccatcactttttcctgaaagcaacaacttgttcagaaatacttcacaatctttattactgaacgtatagacaaggcgatcaccaatcataggactgatatagtgactgaaaagataatggtatcttacataagtagattccttgctggaaggcttcagccgttccaaccaaagcagtccataaaaggaaatgttcttcttcatgcggacactttgaaaaagacgtggatccatctttctctttgcatcattttgctttttcttaacagttaaataatctgctgcatagatagaacggtatctgggacttccatcttctttgaatgcataaatgtatctggcttcccagcgtccgtcctttcttttgtaaatattttctccttttcgtggcatgtttttctcctccattttgaccatttttttgacggtaaataagtcaataatcacaagatttaattattgctgtgtagcaaaaaatcaaaaaatctgtcttattattgataaaaatacacaaatttcgacatttctgtcttgacttgaacgtattatgagagtaagatatcgatgattaaagtctttttaaaccgtaaattaactataaatgaattcgtagagttgtatactctacgaaaaaaatacaggggagaataatgggaagaaagcctcaagatcttacaggaaggcagttcggccttcttacagcaatgtatccaactgaacaaagagataaacgaggatctgtttactggcattgtgtctgtgaatgtggaaacacaattgacgtgccggcagcagggttgatccatgcacacaatcgaagctgtgggtgtttaaaagaccaaaaccagaaagcaattgcagatcgcagacatctggtagatggaacttgcgttgaagtattagagaagagaaaaaaacgcagagataacgagagtggttttcgcggtgtgttccgattaaaaaacagcaatcgataccgtgtcgatatcggtttcaagggaaagcgttattatgttggtctctttgatgattacgacgaagcagttcaggccaggcttaaagcggagaacctgatacataatggttttgttaaagtatggaaagaatggaaccaaaaggaacaggaagatccagagtggggcaaagaacatccgctggtattcaatgtcagaaaagtagacggagagttacaggtagaagcaggatgcagataaataatttatctgggaaaaggttataggaaaattcatattagttcgatttgaacgaatactgaaagtaaaaaagaaaaagacaatatcaatcaaatgaggtaaggcgaaaaaagaaaacacttagctgactgtgcttacatacaggggctttatgaaaatgaaataccatccaataaggatgtgtagatagatataaaaataaggtatgagccctactaggggtaaaggagaaaaatactatgaaggttgttattttagcaggcggctttggaacaagaatatctgaggagtctcatttaaaaccaaaaccaatgattgaaattggggaaaagccaatactgtggcatattatgaaagaatattcagcttatggtattaatgaatttattatctgtgccggatacaaacagcatgtaatcaaagagtggtttgcggattattttattcatacatctgatattacttttgattttacaaaaggtaatgaaatgattattcacaataagcatgctgagccgtggaaagtgacagttgttgatactggattaaatacacaaactggtggccgtatcaagcgtgttaaagattttgttggcgctgacacatttatggttacctatggtgacgcagtaggagatattaatattgatgaattacttgcgtttcatagagcacacggtaaaatcggaacaatgtcaatgtataattttggacagacaaaaggtattgttgatgttggcaacaatggaatcattaatgcatttagagaaaaatccgattttgacggtgatttgattaacatcggatatatggcttttgaacctgctctgtttgattatattgaaggagacagcacgatctttgaaaaggaaccgctcacgaagctggttgaagatgggcagctcgcaggatatgttcacaaaggcttttggcagtgtatggatactttaagagaaaaacaaaagcttgaaaaattgtgggaagacggtaacgccccgtggaagctttggaaagactgaggaaaataaagatgaattttgatttggacttttataaaggaaagaaagtatttgtaacaggacataccggttttaaaggatcttggctgtgtaagatgctggttaatgttggagctattgttactggttattccctcaatcctccgactagtccttctttgtttgagattgccggaattgagcaggatgtgcattctgtaattggagatatccgtgattttaaaacattgaaggccacatttgatgaagcgcagccggaaatcgtactgcatctagcagcacagcccatcgttcgtgacagctataagaaccctgcttatacatacgaaacgaatgtgatgggtacagtgaacattctggaatgtgtgcgtaacagcagttgcgtgaaatctttcctgaatgtgacgactgataaggtctatctaaacaaggaatgggcttggggctatcgggagaatgaagaactggacggttatgatccgtactccaactctaagtcctgttctgagctggttacacactcctataaaaacagcttctttaacgatgaccatgttgcaatttctacggctcgtgcaggtaatgtgattggtggcggcgattttgcgaatgatcgcattattccagattgtattcgtgctgcaatcaagcatgaggatattgtggtaagaaatccgttctcgacccgtccgtatcagcacgttttggagccgctttatgcgtatctgatgattgcagcaatgcagtatcaggacattaaatatgcaggctattataacgtaggtcccgatgatgtggattgcttccagacgggagccttagtcgatttgtttgtgagcaagtggggcgaaggcatgaaatgggtcaaccggtatgacggtggccctcatgaagcaaacttcttgaagctggattgttccaagttgaagactatctttggttggaagcctcattggaaccttgatacggcaattgagatggttgtcgaatggagcaagtgttgggtagaaggtggagacattcgtgcctgcatggataacgagattaaatcatttatagaaagttaaaaggtagaatttgcatgagtcttacagcggttataaatgaattacttttggaaataaaaaaagaaaaaattgatcccgctgaaggactgggggatgaattgtttttagctgtggcatcactgactcctattgtaaacgttgacattcttattgttaaagagggaaagattttgctttcatggagagatgatgaacaatgcggagctggatggcatttgccaggaggatgtgtccgattaaaagaaaccttagaacaaagactccatgtctgtgctaaaagtgaacttggaacggatgttctctgtgatatgaaacccgtattaattacggagaatattgagccaaaaagagatagggggcaaacccattttatttcgttcctttatcagtgtgtgcctgtagataaagctcaactccgactgcttgacaaccaagaaataaagggtcatcttggatggtttgatcatataccggaacatttccttccggttcaagatttttatcgagagatgataactaagattttaggacagggggattagtaatgccttttgaatttaagaaaaccgaaattgagggattaatgctcataaagccacacatgtatccagacgagcgcggtttgtacaaaaaatattatgaaaaaaatatttttgtagagaatggtataacatgtgagtttacagaaagcagtgatttatattctaaaaagggagctttaagaggacttcattatcaaacagtggactcgcaagcaaagctcatacatgttatttcaggtgttttatttgatgtggcgcttgatttaagagagaattctccgacatttggacagtatcatacagagcttttaaaagctgaagatcaatttgtgacatatatcccagaggggtttgctcacggatttatttcgctgactgatgatacgattttctcttatcagtgttctggaaagtatgttccgtcagcttgtggaggtattcgctggaatgatccggaattaaatattccatggccgcttaaagaatatggagtagaacacattattgcaaccgagaaagacaaaaattggccaacattagctgaatatattgcattaagaaagtgacggaggagcggagtgatgaaaaaagcaattgtaacaggagcaacaggatttattggaaaatttcttgtaagagaacttgtgaaacagaatgtggaagtcattgcagttgtgcgacggggaacaaaaaatcttaatacgatcaatgctttgccggtgaagatagtggagtgcaacattgcagattatcatatgctgcctgatatgattgctgatcgagatattgacgttgtctttcatattgcttggcagggagtatctgatctggatgctcgaaatgaagcaattcagatgcagaatttacagtcaacacttgatttgattgatgctatgcatattatgaaaatcggttgctttattggttgtggaagtatgcatgaagcagagtcgctggttgagatgaatgaagataaagtgatttcgaatcttggatatatgtataaggcaacgaaaacagcggctcactggattggaaaagcaaaatgtggaacttatggaattcgttttttttggccgctgatcaatacatatggtgaagaggaaagatcagctcggcttgttaacacaataatacgtaaagtccttcatggagagattcctgatttatcagcaggaaatcagtattatgattttgttcatgtttcggatgttgccagagctcttattctaattgcagaaaaaggtgtggatggaactaattatacgattggttccggtgatgcaaaaccgttaaaggaatttttaaagattgttggacaagttgctaatgatttacacggtggtgagccggtagagttggggtttggaaaaataacatcaaatgtcatttctttaccgataacaacatttgatgttactaaactttataaagatactggatttaaacccttgattccttttagggaggggattgagcgaacagctcgatggattaaagaagatgaaggaatgtaaaggatatacggtgggaagatggatattttgtactcaagtagtgacagctatgcctttttgacaggcatttcaatactgtcattgttagaaaataatagagagtgtgatgctattcatatttatattatggataatcatatttcagctataaataaaaacagattgattgaactggctaaggaatatcagcgtgacatctcttttgttccaatgccagatatgaaagaacttactggacaggaaatagacacgagaaggtggaatatcagtacatttggccggttatatatggcgagtgcattgcctaaaacagtacataaagttctgaatattgattgcgatactatcattatagattcaattgaaccattgtggaatacagatatgacgggaaaagtatttggcggaatgctagagtgtattaatgaccgttatagacgtaatgtggggaaaaaagatggtgactattatttgaatggtggtattgtgttcttgaatctcgatgaagtacgtgctggggattacgaaagaaaattcacggattacattacaaaatacggtagcagcctagcatacttagatcaggatgttttaaatggtgttgttgaacaggagaagaaagtaaaacttccaatgcgttataacacgctttcaatttatttttatgctacatatgagcaggtactaaaaatcaggagatcgaaaagtcaagatttttacagtaaggaagaatttacagaggccgtatcgaaccccggcttagtacactttacaacatgttttttggatggtctaaggccttggataaaaggaaatcaacatccatatttaaaaactttcttaaagtataaagaaatgtcaccgtggagagatattccacttcaggaggataggagaagtagtttggttaaagttagaactgctatgattcgtaaagcaccacgatttgtactttgtgaagttgcatctgtgctgcatggtgttgtaattcctgagaagaactataaacgaatgcaagaaagagtaaaagagtgagaagatgccagagtttagtattattgttccaatatataaggttgaaaagtatttagagacatgtgttgacagcattattggacaatctttttgtgagtttgaattaatactggttgatgatggttcaccagatacctgtggagaaatctgtgataagtatagctcgtcagacacacgtgtaaaagtagttcataaagaaaatggtgggttatcaagtgcaagaaatgcaggattggatattgccaccggtaagtatgtcatctttattgatagtgatgatttttgggatgatgctagtgctcttgagcacattcacattaaccttacagaaacggatgctgacgtacttgtattccctgcaaagagatactatgagagtgaagataaatgtacttatatcatcacctcagacgtggacaggacaaagattatagataaagatgttaatgcatcaatccgttatatgattgaaaataatatttatcgagcagcagcatggaataaagtggttaaaaaatctattattgacagctattcgatgagatttaaagacggatatcttagtgaggacatggattggtgtggagatctccttctttatgcgcaacggtttgatttttatgataatccattctatgtatatagacaacaacgtaatggatcaattactgctggaaaagctgaaaaattaatatcagataaactttatatgtgtgagaagggatataggcaagcactaaagttacaggacggagataagactgcgctgcttgcttcttattatgcgtatgagtattctgtccttctgggagtttcatcagaagtgaaggatagagaacttttgtgcagagttaggaacctacaaccattgctggattatgatataagcagaaaagtccagaaagttaataggttaaaaaaacttattggctattcgttaacgagaagagcattatgcttttttgttaagataaaaaaataggaatgtgtatcatggaaagaaaaagaattgattatattgattggctacgaataataagtgcccttgcagttatcggaattcatataacaatgacgcaacccaataattattctgtacaggagattggaagagataattatattatacttacatgtgtgtatactctgattcaatgggcagtaccagtctttttaatgattagcggaaatttacttttgcattcaaataaaataacctttgcaaaagtaaaaaaaatgaccattcgaattgggacggtattgtttttatttggcagtgcttttgcttttctagaacagatatttgaaaaaacattagaaataggaatgctaccgaattcagtactactggtgcttcaacagaaaagttgggcacatctctggtatttatatattctaattggtatctacttgattcttattcctttgaagagatttatcgataattcaagtaatagagaaatttgcatatttacggcgatattaattattggaaactttgttattccaacaattaatattgcctttggtacgaagatagaaaattatatgctgtttacgcagtatgtaacatatgttttgctcggttacattattggtggactccatgctgaggataatggcagagagaaaaaagcaatagatatcatcactaaccgggggggggtacagctcggattgtggctgtttgcctctgtaataaaaattattatacagtacgctgctgttatgagatgcggagagggctctgcattgattctgggagatagaatatttactatgatccaggcactgtcagtattctgtttgttcaaaaaatacatggacagtatacatgtgggaagactagcaaaatcaattagtagatgtagttttggaatttatttgattcatcccttctttatcaatcttctgtacaagatgatgaacattacacctactaattttcctctgttaggaataggatttgcaattccgctgttatggtttattgtgtttctgctctcttggggaggaacatttataatgttaaaggttccgggaataaatagtttgctatgagatttttaacaaaaataattagatgtattagtgaaagctagcattttgtaggagaactgaatggaaaaattgataagtattattgtgccaatatataaggttgagaactatttgattagatgtattgaaagtatagtttgtcagacttatgagaatatcgagattatccttgtggatgacggctcacctgacaaatgtccaatgatttgtgatgaatgggctaagaaagatgaaagaataaaagttatacataagaaaaatggaggactatcagatgcaagaaatgccggtataacgatagcacaaggagaatttcttttgttcgtagattcagatgactatattgaaaaagacttgtgcgaaagctgcatgaatgtcatggatgcggatgttgatattgtcgcatttaattatagaagagtatatgatacatacggtgaaaataagaaagaatgtggtgtgtttgaaaaattttctaatttagaaggatttaaacggtatatcaatagaaccccttttacacatatggcatgggataaattatataggaaatgtgtttttgaagatgtaagatatccagttgacagacttgcagaagatatggcaacgacgtataaaacttttaaaaatgcaaataaagttggatatcttgatagggtactttataattattttattagaagtgatagtattatgggtgggaaatctttaaagcttttgttagacgcatatcaaggtgaagtagaagcttataaatatggaaataaatactatcccacattgttagttcaaaacaatacaagatttttaaatcaatctatgaagacatatctgaaattgatgaagaattttggtaatgataataatgaagacatagagaacgaaatgaaaagtgtgctcattaacatacaggagattgataaggaacatatgccctttaagactatgctattttattgctgtttccgactcaataaagactttgcatggatgttgtttaaaaaatttcatctttcataaggtgaaatttaggagaagtaaacaagatgataaaagatgaaatttataaagaaatggtaaaataccagtatatctcttttgatatgtatgatacgttggtgaaaagagatttaaaagatccaaaagatatatttaaacttattgaaaaagcagcattagaaaaatatgaaaacatagtgcagggatatagtcgattaagggtcgagactgaagaaaaaatcagaaaatcaaaaataagcgaagtaacgttgacagagatatataatgagcttgcacaacagtatactcaatctatagcagatgaacttatgcatttggaactcgaatatgagtataaccttaccgttatgaatccttggatagagagcatttataaatattgctgtgaaaacggtaaacaaatcataattattacagacatctacttgcctgaaaaattcatcaaaagagtcttaaaaaaggttggaatcgatagctggagatgcttatttgtttccagtacaagtggtaaaactaaaaatgatggaagcctatatgatttagcattaaaagagttgcaaatcaatggatgtgaaatattacatataggtgataataagcacagtgattatgacatggctcatgatagagggattgaggcgattcacatagaaaaagatcgttttcagcttatatataatacatatatgcattcggatagtgaaatgtctgttttatgtaatcacactattgcatttcaaaataatcatatgaaagaagagtggagtagaccttacaagctaggatatgagagttttggtccgttgttgtttggcttttctaaatggttgaaagaaaatgtagttaaagagaagattgataaaatatttttcttgtcgagggacgggaaaataatgaaacgtgcattcgacatatatgacagtgaccatgaaatggacagcaattattttcttgcatcacggagagcacttcaagttcctaaattggtggaagaaaaaaatataaaagatattttaggctttatttattttccaagtgaattaacaattgaaagtctattgcgcaaactaggaatcgacgatgataatattgtcgatagtgtatgtaaaaaaatagaaaaaagaaaagatacgattatagcaaaaaaagatttagatgggattttaggaaataaaatatggaatgaagcggttggctatataaagaaaaatgcagaaaatgaacggaaatcgttcatcagatatttaaatcaagagcagtttagtggaagagttgcaattgttgatattggatggtttggcaatatgcaaagcaatatcgaatctattattaagcaagatcaaatacctgcaaatgtatacggatattatgtggcattggcaccagatggaaaacatcaaaaacatttaaatatgaaagggtatctatatgatattcatcacaatcaaaagtcgcataagaaagaaacactaataaatcaggttttcgaaactatttttatggctgaccacggatcggtaaagagatatatcgaacaggaaggtgaatattcagttgaattattggaaccggatttaaacgatacggaaagtattaattggctgaacgagtatcaaaaaggtgcattggcttttgttgaggattattgtgagaatggaatttcttacgatttgccaattgagtttatcacgaattgtgcatttaaacagtttttgagaccatgtttgcaagatgcaaaaaaatggggaagttttaaatttagagatggggaaattagctttatagcatatgcccacaatttgaaatactatctgaagaatccacaccagtttttaaaagattataaggtagctttatggcgaatcggcttcttgaagcaagtttttaaagttaatttgccgtatgataaaattgtaagcctacaaaaacatatatgataaaggagatgagggaaaagaatgatgccgtatatactaatgtttgtcttgtcttgcttgaactttaggctggcttatttattaaggaaatataaaacaattaaaatcttgtttgttttgattgggcttttattgccatgtgttttagcaggagcaagagataatacaattgggacagatgtgttggtttacggagatgcctatttgaattatgcgcagagatataacagcttgtcaagttttatgaattttgattatcttggaggtgaaccgctttttaagatacttagttatgtttcggcacattactttggacagtttggatattattttacgttggaatttgcttgtgttttgccaatttatgcaacatttgttcgcagagggtgggaaagatattcttggcttggaatgttaatctattatttatgcttctacagcttttcattgaatttgttgcgacaaagtattgctatgtcaatcattttttggagctataattatatcgtcgaacgtaagcccatcaagttctgtgtttcggtggttatagcggcagggtttcatttaacagcagcaataatgttgctattgtatcctattcatcgaatggtgacatatgttcaagataaagattcaaagaatttttttagtagattcataggaccataccgcaaattgatatatgcactcattattttgatgtgtgttgtattattatttttatatagttcactacttcctgctattattgctttgactggtaggtttgaaggacaattaaaatatttgtcaggtggtataagtatttattggccatattggctaactatgtttttgccaattttttttctgttcaggaagtataatgttcgacgtagcacggatgaagagtattcttttttatacttaatgtttgcattaagtataattttgtttcagatgattggtattaattctgaatcatacagaatttctttgtattttatgcagtttctaattctgttaatggttaagattggttgtacggagtatcgtacttctcgtgtgatactagaaagatggtgcattttgttttctttgggtatatattatatttatttctttataattgcgttatttaatcatgtttacccatatacatcatctatgttaggaatataggatatgaaaaataaaattagtgttattattccagcatataatgctgagaaatggatatataattgtgcaaaaagtgttttaagtcaaaatgatgataattttgaagttattattgttaatgatggaagtaaggataatacgctggcattatgcaagaagttggagaatgatgataaaagaataattcttgttgataagaaaaatggtggtgtatcgaaggctaggaatgaaggaataaaaaaagctactggcaaatgggtggtttatttggattcggatgattacttatgtaaaggagcatttgaaaaatttagagaaatagagagtagcattggtaaatttgatatagttatatttaactatattataaattctgcggaaatgtcacaacaggaatatgcttttttgaatggagatagccgaatttgcaataaagaaaaagaagatattattatttcttgcttatcgaataaattagcggggaatgcaagagcacctattaacattggtgttccatggggaaaagtatataggagagagttccttaccaatcaaaatattgcttttccagaaggaatatcgcatatggaagacactgtttttaatttacaggcatttaaaaaggctgataatatttatttttgtaatagtgcgttttatatttattcaataaatatggaatcggttacaaaccagtgtgctaaaaattttgatagccaggcagagaacgtatttaaactttttaatgaagttttgtcgaattgtctaacggataagattaagactgggcttcagtataaaggtctgtgtttatatacacaattcttgcaggtggattgcttcaatcctgctattaaggacagctttagacatagaatggagagatgtttggaggctagtaaaaaagatttctttccttcaacggatgcaaaaatctataactatatgtctaattacgaaagaatgacgtggaatgcgataaaactgaagaatccttttctcatttatatcttttatcaaataagaatgagaaagttaaaagaaaagaggtagtcaaatgaaaagagttggtattgtcacgctccatttttcgattaactatggagcagtactgcaatgcttggcattagaaaaaactcttgaaaaattagggtgtcgtgttgaagtaattaactattatccaagatatgctaaatattattgggaacctcaaaaacatatatgcgatgcaattcatgatgtattgcaaaaaaagaatagcataaataataatcttatatatgaatgcttgagagctacaaaatatgttgttcaatttaactgcagtaatgcggattacaaaagaaaatatagcgaatttaaaaagtttgtaagtaagaatttaaatttaacaaaagaatactctagtattgaagagcttagaaccgtaggttatgatgctttgataactggaagtgatcaggtttggaattctgattacaccgattttaaatttgatcctgtatattttttgaattttggagccaatagcgcaaagcgcattgcatacggagtcagtatgcatttatatgataataaagaagattggaaaaagctgtcgttatatgcaaacaggctagatgctatttcagttagagaaaaaagtgttcaatatagaattgaagcaacaggatatttcggaccttgtaaaactgttcttgatccaacattattgttgaaaaaagaggaatggataaattatgaaagtacagaaattaaatatgaagaagattttgtcttagtttattcgttaaaagaaaaagaaaaatgttgtgatttggcaaataaaattgcttcaaaaaagaatctccggattgttgacatttcgcctacttctatttgtgaaaatagtgaatgggttttggattgtgctccagcagattttttatactatgtccaccattcaaaatatgtagttacagattcttttcatggaacagttttttcaattgtttataaaaagcaatttgtatcggttgctgcggaaaagtctaaagattcacgcattgtgaatttattgaaaagtttgggccttgaatgttgcatatcatacaattttaagaatttaattcaaattgagtatgatcaagtgaatatacttatagaaaaaatgaaagaacagtctatcaactatatagtttcagctttagaagaataaaagaaggaatggtggtatagtgagaatagagagaacgaaaaacgcaacaagaaacataatatttggaacaattatgaagatatatcaaattgtcattccattcctaatgcgtacggcgatgatatatcttatgggtgtgcaatatcttggattgaattcactttttacgtcaattcttcaagtcctgaatttagcagagctgggggttggctctgctatgatatatagtatgtacaagccaattgcagaagatgatgatactgcaatatgtgctttaatgaaactttatagactatactatagagtaataggcatggtcattgccattattggatgtgttttaacgccgtttattccgaagttgatttccggtgatattcctaaaggtcttaatatctatattctttatcttttgaatctcggcgctacagtattgtcttattggttatatgcatataaaaatagtattttacaagcgcatcaaagaacagatattgttagcaaggttactttgataacaagcacaatacagtatgctctgcaactcttggttttatggatatttaaggattattacatgtatgtgatcgttatgttggcgacacaggttttgacgaatattgctacggcggtttgtgctgataaattatatccacagtataaaccatatgggcgtgtggaagaaaaagacagaaaagctattaatggacagattcgagacttgtttacatcaaagattggagctattatttatgattcagcagatacaattgtaatttcagcttttcttggacttactattttagcagtttatcaaaactacttttacattttaaatgcaattacaggtttaattacagttgttttttcttcttgcatggctggaattggaaatagtattgtcattgaaacaaaagaaaaaaattatgatgatttaaacaaattcacgtttattatctgctggggagctggattttgctctgtatgtctgttatgtttatatcagccttttatggaactatgggtcggtaaaaatctaatgttttcatttgaagcggttatttgctttgttgtttatttttttgtaaagcaattaaacactttatttaatacttataaggatgcatctggaatgtggcatgaggatagatttagacctttaacagctgcattaaccaatttggtgctaaatctgattttggtacaatttatcggtatttatggcattttgatttcaacggtcttagctattgtttgtgttggaatgccatggctgttacataatttatttacagtgaattttgatagaaaaaatttgggtttatttctgaaaaaactaggcttttattgtacggtagttttcgttagttgcgtagtaagttatgggatttgttcgtttgttaattgtgacgcaattattacacttttattaagaggaattatatgctgtgttattccaaatctaatctattattttgcttacagacgaacaagagagtatcaaggttttttgatgttggttgacaacatgacacgaggaaaaattaaaggagttttaagaaagttggggatgaattaaattgaaaatttatgcagcatattatgatagtaaaatacgtttgaattcatcttctggaggagtattttcatgcattgcttcaaagtttgatgttgtttacggagttgctttaacggcagattgttacggctgcgaatttgtgcgaattgaaggagatatttcttctataagaggatcaaaatatttacaagctaaggttggagagtcatttaagagtgtgaagaaagatttgctaaatggtaagagagtcctgtttagtggaaccggatgtcaaataaatggtttgtctctatttttgggaaaggaatatcccaatctttttttacttgacgttatttgtcatggggtgccgtctccaaagttatggaaagaatatgttgagtatcaagaaaagaaacatggtaaagttgaatctgttaattttcggtgtaaagatgagagttggcaaaattttggtatgaaggaaaactatttgtatataccaagaattaaagatccgtttatgactttttttcttagtgacctgagtctgcgcccttcatgttatgcatgccaagctaaaaatactagaatgtctgatatgacaatagctgatttttgggggatagaagagattgctccggagatggatgatggaaagggaacgagccttataattacgagaacaaataaaggacaaaatttgtttaattctatagagatggatcttcgatggaaagaggttaattatgaagatggtgtcagacataatgtttcagaattctcatctgttgccatgcctcaacaaagagattcttttttcatagatatgaattctatgtcttttaaaagtttgagtaacaaatatatttatggaccattatggaaacgaattggtaggaaaataaagcatacgattcaatataccatcagcaatcggggggggaaaaagagtaaataatgcagactatggattactttttgtattcaattgtgaggaatgatgatgaaagaaacaccagtactatataaaagaaaagaagaatgctgtggatgcacagcctgttatgcaatttgtccaaagaaagccatttctatggtggaagacgaagaaggatttgaatatccgcagatagatgaaagcaaatgcgttcgttgctaccagtgtttgaaagtatgtccgttcaaggtggcacaagcataggaaagaaagattatgaaaacaacattacttatcatggcagccggaataggcagccgatttggaacaggaattaaacagttggagccggtcgatgatgttaaccatatcatcatggactactcaatccatgatgcgatggaggctggcttcaatcatgtagtatttatcatccgtaaggatattgagaaagagttcaaagaggtcatcggcaatcacattgcctccatttgttcttctcataatgtaactgtggactacgcttttcaggatatcaacgatattccgggagaacttccggcaggccgtacaaagccgtgggccaaagttgacgaagccattgccaaggcgaatgccctgaacaaggacgactacaaggatttctccggtgtagaagccgctgtcaacgctgttgtgcgtggtaagaacattacggagcaatccgaagtagatgcaatggcaaaggcaattgaagatgcgattgcagccctgcaatacaaggaaaagccgaagatctgcaagggcggcaaggaagtgaagatttccaacggcgcgcacgaaatgcgcatccacggcaagagctacggcacgtttaccttcgcgtgggtaaatgacaaggcgggctggtcgattcagaatgccgacggcaagtacctgtcctttgacaacggcaagctggttctgcgtgacacggcgtatgtttggaagtatgatgcgaagttctacacgacgacgaaagaaaagacaagcttcggctggggctggtggggccgtccgagcaccaaggtgaccaactggtatctcgtcggtgacggaacagacctgtcgatttccaagtcggacacaaacgcggatgtgaagctgtatgacgcaatggaatccacggagcacagcttcggcaagtggacgcctgcggaagatggcaagcacacaagaacctgcacgatctgcggcgcgaccgagaccggtgactgcacctatgaaaacggtgcgtgcacggtttgcggcgcactggatccggacaatgccagcgtttcggtcagcgcgaccgtaaccaagcgcacctccggcggtggcggctggtggtggtggaaccgcccgacgaccacaacgtgggaggcacgcatcaccgcaaccggtaccggcgtggatattgataaggtggagtattccgacgatgggaaacattatctcaccggcacgagctttaccagcgacacggaaattaccaagttctatatccgcgtgacggattccaagggcaatgtcaccaattggctgtatgaaaatggcaaggtgacgcagaagtaacgactgatagctacctgacccgcgtggaaaaggtaagcgcctaacctttaccttggggtgtgtccagtctgccgactacgctaatgttgatgcagccattgccacaacggttgtcagtagaaagaaaaagtacaacagataatggaatagcattcctttgctccatcttccgagcaattaattcagttgattctggagataaaatgtaattaacaataagtttttaaggtaactgatcacagatgaaatgaacaaataaactccagagagaattacagagaagacaccaaaagcggaactttgttccgcttttgtgtttgaaagagaggaaaatccattcgtgagaggatttacgttcattaggaaattatggcagtatcaattcaggtttgaaatttaaatagtctccggaaacaagtttatactcaatcccgtctacgtatcctttaaagctgtcatcaaagcgttcctccccatgacaatgtgaatagattactttggaaacattatactctaaagctatttttgtgaatggactatcctgttcaccgattgttgtcggcggataatgcaggaatatgataaatttatcatagccggcagtgcgggcagcttcgaatgatacgcgaagcctatctatctcgcgagtacgaagttttaaaaaatgttctatcgaatcttttccttcataacaatatccttttgttccaacaagtgcataatcctgatagttatagaaattattttgtaggaactcgagctttccttgaaagagattgttgagcttttgtgttttctttgcatcccagaacatgtcatgatttccgcggagaagaatcttacgccctggtagatttatgataaagtttaaatcttcctgtgcttcatctaaattccgtccccaagaatgatctccggtaagtacgatggtatctttggatgttattttctttttccagttcttttctatcttagcaacatgattcttccaacgtcggccgaaaatatccataggtttattgtttgagaaggagagatgtaggtctcccatagcatataaactcacgttaaagcacctccctgtctatattaattagcatgagaacaaatcttcctaaggtacaacaacgatcttgccgtattcttccaacattgatttcataaataaattctcctttcaaatatcaacttgctaccatttccaatctaattattttgttctatctctgctcattgtatctatcctacctttcgcattatattccttatattaatatggaagataatcgaacaagaaaaagagtatgttgtaggatttgatatttctgaaaagattacatttttttgcaaagagaatgaacattatttctatctgttagtgaaatagatgggaatgaacataatattctctttattgtagtaggtgaaaaataaacattatgaagtggaatcataaagttcattttgcaataaagtctaattaaaaaaatgggcttttttaaagcccaaactcttttaataatttcttctgatattcccggtctgcagctgctttgagaatctcatcagttctgtttagttcggacaatttcaaaatcagttgattaatcctattttctccaagagattccccttcttttatgccctcttttatcccttcttctcttttttcatctaattcatctttcattaattctaataatgcattacacatatctcgtttcccctcctttagccgattctcgtttgcttttactataatttccataacagcctgatatagctgatcttctttgttctttttataatcctctaaaagcttccttgtgacagacaggtcttccagtgtatctgtcaaactatataaccaaagatttttctccggtgacaatcgatttgttacaagaatctgaatcggtaagatatctccaatcatgcatcctccgtgtcaatcagcggagtgattgacacgggagtgaacagtaactattaattactgttaactgattctttttacagtattataattttactataaatgaaaggcagagtaaagtgcgattgcctttcttctctgccttgttactgtttataagaatcttattcgttactgctcacagtatctgttaatatctgtctgactcatcataatcatcttttccgccatagcagtcatctgcatttttggaattgcagtttgtgctgttcttactctgatttgaataagaatttttactggaattcttattcgaacctgaattagatgttgaatttctgttcttactctgattttcttccttcgatgaatagaatccattctgagaatttttacttgtgttgctataattttttgccatgatacttcctccttatttggtgttactgttcttattaactgacagtaactatttagtacaatctttattatcccaaacggaggtctttttatgcattttgtttcaaccatattttgaatattttgcttgctttttccaaatgcatatattatactgattcatgtagaaagattattttctacaaccccttattaattatttatactcccctcaaaagaccgatggctcccccatcggtcttttacttttcttttttctaatatcgtcggttcccaccgatcagtctgatcacgatcataatgatcagaagaggaacaagaaccggtgccagaaaactgatgattcctgttataacagacacaactactacgactacaaatacaactgcaaggatcagcaaagccttcttccaccaggtatctaatctgaactcatgataggaaccataagaatgctctgttccatattcatccttctgtccataaccagtatagctgttctgtgcctgcgttgtctggttgtacgaattattaaatggactcctgttctcataaaccacttcttcgtctgttccatcacttgcatctacaatggttttcgcaattgcccacggatctccgagcagttccaagacctcctgctcgctctttccttttctcatttcttctataatataatcatcataaaacttaagatgatcctgaattgttgcggcatcaagctttccattcaaagcctcctgtaattttcggataaattcctgtcttgtcatattcaactgttacctcctgttccgaaggttactgttcacacgatgtgcgaccagcaacgcatctcgccattttaaatcgcccatgcatcctccgtgtcaatcagcggagtgattgacacgggagtgaacagtaacttttttactggcttctatcatatgatgcgagtgtcaaaagtaaattttgacacttacatcatcatatcatgtatcgtgaaaaatttccagtcttcccttaacaaaattatcgacatttcgtctataatctggattaaacaattcttccgttttagattatatactcttaataaattttacttttctttagctttcgtgacacgaggtgttcacaattcttccgtataataacatcatcaagttgatacaaatgaattacaaaagtatcatacatagaaaagaagacggtgattgtattagcgacagatcttttatgattgccggacttcgaccaaaaattacgaatagtttatatagataatggcccggtgcagtgcaccgggccacgtttttgttattatattttcttaacctctttttccatttttcagatcttccacgatttcattgtaacgttttttattcaaacgatagaagaacagaacaactgctgtgacaatccacaaaattcccggaattgttgaaaatgaatgtttcataactgcaattacttccggattctgtacctgatttgccacatatccgtatttaccaagcagagctgcaaggagtgcagttcctatagccattccgattttatttccaagagaaacaaatgcatactggaatccatcatttctaagtcctgttttccactcgccgtattccacacaatccggaatgatcgcatagattgcagtgttaaatcctgaaaagaaaaactgtgtaatacctgccaatgcatagaatacaattggagattcttttacattaaagaagaacattgcaagcatagcgattcctgtaagtaatgcaaaaacagatgctgttcttcctttattattcaacttgcggaataccggctggaagcaagctgcaccgataattgaaggaataataatacacatggaatatgttgtataataggaagcatctccttctacataagtgaaataatataaaatatctgcatttcttccatataatgtgaatccaaacaacacctgtccaactaatgcaagcagatatggtctattctgcataacggccttcagctgtactttaatggagattttttctttctccggaattgtcacctgctcttttgtctttgcaaaacagaagaaatgacatgcagcaaagatgcatccgtaaataattgcaacaaacagataaccgttctttacactgttgcttccaagcctgctgatcagtggcactgttacgatattgatgattccgattgcgatcattgctgctacggaacgagatgtattgatcttggcacgctcatcaatatcctgtgtcatagcaccgcaaagtgttccatatggaatgtttacacaggtgtatcctaagacgagaagacagtatgtaattaccatgtaaactattttcgatgtatttgaccaatctgggtgcgcccagaaagaaaggatcaaaagcactgatgtgatcggtgctgccaccaacagccatggacggtatcttccccatcttgtgtttgttttatctgttaatccacctacgatcggatcattgatcgcatcccagaatcttgagaaaagcattaatgctgatactgccgccatactgattccaaatacatctgtatagaaaatcattaaaaagttactgacaaacatccagctaaagttacatcctacatctccgaaaccatatgcaatcttgctgatcagaggcacttttccattattactctcgttttccattaattacctcctagtcagagtttctgataaaactctgtcctctcttgattcgatcacctatttctcctgcacattgatgattactttcatcgttgtctcgcggttatcatcaatatactgatatgctttcagataatctttgaatgcaaatgtcttagaaatcaatggtcttaaatgaacctttccttcatttacaagttctataccatctacataatcatcatgacgatacatcattgtgctcttgatatccagttcgtgatcatttgcaactgcaaggtctactgttgccattcccgcaaatacggcaacaagaacgatgatacttccttttcttgcgtatttaattgcctgtcccattgtgatattatttcctgcgcaatcatagatcacatctgccttgtcaggaccaaaagcttcaaccattgcctctccaaagtccttctccatagtattaacgcatacatcaataccacattcttttgccttatccagacgaaggtcgctgacatctgtgatcattacctttgcggcacccattccttttgctgcctgtgcaaccaggttaccgatcggtcctgcaccaagaactgcaatattcaatccctttacatctcctacctgcttcactccatgcactgcaactgccagaggctcgatcatggcaccttcttcataagacatatcttccggaatcggtgttactttagaggcatctactgcaaaatattctgaagctgttcctgttgtctggaatcccataaccttaagttcctcacaaaggttatattttccatggcggcacggataacactgtccgcagtaaacctgtggctcgatcgtaactttctgtccttcatgaaattctgtaacatcttttccgaccttggcaatctcaccggatacctcatgtccctgagtcaccgggtattttgtaaatggatgctttccatgatatacgtgaatatcagatccacagattccaatattcataatcttaactagtacctgatcatctttcacttccggaaccggtacctctctgaaaataatttctcccgggtttgtcattacctgctgtaacataatgttttcctcctttattgaatatcttttattaaatgttttattaaagtaattacattattgttcaggaaatgtattttgtcaatatgttattgttcagttctgcctattgcacaagatttcgctataatttttatgcagtttgcgcaaaaaaagtccagggaagaaacatgtgttaaaaatgtttcttctctggattttctaactttctatcattctgatcgttataatgttttaataaaagcctgcaaataatgttttgccacaccaactgccgaggcttctctcttatatgaacaaactttcaggtatctcgcatcatgctcaaatccattatattccattacttttttccctaaggttatcatatgatctgcaagatatccccctacttctcctccaagaataatatccatatcatatgccattctcagatttgaaataaggattgccagattattaagatactctttccaaaccttcacagcctgtccgtcctgctcttccaccttcttcataaactgttccagtgtctctttggtatcatctgtcagcacgctcgccgcacagtaagcatccgcacagccttgttttccgcaataacatttctttccgcccggaacaaggatcatatgtccaaattctccggctttctgattcgctcccggaatcaatttcccgtcaatgcaaaatgctcctccaagtgtgttattcaatgaaagatacaatgcatttctatagttatttaaatcctctgccatcattgccgcattggcatcattttcaaaataaaccggaagtgaaaagatctgttccaaaaagcttaaactataattctccaattggagcgcatgagatttgatcagcattcgttctttcgaattaacaattcccggaattgaaattccgattcccaagattcgttctctgttttctacatctgaaagaaatctttccaatgcttcgctcaattgtaagtagtaagcggcctctgttgaaaattctaagcggatcctttcatatttctctatctcatagctcaaattcacaagtacaaatcctgcatgcttagcagtgatccttatcccaaccgcataacggtacgctggattaatactgattcgttttgcttttcgcccacctgtagattcatattctccggtttcaaccgcaattccattagccaagagctcattcacattcgacaatacagtcggcatactaagattgagatccttcgacaattccactttagacgttgcttcgtgatttataatataatttactatttttgattttgtaatatttctcttttccgctccaaccatatccaaggctccttttataaatcgttttataaaagtatcttatcccttctttgccggtttgtaaaggttacaaatgcattttattcttctactttcaccggatttgtcacactgaccttgtgatcataccatgttcccttttttccgatcaatgcaagatcaaattctttgtccagtgccggaaccggaacgtcgaatccatagacctcatcagatgttccatcgctgtaattaatagtatctgttgtaggctgaagcaattctgcgccgtccttctgtgcatcctcggcagttccttcgaacagattgacaatatttttagacaccagactgatatgaattgtcattttcccatcctctactgtcagtgttccttttccatccattgcttcattcacatggaacatagagctgtctgtttggaactctgctgtatatgttccgtcttccagtgctgcctgctcctcatctgccttatctgcagaatcctcttttgtatccgcctgttctgtctgtgcttttccactgtctttagcctctgtgctatttccacatcctgtaaatacagatgcgatcatagaaacagaaattaataccattaataacttctttttcatctaaatccttcctttcattaattcaaaaaaggtcatgccattcctttttctctgaacaagcatgaccttctcaatatcttcttacaaattactctgcatcaattgcagcctgtgtatgtgctacatacagctgctggattgcctggatttctcctaaacctgcaatctgagtatcaatgctgtcaaatgctcctgatgcctcaaactggctcttccaggaatcatcgtcatctccggccatatcgttgttcgcatggtctcctgcaacaaccatcagcggacgaaggattactttcttatatcctgcttctttcagtttctcaatcactgcctcgcaggatgtatcttccggctcaccctctacagttccgataaatacattgtcatatccaagctgttccatctgtgtctgcatctgagaataacttacctttgcagtatgagatgtaccatgtcccatgaatacaaatgctgttccgtcttctttcactgcatctaaactatcaaatccggcgtctttcactgcctctgctgtgattgcttccgctactgctgccttgtctgcattgataacagttgcatcagctccaacttctccaaggagcggctctgcgatcttaacagattcaaatttatctttatatccctctactgctgctgtaagttcatcatactctgcaccatgcatcagatgtgttggctgtacaacgaggttctttacgccattgtcaaccgctctctgcaatgcctgatccacattgtcgatcttctcaccatcacgagcctgtacatgattgataatgatctgtgctgtaaatgctcttcttacagaccagtccggatttgctgcctggattgctttctcaataccaccgatatctgtcgcacggctgtcattgaaggatgttccaaaacttactacaaggatttcattttcaccaatctcatcagcattgagcggatcatccttggatgcatctcctgtatctcttccgaaataatccggatccgcattctctccctcaacaagttctttctgtgcatctgtcagtgcatcccatgcttctttcgctgctgtacactgctcatctgtcttgtctgttctttcctggacataaatgtcatcgatcagcttcgcaactttatctgctgcttcctgatcactgtcctgtttagactctgtctttgttgtgtcagtgttgttgtcgccctttgatccacatcctgcaatcatggacacactaagtgttgctgccagtaaaaccattaatactttctttttcattgtcatcctcctgatttcttattctcagaaatgaaaacaccctcgaatcaaacgagggtacgcaaagaaaaaccggtgatcatttacaatctatctgtaaataattactgcagtctaaatcattttctttcgtacggccaattcctcgtggcatgaattcttcattcctgtactgcgaaaggcaggtctcccggctgatcgttcaaatgcttctgcttcaccttcccggtctcccagtggtctcaaaacacaagctcacgaaatacggtgacgagttcgtacaggattctcacctgtttcccttttcaccagtccagatttcccacgtcgttcctctgatcattcataatcaggacgccatcatccatctgactgacacctcacgcatctgtattaaattatatgttacaacggggtcattctatcacacttacacaaatgcgtcaagaaatgttataaattggaggatttggcctcatttccgactttgatttcctcagcaaaaatgatacaatatccctcagagacaaaatttgtaactaaggtggtttattattatgaaagaatctaatagccaggcatttcgtcgtggttttcgcgatggaattccgatcggacttggatatcttgcggtctccttttcaatcggtattgccgcaagaaatatcggcctgaatgcatttcagggattccttatgagtctgttaaataatgcatctgccggagagtatgccggactgactgtaattgctgcaaactctccttatattgaggtcgcaattgtcacattgatcacgaatgcacgttatcttctgatgagctgtgccatgagtcagcgtttgagtcccgacctttcgttaggacaccgtctgctgatgagttatgatatcacagacgaactttttggaattgcgatcagcagacccggtactttaaacccttattatacctatggcgcgatggtaactccgcttccgggctgggcttttggaactatgctcggtgtcattgccggaaatatcatgtcaccgcgtatggtcagtgcatttagtgttgccctctttggaatgtttatcgctatcatcattcctccttcgaagcagaataaagttgttgcgggactggttactcttgcatttatctcaagcttcgcagcaacttgcctgccttggatctccactctgtcggatggtaccagaacaattatactgaccgtcatactttcagccggagcagcattcttcttccctataccgacagaagatgaaacttcagcttcaactaagcaataataaaaacgtaactgttcagttactcagaaggaataaaaattatgacacacaatatttatatttatattcttatcatgggcggtatctcttatttaatccgcgtactgccgatgaccttgattcgaaaacctttgaagaaccagtttcttcagtcctttctatactatgtaccttatgtcacactagcagtgatgacattcccggcgatccttcatgccacacagtctccaatctccggagttctcgctctcgttgttggagttgtagccgcatggtgtggtgccggactgctgccggtcgcagttctttgctgcgcagttgtatttattgcagagcttttcttgtagagtgatcttatagattttagtaactgtcgatgcccttttttctgccattgatgcttttttcgctaccgtcgataccctttttcgtttggcgaaatgaattatcttaattttctgacatttaagacaatttctttaaaaagtctaacgcaaaaatatcaaaaaaggggttgcatttttctgtagctttgatataataaccatgttgtttgaaacgagcaacaaacaaaactcaagtaatgcggaatggtgtaattggcagcacagcagactctgactctgttagtaggggttcaagtcccttttccgtagctgggaatttgcttcggcaagttccctattttatcggagtgtggctcagtttggtagagcgctacgttcgggacgtagaggtcgcaagttcgaatcttgtcactccgatgttttaagagattacaatttgtaatctcttttttgttatagtctctttgttattaaattaatattataaacaaaatgcgttgacctcaaattcacaaaaatgaaaatcagtcaacgcaccatcattctctattcatcaaatctttatttcagctccccatcaaatacaacggttgccggtcctgtcatataaactgtgttcttctcctgatcccactgaatctccaaatctccgccaagaagctttacagttacttcatcttctgtcaatccattcagaatacaggaaacagctacagcacatgctcctgttccgcaggcaagtgtctccgcagatcctctctcccaaacacgcatctgtacagtatgtctatccagtacttttacaaactctgtgttcacacgtcttggaaatctctcatggttttcgaattttggtccgatttcttcaatcggaagattatcaacatcatctacataaacaactgcgtgcggatttcccatagatacgcaagtcatatgatattcttttccatccacaagaatcggttcatctacagctttatctccctcagccacaaccggaatttctgccggtgtcaagattgggcttcccatatcaactcgaaccttcgcaacttttccattttctacgaaaagctgaagtgttttgattcctgctaaagtctcaactgtaatctctgttttgtcagtcaggccgtaatcatacatatattttccaacacagcgaactccatttccacacatttctcctctggagccatccgcattatacatagccatctcacagtctgccacttccgacggacagatcaggattaatccatcggatcctattccaaaatgtctgtcactcacctggattgccaacgctgatggatcttctaccttctcttcaaaacagtttacatacacataatcatttccaattccctgcatttttgtaaatttcattttcttctccgttccactgtcatcactgacagtcctctcatttgttattgtttacagcacttcttattcgttactgttaacagctgcctcttattcattcataattgtcagcaccatctgtgctgtttcgagcatattagtcccactttccatactgctcttctgtaaatatcgatgtgcttcctcttctgacatgttatttcgttctatcagaagcgctttcgcctgatcgattatctttctctgagaatcgtctctctttcgtatcgtttctctgcgctttcttctcttcctgctctgtgtctgctgaatcatttcaacggtatttaccaaatcataaactttgattggaagtggaagtcctacaactccatccggcagtccatccatccacttatccgctgaagccaccaaaagcatgtcaaacgtatccggaagagattctcgtaaatctgtatactgcatatcttgaaaccgataaccacacacgacaattccatcgttccagttatcagcatactgcaaaaccttagctcctgtcaaacataccgcagatacttcaatacccgcacgaaccaaactattacggatatttactgcattttccctctttggaaaaacgacaataatgttgctcatatctgctcacctcttccgctaactactcttctatcaatccgttctctctaaatgcccaatgccaggatacctgaactacagcctgtaaagataatgatcgatctcccagtctgtcacctgcatacaatattctttatattctttcttatttgcttttatgatcttctcggcaagctctttccctaatacgctgatcagcagttcatctttctcaagctctgctgtagcagccccaagcgttctcggcagttcttccacttgaagttcatctcttctttcctgcgtcatcttctgaatattttcatcaatattcttcggaggcataatctgattcttaattccgtccaccccggctttcagaagtactgcaagcgccagatatggattcgccgtagcatccggactgcgaagttccagtcttgaattgtcttctttctccatagacacacggatcaaaggtcctcttgtcttagctgaccatcccatataaacaggtgcttcataccccggcacaaaacgtttataagaattgatcgttggatttgtaatacaggtgattgccttcatatgtttcatcaagccaccaataaaataatatccttcctgactgagtccgttctcatcctctgcgttataaagtgcatttgttccatcgtttttatataaagataaattaatgtgcattcctgacccataagtctcgctcttcggctttggcataaatgtcgcgtgcagaccgtgtcgttttgcgattgtcttgacaaccatcttaaatgtcatcagattatctgctgtaatcatcgcctcatcgtagtgaaagtcgatttcatgttgcgccggcgcaatctcatgatgtgaggaaataatctcaaaccccatatcttctaatgttaagatcatatctcttcttgcattttctccaagatccaatggccctacatcaaaatatcctccctgttcgtgagttactgttgtcggtctaccgtcatcatctgtatggaaaagaaagaactcgcattccgggccgacattcatcgtatatcccatctctttcgcctccgcaacagcctttctgagtacataacgcggatcgccttcatacggtgttccatcttttttatacacatcacagatcagtcttgcaacttttccctgctgtggtctccatggaaagatttcaaatgtactcaaatctggatataaatacatatctgattcttcctcatctgcaaccccttccaaggaagaaacgtcaaacatacagcggttatccaatgctttttcaagctgtcctactgttaccgccatatttttcatcgttccaaaaatatctgtaaactgcaatctgatgaaagcgacatcttcttcctctactatgtgaaaaatatcatctcttgtatagttatgcattatttttcgacctcctttatcataaactgatacgataaaagggcgttctccacctaagttggaaacgcccttgtttctgtgttacattatatcgactgactgttttcttgtcaattatttctgaatcagttcaagaacttcttcttttacaggcattgctttgatcgcacccttctttgttgttacaagtgctgctgccgcattcgcaaatgtcagcatctctcctaactgttcctctgtcagattctcaaaatcatgatcaaccagataattcaaagaacttccacagaaagtatctcctgcaccggttgtctcaattgctttcactgaaaatcccggtctctctacgcgcatgtctttgtaataagctctacttccgtcttttcccatagtcagaagaatcagcggaatattgtatgtctcctgcagatatgcgattccctcatcatagtcttccttaccggatacaaactgaatttcattatcagagatcttcaggatatcacattttccaaatccatactccatctgctcttttgcaagatcaagagagctccacagcggcggtctcagatttggatcaaaggatacaaggcaaccatttgcttttgctgtttctaccgctttctttgtcgcttcacgcacaccttcatgtgtcatagaaagtgttccaaaatgaaagacttttgtatcttttactacttccggattcacttcatctgcagtaagcatcatatccgctcccggattacggtaaaatgagaattctctgtctccatctgggaatgtatgtacaaatgcgagtgttgtattcacattttcgtcaaccatcagattggaggcatcgattccggcttccgtaatcgtatctcttaataacgctccaaactgatcttttccaacttttcctataaatgctgtcttctttcccatcttgttcagaagtgccagcacattacacggtgcacctcccgggcaagcctcaaacatattgtttccctgctcgctttgtccattcattgtaaaatcaatcagaagctctcctaatgcgattacatcatacttctttgccatgaagttctcctcctatttcttgttttattactttgtcttaattaaaatatactaactcttcaattggttctgcaggctcaatattctctgcctcaagcaccggtccttctccgccgtatacggacagattcgcataacgcacttttgcacgaatttttacccagtctcctgcattcagtttcggcgcataagcgcttctgcaaacatatccaaggaaagatgtatcatctgcacagcaagtcattgccatacgccccggatagaataccttagacggaaatgcttttggtttcataacctttgcaacaaattctacaacttttcctttatagcgctccggatgctcctgcatatcaatataccagataccataatcttctcttggaatctcaatcacaggtgctttgagatcatatggtacttcgtcttcaaagatattgtctacctcaccgttctcatcctcaaagattacttctgcctgagggcttacaaccttaacacttctgcggtatcctgccaacggtttcttatcctcgcaacggttgaacagaacaagctctgcgccctttaccatctctacaaacagtggttttaagtttgtcagatacatctgaaaagtacttgcatctaccgttgtgatcttctgctcaatagcccagcctgccggaagcttcatcttctcaaattcactcacctgccacataccgttatactcgataaccacacgttccggcttgtgcttcttattcatctcttccagccattcttctgtcagatcttctttatcttctacagtctcaataacgacaccatacttcagcaattctctcggatcatactcttcttctccctcttcacaaagaatcagaagtgtcttgccgtcgatctggaagtagtcctgtgacaatgtaaaattcagaaactgtgtctttccactatcaagaaaacctgtcatcagataaaccataacatctggctctttcatcatatctatctccattccgtctccctttcgcagaagacatctgttattacataatgctacgcagccccctatggggtactgctttgcttatcctttttatttcaccttaaataattctgcaagcttgtcttcgttaagctctgctccgatcacacagattcttcctgtgtattccggtgctcctgttcttacttcatgttcctctggaaccatatcaaagtagatccactcaccgtctgcacctgcaaccattccttttgcacggagtacatttccgtaagagccgtcctcttcaagagtcttcagaattgcactgacctcatcctttgtataagtatgaattgtctctttaccccagcttgtgaaaacttcatctgcatgatgatgaccttcatgatcatgatggtgatgtccgcatccacaactgcactctccatcgtgatgatggtgctcatgctcatgttcttcatgatcgtggtggtgatgctcgtgatcttcatgatcgtggtggtgatgctcgtgttcatgttcttcatgatcatggtggtgatgctcgtgttcacactcttcatggtcgtggtggtgatgctcgtgttcacactcttcatggtcatggtgatgatgctcgtgttcatgctcatgtgcctcttcagctacttctgcaagcaattcctcttccagagatttgcttgattccattgtttcaagaatcttctcgcccggaagctgctcgatcggtgttgtgatgattggagctttttcattcagttctcttaacagtgcaacactttcctgaatcttctccggttttgctttatctgtacggcttaaaataactgcacctgcatattcaatctgattgctgaaaaattcgccaaagttcttacggtaaatcttgcactttgttacatctacaactgttgtaaagctattgagctctgcatcgatttcaccctgaacatcttgtacagccttgattacatcagaaagctttccaactcctgatggctcaatcagaatacgatccggatgataagtatctacgacctcatgaagagattttccaaaatctccaaccagtgaacaacagatacatcctgaattcatctcacgaatctcaattcctgcttccttcaaaaatccaccatcaataccgatctctccaaattcattctcaatcaatacaacctgttctcccttgtatgcgtcagaaagaagcttcttaattaaagttgtctttcctgctccaagaaatcctgaaataatgtcaatctttgtcattgttctcttctcctctttctattatttcaaatccaattcaaccgggcaatgatctgatcccataatatctgtaagtatcttcgcatcgtccagtctgtcctttaaactttccgagacacagaagtagtctatacgccagcctgcattcttcgccctggcactgaaacgataagaccaccaggaatagattcctgtctgctccggataaaagtaccggaatgtatcaataaatccgacatctagaagttcagtaaacttctgtctttcctcatccgtaaaacctgcattcttacggttggtcttcggattcttaagatcaatctctttgtgcgctacattcatatctccggtcacaatcaccggttttgtctcttctaacttcttcagataagtacggaagtcatcctcccacttcattctgtaatctaaccttgccagcccattctgagaattcggtgtgtatactgtgacgaaataaaactcttcaaattcacacgtaatcacacgtccttcctggtcatgctcctcaataccgattccataactcaccgacaatggttctttctttgtaaacacagctgttccggaatatcccttcttcacagcataattccaatactgataatagccttctaattccagatttagctgtccttcctgcatcttcgtctcttgaatacagaagatatccgcatctgcctcatgaaagaaatcaagaaatcctttctgtacacaggcacgaataccatttacattccatgatattaatttcaatacgctgcatcctccctttcaagagtgttgctgttcaccgtccattcgctaactcttctgtgaataatcagcaactttccataaccgaatcaataatacacctcatcaaggaataaccctcttgcaggtgctaaaaatccagcctgacttctatcttttgatttcaaaggttccttcacactctctatgcttcgtgctccggttccaacttccagcaaagttcctgtcaaaatccttaccatatggtaaagaaatcctgttccttcatattgaatactgactttgcttccttgtccgcaaatcattatagcataaattgttctttttgtggacttttcatcctttttatccgtatatccagcaaactcatacgtgccaatcaacaattgtgctgcctttctcatcgcatctaaatccaatctctgcggaaaatgatatgtatatcgtcttgtgaatacatctggtttctccgccaaatccagctgataaatgtatctttttccaactgcactttttctcgcatgaaatccattcctcacaagctctgcatctaaaatccgaatatcttcaggtaatcttgaatttatcttttctgtaaaaaatccatcctccacccgaccagaaagaactactgttgcagtctgtccattcgcatgaacacctgcatctgttcgtcctgaaccatcaatctccactggatatcctgccactgacgaaattgttcgctccagagttccctgcaaagtgttctctgtgtttgcctgtctctgccatccctgatatgcagttccgtcataagcaattgttaatttataagttctcattctcgcctcccgtgtaacatactaacattctccgatagattgaaatcggttatactcacgaacagagtataaccgatttttattatcttagaaatttcttcaattcatccataaatgtattcgcatctttgaactctctgtagacagatgcaaatctgacatatgcaaccggatccaatgtcttcagattctccataacaatttcaccaatctcactgcttgggatttctttctcttcacgattaaaaattgacagttcaatcgcatcaattgtcttttgaatctcttcagccggaaccggacgcttgtagcatgcattcagaactccattctctatcttcgctctttcatactgttcacggttattatctttcttaattacaatcagtggaattgtctctaccttttcataagttgtaaaacgcttaccacattcatcacaggaacgtcttcttctgatagaactattatcctctgctggtctggaatcaatcactcttgtatctggattgccacaatatggacacttcatataatccactccgcctttccacgtatcttattgccttcattatacacaatgtctaatatttttgcaaaaacttttcttctttaatttccacaagaataatatccggtccaatcttctttatacatgcaaatggtatcacatattcgctatccgttccaaagaatccacagaactttcccggtcccggaacaatcaatgcttctatcgcaccggagcatacatttatctgcagatctactacacctccaaggcacttgccattgcagatattcacaacttccttttccctcaattcgcaaaatctcataggcattattccatgattgccgatattttctcttaactattctatgcatgaaatcagaatctgttgtataataaaagaagtctcctttctgtctgatcgtaagacttctttttcccttaaaagcttgtccgataaatcggcaatgcattgattaccggttcctcatatggatgtacctctttaattacctgaattgtttcatccactttttctgtaaatacagtcacttcaactttcacttccggctcacaactaatctctcctacatttccaatgtaaggagaagttccatctaatggtctccagtaactggtgaccttggagcaggacatacaggaatcataatttcctatatgaccggcatctactaactgcaatgctttctgtagctgcgaaatatgtgtttctggaataaagatttctaatttgcaatacttgaaatccatgcgacacacctcctcaatgcacaaacaaaatttatatcaaaatcccatcgcaatgatctatttcatgctgaatgatctgagccgtccatccactgtatttttctcttttctttttgaaattcatatcctgatattcaacttctatttcctgataacgtctgcagcttcgcactccatccaatgacagacaaccttcttccgtctcataagcgcctgtgcgtttcacgattttcggattaaacatagcaatattaaacaaccccatattcactgcaatgattctcttttttactccgatcatattcgcagccattcctacacagcctgcttcatttactttcagtgtatccagcagatctattgccacctgcttatccgcttctgttgccaattctgatttctgatttaagaaaaatatgtctctcataataggcttaatcatactattttacttcctttccattccctgcaaaccattctgtttctatagaaattttttcttctgtcgctaagcttacataatattcatctatacatcttgtctcaataaaatattcctttgctttttcattttcccattctttgctaaatccaatgccttttactttcagcttcgcttctagttctgtccataattgagtaaatatccggtctttttcctccccacaaagttcagacattgcattttgtatttcattcgaaaatatcttcttcgctgtagcttcatgatacggacgcacacgttcaatatcaatgcctacttcctgatcagcaatcgctagaactacatatttaccgctatgtgacaggttaaaatgttttctcgcatccacaagcatcggcttcccatttttattcattacaagctgagcatcattttctacacctaaatactcttttaaaagatatcccgctatcagctcctgttttttatccgtttctctcttatgcttctgatatttttcaacatatctttgtgctatctgtgagagaatccactcttccttaaatgatattttttctatatcagctattatgattcttcccttggtcatttattgtcccatcttttctatatacttttttcaagaatgccaccagcatttttgccgtgagacactcaatcctcatctgatatatacatatagcaaaatcttttctttgtcaagaaacttgatttttttgcaagaaaaaaacagcgctttcgcactgcttctcattcctgtctatattccatgcatcctccgtgtcaatcagcggagtgattgacacgggagtgaacagtaactcttttcccgcaatgtgccagtccaacataacacacttctccggtcatctctgcgtcatattgtttttcctttatctgttccagtgccttttctgcaagcttttctaaatcgtctttttcatctttggtatacttgaattccaaaattaaatttggatatctgtcatgttttgcataaagacagatatcacttctgccttctccggtttcccgattgcttttgatatcataatcctttctaagaaatgcacacattccaagcgtcatcatatggtaactattctcatctttcagatcatgataagatggcaattccaaaagaactctctgatactcttctgcaaaacgttccatatcctttcttttaagagcatttaacatcttttccatatgtctctcatcgattttcagatgacatgctgttaattctttgaacactttccacacttccagattaggaacccgaagtcggtaatagtcctcttcgatttcttttgtaattgttacaattccggcatttacaagaagtccccatagatttgcttcgtccattttttcataataagccattgaaaaatctactgtcacttctacttcaccttctgtgaccaaggtctcatattctttctcaaaagaccttccctgtacttcaagtgcattacgtaaaatactgttttcgcttgtattaacccaataagaatccatccttcttcttgccgcataacacgatattgaccatggattatatacatctgtactgccaaaatgatatccatcgtacatctttttcagctcatctgaaaattctgctttacaataagcaagcagctcttttacttcttgctctgtaaaaccaaaacagtcatcataatcttcgtcctgcactgtgcagacaactaaattattgagacccgaaaatatattttccttcgcaattctctgaatccctgtcagaattgccttttgaagataatcgttgcctttcagggacgttgccagaaaacgattcaacatggctcttacttcatcataatatccttctgaatttgcagacataaacggagtatcatattcatctaacagcaaaaatactttttctccataatacgtactcagtgcctgacaaagaacagcaattgaacgaattacatgattttctatttcttttccgatgctttcctgacataaactattataaatcatattgaattctttcacctggaattctgacagtcttccatcattaaccatctgataaaagcgctcatactccgcacgtacagtatctttcaatgcataacacaaagattctgcatcccccgctttcacgttaaggaaagacaaaaatacaacaggatatcgattgagctccttgtagtggacagattttgtaatctttgttccacaaaataaatcggaggaatcttttgtgcagtcaagaaattctgccaacattgacatattaagtgtcttaccgaaccttctcggtcttgtaattaatgtaatctgataccaggattctaaaaactgttcaataaactgtgttttgtccacataataggcttgtttttcacgcaaatcgcgaaagtcctgtactcctattgcaagtttaggtttttcctcttgtatcccagatacattgtacagaatactgtcttcctttaccacgtcacaacttgcaacataagttggttttcttccaaataattcatctaaggaacaggctaacacctcacttattcgttccagtacttcaaagtccggtgtccggtttccattctcataattggtataagtcgatctggaaatccccagtttttctgccatctgcgcctgagtgtagacccgggatttacgtaattttgtcaaatactcgttaaattttgttttcatagaatcaccgctttttttcttttagtatacgcttttatgtttcattttgcaacattcttttttatttatatacaaagaaggacagaaaggtttcgttttgttaacctttctgtcctttttaaatagttgctatcttattttccttacagcatagctccgaaatctgttacgattgcctgtcctgtaattgcctttgattcatcgcttgcaaagaacaggattacatttgctacatcttctgctgtacaagatggtgttctaagattactgtgtgttgacattgcaccgatcatatccgggtcaagtgctgccggatttgttcctgatgtcattggtgtaatgatatttcccgggcagattgcattacaacggattcctgttgcctggaaacgaagtgctgtatgctttgtcactcctacgattgctgctttagatgctacataagcagctccgccacatcctttcactccagcgatagaagcaacatttacgatagatgctcctgcctgcatcttctgtgatgcagcacgcatgcaacgcatagttcctttttcgttcgtctctacgatacgatcaagatcttcgtctgagaatcgatcgattggtttcagtccttcctcaagaattcctgcattattcacaagaatgtctaccttgccatatttctcgatcacgagatccatcagtcgctccggatctcccttctttgagatatctgttgaaacagcgaaaacttctcctcctgctgccttaatctcttctgctactttctccagtgcagcctctcttctcgctgtgataacaacagttgcgccctctttggcgaacatctttgctgttgcttctccaactcctgagttacctcctgtaataatagctactttacctttcaaacgatccatttcaaagatcctcctttgttgttataggtaaaattatacaattcttctttcagtatttcaatctatttatctatattttacattttgttttatgctttatatttcatccaaacaaattcatagcctttcaaaactggatctttcacttctacaattttaccattcaccagatttctgaaaatgccttcttcctgcatccacgcagtctgttcactttcgctgaaattaaacagtgcaataaatcgttctcccttatactctctgaggattcctaaaatactgtcattgtgaacatcataagtatatacttctgcttcctgggaaaagacattttcctgtcttcggatctgttccaatcggttcaacatctggaacaattgtccctgtacagtagaaagatcttttctcttatccgcgagttcccacaggaatgctcctctgtggagataacgtgaatcagatgctttttcagcatcatctttataactataatcatttacctgtcctaactcatccccgctgtaaagcatcggaattcccgactgtgtcaacatgtaagcgtggagcatgagatcttcttgaattgccgtctgcattttttctgcatttccttcaaatcccgctgcttcaattccgcacatggatgctgttgttccacaaaatcgtgcatcttgagttacaggatcatcgttatataactctccccggctgatgctgtctgctatctttccggtgaaataatcattcagataacgcttatgagaaggctcttccattccccattgtttcattgtatcaaaatcaagcccccacccgatatcatcgtgacaacgaaggtaattcaaaaatgtatattgctttggcagacggctaactatatccatctgtttcttcaaaagccggatgtctcttgtcgcaatactattccaggtcgtcgccattgttgtcacattatagagcatatgacattccggtttttcaactgtaccaaagtacggcaccaccttttccggctccataaccacttcgccaagaagtatcacacttgggcagacgatttcagcgatcatgcgcatcattctgacaatcgtatgtacttctttcagattcctgcagcttgttcctaactctttccagatataaggaactgcatcgatacggataatatccattccctgattcgcaagaaaaagaaagttatacatcatttcattaaatactcttggattacggtaatttaaatcccactgatatggataaaacgtcgtaagcacataatgcccgatttccggaagccatgtgaaatttcccggtgcagttgtaggaaatacctgtggaacagtttcttcgtatctcgccggaatatcaccgttatcatagaagaaataacggctcatgtattctccttcgcctgctcgtgcacgttttgcccactcatgttcctcagaagtatgattcatcacgaaatccatgcatacattcataccattttcatgacatttttctgtcaatctggcaagatctttcattgtaccgagatccggtcttactttccgaaaatctgccactgcatatccaccgtctgattttcctttcggagtatccagaaaaggcataagatgaagacaatttacattacactctttcagataagctaactttttttctacacctttcagattaccggcaaagttgtcaatgtacaacatcatgccaagcatttctttttccttaaaccagtcaggattcttttctttcttaatatctctttttttcaactctgtgctacgcttcaagtagtaatcatgcatctgctcacaaagttctgcatacattgcatcatttccatacaactccatgtaaagccagcgtaattcatcctgatgtttttccatacgctgtgcaaagattttttctgtattattcacattcttcaccattttctgttccatcgtcaaccaatttattttactctttcacaaaacaatactgatatgcctgatattcgcccgactctatcggaagcggcatgccgccatacataagtacagctccggtgtatctttttccactcttttcttctcgatatatagctgtttcttcaagcccttgaagttttacataatttactgtcatatttccatgaatcacctgcataactatatttaaaagaactttactttgtcctttctcatctgtatgcacaaactcccatgcacagatttcttctgttgtcggatctgagagacgatagtacaatccgttctgaatgatcggcgcatagctcttatattctgcgatttgctctctgatctcctgcttttcttcttcagaaagtttcataagattcagctcatacccaaaagttccggacattgcaacaacacctcttgtatgaagtggggtctttcttcctgtctgatgattcggcactgctgacacgtgagaacctactaccgataccggataaccaaaggatgttccatactgaatccgtaatctgtcaattgcatccgtattatcactacaccagatttgcggagtgtaatacatcataccggcatcaaatcttccacctccaccgctacagccttcaatcagcagattcggatatctctgcacaagacgttccagaaaatcataaagccccaatacataatcatgtaacactcttccctgatctcttgttacagaagaataaacatccatcaggcttcggttcatatcccattttacatattcgatattcccctgatccaacaccttgcaaatctgatcataaatttcgtctacaacttcttttcttgaaaaatccaatacaagctgatttctgcttctgaccggatttctacccggaaccgtcaatgcccagtccgggtgtttccgataaagatcactgtcttctgaaaccatttccggctcgatccagataccaaacttcacacccagatcattaatcctcttaattagatttccaagtgtgccaccaagtttcttctcattcacaaaccagtcacccagtccgctattatcatcatcacgttttccaaaccagccgtcatccataacaagcatgtcaatattgacttccttcgccgctttggcaagctcatagattgtatctccggtaaaatcgaaataagctgcttcccagctattgatcaagattggacgaatttcttctttatatttgcctctgcagatatgttgtctgatacaatgatgcagattctgagacaaacgattcattccttctgaggaataggataaaatcacttccggagcctggaacatttctcctgtttccaacggatagcgaaaagcttcttcctgaagtcccagcatcattcttgtctggtttaactgatctttcaacacttctccctggaaacatccactgtatacaaaggacattgcataacaatttcctttgtcttctgtcgtttctttttctgcaaggatcatcatcggattgtactgatgactggaggttcctctgacacttccgattttctgtgttccatgcacaaccggaactctctgaacatttcgctccatcgcatgtctaccataaaatgttagaagctcataatctccgtaaagaaaatccagacttgctgactcaattttgtttaaatagattttgccactgctttcatttttcacacttacacttcttgtaataatatcctgtgcgggaagcactccataaagaagcaccaccttaactcccgtcaccggatcttccattaagatttccagtgtctgtgcttcctccttacttgcataaactgccggaagtccttccagattatattttccatcaaggattacatgactcttgtaacgaaggtcgcagctcatacttccatctgcattttctactgcaaatgctgtacttctgaaatccccgttcccgtaacaaggaaattcctgtggaagtgtatccattgaatacgtacgatcttctcctgcatcatatggatttcccgaaaatcccctgtcataatatgtcagaagatagtccatacatccatcggttttcttcccgtaatatagatgtaacaaaaatccatagcgatccacctgcatctgatatgttgtattttttgtctgtaaagtaaatgttctgtctttctcgcaatatataattcccatatctaaatactcctgttttccattttagcgaagcaagatctgcattactgtctgttcccgcttcgctatcttttactttttattatttcactgctccattaacaactccgttgaggatatgcttctgacagatcaaatagaagatcagaatcggaagcaatgccaacagataggatgcaaatgccagattataatttgttccaaactgtgtctggaagtttaactgtgccagtggaagtgtattcccgcttcctgaaccggacatgatcacaagtggtgtcataacatcgttccatgtaccaagtgctgtcagaactgcaactgtcgcatgcattggtttcatgatcgggaaaacaatcttccaatatgttttccatgtactcgcaccatccacacaggctgcttcttccaatgcaatcgggatatttgtcaaatatcctgaataaagcaatacattcataggcatataaaatacaacgtacagaataataactcctgctctgtttgccagtcccatctgcgccgtctgttttacaacaggcatcatcagaattgcaaatggcacaaacattccgctgacaacatagaaataaatgagtttataaaatttactcttcttatttcttccgattgcataccccaacagtgaatgaatcagaattgaaaggacaactgttacaagtgtaataaatacactgtttccgagagaatgccagaaatctgtcactctcattgcctcagcaaaattatcaaggctcaaatgacttggcaaggaaaggattccgctgatactattcgtcatctcagaaggcttcttcagtgcaattacgattgtcatatacagtggaaaagcaaccgtaatcagaccaagtaaaagtaaaatcgttataggccagtttactcgttcttttattttcattttttccattacagctgttcctcctttttccctgtgattgtcatctgcaatacagaaattacaacaataacaataaagaatatcactgcgttcgcactctggaatccaaactgaccgccgctcataccattgttatagatcagataagagatggattctgtactctgtgccggacctcctttggtcaacgccatgatctgatcaaataccatcaggaagtttttcacacagagtaccatatttatgctaaagaatggaataatgagagggaatgtcaaatgtctgaacttattccatcctgttgcaccgtcaattgctcccgcttcatagacatcctccggaacagtctgaagtccggaaatgtaaatgatcgtgttcattgcgatcgactgccatgcacatacgattacaactgcgatccatgccatcttagtactggacagcatactggaagaaagggtcttgcttccaagcatttctccgaaagccggaagaatgtatgtaaaaaagtaattgaaaatgtatcctacaaccaacgctccgagaacatttggaataaagtaggcaccacgaaacgcactcttgaatttaatcttactattcagtccgagtgcaaggatcaaactgattacatttgtcacaatcgtagctacaactgcaagtttaaatgtaaacagataagaacctccgactctgctgtctgtaaaaagatcctgataatttctaagtcctacccagtcaaagctaccataacctttgaaattcgtaaaactgtaaatcacacctttgatcagtggcaatgtattaaaacagaaaaacagtgccacgatcggaattgttatcagaagaaaggtcatttttcttccactcattgatttctttcccatgcttgaattccccttccttaatcttcgtccgcatgctctttctcgtaatcttccactttgcggatgatatcacggttatatctcttccagtctgtatcaaactttgttaagaatgcatccacatcccctttcataagaaatgtctggatctgtgcatccactgacatctctgaaggatagtaatgatcctggtaatctgccattcttccttcttctatgaaagatttcactccatcaagtgttgaagcaagttcaaaatctccttccttacaaggaaccgctttctgttcatccagataactctgtacattttcatctttcaaaaggaaattaagcacttcatacgctgcctctttgttctcgcaatctttcataacactgaactgaagatccacaccggagttcagcttgttctctgatgcatcattattagccggcattacaaaggaatcgatatccatatctggatttactgtctgaatctgtgggattgcataacttccgatcgtgtacattgcagattctccgtttgcaaatgctgtacaagctccattgtaatcataggcaaatggatcttttggtccataggcaagcagtgcctgtgtcttttctgctacttctctatattcatctgaaaatgttgtctctcctttgtttacctggctgcagacatctgccggtgcaagatcaacggcgatcgcattccacggtgcaagacaagtccatgtatctttaaatccaaaatacaatggctggattccttcactctggatctgttcacagagggctataaattcatcccaggtttccggaatttcccagccatattcctcaaacattgctctgttgtacagaactcctgctgcatttgccacatatggaacggcatacacgccatcctccggtacaaattcaagcgctttgtctatatccaggtaagcctgtttaatagagtccaggccttcataatctgaaatatccatcaacatatcagaatcaataaagttagagaaattgacatctccaccgattccgataatatccggagcatcttctctgataaaacgtgttttaagtactgtcattgcatcattcggagattcaatcgtcaaatgaatatcgtcatgagttgcattgaattcttcttcaatcttttcaaaggtttttactgcctccggtttatactgcacaagctcgatttctatcttcccgctgttttcactcttctgtccgcagcctccaagtatcattgccgaagtcatacaaagcatcaatcccatgcaaatgattcgattgctcttcttatacatttccttactccttccttctaccatacacctttcattttgacacattccggaatatttttgtcatttcactcaggtcatctatttgataatcatattctaacatatctttatgccactataaatatcagagttttttaagttttatagcaaaatgcaatttttctattcatatattgaagtcatctagcattttgatatataatgacactagaggtgatttatatgagtgatttacttttttccgtatttccaaatgaaaattttgttgatctgggattatatcaatatggatgggaacaatgtgcaccggctcactcgttcggtcctgcagcaagaaatcattacattttccattatgtgatttccggaacaggaacattacttgcagatgatgagcatggaaacacgaccgagtggcaagtgaaaagcggacaaggcttcatgctttttccaggtcaggtcaatacttatattgctgattctaagcttccgtgggaatatacgtgggtagaattcgacggtcttcgggcccgcgagattgtcacaaccgcaggtctgagcctgaatcaccccgtttatcatgcaagttcaaaggaacttcgcaaccagatgatggaagaaatgctttatctgagccgtcatcccgaagaatctccgtttcatctaattggacatctctatctgtttttggattattttatgcgttctgccgcaacagttcatgtgaagcaaaacggaagcatccggaatttttatattaaagaagctctttcgtacattgaacagaattttcagaatgatatttctgtagaagatatttccgcattctgtggattgaatcgaagttatttcggaaagatttttcacgatacgattggacgttctccacaggaattcctgatcagttatcgtatgactaaggctacagagcttttgaagatcacttcactgtcaattgcagatattgggaatgccgtagggtatccgaatcagctacatttttcacgtgcattcaaaaatgtctatgggatatccccaagaaattggagaattgaaaataagatagaactatgagaaacacgctctgcgagtttctcaagttatcgcggcagtcgccaagctctcgtgcaagcacggactttggctcgttgctcgcgtaaataatagggacagtaattttgcttcactgtcccttaataaatcacattatcctattaacatctcctgttcaatttccatttcactttccaggatacattgcttcaacgcttccaattgtccagcatttaatgcctctaattttttcttcttctcactgtttagtttaatgccttttccatttttcaaagcatcctcataagaaagaacatccatcttccatggaatcagattcgggaaaatattattctcattgtataaaaagatctgtattccaccataatccatatctccccagtgataacactggatttcttccggtgccgtcttcattaacatttgcaaaaagcgaacttcttttggcgaaaagtagccatgacaaaagagatacaaaacttttggatcatactccatgctttcgtaattcgctttattctcaatcacaatgattttttcaacacctttttgtaaggttggaacggcatgctctaatgtctgtgcattaagtactgttccataataatttgaagaagtgtcaattttctcttcgctcgctgtgctactgcgatctgtcaggtaatactccacagcacctttccattccaatgtctgagaataactcaatattccatgtactgccagtatctcatcatctgacattccctcgtcatattgcggagagtatttcaaagcttcaatgactgcaccttgataaatgcgttcgaaaactttagatggtgtgatatcatttttcttttcaaatactttagagctgaacacacgcttccattccggttctttcagatcagctaaagctttcaggcatttaagaaattcttcatcctccgctttggataactctttcgtatttcctttattcagctgttctaacacatgatcacaataagcgcttagacagctttcggatacatccacctgcagtttgcatattcttgaaattgcctgtaactgacgctctcttggatccatgattccaatcagctcacataatcttggaatcacttctacccgataatcaatcctcgtaatatctgtattcatttctctccagtcaaaatgcagatacttttctccacccaatgctgggatccgttccagaacttttgcctgtctgaccagttcctctctgccacctactgttttcaaaagattcccatccacctttggatgtttcattcctgagagatttcctatgcgatagtcctttgtattcgtcttatcgatcagccattttgccaacggcagattctttttattcaattccatactctttccttattcatttccctcaaccatatcgaggtaatcacctttatcaatatgcatcatggatacctgattctgatgtcttctgaatccatagacacagtccacatttcgaatcaacgactgcagacgttcatccggtacacatacgatcagctgaagctccagctctctcgcataatgaagacacacttcgcttcgctccttatccatcttggaaaatgcttcatcaagaagcaccagacggatcttagaatcacggtttgtctgctgcatatagagcatcgcaaaacctgcaagcagtgcgacatatttcgggttctgtccctctcctccggagtcacggcctgccatatcatcgactgcatttttgcggatatttccattctcatcttccaccttttcatacatactgaaagtcagataattacgataatccacatactgttccatctgctgacgatactggcttaaggatcttgcatcttcctccttaggaggcatgaacttctcagtcagacgcttgatatcttcttcatacttctgatagaactcatcctcaccaagacttaactgaccttcaaatccgtagtcatcgaacactttactgtctagttcaggtgctgtaagcatctcatagaactgtccgttttcattctgagccggtatgatatcaatctggtaaatactatctgaaaacttgatcttcgcaagcagacggttgatctcttttttatgtctgtaagctgccttgatttcaccatgaatggaagcaatcacattttcacgcaatgtatagtaaaccagattatactgcttatcgaattcttccttatacttcggttcaaaatctttcctgcactgattcagcactttgtcatacacatcattttcatgttctattcctgtaaaaccataggccggataagcattattgaacttatttctacttctttgcagttcttctctctccgtctcttccaacgtttccaaagcatccttttcttttgtcttgtctctcttataagctgcttcgctctgtacttttaacgcatctgttacttcattctgaagctgttcgttgacaacaaatccctctgtcagaaagtttatcttttctgaaaatgatttgatattactctcgatttgtccctgtgtcttcgcatactgtactacttcactttgaatgctatcaagaatctctgcatttttcttaagcaactccagtaattcctgctttttcttcttcagttcgacggtccggtcgcctcgtttcaattcttctacttccagacgtaatttttcttgtttctcgtaataatcctgaagctgttccgctgcttttgaaagatgtacgatctgttctgtgctctggttcagacactcgaatttctgtgctgcacgcagtgccatctcaacacggcagtcctcttccacttcctgtttcagcttcgctgcttcttcttccaactcaagaagtttcgcctttgacactttcgttccgatacaggcatatttctcataatcattctttcttaaatgtctgaaaatgtaattgctgtaggaataacagtcctttgtgacaccatctctcgtctcatgaagttcttccaccgtctcacatttcttaatgcgtcctaagtatcgcttcagacaagtatctacataagcttcctctgcgcgcacgcactcatacaatgtattctcatctgcattcggcttgtctctcacgattgccgcagtatccatgagttcgacatcctcgatccccttcatctgcttcattttgcgaaatgctttcgcagcatctaacgtatattcaggtgatgtcaccagactgtgtttcacacgtcccatacgtccttcgattgcatttttccactcttcatccgtaatatcaaacaagtccgcaaagatatttacatggatcgttcttccatactgagtactaagtatattctgcaattcctgtcttgcacgcttcaattccgcacgatatggttttctgtcatttttgaggtcttctaccatctcccgcttctcttgaagttctttctgattctcacgaattctttcgcggacatcacctaattctgtattaatattgtcaagcgcatcacttaaatattgctttagcttttcaatcgaatcttcactcacaacaccatctcggatatcatcaattctatgcagcgcctgattgctcacataagcactgacttcatcgtcttcctcccaggctgaaagaccttttacgatatctctccattgttctgaattcgttgccaggagctggatcgtattttcaatctcctttagctccttctctttctgtccataatcgctggctttgagttctgcctcgacttctacctgttctttcgtataagcatctttctctgccaaataagattttctcttttcttctttttcctcaatcttcttgagaatatcctgcagatcatcctctttcgattgcaaatgtgctttacaattttctatttcaatatattttaagatctgttccacatagatcttatcagctcttgctttctgcaaggctagattatgctgactgatctcgtcaagcattttaattctctgctccagatcttctacgcgttccttgatctcacggtaagcgccaagctgatcactgattgttgcaactgtatcttccttgctctttgggaacatataatctttgataaactgtcccgttccgttcgtcatacgaagtgcaatcgcgcttttctccattgtcatcatacggcccggctctacataaccaaagattgcatcataaaccgttttcaaatacgcttctttcgatggatatacacggttcacatctccgcgacctctgttgtcagccgattctatccttgcttctaccaattttttaagtttcgcgattgtatacgggacaccttcttctgtcaaatattcatcctccggaatctttccggaatgactgaagaaacaatatttcctgatgtctgtatctgcctttccaacctcaaatgaaacaccaatacaagtatgtgtattctttcctgtatccttaatctccaagacgatctgagaacagaagtcctggtcttctcggttaaaggaaccgtctttctgcgctcctctaagataacttagaacactacgcctgttcttcgcgtcatctgccgctttattcaagaatgtggaagatatacttccatataaaacaacctggatcgcatccataacagtagacttaccagatccacttttcccactgaaaagattcacatactcatggaactccatcactttgtgactgataccgccccagttattcattaacattctagtaaatattttcttcgactgtttctctttcatcttccacacctccctctgcttcttcctggatttcctgttcagaaacttcttctgtaatctcttcctctgcgtactgatcttcctgatattctttgatcaacgcagtaatatccatacttccacaatatagattgatcgtgctgtagatataaatcggagtctcatcctcaacattctggattgctcccggcacttcaatgatttgatgcttactcatcacatataaagcttctttccactcacccatcgtaagcttataattaatcagattcgtattctttccatattcacgaatctccgccagattcgtcactgtagctttcaagccttctcctaaaatcttatctctgtaaattaatttaacaagtaagattacttttgtaacagtggcatttatcttttctatcgcgattccatctccatgtaaacggtaaatgtgttcctgtgggtcatgcactaattcacagtttaaaacagacagatagtcttcaataaactttctgtgtcttgtacagatctcataatgcagattgtctcttgggacaagtgttacaggatcatacttcatctgtaaaatacatgtctgtctgaataatgcagcaattgttttcttcaggttatcagcttctgtcactgacaattcttccatataattaaccatctgattctactccctctatcgtaagttttgaaaatcggaaaccagcctcattctccatctcctgcgccacttcaatctgtgccttactgtccgcagattctgttgcatgctgccataccataaataacttctccaaatcttctattgattttacagtatcttttgtcactgtgaattttccattctgttcatttttctttcggaaatctctgatctctttctgcgtatacagtggttccaggacaaattctgtcatattctcttcctgtgatttctcaggtgttaccgcctgtggagtgaacttttccttctgattttcacgtctttgatacagactcttctctgtcataatcttatatggctccgaaaacctaagttttgaagacaacttatccagaatctcttccgacttgccactttcattgatcagattaatcagtgcgactgtctgatcttcttccattacaccttccatcataatgtaccggattcttgctgcggcacggcttgcaaatactgtcttttgttcaatcagcttattatatcttcgctcaatcgcatcaaactctctcgaaatcttatagagcatatctgtcgcctcttcacagatctcgatcattcttcgcagacggtaagattttctcgtattttcttcttcacttaagagttctgtttcaaatgagtattttcttgcttctgtcttttccagattttcttcgatcaactcttttacagcttctttgtatcgataaaagctgtctgttgtagtcaatatcgcatattttttgctatcactgttattgatctctttcacaagtacttcctggattcctcggaaacttctctgctttgacagttcatcgaagtaacctcgcattccctcctgcatgttcgcgagcatctgcagaagtgctcttgatgtatgaagcgcactttttaaaatctcattattcttctctttgtctaaactgtaggtatagagatgactgtataccgtaagcacactctctcgttccttaccgtcattttcactgtataatttctgaaataattctacaaacagctgactgtattccggaaatgaaacgacataactgttcaacgtttcatcataatcccttctaagccatccccagtcttcaaaatgcttcagactgactgatgccatgttggctctggtgatcagctctccttcttcatcgactcttgcctcactccagtccagtgccatcttcgccagtcgttcattcatgatcatctgacactctcgttccgtaagcccgagaagagaataagactgactgctctcctcataaagcgctaccagaaactgcatatagaattccatatatttacttccaaatattttatatagatcctttggaactttttcgaccagtttcatgttttttcttatgtctcctttttattcctattaaagtttcttttacatctttttcatttcttataacatcttctctgcttcaaaaaactgagaaaaatgtgcaatgaccggacattttcccttctctgtctgaagccactcaatctcattcacattttccttcggccgatacaagatcaccggcattcctatattctgtgctcctgttacatcatgtgcgatgctgtctccgataaagatactttcttccgccatcactcctgctttttcaacacagagatcaaaaagttttcgatgcggtttttcctcgccagcctcttcacttgtcacaattccatcaatatacttacctaatccaagctttaatatcttccgatactggacgtctgaagtcatattggatcctataccgatataaatgcctcgctgtttcaattctttcatcaactcttcaattccaggagatggaataatctgatcgatcaatgtatcccagtacagattatacatctcatacgcatatgggaaaactggctttccaagtgtctccagcatacactgaaatctcaccaggcgattatggttcaccgcataatctcttccggctctgtcatctgccttcactctcgcttcggcaacatatttctccaagtcttcttttgctatacctaagttctcatatgcccattctttcatcaccggcatcgtattattatgcgctccaatataatcataaatggtgtcatctatatcaaaaaatactgcttttgtcatccctatgtctcctgtttttttgctactgtcttgattgatgttttgcatcttctgcgcatctctgcaatcctgccggaggctatatcagatgggagtcatctcacatctgatataccctggcacatttttgcctcatttcattataacatgttttcatcaaagaaaaagagtttcgcaaatgacttttcctctccatctgcgaaactcttaatattgatcatcagctcttactctgacttttcttctgccaccgtttcttgtgactgtatttctgttgcctgtgtttccggctctttttctgtttccggttctttcactgtttctggctctgctgcttgtgtctctgtcggcttcatcaggattcttccggactcctgctcttctttcttttctccatctgcttcttccggttcagggattcccttcacttcacggaagatcttcatgaattccttacctgtgatcgtctctttctcgatcaggaaggctgcaatcttatcaagagcatctctgttcgcactcaagaggcgttttgcttcttcataggaagctttgagcatcttcatgatctcttcatcgatctccgctgctgtcgcttctccacagttacgaactgcacgaccgtctaagtaacggctctgaacagattcaagtcccatcagaccaaagcgctctgacataccatactgtgtgatcattgctctggcgatcttcgttgcctgctcgatatcgttcgatgcacctgtcgtaacagtgtcaaatacaatctcttctgctgcacgtccaccgagtgcaacaacgatcattgcttcaagttctttcttcgtatttaaaaacttctcttcctccggtgtctgcattacataaccgagtgctcccattgttctaggaacgattgtgatcttctgtaccggttctgtattcttctgaagtgctgtgacaagcgcatgtccaacctcatgataagatacgattcttcgctcttctgcactcatgatacggtctttcttctctttacctacaagtacaacttccactgcctcaaagaggtctttctggctgacaacctgtctgccatgcttaactgcagtgattgcagcctcattgatcatattggcaagatctgatccaactgctcctgaagttgcaagcgcgatctcttccagattgactgtctcatccatcttaacatccttcgcatgaaccttaagaatctcgacacgacctttcagatccggcttatctactatgatacggcgatcgaaacgtcccggtctcaacagcgccggatcaagtacctccggacggtttgttgctgcaagaacaagtagtcccttattcgtatcgaatccatccatctctgcaagaagctggtttaatgtctgctcacgctcgtcattaccgccaccgccaagtgcgctgtcacggctcttaccgattgcatcgatctcatcgataaatacaatacatggagccatctgctgtgcctgtttgaacaggtcacgcacacgggaagcacctacaccgacatacatctctacgaatgcagatcctgacaaggagaagaacggaaccttcgcctctcctgcaactgctttcgcaagaagtgtcttacctgttcccggaggtcctacaagaagtgctcccttcggaagcttcgctccgatacctgtatattttccaggattatgcaggaaatcaacaacttcctgcaaggactccttcgcttcatcttcacctgcaacatctaagaatgtcacacctgtctgcttctccatatacatcttggcattgctcttgccgattcccatcatgccgccgcccttagacatcttcttcataaggaaattaaacatgaatacaagaagtacgatcggaaggatcactgtgatgaagatatccatgatcagtgaacttgccgtatccggaatctgggatttaaactctacccctgccttatctaaacgctttacaagtgtgtcatctgatacatttcctgtgtaataatccggttccttgctcttggagctaccctgcatctgactgatctgaccaagcagactgtccataacattttcctgatcttcgctttccttagaatctgaactatcactctggtctgcagaagctttctcattatcctttacttctgtaagttttccctctgccttttcctttctggcatcatctgtcaaaacgatattgatccttgaattggtaaatgtgacagactctacttttccattatcaactaatttcagaaatttatcatagctgatctcagaagcgcttccgccctgcatcatagaatataggcccataacaacaaaagtaaccaacaaggtagtgaacaaaataattccccaaccctgtcggttcttgttcgggcctttgtttttattgttattctccatttttttcctccaaaacttaaatagtggttattttccagcaaatcttttaccttatttgtaaaaaaacaactacttcctaccattataaatagtggttttccataaatcaataaaaagattatgaaaatattgtaaaaacgtgccgtttcatagtatactagaaaagtaatgcctgtttataacagatttatctgttaataatagtaataacagttcggcaaaatttatagtaaggaagataaaacgatgaaaattggatttgataatgacaaatatctgaaaatgcagtccgaacatatccgcgagcgtatcggaaaattcggtggcaaactctatcttgaattcggtggaaagctttttgatgactatcatgcttcccgtgtacttccgggatttgaacctgacagcaagctgcgtctcttaaaggaactcagcgaccaggctgaaatcgtctttgcaatcagtgcaaaagacattgaaaagaataagattcgtggggatcttggtatcacttatgattcagacgtaatccgcctgatcggtacttaccgtgagcagggacttttcgttggaagtgtagtaatcacacagttctccggacaggaaagtgcacttctgttcaaaaaccgtcttgagaaccttggaatctctgtatacattcattacaacattccgggatatccgtccaacattccactgattgtcagtgagaacggttatggaaagaacgattatatcgagacttcacatccgcttgttattgtaacagctccgggacctggaagtggaaagatggctgtctgcctgtctcagttatatcaggagcaccagcgcggaatcgaagccggatatgcgaagttcgagacattccctatctggaatctgccgctgaagcacccggtaaacctcgcttatgaggctgctacagctgaccttaacgatgtaaatatgatcgacccatatcatcttgaagcttatggtgtgacaactgtaaactacaaccgtgacgtagagatcttccctgttttaaatacaatcttcgagaagatctacggttccagtccatacaaatcacctacagacatgggggtaaatatggccggaaattgtatctgtgatgatgaagcctgctgtgaagcttcccgccaggagatcatccgacgctactatgcagcactcaatgcgcttctgaaaggtgatgcttctgagaaggaagctgagaagatcgagcttcttatgaatatggaaggaatcactgtttctgaccgaaaagttgctgtcaaagcactggagcgtgctcagcagacaggcggacctgctgccgcactggagcttgaagatggacgcatcatcaccggaaaaacttccaacctgctcggtgcgagcgctgcccttcttgtaaacgtactgaaggaacttgccggcatcgaccacaatgtccatatcatctctccggaagcaattgaaccgatccagaaattgaaagtggattacctgaacagcaagaaccctcgtcttcacacagacgagatcctgattgcactttccgcaagtgctgctgtcaatccgatcgctgagcttgcactctcccagcttccaaaactgaaaggatgccaggctcatacttccgtaatgctttcaagtgttgatatcaagacatttaaaaaacttggtgtacagctcacaagtgaagctgtgaacgaacgtcagattttaagctaaagacaaatccttaccaatacagaaagatatcacaaaaacctctctgcagtttcaggtataaccacctgctgtctgagaggtttttttctgtatttctcccattttacaaagcttttttgccttcacttctttacattacttcgtcaaaatcacttcatcccatcttttttctatgtttttatcaaaaaagtattgtaatttttttctgaataggtgtatacttggaaagtattttttttgataacaactattcacggaggaggaaagacactatggcagtaaaatatgtatttgttacaggcggagttgtatccggtcttggaaaaggaattacagctgcatctttgggacgacttttgaaagcgcgtggttacactgtaactatgcagaaattcgatccttacatcaatattgacccaggtacgatgaacccggtacagcacggagaagtttttgttacagatgacggtgcagaaactgaccttgaccttggtcattacgaaagatttatcgatgaaagcctgacaaagaattccaatgttacaacaggaaagatctattggtccgttcttcagaaagaacgccgcggagatttcggcggaggaactgttcaggtaatccctcatattacaaatgagatcaagagccgtttctaccgtaatccggctgcaacagatactgagattgctatcattgaggtcggtggaactgttggtgatattgaaagccagcctttccttgaatccatccgtcagtttcagcatgaacgcggagcagaaaatgttatcctgatccatgttacgctgattccttatttaagagcatctcaggaaatgaagacaaaaccgacacaggcaagtgtaaaagaacttcagggaatgggaatccagccggatatcattgtctgccgttccgaatatccactggatgatgcaatgagaaacaaaatttctctgttctgtaatctcccggctgaccatgtacttcagaacctggacgtagaatatctctacgaggcaccacttgccatggagaaagaacatctggcacaggttgtatgcgagtctctgcatcttgactgcccggaaccggatcttacagactggactgagatggttgaaaaccttcgtcatccaacacaggaagtgactgtagcactggttggaaaatatatccagcttcatgacgcatacatcagtgttgtagaagcgttaaagcacggaggaatttacacacacacaacagtaaatatcaaatggatcgattccgaaactgtaacagaagaaaatgctgaagaactcttctctgacgtaagcggtattcttgttcctggtggatttggccatcgtggtgtagaaggtaagatcacagcgatcaaatacgcccgtacacacaacgttccgttccttggtctctgccttggtatgcagctgtctatcgttgaatttgcaagaaatgtcatcggttacaaagacgcacacagcatggaactcaatccagatacaactcatccggtcatccacatcatgtccgatcagattggtattgaagatattggtggtactttaagacttggttcttatccatgtgtacttaaagacaactcccttgcttataaactgtatggaaagaaagagattgaagagcgtcatcgtcatcgttatgaagtaaacaatgactaccgtgaagttcttgaagaaaacggaatgtccctttgcggactttcaccggacagccgtattgtagagatggttgagattccttctcatccatggtttatcgcaactcaggcgcatccggagctgaaatccagaccaaacagaccgcatccactgttcaagggattcgttgaagctgcactggagaatcagaaagagaaaaataaatagcaaaattttaaaagtcacactctaaagtggactcaaaaaaggatttgatcgtatctggcaaaacccagatgaatcaaatcctttttctatctgacgacaggttcttaaattcctgtccttcacttattatcagcagatttctttttctctgctctctttttcatgatcagctcttcaatcttccatcctgcccagcccgagaataatccgacgatcaatccgccgagaacgtcggtcggataatgtacccctacatataatctcgataatgcgatcaaagtagccaataccattgccgcaattctccatttcttcggaaacacttccttgcacttgtagattgcaaatgctgatgcaaaggatgcacatgtatgaccggaagggaaagaaaaatccttctgtttctcaatcataagttctaattcctgtatcacttcatacggccttactctggcaaccacattctttatcgccacatttgtgatcagtgttcctataataagtgcaagcgctgatgcaagccctgccttcctcgtcttcttaggaatcagcagaacgattgtaagaagaatccaaaaaattccaaagtctccaagatgtgtgactcctttccagaaccagtccatccagtcatgacggatatattcctgaataaaaagcagaatgttctgatctaattgtaaaatagcgtccatttctttttgtcacctctttcaaatcatttgtagcttctcaagttgtcgcggcagtcgccaaggtctcgtgcaagcacggactttggctcgttgctcgcgttcaatcagttcaccatgtcacttttattttgtgttatactgttttatataattttcttgcccttgtttttgcccttatcagagttcgtaaacactggtgggacgatataacgcaagggaaacaataagggaaagctcacctgcgataaactttgtgttttcaagggattgagagatatttgataataaaatataacagttattaaatcccttggaatatatgaaatctcaattcaagtttgtagaattcaaaaatttaatatgaaatgtgagatagagcgtatggaaattaactatacgttctattttttttccttttttgaaaagtgattaaaaaactattgacattttgttactggtgtccacacaaagcacttcctatattagaaaaaatagtgtatacttaacaagtacatacgttcgaaaaaggagtgcaatatgagcaaacagaaatttaaaaccatattatgtggatgtataacggccctttgtcttcttttgacatcctgcggttcactgcagatatcacaaggatcaggcaatcaggattctgaccgcggaaatcaaacgacaacagaaacgacattcgcatcgacagggaacatagaatctgtagatacgctggaagaagtaccggagtatacaggacagccatacgtggagatcaatgataatgagccaacatttacagaagatgagctgacgacagattcttacgaagaatacagcccgttagatgaactgggaagatgtcagacagcggaagcctgtgtaggtgaagatttgatgccgacacagaaaagagaaagcatcagtagtgtgaagccaacaggctgggtgaataaggaatatgacggaattgacggtggatatctgtataaccgttgtcatctgattgggttccagctgaccggtgagaatgcgaatgagcgcaatctgataacaggaacccgttatatgaatgtagatggcatgcttccattcgaggatgaggtggcagattatgtcaaagaaacggataatcatgtgatgtatcgtgtcactccaatctatagcggtgatgacctggtggcttccggagtccagatggaggcgaagtctgtggaagatgatggcgcaggggtaacatttaacgtatacgtatataatgtacagccatatgttgtgatcaattatgagacaggagagagttatcagacggaagaactcgcaacgccggaaggtgagtgggctccaggaacagaagctgaagtgactgatggaaatgtatccaattcatcaaaaacatcaaattcaaccaaaaaagaaacttatatattgaataggaatacaaaaaagtttcataaatcaacttgttctggtgtgaaggacatcaaagcagagaacaaagaagagtatacaggaagtaggtcggatttgattaaagaaggatatgagccttgtggtagatgcaagccgtaagagttatgagaagagttatgagaagagttatgagattagaaatggttgttggtcgcacgaagtgagaacagcaaccgctaatgtgtaagcacatgtggtctcagacctttttgttatagagattattatagaaaatataatatcaacatataacagatagttccgcctgcaatggatagaaacatatttttcttccatatatgaagtactgcggtgacaagaatggagattccttccggaattccatgagttccgtgcagtacttctacatttttcagacaatagataactaacattccgaaaacagcagaaggaagaaatttaccaagatactggatatattccggtgtctttttattttctttaaaaataaggaaaggaagatagcgcgttgccattgttccaagtatgcacattccgattgtaattatctgttgtgccaaagtcatgctactcatttggtcggctcctccttttctttaagtttgtcgcattgttccagccactttcgaagtactgtcagtagaagtacaatcagtatcattgtcggaatcataaaggaatccgctccgaagaggatcagacatacaagcgaaaccaggattccaatcatagaagaaacatggattttttctttcatccactgatccaggaaaattacaacgaacatagctgtcatgacaaaactgattcctgatgtgtcgaatttaagaagagaaccaatgattccaccaatcgttgcggaagcaacccaatagaactgattcaataatgtaacaaaaaaataaaaccatccgcggtctacatcttcgggaatctcagaggtgtaattgacagagaaggtctcatcacacattccgaaaatcagataatacttcttccatccaagtcctttgaatttatctaacatggaaagtccatagaaaagatgtctggcctggatcatcacagccatgatcagtacctgaacaggtgcaaatggactaagcagcatttcaacacagacaaattccagtgatccgccgaaaatcaacatactcatgaaaaatgggtagataaaagaaaaaccagatgcattcatatatattccataagccattccaagaaaaatgaacccagtcataatagggattgttcgtggaaaggctgcctttagtgctctacgtttcataattttattatagtacctcctgatatagttcagaattatagcatgataggcttgatttgtgttaatgtctttcggattgtacaattttttttgaaaaaagtgtttacaaaccacataaaactatctataatacaaatagaaaccacaagaaaacaatagtaaagaagaaataaaccacacaaaacaacattatggtaaatgagtaaaaacaggaggagtagaataatatgaagattttagatgcgaagtttgtacaggattttattaaaatggcaaatgacggattccttcagggatggcatgagagaaatggtggtaatttaagttatcgtctgaaaccagaagaggttgagctgatcagaccacgtctgaatgaatcaggagaatggacagagatcggaacagaggttccgggacttgcaggagaattcttccttgtaacaggaagtggaaagtatttcagaaatattatcgttgatcctgaagtatgtcttgcaattatcgagattgattatacaggaacaaaatacagaatccgttggggtctggtagaaggtggaagaccgacaagtgagcttccaactcatctgatgaatcatgaagtgaagaagagaatcacaaatggaaaacatcgtgtaatctaccatgcacatacaacaaatacaatcgcactgacattcgttcttcctttggatgatcaggtatttacaagagaactttgggagtcagcaacagagtgtccggtcgtattcccggacggagttggagttgtaggctggatggttccgggcggaagagcaatcgcagagaagacagctgaactgatggagaaatacgatgttgctatctgggcacatcatggaatgttctgttcaggagaagacttcgatcttacattcggtcttatgcatacagtagagaagtcagcagagatccttgtgaagattctttctatgacaccaagaaagattcagacaatcacaccggagaacttccgcgaactggcacatgactttaatgtaacacttccagaagagttcttgtatgaaaaaaagaaataattaaatttctaagaaaataataaaacgtatcaaatcgaccggatattcgagagtgataattgaaatccagtcagtttgatgcgtttttttataaccatttcttaaaagtgcgtgctataataaaacaggttggaaattctatagacgatcagaaaagcgaaaggaatggataaagtagatcaatgttatatacaatcccggattattatcatgaatttagctgtgttgcaggaaaatgtgaggatacttgttgtgccggatggcagatcgttgcagatgaagcttcattagagaaatataaaaatgagacaggtacatttgcagagcgtttgaaagaatctgtcaactgggaagaaggaacattcaagcaggataaagaaagaagatgtgctttcctgaatcaatcaaacctctgtgatatgtataccgcactgggagaagagagcctgtgcagaacctgtaaattgtatccaagacatatcgaagaatttgaagatgtgcgggaggttacactttctgtatcctgtccggaagtggcgagaatcctgatgaataaaaaagaaccggtacattttcttacttatgaaacagatgaggaagaagattatgaagattttgatccgtttttatattcgaaactgttagatgcaagagatgtgatgattgagattttacaggacagagagaaaaagctgaatctgcgagcagctcttattctggcgattgcacgtgatctgcaggaatgtattgacgaagaagatatattctcgatggatgctgtatttgattactatcaggctgaagaaggtgtgcgggaagtgaaaaatgctcttgcagaagtggattactatacatataataggaagatgtttcaaaatcagtatcagatggaacatttaagaacggattgggagtcttatcttcaagaggcagagaaactattatatagaaatgtaaaagaaaaaatagacaaaaaacggtatgttgagatgatacaagaatttcatgcctggatggcgaaagaaatgccggaatatgaaatacagtatgaacagctccttgtatatttcatcagtacctatttttgcggtgcagtatacgatggtgaagcatttgcaaaagcacagatggctgttgtcagcaccctgttgatccatgaacttctgatggcacagtggatgaagcaagaaaaagtgctagatataaatgatgtgatagatacggtgtatcgttattcaagagaactggaacattctgattcgaaccttaatttaatacaagaattgctgcaagaaagtaacgaatagatgggagaaattcttgacagtgtttttttaacatgttatgctatagtcgattttgagagacgaagatgcagagtaacagacagagtcttttcaaagcaattgtttcggaccacccagtgaggttaaggccatacggacagccgggtccactgccgattatggtaactttggttgccttattgattgagtgaaaagctctaattttataagtaggtttctttgatagccttatgcgccagacgcgcagacttgtgaaacggtcaataagagtagtaaaagtataattgctatatagactctgacacgcatgatccagaagttttatttaaaaatctaagagaagatattgccttttctgttacagctgagaataaaacagacgaatatataccgaacgcaggtttgtggcttagcgcccttatctgcgttttttctgtattaagaaagtgttttgacaaaggaacctggaaagagaggaaatatgaaagggagtcgttttaaattaaaccagaatcatgcaccgatccatgaggctctggagactttccggcgaatgagagttgtgccatttgatgtccctggtcataaacggggaagaggaaatccggagctgacagaatttctcggacaaaaatgtgtaggcgtcgatgtcaacagtatgaaaccactggacaatctctgccatccggtatctgtaatacgggaagcagaagaactggcagcagatgcctttggagcagcacatgcatttttaatggtagggggcacgacaagttctgtacagacaatggttctgactgcctgcaagcgtggagatgagatcatattgccacgtaatgttcacagaagtgtgttgaatgcacttgttttatgtggtgcgatccctgtttatgtaaatccggaggtagaccagcggcttgggatttccctgggaatgcagagagaacaggtagcaaaagcgataaaagagcatccaaaggcagttgcagtgttagtaaataatccgacttactatggaatatgcagtgatctgcgagcaattgtcaagatggcacatgaggcaggaatgatgtgtctggtagacgaagcgcatggaacacatttttatttcggtggcggacttcctgtttcagctatggaggcaggtgcagacatggcgtctgtatccatgcacaaaagcggaggcagtcttacacagtcgagtctgcttcttacaggtccggacgtacatgccgggtatgtgcggcagatcatcaatctgacacagacaacatcaggaagctatcttctgatgtcgagtcttgacatttcaagaaggaatcttgcacagcgtggccgtcagattttccatcaggtagcagatatggcagaatatgccagagaagaaatcaatgcaatcggtggttattatgcatttggaaaagaactggtaaatggaaattctgtttttgattttgatattacaaaattaagtgtacatacgttagatatcggactcgcaggaattgaagtttatgatattctgcgtgatgaatacgacattcagattgaatttggagatatcggaaatattcttgcctacctttcgatcggagatcgcgcacaggaagtagaacggcttgtgagtgcacttgcagagatccgcagacgttttcagacagacggaacaggacttctgagtcaggaatatattgatcctcaggtagtgaccagcccacaggatgctttttatgcagataagtgcagtctgccactcagggaaacagaaggtatggtctgtagtgaatttgtgatgtgttatccgcctggaattccgatccttgcgcctggggaacgcattacagcagaaattctggattatatcgagtatgcaaaagcgaagggttgtaatatgaccggaccggaagatccggatattttgaaactgaatgttctgacagggaggtaataacaatggaaatgtggttttcagaattccatacaccggatgtgaaacacagtatccgggtaaaccgtcagctcttttccagacagagtgattatcagagaattgatatttttgagacaccggaatttggccgtgttctgactctggacggaaatgtaatgctgacagaacgtgacgaatttatttatgacgagatgatcacgcatgtgccgatggcgattcataaagaagcaaaagagattatggtgattggtgccggagatggcggcgttgtccgtgagctgaccagatacgacagggtcaggcacattgatctggtagaaatggatccgatggtagttgaggcatgtcgtgcatatcttccggaaaatgcatgcagactggatgacagaagagtacatcttcattacgaaaatgcactccgttttatccgaagatgcgaggcaaaatatgatctcattatcgtggattcctcggatccgtttggcccatcggaaggattgtttacccgcgaattttatgggaattgttacaatgcgctgaaagaggatggaatcatggtcaatcagcagggaagtccattctacgcagaagatgcacatgcaatgcagcgaagccataaaagaattgccagtacatttcagatcagtcgtgtttatcaggcacatatcccaacctttgccgcaggttactggttgtttggatttgccagcaaaaaatatcatcccgtagatgatctggacgcagaagcatggaatgcattaaatcttcgtacacgttactatacaacaagactccataaaggagcattttaccttccggcatttctggaagatatgctgaaagaagtggaggaataattcatgattttaccgaatatagaaacttttatcggatgcgaaagcagctttgaggaagcatcgattgtcctttatggtgcgccatttgattcaacgacaagttttcgtccgggtgcaagattcggtccggcagctatgcgtcatgagagtttcggacttgaaacttacagtccatatcaggacagagaccttatggatatcagtgtatttgacagcggggatctggaactttgctttggaagcagtgaaatggcgctttcggatattcaaaagagagcagaagaaatattgaaagcagataaatttccattgcttctgggaggagaacatctggtgacgctggcagcagtacgcgctgtagctgcgaaatatccggatctacatatcatccattttgatgcacatgcagatttaagggatgattatctgggagccagattgagtcatgcatgcgttctgcgaagatgccatgatcttctgggagacggacgtattcatcagttctgtatccgaagcggagagagagaagaatttagatttgccgcgcagcatacagatttccatccactttcttttgacggactggaagagactgtaagagaattgaaagagaaaaatgtaccaatttattttacaattgatctggattgtctggatccggcagtatttccgggaacagggactccggaggctgggggagtaactttcttagagcttcttaaagccatccgtacagttgcacaggcaaatgtagtaggagcggatgtgaatgaacttgcccctatgctggatgcaagtggtgtctcaaccgcaacagcatgtaaggttcttcgtgaactgcttctggcaattgcaaaataaaccggcaacttataagagagcaattataaatatacaactgttgaagaaaaggagaagagttatgagcagagtacttgtaatcggctgcggaggagtggccagtgtagcaattcagaaatgttgtcaggcagatgaggtcttcacagaactctgtatcgcaagtcgtacaaaggaaaaatgtgatgcacttgcagaaaagctgaaaggaaagacaaaaacagttcttacgacagctaaggttgatgcagacgatgtggatcagctgatcgaactgatcaatgattacaaaccggatctggtaatgaacattgcgcttccatatcaggatctgacgattatggatgcgtgtctggcatgtggcgtaaactatatggatacagcaaactacgagccggaagatacagatgatccgaagtggcgtgcaatttacgaaaaacgctgtaaagaagaaggattttcagcatattttgattattcctggcagtgggcataccgcaaaaaatttgaagatgcaggtcttacagcactgcttggatgcggatttgacccgggtgtcacacaggcatattgtgcatatgcattaaaacatgaatttgatcagattgataccattgatattctggactgcaatggcggtgatcatggatatgcatttgcgacaaactttaatccggaaatcaatcttcgtgaagtaagtgcaccgggaagttactgggaaaatggacattgggtagaaatcccgccgatggatattaagagagaatacaactttgatcaggtcggagacaaggacatgtatctgcttcaccatgaggaaatagagtctcttgcaaaaacaattccaggtgtgaaacgtattcgtttctttatgacttttggacaaagctatctggatcatatgcgttgtcttgaggatgtgggaatgctttctacaacaccgatccagtataatggacaggaaatcgttccgatccagttcctgaaagaacttcttccggatccggcaagtcttggtccacgcacaaaaggaaaaacaaatatcggctgtatttttaccggtgtaaaagatggaaaagagaagacttactatatctataacgtatgcgatcatcaggaatgctaccatgaggttggaagccaggcaatcagttatacaacaggtgttccggcaatgtgcggagcattgatgatgctgactggaaaatggatcagaccgggtgtatatactgtagaagaatttgatccggatccgttcctggacgcacttgaccgttatggtctgccgcgcagtgaaaatcatgatccgaagttggtagactgatggaaagattagataaaagagcaccatttacagccaccggcggaattattccgccggaatttcagaacatcaaaacaccttgttatatactggatgaaaaagcacttacagaaaacgcaaaactgctcggtgaagtagcagaacggacaggatgtaagatgcttctggcacagaaagcattcagtaattatgattgttatcctttttttgaaccgtatctggcgggtacagaggccagtggattgtatgaggcaagattaggggcagaggaaatggcgggaaaagaagttcatgtattctgtgcaggttaccgggcggatgaattcgaggaacttcttcagtatgccgatcatattgtatttaattctccgtcccagcttcttcgctttggaagaagggcgaaagaggcaggaaaaagcgtgggactcaggatcaatccggaatgttctacccaggagggacatgagatttatgacccttgtgcaccgggaagccgcatgggtacaacaagagtacagtgggaggaagcaattgtgaagaatccggagttaatggaacttttggatggggttcatttccataccctctgtgagcaggactcggatgatctggagacaacccttgcttccgtaaagaaacagtttggcgatttgatcaccaaagtgaaatggattaattttggcggtggtcatcatattacaagaccgggatatgatattgggcgactggagcaatgcattcgaaaggcacaggaagaatggaaggttgaggtttatctggaaccgggagaagcatgggcattgaatgcaggatttcttctgaccagtgtgctggatgttctgaaaaatggagacacacagattgcaatcgtagatgccagcgcagcctgccatatgccggatgtactggaaatgccttatcgtccaccgcttcttggcgcatcggatgagacaacagatagtgggattacagtccgacttggaggtccaacctgcctgtccggggatgtgatcggagactataaattcagcaaactaccggaatacggagatctccttctgtttggagatatggctatttatacgacttgcaaaaacaatacatttaatgggatgccattaccggatatctggatcagacatgctgacagaaccatgcagcagctaacttcatttaattacacagattttaaagaaagattaggaagccgtgaatagcggcttcctaatacatttatctaacacatttcttgtttcacatcaacatccatacccaatatacaactccaagcgcccagctcgtcacaattccatacaggatcaccggtccggcaatcgtgaaaatcttacagccaataccaaaaacctggccctccttcttatattcaatcgcaggtgcagcaacagagttggcaaagccggtaatcggaacaagtgcaccggcaccgccccatttagcaagcagtggataaattccggtaccggtaagaaggatactcagaagaatgagcagaatagaagtccagctgctgcagtcatccggggaaagctttttcaattcacagaaatgataaatacattgtccgatcaggcagatcattccaccaaggaagaatgccttcaccatgttgaaccacacattgtgctgtggtgttttctttttgacataggcctcgtattgcttctgttgtttcaattgttctattttgtccataaatgaaaatcccttctttttgtttttaaattctacacatagtttttcacaaaatgaaaataatatccttaaaaataaataatgaaacatcagaaatgaggaaatgatatgaatgatacgggaaacaaaaaccgggcagttgaatcagagtgtggtccttttcatctgtcccagcttcgtggagtacagagcattgtattcacaaaagcaccttatcttctaagcgctgcatctgtggcaggaagcaaagaagcgcagggaccgcttggaaaatgctttgatctgacaaatgaggatgacctgtttggagcagagacatgggaggaagccgaaagcaatatgcagaaggaagcctgcgtactggcactgggaaagacacatgtggatccgaagtctgtgcgttatctctttggaggagatcttctcagacaagggattgcaacttctatgggcgttgaagatctgcagattcccatatttggtctgtacggtgcatgttccacatcaggagaagcactggcattagcagcaatgagtgtggcagcaggatacggagattacatgctggcagtaacatccagccatttcggaagtgcagagaaagaatttcgatttccgttaggatatgcgaaccagagaccactttccgcacactggaccgtgacagccagcggggctttccttgtaggaagccatctgaataaaatacattccgataagcaacgtcaaagaaagtcccagttccggcatattcggatcaccggcgttacgatagggaagattgtggactttggcttgaaggattcgcagaacatgggtgcatgtatggctccggctgcaactgataccatctaccgtaattttcaggatcttggacgtacacaggaagattacgatcagatcataacaggtgatcttggatatattggtcaatccatactttttgatctgatgaaaagcagaggatatgatatcagaaaaaagcatatggattgtggaatgactatcttcgatcaggagacacaggatacacatgccggcggaagcggctgtggatgcgcagcgtcaacactggcttcttatatcctgccaaagattgagaacggagaatggagaaggatactctttgtgccgaccggtgcattgatgtcaacggtcagcttcaatgaaggagcaagtgtgcctggaattgcgcatgcgattatgatcgaacactgttgaaaagccctattataataggaagaagtaaaaaatgtgctaagtgtgtgttaaaaaaagaaaaggaatagaaaaatggattatataaaagcatttttaatcggaggtctcatctgcgctgcagtgcagattcttctggacagaacaaagctgatgccgggacgggttatggtattactcgtctgtacaggcgcagtgcttggatttattggagcatacgaaccatttgtaaaattttcaggagcaggcgcaagcgttccacttctgggattcggaaatgtcctgtggaaaggtgtgaaggaagctgttgataaagacggattcctcggaatctttctgggagggttcaaggcaagtgccgccggaatcagcgcagcacttatttttggatacctggcttcattgatttttgaacccaaaatgaagaaataaacgagaaatcactataatgttacaaaatgttacaaggttcataaaaatatacatgaaaatatcttgacagtaaaagaaaaatgaaatatcattaattgagtattaaaggcaataagatacgacggaacaaggaggcacggcaggacagattttttatcccaggtgtctctttcattgtgtaaaaggatgagttaaagatgattgatatacatagccatatcttgcctggagttgatgatggagcgtcttcgatgaaagaaagtcttcatatgctttctatggcgagaagacagggaatcacagatgtgtttgcaacttcacattattccaaagcgtttccgaacagagatccggagaagctgagacggcttcgggatgagctgatgagccgtgcaaatcgtccggtgcaaggaccagagggaaaggtgaagtgcaaaagaccaattcgaatctggacaggtcaggagattttttattctaatagtgttatacgactgcttgaagagggaaaactgcttacgttggcagacagtaattacgtactggttgagtttatgccgtcagtgccttattcagagatatgtacagcggtgaggaatctgtcaagagcaggatatactccggtagttgctcatgcggagaggtatcgttgccttagaaaaggtaagcgtgtggaagaactgatcgatctggaagcattgatccagatgaattacagatccgtcagtggaggctggcatgatgcaacagcgcgctggtgtaaggataatctgaaaaaaaggaatatccattttatgggaactgatatgcacaatatcgggagcagaatgcctgatacaaaagaggcaatgggttggatgaggaagcatttagacagtacttacctcagacagataacaagagagaatgcacttcgcattacagaaaacaaaataataaaataaaggggagcaaagatgggaaagacgcatgatgacgacgaggtcgagattgacctcagagaactatactacgcattgaaaaagcgtgttttggtaatccttgcggccgtactggcgggagcagtgattgccggagcagcaacaaagctttttataacacctgtttacagtgcaacagctacaatgcttgttctcacaaaggaaacaacactttcttcactggctgatctgcagatcggtagtcagctgacgaaagactacaacatcctgatcacaagccgtacagtattgcaggacgtagtagatgaactgaatctggatatgacatataaagagttgatggaatgtatcacaatagagaatccaagtgatacacgtattctttccattacagcaatagacaaagatccagagatggcaaagaagattgctgacacgctggcgaagacatcagctgactttatcggagacaagatggaagtaacaccaccgaaagttattgaagaaggtgaagtgccgacaatccagacaagtccgagtacaaagaagaatgtgctgatcggagcactggctggtctgattctttccgcaggtattattatccttctcacactgatggatgatacaatcaagtcagaggaagatatcgagaactacctcggtctgacaacactggcaagtattccggatagaaaagactacattacaggaaaaggacctcgcaattcaagcaagacaacatcgaagaaaaagaagaaaaggaggaaaaaataaatggcaattcagagagttatattgacagattccagaaaagaagatgtcttctatgaagaggctattaaaaccctccgtacaaatatgcagttcagtggtgtagagacaaagagtattgttctcacaagctgttatccaaatgaaggaaaaagtgatgtggctttccagcttgcagtagagattggaaagatgggaaagagagttctgatcatagatgcagatattcgtaagcccagttatatcaaacgttaccagatcaaacagaagaccaatggactgtcacagtatttaagtggacaggttgctttggaagaaataatttattctaccaattaccgtaatcttgagattatcttttcaggtccgtatgctccgaacccgtcagagcttctggagcagggacgttttggcagattgatcgaagagacaagaaaagtttatgattatattttgattgatacaccaccgatcatcagtatgagtgatgcagcaatcgcagcaaaacaatgtgatggagcaatcctcgtaatcgagagcgaagcagtaagcagaagagatgcaatgaaagcaaaagaacagcttacaaagagtggatgtaagcttctcggtgcagtactgaataaagtggatatgaagaaagaaaaatactatagtaagtataattcatactactacggtaaaagcaaacaggaatagccggatatgcagtggagaatatccgctgcatatttcagtttacagagaaaaaacagacaaagcatttaagataaataaaatcagatgttttgttatgcagtcagacagaagattatcaggggaaaagggtgtacgcgaatgtataggaagaacagtaacggctggttgaagcactgggatttcattatactagatcttgttgcattacagctggcttatataagcagttatgtattgcgcatgggaacaagtgatctgtatcataacggattatatctgaatatcgggattattattatactgatagacatttgtacagctttctttacagagccatatcatgggatcatgagaagaggatattttgtagagtttaagaatgtattgaagcatgtgtttatcgtgagtgtgcttgtgatcgtatatctctttatgagcaaacagggaagcatgacctcacgtcttgtgattacatcatttgttccaatatcagttattttggtttatgcggtgcgaatcatatggaagaaatatttgctgaaacacggcaatatgctctattcaaaaataaatatgctccttgtttcaacaagtgatgaaatagattccatgttaagacgggtggaacagaatgtatttaatgaatttgatattgtcggaatcgtacttgcagaccgcgaaccggaagaaaatgaattgatcgaaggaattccggttgtaagtaagattgatacagtagctgaatacatacagacaagatgggttgatgcccttcttgttggaattaagaagaaaacattgataccggaagatttgtttgaaacatgtgtgaacatgggaattacagttcacgaatgtctggatgacagaacaggatggacaggaaatcagtttattaaccgcatgggtggatatacagtcctgacttccagcgtcagagtaatttcctcacgacaggctatgatgaagagaacgatagacatctgtggcggaatcgttggaatgattctgacaggtatcattacaatattccttgctccggcaatctatattgcttcaccggggccaatcttcttctctcagatgagagtaggaaaaaacggtaaattatttaaaatatataaattccgaagtatgtatatggatgcagaggaacgcaagaaagaactgatgaaacagaacgagatgaaggggctcatgttcaagatggagaatgacccaagaatcatcggaagcggaacggatggaagcaagcacggacttggctggtttatccgtaagacatctctggatgaattcccgcagttctggaatgtactcaaaggagatatgagtctcgtaggaacccgtccaccaacagtagatgagtggaaacagtatgagccatatcaccgcggaagacttgctgtaaaaccgggactgaccggaatgtggcaggtaagcggaagaagtgatatcactggctttgaggaagttgtaaagcttgatatggaatatgtcaagaactggaatatcggaatggatatcaaaattctgcttaagactgtcggagttgtgcttaagggcagtggatccaagtgatggaatggatggaagagataaggaaaatgatataagaatgatgatctgcagtggaaccgggaggggaaactgcaggtattattggtattgaacgtatagctataggtagaaataaacggagaggaaagactgggggcttgggagtggaatggagcttgttgagatgtttttctttttttgaggcattgaacgtatagctacaggaggaaaaaacaatgggtttagtggatatgaacaataaaacaattcttgtaacaggagcagctggatttatcggatctaatttagtcaaaagaatatgtgaagaaaatccatcagcaatcgtaataggtattgacaatatgaatgattattatgatgtagcactgaaagactttcgcttgaatgatctagctaagtatcccacatttacttttgtaaaaggaaatattgctgacaaagttttaatcacggaagtatttgaaaaatataaaccttctgtggttgtaaatcttgcagcacaggcaggtgtgcgttattccattactaatccggatgcctatgtggaatcaaacttagttggcttttttaatattctggaggcatgccgtcattcatatgacaatggagagaaaggagtagaacatttagtatatgcttcttcttccagtgtatatggaatgaataagaaagttccctatagtacagatgataaagtagataatcctatttctctttatgcagcaactaagaaatcaaatgaattgatggcgcactcatattctaaactgtataacatcccttcaacaggtctacgtttcttcactgtatatggtccggcaggacgtccggatatggcatattttggatttacaaacaaattagtgaagggagagacaatcaaaatctttaactatggtaattgtaaacgagattttacatatgttgatgacattgttgaaggtgtttttcgcgtgatgaaaaaagctcctgataaaaagaatggtgaggatggacttccaattccaccgtatgcagtttataacatcggaaatcaggatccggagaatcttttggattttgtacagattttaagcgaggagttagttcgtgcaaaggtattgccagaagattatgactttgaggctcataaggaacttgttcctatgcaaccaggggatgttccagtgacgtatgcggacacaagtgcactggaacgtgactttggatataaaccatctacaagtctgcgtgagggattacgtaagtttgctgagtggtatgcagagttttataaataagtaaataagaggaatagagaaatgagagaatttaatgatttgaaaattgctgttgcgggtactggttatgttggtctatctattgccacattactgtctcaacatcatgaggtgacagcggtagatatcattccggaaaaggttgaacttattaataacaagaaatccccgattcaggacgaatatattgaaaaatatttagcagagaaagaattgaatctgacagcaacattagatgcaaaggaagcatattctgatgcagatttcgttgttatcgcagctccaacaaattatgatagcaagaaaaacttttttgatacgagtgctgttgaagcggttatcaaattagttattgagtataatccagaggcgattatgattataaaatctacaataccagttggttataccgcaagtgtgagagaaaagtttcattgtgacaacattatttttagtccggaatttctgcgtgaaagtaaggcactttacgacaatctatatccgtctcgaataattgttggaacagatatggagaatgcacgtttggtaaaagcagcacatgtatttgcagaattacttcaggaaggtgcgataaaagaaaatatcgatacgttgtttatgggatttacagaggcagaagcggtcaaattgtttgctaatacttatttggctctgcgtgttagctatttcaatgagctggatacttatgctgagatgaaaggcttgaatacacaacagataatcaacggtgtttgtctcgatccacgtatcggaactcattacaataatccgtcttttggttacgggggttattgtcttccgaaagacaccaagcagttgttagcaaattatgcggatgtaccggagaatttgattgaagctattgttgaaagtaatagaacaagaaaagactttattgcagatcgtgttttggaaattgctggagcttatgaagctaatgatagttgggatgaaagcaaggaaaaagaagttgtggttggtgtttaccgtttgactatgaaaagtaatagcgataactttcgccagagttccattcagggtgttatgaaaaggattaaggcaaaaggtgcaacagttattgtatacgagccaacattgaaagatggagagaaattctttggttcagttgttgttaatgatttagatgagtttaagaaaaagagtcaggctattatcgcaaatcggtatgataagtgtctggatgatgtgaaggataaggtttatacacgcgatattttccagcgtgactaagaagtacacagaggggagatgcaggatggcaaaaaggaaactgctgatttatgcacattactacatacctgatactgcatccacaggccagattcttcgtgaactcgcagaaggcatgttggataagtttgatattacggtaatttgtgtggttcccagctatttaggaaccattgaagataaatataagacacagaaatattacgaagaagaaatcaatggcgtaaaagtcttaagaataagagtaccagagttcagcaagagcaacaagaagagccgtgtgaagaatattgtttcttatttctttggagcaatgggggcgacctttaaggttggcaagatggactatgtgttctccatttcccaacctccgatcctcggcggcctgttgggcgtttggggaaaatgggtaaaacacgccaagtacatttacaacattcaggacttcaaccctgagcaagtgctggcggttggctacaccaagagcaaatttatcaccgatgccatgatgtggtttgacaagttcagctgcaaaaaaagcgatttgatcatcacagttggccgagatctagtcgagactgtagagagacggttcaaaggcaaaaatgttccgaaaaccgtcatgatcaacaactggatcgatgaaagcgagatttatccgctggaatcggataatgagagagtagttgctttcaagaaaaagtacggtctggatggtaagttcgtcattatgtattctggtaatatcggtctttactatgaccttgagaatctgattaaggttgtagagcgattcaagccgggtaccaagactgcagatggccaagaggttgtatttgcttttgttggcgctggttctgtgctagacaaattggtgctgtatgtaaaacagcatcacatgaacaatgtggctttcattccataccaagataaggcagatcttatctatagtctgaacgctggtgacgttcactggtgtgtgaacgcaaacggcattaaaggagtaagttgtccgtcgaaggcatacggcataatggccgcttcgaagcccattttaggggtgctggagtcgggttcagaggttcgttgcttgattgaggatacacatggcggtctctgctgtgaaccgggtgagtatgacaaggttgaggaaaacatccgctggttcattgagaatgccggagatagcgagctgaaggcaatgggagctagaggccgtgagaatctggagaataatcttaccagaaatgtatcggtgagaaaatacgcagaagaaattctgaagttataaaggaggcaagaggtatgaacagtaactggtttaagctggttatgaagatgacaaaagttgaatatggaaggaacctcttgctgaagggtgttccaatcatcttcaacaaaggtggtgccaaactgaagattggcgagaacgtcacaatcaagagcagctttctgagtaatttagttggactttacagccggacaatcattgtcacgcgtgctccgggagcagagattgagattggtaataatgtgggaatttcgggtgctacgatttatgcccggaagaagattacgattggagagaacacctgcatcggtggcaactgcaagattctggataatgacttccacccaattgaggcagaaacgagaaacaagctgctccgtgacgaaaacggtggtaacagtgatttggtgccgagcagggaaatcaagatcggtaagaactgtttcatcgggtgcaatagcataattctgaaaggcacagtgctgggcgatggctgcgttgtcggtgctggtgctgtagtgtgtggaaagtttgaagataactgtgtgattgttggaaatccggcgaaggttattaagaggttgtgaggaaggagttattgtcatgccccagatattatggattggctgtttggaaagcgatgaggaatttaggattaaggcaaaaaaggggtatgatttagcatctgcacaggtatcccagaaaaacttgctttatggaattgaagaagtaagcggtgtcgagtgtgattctataaatggcagcgttcttccgccatatccagtatataaaaatagaataatcgaacctgtagaatgggaacacaaaccaggcacgaaggatataagtgttggatataagaatgataaatatatcaatcgtttgaattgtaaaaagtcaatgctgaaggctgctgatgagtggtgttcaacacgatataaaggcggtgaagtaattgtttttacatattcaatgcgttcagcaccgatggcaacagcctgccgtataaaggaaaaaattccacaggctaggatatatcttattgttacagatttgcctcaatttatggatttagggcaaagtcgtataaaggcgaccttgaagaaaatagattggaaaagcataaagaaaatgcaaaatgaatttgacggatttattctttatgctgagaagatggcagaatatttggctattccgaaggggaaatggactttgatggaaggtagctatgatgcgtcagaacaggttatcgcaaccgaagaaaagaagaaagcaataatgtattctggaaagttggatgagcagtatggaataaaattgcttttggatgcatttatgagtattccagacaaggatgtggagctgtggctgactggtggaggaaatgcggaaaggtacataaaggaatgtgcacagcaagattctcgtattaaattctttggctttttgccaagtcgacaggatgtattgaaaaaacaggcggaagcatctttgctagtgaatatgcggctgccttcagagctggcatcgggctattgctttccgtctaagttgtttgaatatatggcaacaggtacgccggtattgagttttgatattgctggtattccaagagaatacttacaatatttgctcattgtagaaaaggaaagcactgaagcactgcgagaaaagatgcagtctgtactaagactggatagaaaagaacttgaatgtttaggaagtagggcttcaacttttataaagacaaaaaaaaccaatagagttcaaagtgggagaatatggaattatgtcactaagcactaaattaaagaaaccatttacaattgttgtttgcacatataatggtgaaagatttttgaataggtgtttgactgcacttgagaaccttgatgagctacataatttgacagaaaagatatatgttgtagataataattcgagtgatggcacgccagagatagcaaaaaagttctgtgagcaagataatttgtttgaatatgtattcgaaaaaagacagggactgtcgtatgcacgaaagcaggcagtgaaagcatcaacggaatgggttgtttacgttgacgatgacaatgtgttggataagaattggctgatcgaattgaaaaagacaattgaaagccgtgaaggagtaggagttgtcaatggcgcagtgatagcgacaccagaacaggagctgaataaagagcaaaaagcaattctgcaggtgatgtatcgaaatttagcttgcacacattgcaaagaacctactagtgaggatgaacctaatacaattcctatgggggctggaatgtgtataaggactgatgcattaaaagaaattgaaagagaaggatggttaaaattaaaggggagagaaggaaaaaagctttcatcaggagaagacacagaactatgcgaacgagtttttgcacaaggctatagttatgtaagtaattacaaaatgaaattgtatcatattataccgcaaactcgattagaggaacaatatgtcattcgattgattgatggacttgtaaaaggacgagtggattttataaagtcaaaaaaattcggaaaagttaaatgtctattgcgaaaaatcaagtattttatggagatacaaattcaaaagaatgctttagatgcaaagaatctttcagttgaagaactatggaaacataaagtggctttgtaccaagcagaggcttttgtgaagagtctttaagggaggattaagatggcattttatatattactttttgtttttacagtagggatactgttttgcagtagaaaaaaaagtgcaactaggctgtcaattggtatattatgggcagtatatgcattccgtgatgatattggtgtcgatgatggaaactacattcaagttatagattatctcaaaagaggatgggggtatgatgttgaatggagttaccgaaaaatatgtgaattagctttaaaaatcggaatgaactataagttctgtttttttgtgtatggcacattgtctataattctgttatataaagcgcttgacattttttttgagggaaatttcaagaaaggaatatatcttgcctgcttctatggaacggtttttgtttcttctgtgactgttatgcgacaattcttagcagcatgtttttgcttttatgctattgcgttattatatagagataacaagctcactaaatcgttgattatgtgcgtactaggcgtggtgtttcattcgggagctatacttgcgataccgtttctttttattttacaaagaaattatgtggtcagttacgcaaaaaagataataatcatatttctatgtgtcgcttgtggctatttgggtgtgttgaatattcttatcaacatctttatgagattcattccaagttcctatcaaatgtatgcatcttcactcggacagagctatagtactgcaggcggaacattatcgtggttattattacttatgtttgcttttcaatgtgttgcatcagaacgagctggaataaaagtaccagaagataaattagataatgtaatggaaatgggacagttaatgtacctaggattactttttctgtttgttcgtgctggggtagcaagtagattggcatttacttttttgccgtttgttgctacggtaccaattacgtttataaagagaataagaaaggtgcagaggaaagttgtgattttcgtgcttgttgttgctatgttactgttgatgtgtatgacattaaatagtacagcagctataaggaatggtgtatttataccatacagaggatcatttgacttttggaaataagggaatcaatttatgagaatagtatttgtactagaaagacttggaaatggaggcgctgaacgagttacagcagcgcttgcaacggagtttgcaaataaatacggctatgaagtccatgtatttacatgtgttaaagaaaaagaagaatatgaattgcctgataatgtgaaacgccatgtaatgaaggctgggaaaaatcgaataggaacgcttaagaataaaagcacgtatttatcaaaagaaattggaaaagtaaatccagatatagtgtattctttggcaactccaaaaacaacaataatgctttgtatgctgtcagtacatagaaaattcactctaatagtgtcagaacgtaatgatccgaaccaatatcctcaaagtaatttgttgaagaaaatgcgaaatacagcttatgaaattgcagatggagtggtctttcaaacagaagatgcaaaaaaatattttaatgcaaaaattcagaaaaaaggctgcgtgatacccaatcctatatcatccaacttgatgtctccgtatcaaggtgtaagaaaaaagaaaattgttaatttttgtagattggaaccacaaaaaaatcttaagttgttgattgatgcgatgcttcgagtgcgtggaaaatttcctgaatatagtttggatatttatggcgatggtatacaaagaaaggaacttgaggattattgtgtaagtaaaaacgcgaatggttatgtcaattttaagggatttgaaagcagagtgcatgagaaaatcattgacgcagcgttgtatgtgtcatcttctgactatgaaggtatttctaattctatgttagaagctattgcactaggaatcccaacaataagtacagattgcccaattggtggagctaaaatggttattgaagatcatgttaatggcattttggttccagttaaggatgtggagcgactgtctcaagcgatgttggaagtacttggagatacagaactttcacaaaaaatgagtgtgaatggtattaaattacgagaaaaatttagtgttgaaaatattgcaaagaaatggattgactttgcaaaggagaatacaaaaaatgaaaaataggattgaagagataattgcgacaagaaatccaagacgatttaaatttttgtcggataagacatacttgtctattaaatttaagtatatcttcggacgaaaaattgattggaataatccgaaaacttttaatgaaaaattgcagtggttgaaagtttataatagaaaaccagaatatacaggattagttgataaatatgaagttaagaaacacatatcaaaggttctaagtgaacagtatgtcattccaacattgggaatttggaattcatttgatgaaattgactttgacgctttgccagatcaatttgttttaaagtgtacacatgatagtggtggtttggttgtatgtaaagataagaagaaacttgatatagaagaagcaagaagaaaaattaatcaaagtctacagaataattatttttatagtgggcgcgaatggccttacaaaaatgtaaaaccacgtattattgcagagcaatacatggcggataatctccgggattataaactgttctgttttgatggagttccacgcatgacacttgtatgtagtgaacgctttactaaggatggcttaaaagaggatttctatgacgaagcatggagtcatctggatgtacagaggccagctcatggcaatgctgttttgccaattcaacgtccgaaacagtatgaacttatgaagaaattggcagagaagctctctgataaaatgccttttgcaaggatagacttctatgagattgatgagaaagtatattttggtgaaattacgtttttccctgcgagtggatttgagaaatttaaaccggatgagtgggatttgaagttgggtgaatggattaagttgcctaccggggggtacaggctaaattctgaggtgtgctcaataattatttcaaactcttattataataacaaggttgaaaaatccattaatgattacaagttattttgctttgatggagagatagattctataatggtttgtactggacgtgaaaagggacatccggatttttatttttatgatgcaagttggaatcgcctgtattatcaacatagctatcttgaaaaaacaaatgatgttgaaaaaccacacaacttagatgaaatgttaaaaatagcaaagactctcagcaaaggattcagtcatattcgggtagatttatttgatgttgatgggaatgtatactttggtgaattaacattttttgatgatagtggatttgatactgatatttcatatgaaacagacctaaaatggggagaaaaaatcatacttcctaatagttaaaggaatttttaatatgagaggaaaacgactattttataatacattatcatcacttgtatttcaagtgacaactataatttgtggctttattttacctagattgattttaagtgcatttggctctgaagttaatggactggttaactctattacacagttcttgggtatcatttcatttttggaacttggagttggagctgtagttcaatcggcattatataagccgttggcggaaaaaagacaagatgatgttagtaagataatttcatcggcaaacaaattttttactagactcggacaaattttgctggcttatgtaattgcactggttgttgtgtatccaagatttgctggaaagaattttgggtttgcttatacagctactttgattgttgctatatcaattagctctttcgcccagtatttttttggtattgttaatagactgttattgacagccgatcagcgtggatatattcagtataatgcacagactttagcagttatatgtaatacagtggcctgttttgttttgattcaattgggttgtagtattcaaattgtaaaattgacaacatcgctgatatatttgctgcaaccatttgtcatttacctatatgtaagacagcattacagaatagacaaaaaaatcaaatacacaaaggagccaattccacaaaaatggaatggtattgcacagcatgtggcagcagttattcttgatggaaccgatacgattgttttgactttgtttgcaacattatctgatgtttcaatttattcggtttattttttggtcgtaaaaggcgtaaaacagctatttatgtctatgacgaatggtattacatctttaatcggtgagctgtgggcaaagcaggagttggaagagttaaataagacattctcgtggactgagtgggtaattcacacagggacgacatttgtttttgggttgactgcagttttgattgttccgtttgtaagagtatatacattgggtatccatgatgctaattatattcagccactttttgctgcattaattgtagcggcgaatgccggacattgtttgagactgccgtacaatattattattcttgcagcaggacattacaaacaaactcaaagaaattatatagtagcggctgttattaatatagtggtttcggttgtaactgtaaaagcgtggggattaattggtgttgcaattggtacgctggcagcaatgggatatcaaacgatttggatggctatatatgattctcggaatctgattaagtggccatttaagaattttatgaaacaaatatttgttgatgcgttaaccgtggctataggcttttttgcaacgaaaatgctgtcacttcatacagtaacatatatttcttgggtctttctggctgttaaaacatccgctgtttggggggctattgttctggtacttaattttatcttttatggcaacaaaattagtggtctgtttggaaaaataggaagcaaaataaggaaggggtgatattgtgcaagaatcaaaaagacttgaaacaataggcaacataaaagttttgatgattctagccgttgtcttgtatcattcttgtatgtttttttcgggtaattggtttgacggtgcgaaacctgtctatcaggcaccatatttatatattgtcgctcgttggctaaacgcattccgtgttcagacatttacaatgaatggcttcaggtttcttattttattgtttgtgtaaagaaaaaaagcgatataaacattgaacacattggtgtcaggcactattaaatttcagacaaagcattgtaagtacagtaaagaagtagaagaagtgttggaatagtctttagatattccgacacttcttctacttgcggattgacgaggaaggtacgctactggctgctgcatgtagtgagaacagcaacacaacatctgcgaataccagggcattaaaaaattcagcttgtaataatagaattctcatgttaatctaataccacgcagtcatcattctgatgaactacaaaaagatctatgaaccaaatcggtaattattcaataagctcagaattccgagtagataatccgatgacaaaaccaaaaagatgaatattgtttgaagattatgtgatggagtgagtttcgcgttattgtttctcaaatatctgattttaagggatagttacttccatagaaaactatcttgtgttaaccttggcgactgccgcgataacttgagaaactcgcggagcgtgtttctcatagttttcttatactctgcaagcctcaagatctttcatccatactgccacgcaggcatcacttggcattctccagtcccctctaggagaaagtgccacagtaccaaccttcggtccatccggcagacaggaacgcttgaactgctgagagaaaaatcttctacagaatgtttccagccatttaaaaatggtctctttgtcatattcaccatcaaatgtcatacatgcaatacggaagattttactcggctcatatccaaaacgaagcatgaaatacaggaagaaatcatgcagttcgtaaggtcctacaagatcttctgtcttctgcgcgatatctccgtccttcggcggtagaagctcaggacttaccggtgtatcaagtacatcgtaaagtacattcttaagagcttcgtcttttgtatcatccgcagcatattttacaagatggcgaaccagtgtcttcggtacagaagcattcactccgtacatggacatatgatctccattgtaagttgcccatccaagcgcaagctctgacagatcgcctgttccaataaccattccccaagtcttgtttgcgatatccatcagcacctgtgtacgctctcttgcctggcagttttcataagttacactgtgatcttccggatcatgtccgatgtcacggaaatgaacattcacggcatctgcgatcggaacctcgatcaaagttgctccgactttcttcgacatctcacaggcattctgataagttctgtctgttgtaccaaagcaaggcattgtcacggcaatgatatccttcttatctcttccaagcatgtcaaatgcgcgtgccgttacaagcagtgcaagtgtagaatccagacctccggaaatgccgacaacagcagttcttgcattcgtatgagccagacgtttcttcagtcccattgcctggatcgtcaggatctcctcacagcgctgtgcgcgggtctgttcatcagaaggaacgaacggctttttcggaaatgttcttgtcaaaaatgtctttgtctcttccacggtaaatggaacacgtaccagagtctcttcatccaatggctggaatgtcgtattctttcttctctcacctgtaattctctgaagatcgatctctgagtaaatgatttcatttacatatctactgctttctttcaggattgtcccattttcagcaatgatattgtgtccgccaaaaacaagatccgtagttgactccccttctccggcatttgcataaatgtatccagagatcaatcttgcagactgtccggagatcagtgcacgacggtaagtgtcttttccgatcgtctcatcacttgcggaacagttgacgatcactgttgcaccttcaagtgccgcctgaatactcggcggaaccggtgaccagacatcctcgcagatctcggctgccactaccagttcttccattccttctgcctggaagagaatctgcggaccgaatggaatcttctttccttcaaatgtaatctctctcactgtctgtggtcccggagtaaactggcgcatctcataaaattcaccatagtttggcaggaacgtctttgtcgtaaatccgatgatctcgccctggttcattgccgcagctacattgtaaagctttccattcacttcaagcggtgctccgacaaatacaagcatatctttgtcgtttgtattttctgcaatctcaagcaatgcttttctggaagctttcagaagtacgctgtggtcgaacagatcactacaggtgtatcctgtcacacaaagctccggaaacacaagaatcttcgcgccatttttctgtgcttcttccatagcattgatgatattctgtgtattgaattccacatccgcaacgcggatatccggtgtcgctgccgcaaccttcacaaatccatttttcatctcatcttcaccccatcttctatatttatatggtgtcagggcaaaagccccggcaatacttatcgagcctgttttaacaattctttcaattcatctactgtatacttatatgctgtattacagaaatgacacttcacttcaatctctttgccttcatcgatcatttcctgaatctctttctttccgatactgatgattgctttctcgattctcttcttagagcagttgcaatagaactgtgccggcattgtatctgtaatttccagatcaagtccttcaagaacctgctcaagcatctgctccggtgtatgtccgttatccagcatggatgttacagactggatcttctgaatgtttgcctccagcttattaagcacttcatcctcgataaaaggcattacctgaacgataaatccaccggcgcatttcactgtattatctttgttcatcagaactccaagtccgacagaagatggtacctgttcagatgttgcaaaataataagtaagatcctctgcgatctctcctgtctgcagaattgtctggcctgaatatggctccttgagtcccatatctttgatgatcgtcatgacaccctgtccaagtgctccaccgacatcaagctttccattcttcgccggaagcatcacatccggattaaatgcatatccttttacatttcccttactgtccgctgtcacagtcagaccttcgatctgaccggaacactgaatctggattgtcagcatgtctgtatcatttttcatcatgcttcccatcatcactccacctgtaaggagtcttcccagcgctgctgtcgcaaccggacttgttccgtgatgctctcttgcctcctcaaccaggtttgttgtcactgccgcaaatgcacggatctgtgcatttcctgctgttgctcttacaatataatcattcatgtcttattctcctcgtctttcttatctattcaagaattgtatccaattcatttcccggattctctggcaacgatatagattctctcactcttctctgtcggttcctcgtgtgtaactgcgtcatatgccgcctcaaaaacaagtcccgaacgttctaccagctctttcatctcttctaaggtataacctctctggtaatgtgtctcctgatatctccggtataaatcttcacttccatcttcctggataaacaatgtcaggtcatactcattaatccgttcttcttcataatagaaattatcccagataaaactgcattcccctctgtcttccgcgatcacagtatctcccatgacttctttatacttatatacagtattaaaatcaaacaaaaaaactcccttgggatctaggtagttgttcaccagacggaatacttcttccagttcctccggttctgtaatatagttgactgaatcacagacactgacaattgcccttactgttccatataattcgaactcacgcatatcctgaagcagataaagaatgtccttccctgactccatacgtttctccatcgcaagctccagcatatcttctgaattatccacaccgatcatgtcatatccataatccgcaagcttctctgtcattgttcctgtgccacagcccagatccaaaagaatgccatcctctattccacggtcttttaaaagactgtgaatgtattcgccccactcttcgtaaggtacattatccatgaaaatgtcgtagaccgccgcaaaccctgtataagcttccaactgttgacctccgttcttttctgtttctacataatccattatattttaccacaaattctcttttttgacatcaaacatttctacattctattgtatttctcaatttcctgtctctttttctagaaactcctatttttgtcaagaattttgaaactttttctcattttcgcctcttttttgttccaaaatctaccattttttataaaagttttacatttacaacatatttccataacatttttgcgttttattcttccttttagcactttaatatgctataatcataaagctgtgttaataaaaaattttttatattaacaaaaggcgccgctatctgttgtggggacagcaggatagcatagaaaacaaaagaaaggacattgaaaaaatggacaacaacaagaaagaattcaagccgtatattccagcggacaaagtcgttcctgagtttacggtaacagcactcttgattggtatccttctggcaatcgtatttggagctgctaacgcatacctcggacttctcgttggtatgacagtttccgcttccatcccggcagccgtaatttctatgggaatcattcgtgtgattctccgtaaggattctattctcgagaacaacatggtacagacaatcggttctgccggagagtctgttgcagcaggagctatcttcacacttcctgcattattcctttgggctgaagaaggaaagattgctttcccaagcatcctttccatcgctatgattgccctgtttggtggaatactcggagtatgcttcatggtaccgcttcgtcaggctcttatcgttgaagagcacggaacacttcctttcccagagggaactgcttgtgcagaagttcttctggccggagaagaaggtggatctaaggctggtacagtattcgcaggacttggtatcgcagccgtttacaaattctttgcagacggaatgcagctcttcccaagtgagattggacatgcattcaagaactacagcggagcacagattggtatgcaggttcttccggcacttggtggtgtaggatatatctgtggaccgaagatctccagctacatgttcgccggtggtacactcagctggttcgtactgatgccaatgatcgcactgttcggtggagatgctacaatcttccctgcatcagttacagtcaatgaattgctcactatgccaggtggtggtccgtccgctctgtggagtaactacatcaaatacatcggagcaggagctgttgcaactggtggtatcatcagtctgatcaagagccttcctctgatcgtaagaacatttaagcaggccattggaagtatgaaaaagaatgcaggatctggaaaacagcttcgtacagagcaggatcttccattcccattactgatcggagttatccttgtgatcgctgttctgatctggatccttccgatcttcccggttaacctggttggtgccctgatcatcgttgtattcggattcttctttgcaactgtatcttctcgtatggttggactgatcggatcttctaacaacccggtatcaggtatgacaatcgctactcttctctttgctacagtaatcctgaaagtaacaggtactacaggacttacaggtatggttggagccatctctatcggtggtatcatctgtatcgttgcagcaatcgcaggagatgcttctcaggacttaaagacaggattcatcgtaggtgctacaccttccaaacagcaggttggtgagatcatcggtgttgttgcttcttcagcagcaatcggattcgttctttaccttctgaatgaggcttggggatacggaacagaaaagattccggcagctcaggctacaatgatgaagatgctcgttgaaggtatcatgaatgaggaacttccatgggctatgatcctgatcggtgtatttattgcaatcgttgttgagatcctcaagatgccggttatgccattcgcagttggtatgtaccttccattctctctgagtgctggtatcatggctggtggtattgtacgtatcttcgttgagaagaaaaaaggtacagaggcagagaaaaaagcacgtacagacagaggtcttctctttacatccggtatgatcgccggagaaggtatcatcggtatccttcttgctgtatttgcagtagttaagattgattctaagatcattctgccattccacttaccacaggttggcagtctggtgctttacattgcattactcgtacttctgtacgttgtatgtatgaaagctgataaggaaaaataattcaatgaaaaagaaagacagtaaaaactatcttgactttatcccggagaagaatccggaaattgaatatgaaacaggtgaggacggtattattaccgtccttatcgaatggaagggattttatcacaagttggctcagcgcttcttccatcgtccccgtgtaagtgaaatcaagttagacaagcttggaacttttgtgtggaactccatcgatgataaaaaggatgtacatgcaatctccaaagagcttgaagcagagtttccttctatggaacagccgctgacaagactgatcaaataccttgagatccttcatgataatcacctgatctactggaaaggagagaaacggaaatgatgcatacgattctgaaatatcttccttatgtactgctctttgcagttgctacaatgattgtctacggatggggattgtggcgtacgatgagacagggaagcgatcttgctaatatgctcagttccaaaggaatctccaaagtcaaaaagacattgaagaaaaatggtcctatgacccgcacagctcttgaaccatatgtgaaagatctgacggcgaaacagccatttatgcaggaacaaatcaatgtgactaatccaagacaatttcttgattcaattcttccctatatggtaaagcaaaaaatgatcactgaggaaaaagtgaatgggaaaattgtatatcagatccgcaaggattgaaaacaaaaaggatatctgccagaagtaatgattactctgacagatatcctttttgtcttttcatctttttccacttttttctttctttttacaccaatttacacagatttatcgcatttttccttgacacgccccgctgcgtgggatacaataatctatggtaaaaacaacacaactacatcatttcggtaggtgaggttaccacagggattgggatatttgacatgcttaagcattcgataggacccggagattgctgccgcgagattgtggagacacgattagttggtcagcaggctgtgtcgagaaggcacaacctaatgcaattgatatgccctgtgatactaaagcttgaacgatgcattttataagaagtcaatacgactccgtcattgttcaagcaatgatggagttttttgtttctcataaaaatacaaacaagggaggtgaggttatggactctggtgccagtagttaccacatatgtggctcaatagacaaaaataaaataatgcgaggtaattatcatggacaaagatatttttataaagcttctggcgcagcgcgaattcaaagctgtcagaagtattctcgatgtaatgaacgaagtggacatagcctcccttctctcaactttaagtgataaagaactggctcttgcttttcgtcttattccaaaagataaagctgctgaagtattttccaatatggacacttccatgcagacttatctggtaacaatgtttactgagaaagagctgaaagagctcttagacgacctctatatggacgatacggtcgatatgctggaagaactcccggcaaaccttgtaaagcgaattctggctaccgtcagcgcgtcagaccgtagcatgatcaaccagctgctgaactatccggaagacagtgccggaagtatcatgacaacggaatatgtagacctgcgtgaggaaatgactgtcggacaggcgatggcacatatcaagaagaccggaatccataaagagaccatttacacctgctatatcacagaacgcagaaaactggtcggtatcgtaagtgcaaaagatttgatgacaacagatgacgatgttccgatcaaagacctgatggagacagagatcatctccgtgtatacacactctgatcaggaacaggttgcacagctgttcacaaagtatgacctgcttgcgctccctgttattgaccaggacggccgcatggttggtattgttacattcgacgatgctatggatgttatggtagatgaggccacagaggatatcacaaagatggctgccatcaaccctagtgagaagacatattttgaaacatccgttcttcagcatgcaaagaaccgtatcccatggcttttgatcttgatgttcacttccatcatcacaggaacgatcattacaagatatgaaaatgcattcgcagccatccctcttctcgtatccttcatcccaatgctgatggataccggtggaaactgtggttcccagagtgcaacactgatcatccgtggaatcgcactggatgagatccgttttacagatcttttcaaagtcatgttcaaagaattccgtatctctttgatcgtcggtgcttttcttgctgttgccaacggtgtgcgtatctttatacagtatcataatccaggacttgcagttgtgattgcctgctccctgatgggaaccgtgatcatggcaaagctggttggatgtaccctcccacttcttgccaagaaagtaaatctcgaccctgcgatcatggcatctccactgatcacaacactggtggataccttctcaatcctgatttactttaatattgcgacagtattattccgtttgtaatagcaaatcacaaatggatacaaaatcaaaaaacatataaataaaaaagtatcagaaacttttaaattagcttctgatacttttttatttctttttattaattatctttccatcatactaatcgactcgattccaacgcttccgcctcggacaacttcaatgctcttaaattcttccttcatcaacttcacaaccgcatcattctttgtcgcagtctgtacaaactcaaccagaagactgtcttttccgtaatcgattactttcgccttaaatgtctctgcgatctgaaagatctcaaccttatcttccggtgtacattttaagacttttacataaagaatctctttcattcttacaaatacgtctgtaaaatcaattactttaattacttcaatcatacggttaagctgcttcttgatctgctcaaatgtctcatcatcgctgactgttgcaattgtcattctggaaacggtcgggtcttctgttgttccaacggtcagactgtctaagttataacatttaccggaaaataaaccggaaatcttcgaaagtacaccaacctggttttctacatagagagaaatccatctctttttcatattattatccatatctcttcctcgctaacctatattttctgttctaatcgattaacaatccatgatcaaatcttcaagtgttccgcccggctgaaccatcggatatacaagttcttccggattgataacgaactcgatcagtgtcggtgtctttgtattcttcttcgcctcttcaaatgcagctgcgatatcttctttcttcataacacggattcctttggctccgtagctctctgcaagcttcacaaaatccggtgtgtactccggcatctcctgcccgtttgttctgcggaaaagtgctcctgatttcaggttcgtcatactgtaacgttttccatagaacagcttctgccactgacgtaccataccaagatattcattgttaaatacacagagaatcaatggaagttcttccaatactgctgtagcaaattcctgaatgttcatctgcataccaccgtctccggagattgtaataacgtccttatccggattaccaagcttcgctccgatcgcagccgggaagccatatcccatcgttccaagtccaccggaagtgatcagctgcttgttctttgtaatctcaatatactgtgttgtgaacatctgatgctgtcctacatctgttgcaatgatcgcattgtcaaactgacggttgatctcttcaataatatcctgcggtcccatatccacgcggttcttcatcgtcaaaggatgttcttccttccactctgcgatctgttttctccacttctttgtctcacaatgctctacatattcattcatcttcgtaactgcctcaagcgcatccgcaacgatcggcacgtcaacatgaatatttcttgaaatagatgctgtatcgatatcaatatgaacgatctgtgcattcggtgcaaattcatgcagcttacctgtaatacggtcattaaaacgtgttccgatcgagaataaaagatcgcattcgctgactgccatgttcgaagcatatgctccgtgcattccaaggtttcctatataaagtggatgatctgtcggaaccgcaccgcgtcccatgatcgttgtgacaaccggaacttctgtcttctctacaacttctgtaaacacctcattcgcacgtgcaatattcacaccgcctcctgcaaggaataacggcttctttgcctttttcagcatcttaagcgcacgttttaactgtcccatatgcacattcgtatttggcttatatccacggatattgactgtatccggataatccgcacttccaagttctgccatcacatcttttggaagatcgatcagtaccggtcccggtcttcctgttctcgcgatataaaaggcttctttaataattcttccaagatcctctctgtttcgtacaataacaccgtatttcgtaatactgcgtgtaattcctacaatatcaacctcctggaatgcatcatttccgatcaatggtcttgctacctgacctgtaaaacatacgagaggtacactgtcataattcgctgttgcaagacctgtaacaaggtttgtagctcccggtccgcttgtaacaagacagacacctaccttacccgttgttctggcataagcatccgcctcatgaaccagtgcctgctcatgtcttggcagaatgatccgaatatcatcctgcttgtacaattcatcactgatatcaatcgtacatgctcccggatagccgaaaatggtatccacgccttcttccttcagcgctcttacaagtaatttgtttcctgaaatctgtttcaatctatatacctcccttttcaaaaaagaaagccccaagcatgaccttcatgcccagggcgaatatccagtatttaccgttcacagtacctgtgtcaacagccagatctatccatgtcatcacctgaattcagagataagcctctgtacatccacaagctgtgtactactccctgtcttcgtatttgcgtaaagcgtaaattaattataagtgttaaaaaatatcttgtcaacgtcgagttcttgatcttatttaatctatcgcatatgatttttcacagctccgactactgtatacagaaccatcattacaagattggcaagaacaacactggctcccgccggggttgccgccacataagaaagggtcacacccgcgatcaaacacaccactgagatcactgctgcgtttattatgacacttttaaatgtcctgcacactctcattgatgtcaatgccggaaaaatgatcaggctcgagatcaataatgctcccatcatacgcattccaagcacgatcgtcactgctgtaagtacagcgatcaacgtattgtaaactcctgcttttacacctgttgcacgggcaaatgtctcatcaaatgtaatcgcaaatatcttgtgataaaaaacaataaacaggatgagtacaaaaacggaaagtacaagacttaatttcacatcctcagcactcatcgcaaggatgcttccaaacatataattatatacatccgtattcattcctgttgtcaatgagatcaccatcacgccaactgctagtgacgttgtagaaatcaacgcaattgctgcatctcctttgatctttgcattcccgctgattcgaagaagcagaatcgctgctacgataacaaccgggattgctactgtaagcggagcggcattcatcgcagccgcaatcgccatggcgccaaatcccacatgagaaagtccatccccaatcatcgaataccgtttcaatacaaggctgacgcccagtaatgcagaacataatgcaaccagtgatccaacaaggaacgctcttgtcataaaaggataagacaacatctcaatcactgtatcaaacatgtgtctcacctcctaagaatgtcttgccggcacgactcttctcgtatccatctgcttttccaaagtacagcactgtttcctgtaaatgaaggatatgacttgcatattctacagcactctcgatatcgtgtgaaaccataacaactgcaatcccggattccttattgattcgactgatcaattgatagaattctgctgtcacaattggatccaatcctgtgaccggttcatcaagaagcaagagtttctttgtcgcacacaatgctcttgcaagcagaacacgctgtctttgtccaccggacagatctcggaaacattgttttgcgaggtcacggattccaagcatgtccatcttctcccacgcctgcttcttatcttctgctgtataaaacggtttcatccctctgctgttcaaccggccggaaagaaccacttcataaacactggccggaaaatctttcttcacatctgtctgctgtggaagatatccgatctctgtctgttttaatccatcatcaaaaacaatcttgcctttgtccacattcttcagtcccaaaagactctttacaagtgtactttttccggaaccattttctccgacaatacagaggtagtctccctgattaatctcaaaattcaagtcatgtacgaccatttgtccttcatatccaatggatacattttcacatttaatcaacgccatcagttcaacacctcccttaatgtttcaacatttttctccataagactcagatatgtctctccatctgcaaactgctctgctgtcagattatgacagctataaaattcttttacatcagcatttgttgcttctgcaatagcttttgcaatattttcgttgctaagttccatttttaatactgttttaatattctcatcctgtactttattgattaaaaacgccattgtagctgcgcttggctctgtgtccgaagcacatcctgaaaatgccgcataataatccagaccatacgcttctgcaaaataacggaacggaaatctgtctccgaaaatcatcagctttcgttttgaatgatccaccacatcctgaaattcctgatccaattctttcaattgtgctacataagcttctgcattttcttcataatcaggtgcattttccgaatcaatctcgcagagctcttctttgatctgctcgacgatcttcaccgcatttaacggagatgtccacacatgttcatcaatttcatgtacagaatgtgtttcttcctgtccatgctcttcatgatctgcttcgtcctcttcatgctccacttcgtgctcttcatgctccgcatcatcctcgtcatgatcatgaccacgctcttctttcattccttccacatgttcctcttccactgtgtcaacacaatccaccagcttcagagtctttctcccgttgtccggcattgattcaagaatgtcttctacccaggcatcattctcgccgcccacatagataaacagatcactattctggatcgcaataatatcctgtggcgtcggctcataagaatgtgtctcctcacccggttttaaaagcatcttaagttccacattctctcccgcgatctgacgcacaaaatcatactgcggaaagattgtcgctacaacactaatcttttcattttctactttattctgttcttttcccccgttttgctctgtctgctgcccggacattccacacccggtcagcatcattccaagaataagacttcctgcaagcagaaagtctcttactcttctcttcttcatcttcaaattcatcttctcacttttacgcttttacactttcacagcatctgttttagcagcgctcatattttgtaaaagcaaattccagatcaaaacaagtctgttcttctccttcttccgtcatcttccaatcttccatctgatccagattcgggaaataagtgtctgcctggaattcacggtctatctttgttacatatacagtatcacaatatggaagcatcatcttgtaaatgctctcgccaccgatcacataaatcttctcactcggatacttcttcaattcttctaaaagttcttcctctgagtgaacgatcactgcatctttcacctgataatttttattcttcgtaagaacaatattcactctattcttcaaaggaagtccgttcgggaaactttccagtgtctttcgtcccataactacaacatttcctgttgttttctgacgaaagaacttcatatctgatggaatgctcaccagcagtctgttctggtaaccgattccccaattattatctgctgctacgattgcctgcatacttcttctcctttacacagcgattggtatattcttaatctgcggatgtgtctcatatccttccaatttcacatcatccggtgtgaaatcatagaagtctttcacttccgggttcagccagaatttcggtgccggaagcggttctcttgagatcagttcctcaatcatcggaacatgtcggtcataaatatgcgcatctgcgatcacatgaacaaactctccgaccttcatgtcacatacctgcgccaacatatgaagcaacactgcatactgacacacattccagttatttgccgcaaggacatcctgagaacgctggttaagaattccatttagtgtaagcttgtcactgtctttttcctttgtcacattaaatgtcatactatatgcacatggatacagattcatctcatgaagatcctgatgcacgtaaatatttgtcataatacgacggctatacggattattcttcaaatcataaatcacgcggtctacctgatccatcatgccttctttatactgatgcttcacctgcatctgataaccataagcttttccgatcgaaccatcctcatcagcccaactgtcccagatatgactgttcagatcattaatattattcgacttcttctgccagatccaaagcatctcatccacacagctcttgatcccggttcttctaagagtcagtgccggaaattccttagacaagtcatagcggttgaccactccaaatttcttaatggtatatgccggtgttccgtcctcccatcttgggcgtaccttctcaccctctgtgcttgttccattctctataatgtctctgcacatatcaataaatactttatctgcgtaactcaactattctctccttcttgaccaatgattcttcttttatatagaaacatcacatcgttactgttcactcccgtgtcaatcactccgctgattgacacggaggatgcgtgtggtgatttggaatgaattttgaccaagttgctgtgaacggagtgaacagtaactagaatcaagagcgaccattcatctggatgaagcccgctcttgagaaaaatatgttctgcttaatatcttctaattaatatgttccggttgaatggaagaatcttattcttcgattgcttcatatccgtctggaatagtaattccaagttcctcacagatggtaggattgtacatctttgttacattcggggcactttcaatcttcattgtagtaatgtcagcaccgtttacaaggatgtcgtaagccatctcaccggctttgtatccgatatcgtagtagctgatagaaagtgttgcaataccgcatccttcacagattccctgctcaccggcgattacaggaaccttagccggcagacagatgttattgatgatttctgtgtttgaagccattgtgttatctgtaggaatgtaaagtgcatcacattcggaaactgcatttgttacaacagactgaatctcattagaatcagcagctgtgtactctttgtatgcgattccatctttctctaatgcttcagcgaaaagctttgcctgatatgctgagttcggttcagcggagcagtagagaagtccgactgttttagcatcaggaatgagttctttgagcattgcctcctgctcatcaatcggtgctagatcgcttgttccggaaatgttcattcctgttgttcctgtccagtcagagatatcaagtgctgtagcgtagtctgtaacagatgttccgagaatcgggatatcacttgttgctgcgcttgcacactggagtgctgttgttgcatttgcaagaatcagatccacattatccgctacgaagttatttgcgattgtagcacagttagcctgctcgccctggccgttctgaaggtcgaatttgacattgccttctccgaacttttctgtacaggcatcttcaaatccttttgttgcttcgtcaagagcagcatgctctaactgctgtaagataccgatcttataagtctttcctgaatcggatccgttgtctgcgctcttatctgtagagtcggatgaacttccgcatgctgcaagtgaaagtgtcattccggcagccataagtactgctaaaattttcttagatttcatgattgtgtcctccctttttcgattcatacaatctacgctttaaaccgttacgctttaaagcactaaactgtaagatgtcatgtgataaattatagcacgattatttgatacgtcaagtgaaaatggaacaaaaatgcaagattgttgaaaaaatgttgcaaaaaaaacaatgctttattcgtctggaaaattgtgatattataagatatggtgtaaaattaagaatcatgaaagtctttcttctataatatggggatttttgctgcaaagaaattaacagaaggatttttatggaattgaataaaggagtttatttttatagatgaagaaaaagcacgaacacattatagaaagtgtgcggccgggaagtattgcggaagagctggggattgaaccgggagatattctgctggagattgacggtcaggtgatcgaggatatttttgactatcagttttatgtggaatctgaggagctgcttgttgtgatccgaaaagcgaacggggaagaatgggagcttgaaattgagaaagatgttgatgaggatctgggaattgatttcggtaagggactgatggatgagtatcattcctgccataataaatgtattttctgctttatcgatcagatgccgccggggatgcgtgatacgctgtattttaaggatgatgattccagactgtcattccttcagggaaactatgtcacactgacaaatatgagtgagaaggatatgaatcgtattgtccgttatagactggaaccgatcaatatttcgttccagacgacgaatccggagcttcgttgtaagatgcttcataaccgttttgcaggggaggctttgaagaaagttgatatcctgtatcagggcggcattgagatgaacggacagattgttctttgccgcggagtgaatgatggggaagagctggaacgtagtatccgtgacctgacgcagtatctgccgcttttacgcagtgtgtcggttgtgccggttggactttccaagtatcgagatggattgtatccattagagccatttacaaaggaagaggcgaaggaagttattcgcacgattgagaagtggcagaagaaagtctacgcagaatacgggatccattttattcatgcaggagatgagtggtatctgctggcagaggaagaagttccggaagaggaacgttatgacggatatcttcagctggagaatggagtcggcatgcttcgtcttttatttaatgagtttgaagaaggttatgcgaagctggaaagcggagaacatcaggaagagatttcccttgcaacagcaaagcttgcatatccgtatcttgagcgtatggcgaagaagatggaggagaagtatgagggacttaaggttcacacatattgtatccggaatgatttcttcggagagcgtatcacagtctctggtctgatcacaggacaggatctgatgaagcagttaaaagatcagccgcttggaagcaggcttctgatcccatgcaatatgctgaagatggacgaggacattttccttgatgactttacattgaaagaagtatcagatactttacaagttcctatagatattgtaaaatcaagcggacaggatctgatcgatgctattttaggtgtcgcaggtccgaatcccacagatatagatgagaatcagatgaaagaccgtaggatcactacggcttaagagaaactatttaagagaaaataagagaaaacaggaaggtaagaatagaatgagtaaaccagtagttgccattgtagggcgcccgaatgtgggtaaatcaacacttttcaatgtcctggcaggagagatgatctccatcgttaaggatacaccgggtgttacaagagacagaatttatgcagatgttgactggcttgacagagagttcacactgatcgacacaggtggtattgagccggacagcagtgatatcattctctcccagatgagagagcaggctcagatcgccattgacacagcagatgttattatctttatcacagatgtaaagcagggacttgtggattcagattccaaggttgcggatatgcttcgccgctccggtaagccggttgtccttgttgtaaataaggttgacaattttgataaatatatggctgatgtctatgaattctacaatctcggaatcggagatccggtgccgatctcagcagcatccagacttggtcttggagatatgcttgatgcggttgcagcacatttcccggagtgggatccatcagaagaggatgacgaccgtccgcgtatcgcaatcgtaggtaaaccaaatgttggtaaatcctctatcgtaaaccgtctgcttggtgagaaccgcgtaattgtatccaatatcgcaggtacaacaagagatgcgattgatacagagatcgtgcatgacggaaaggaatacatttttatcgacacagcaggtcttcgtagaaagaataagatcaaggaagaactggagcgttatagtatcatccgtactgtaagtgcagtggagcgtgccgatgttgtccttatggtgatcgatgcgacagaaggtgtcacagaacaggatgcgaagattgccggaatcgctcatgaaagaggcaagggagttatcattgtcgttaataaatgggatgccattgagaagaatgataagacaatgaaagaatacgaaggaaagatccgtcaggtactttcttatatgccatatgcagagatcatgtatgtatctgcactgacaggacagagacttccgaaactgtatgatatgatcgatatggttattgagaaccagacacttcgtattgcgacaggagttctcaatgagatcatgacagaggcagttgctatgcagcagccaccgtcagataaaggtaagagattaaaactttattatattacacaggttgctgttaagccaccgacatttgttatctttgtaaatgacaaggagctgatgcatttctcctatacaagatatcttgagaataagatccgagaggcatttggcttcagaggaacttcactgaagttcttcatccgtgagagaaaggaaaaggatcagtagaatggaacgtattatctgtctggtgatcggatatgcctgcggacttctgcagagcggttatctggtcggaaagatgcatcatattgatataagaaaagcaggaagcggaaattccggttcgacgaatgcactgcgtgttatgggattgaaagcaggacttatgactttcgcgggagatgtgttgaagtgttttgcagcagttctcattgtccgtgcaatatatcatggaagtaatattcttccgcttctgatgatgtatgcaggagcaggagttactttgggacataacttcccattttatatgaattttaaaggtgggaagggaatcgctgttatggcagcacttgtggtaagcaactgtttctggcatctgccgtacagttccatcctgttttttgtcacactggcattctttcttgtgccggtgcttgtgacaagatatgtttcccttggttcattgcttgcttatgcagtgttttttatccagatggtgatcttcggacagcttggatggtttgatatggcgaagggtgcggtatatgagttatatgtgatcacgttcttacttacagcacttgcatggtacagacaccgcgccaatattaaacgtctgttgaatggaacagagaataaattcggttcaaagaaataaaagaagcgaagaaaaggagagatgatatggcaaaagtaggagttcttggggcaggaagctggggaacagccctggcaatccttcttcatgataatggacatgatgtaactgtctggtcgatcgatccgaaagaagtggagatgttgagcgagaagcgggagcatgtatcaaaacttccgggtgtccatatttcagaagagattatgatcacaaatgagatggaagaggctattaaaggaaaagattttttagttcttgcagttccttctatctttacaaggagtacagcggcaaagatgaagccgtatgttgttgatgggcagatgatcgttgatgtagcgaagggaatcgaggaagatacactgatgacgctgtctcagcagatcagccaggagattccgcaggcggacgtagcagtgctcagtggaccgacacatgcagaagaagtaggaagaaagcttccaacatcctgcgtgatcggtgcaaagacaaaaaagacagcagagtacttgcagtctgcatttaacagtaaagtattccgtgtgtatacaagtcctgacatgcttggaatcgagcttggaggttctcttaagaatgtcatcgcacttgcggcaggaattgcagatggtctcggctatggagataatacaaaggctgctctgatcacacgtggtattgttgagatcggaagacttggcgtgaagatgggcggcaagttcgagagcttttgtggacttaccggaatcggtgatctgatcgttacttgtgccagtgttcatagccgtaatcgtaaagccggttacttaatgggacagggcaagtctatggaagaggctatgaaggaagtaaacatggttgttgaaggtgtctattctgcgaaagcagctgcaaagcttgcacagaaatatgaagtgccaatgccgatcgtagatgagatcaacaaggttctttttgaaggaaaggatccaaaacaggcagtagatgatctgatgcttcgcgagtctaagattgagaactcttctcttctctgggaagaataagagaacgaaacgaatataaaattaaaagtcatacccctttgtttggctgcatacattggtatcagcagaacaagggggtatttttatggattcatttcaggtatacaaggatatgaaagcacggacaaacggagaaatctacatcggagttgtggggccggttcggacaggcaagtcaacgttcatcaggcgttttgcggagcttttgattttgccgaatcttaaggaagagcatgtaaagcagcggacacaagatgaacttcctcaggcagcatcgggaactacgatcatgacaacagagccgaagtttgttccaaaagaagcggcggatgtaaagctttcagatgacatagaggtgaagatccggctggcagactgtgttgggttcatggtggatggggcgaatggccataccgagaatgggcaggagcgtcaggtgaagacgccatggtatgactatgagataccatttacaaaggcagccgagatcggaacacaaaaggtgatacacgatcatgcgacgattggatttgttgtgactacagatggaagcgtgacagatctgccaagagaaaactatgtggcagcagaagagcggacagtgaaagaactccggcagattgggaagccatttcttattttattaaattgccagaaaccgtattcgaaagagacagaacgtctgaaatcagctcttgaggagaaatatgcagcacctgtttatccggtgaattgtgaacagctcaaggaagacgatatttatgaaatgatgcgccaggtactgtatgaatttcctgtcacggaaatagaattttatattccgaaatgggtagaaatgttgtcacgcgatcacagaatcaagaaagatctgattgagaatgtgaagaaaattatggctcagatgtcggatctgcgaagtgtctccggaaaagactggaagacagaaagtccatacatagaccagatcctgttggatcaggtagagatggacacagggaaggttatattgcggatttctttctgccagaagtattattatgaagtgttgagtgagttgacaggaactcagatccgcagtgagtatgaattgatttctctgatgaaagagctttcttctataaaagaagaattcagtcagatcaaggatgcctttgcggatgtgaagatgaaaggctacggagtagtcagcccgaagaaagaagagattcatctggatgagccggtaatcatcaagcagggaagcagatatggagtaaagatccgttccgaggcaccatcgatccatatgattcgtgcgaatatagaaacggagatcgcaccgatcgtgggaagtgagaaacaggcagaagaccttgttgcatatataaaaaaagagagcgaaggtccacaaggcgtctggggaacaaatattttcggcaaatcaattgaagatcttgtgatggatggtatgcgtaataagattacactgatcaacgaagaaagtcaggtaaaactgcaggattctatgcagaagatcgtaaacgacagcaatggtggtctggtctgcattattatatagtgatcgtgagctttttttttacaggaaaatatgataagataaacagtaagtaaaatatgcaaaagaaagcgaggaattcagtgttgctgaatcaccaacagagaaagattcttgaattattgtgtaaaacagaacatgtgactgcgagtgaactggccggtcagcttggaattggcgtgaagacggtaagagtcaggatcaaggaactgaatccggagcttgagaagaaaggaatccagattttatcaaagtccaggtacggatattatttggacccaagacagccggaaggtatcgaaggactgctgaatccgaaggagaatgaagatccggtgattccttcgaacaatcaggagagagtacattttctccttgcatatcttctgaacagaacggaatatatcaagtcagaggagttgtgtgatttcctttacatttctaaggggacgctgacgaatacactccggcaggttgaggaaacttatcagaagtatggtattacagttcataagaaaccgggatatggtatccgtgtggaaggcagtgaatttaatctgcgtcagtgtatggtggatgtctttgtaaagcaggatagtctggaaggaatcggaagacggcatcagacggatgagatcgagacgctggggaaaatggtctatcagtgtctgaaaaaatatgaaatcgaactttctgagattgcttacaatgactttgtggaacatatttatgtggcgatgcgaaggatccgtcaggagaaatatgttgaaccgcaggcagcggatatgcttggaagaaaagagaagcagtttgtggaagaactgacagagctggtgggcgcacattatcagattcatttttctcaggatgagaagaattatctgacactgcagcttgtggggaaggtttatattgacagtgagacagaacagggaaattttgtgatgcaaagcgagattgatcgtcttgttacggagatgctggagatgatctacagggaatttcatgtagatttcaggaatgattttcatctgcgtatggagctgaaccgacatatggttccgtttgtccttcgtatgaagtatcatatgatcctgcgaaacccgatgctggaagagatccgtaagaattatgtgctttcctatacgatggcgtcccaggcggcaattgcactggggaaatattttcagcagtcgatttcagaagatgagattgccggactcgcagaggttcttgaactggctttggagcagcaggagaatgaacagaagaagttttcgattctgatcgtatgtgcatctgggaagacgagttcagaaattctcagatataagtacagcagagaatttaaagagtatattgaaaagatttatgtatgtaatctttatgaactggagaactttccgtttgaaaaagtggattatgtatttacaacggtacatatctcttcttatgtaccggtaccgattttggagattggttcctttctgcaggacaatgacattgacagggtgagaaagctttttgtaagagagagtaaggattttctgcagaaatattttaagaaggaattattttttacggatgtggaaggaaagacgaaggatgaggttctgaagaacctgtgccggaaggttgagcaggagaagggacttccggagacattcactgcatctgttttgaagagagaggaacttacaccaacagattatggtaatctggtggcacttccacacccggagcgtgccttccaggagcgtgcttttgttgcagtggcagttctgaaagaaccgatattctggttccggcagaaggtgcaggtcgtatttttgacggcgatcggaagggaagaggatgaaaatctgcagcagttctatgaggcaacgacagatctgattcttcgtccggcagatgtgcagaatttgattcgtcatccggattatgacaggttgatccagttattgcgcagagcagaagaataaaatgtatttaatctccttgatgaatgtgattatatgttcagtgattcaaaagtgaccacattgattgtggtcattttttgagtggagctttttaaaaatatatgttaaattaaggtcagtcgagggacaggaaaggaaatgacgatgagacatctaacattgatctgtatggcaggtatttcaacaagcctcttagtgaataagatgaaacggctgattcggaatgagaatcttgagattgcagtcacagcgatgtcggaacgtgcatttcagggttacacaggtcagacagatgttctgctgcttggtccgcagctgggacatcggttcgaaagcctgaaagaacagtatgagtccaaaggcatccgcatagacaggattgatccggagcgtttcggagcaatggatgcgaaggctgtactggagcaggcatttccagacctgtctggacaaataggtgataaataaaataaattaaagataggagaatgtatcatggcaaaatttacttatgtagtacaggacaacgaaggaatccacgcaagaccggcaggaatgcttgcaaaagaagcaaaagctcttgagggagttaaggttacaatcgccggaaacggaaaaacagctgacgctacaagactgatggctatcatggctatgggtatcaaaaaaggtatggaagttgaagtaacagttgaaggtgagaacgaagaagctgcagcagctaagatggaagagttcttcaaagcaaacctgtaagagaaagtcatacatatactcattcaatttctagttaagaaaagatgttttaacagatcaataataaggattagccctccggaagaaagatctgtcaggacatctttttgtttttattgaaaacgctccgcttaggatgcgcactgcggcgtataatgtaggcgtcgcaagcgaccgccgcaggcgcaagaatgtgccggggcacattctttgttctagttgcacaaaagtttattgttctgtataatgagaaagtacgagtggagatcatagtagaattaagaaaggggcagacagaagatgagagcagttattttatcattagatacaggggcatataaagcaaaagcggatgtggcagcggcagcatcactcaaaagaatgctggagcaggttgggattgaagtccgggcagcaaaagcatttccagaggataaagaaatgttgaaaacagtgctctgtaagctggcagatgcgggaatggttgaactggttctgacaaccggagcagttggattcctggagaagcattgtgcgccggatgctgtgagggagacagcagaccgtctgcttccaggtattccggaagcactcagagcttataatcttcgtcatacaaagaaagtgattctggatcgttcagaggctggaatcagaaagaagacattgatgatcaatctgccggagagcgccaagatggcaaaggaagatctggaatatatacttccagaagtggtacaggtggtagatactttttcattaagataaaaacagaaggatggaataacaggagagattgaaaatgctggtaaaaatatatacagatggtgcagcgcgcggaaacccggacggaccgggcggatatggaacagttcttgagtatgtcgacacgaagggacagcttcataagaaggaattgtcccagggatatgagaagacaacgaataacagaatggagctgatggctgtaattgcaggtctggaggctttaaaccgttcctgtgaagtagaagtctattcggattcacaatatgttgtgaatgcgtttaaccagcactgggtagacggctggatcaagaagggatggaaacgtgggaagaatgaaccggtgaagaatgtagacctttggaaacgtctgttagaagcaaagcagaaacacagcgtgacatttcactgggtaaaggggcacgatggacatccgcagaatgaaagatgcgatgagcttgcgacaactgcagcagacggaacaaatcttatcgtagatgaagggctgtaagaattcgaaaacaatgattgattaataaaaatcaagaagaaaatcttgaaaacagtggacaacagagggatttcttagtataattgaaaactgtgttgagtaagacagacaatcgcggctgcaagtgccgaaaggccgcaggtgaggaaagtccgggcttcatagggcaggatgccggataacgtccggtggaggtaactcccaggccagtgcaacagaaataaaccgcctgtgcattttgtgcaggtaagggtggaaaggcagtgtaagagactaccgccttgctggtaacaggaagggcacatgtaaaccccatccgaagcaagaccgaatataagcaatgtggctgcccgtcacgcttaaggtgggtcgcttgagcgcagcggtaacgcggcgcctagatagatgattgttcaacgacataacccggcttatcgttttgctcaatcaatggagggagtttctgtttagaaactccttttgtattttagttattaataatgcggaagaagttatttgagatagattcttttgcaagagacagacaacggaggaattaagaccatgggaatgaaaattaatgcagaattaccattacctgcaaacctgaaggcggaatacccgcttccgaaagaactggcagagatcaagaagaaacgtgatgcggagattcgggagatttttgaaggaaaatccgataaatttgttgttatcgtgggaccatgttccgcagacaatgaagattctgtgtgcgactatgtgaatcgtcttgcaaaagtgaacgagaaggtatcagaccgtctgatgatcattcctcgtatttatacaaacaaaccacgtacaacaggagaaggatataagggaatgctccatcagccggatccggatcaggcaccaaaccttcttgagggtatcattgcaatccgcagaatgcatatccgcgcgatcaaagagacaggactgacatccgcagacgagatgctttatccggagaacagaagctatcttgacgatatcctttcttatgaggcaattggtgcccgttcggtagagaaccagcagcaccgtctgacagccagtggaatggacattccggttggtatgaagaacccgaccagtggagacttttcagttatgatgaactccgtaattgctgctcagaactctcataacttcatttacagaggaatggatgttacaacagaaggaaatgatcttgcacatgtaattcttcgtggtggtgttgacaaatatggaacctgtattccgaactaccattatgaggatcttgtccgtctggtagatgtttatgcgaagaaagacctgaaaaacccggcagcgatcattgatgcgaaccattccaactccaataagcagttcaaagaacaaattcgtattgtcagcgaaattcttcacagcagaagatacaatgatgatgtgaagaagatggtcaagggagttatgatcgaaagttatatcgaagaaggaaatcagaagatctgcgatcatatgacttacggaaaatctattacagatccatgtctgggatgggaagatacagagaagctgatttacaaaattgcagaagagtgttaaatttataagagccaggacagataccacacacggtaactgttctggctcttatattagatgtgggagtcaatcccacatctgatatagataaacgatggattatctgcggctatatttctcctcgcagtactggcatctgtatacctgattctcttcatcagtcagtacaaatacatgatcaagtccctgctcgatagatgtgatacatcttgggttcttgcagcggatcacatttttgatcttcttaggaagagtcagaggtttcttggagatgatctctccgttttcaataatatttacagtaatgttgtgatcgatgaatccgaggatatcaagatccatgaaatcgatcgggcattcaatcttcatgatatcttttttgcccattttattactttttgcatttttgatgatggcaacacagcagtctaatttatccaggtgaaggtatttataaatctccatgcttttgccggcttcaatgtggtcaagaacgaatccttcagcgatacgtcctacagttaatgtattttctaacattttgttacccctttcgtactatgaaatatgattatattagtcaacgtgaatatccaaaagtgtaaggatcagagccatacgcacatatactccgtactgaacctgacggaaataagcagcacgtggatcgtcatcaacgtcaacagagatttcatttacacgcggaagcggatgaagaacatacatatcttccggagcgagtttcattttctctttgtcgagaatgtagaagtctttcatacgtacgtagtcttcttcattgaagaaacgttctttctgaacacgtgtcatgtacagaatatcaagttttggcattgcttcttccagacgtacaacttcttcgtaaggaatgttcatcttgtcaagtacatcatgacggatgtattccggaagtcttaattcttctggagagatcagtacaaaacggatgcctgtgtatctcacgagtgctgtgatcagtgagtgaacagtacgaccgaattttaagtcaccacacagaccgattgtcatgttgtcaagtcttccttttacgttaaggattgtgagaaggtctgtcagcgtctgtgtcgggtgctgatgtccaccgtctcctgcgttgatcaccggaattttggaatgctggcaggcaaccatcggagcaccttcttttgggtgtctcattgcacagatatctgcgtagcaggagattgtacggattgtatcagatacactttctccttttgcagcggaactggagtttgcggaagagaatcccataacgcttcctccaaggttcagcattgcagcttcatggcttaaacgtgtacgagtacttggctcatagaataaagtcgcaagcttctttccgtcgcaggcatgtgcgtatttgtcaggatgtgcctcaatatcctgcgcaagtttcaacagttcgtccagttcttccactgagaagtccagtgggctcattaaatgtctcataagtaacctccttgtgtgattgaatcacattatttatattctagtagatcagtaacggcttttctcttaggtgcttgcggatcatcatccggccagccaactgcaatcagagctgccagttccctctctggcggaatctctaaaagttctgtaattttttcttcatcaaagatgcccatgatcacagtaccaagtccctgttcttttgcagcaagacagaaagactggcaagcaacaccaacgtcaaacatctgccatctgtcccccttttttgtgctgtaggatccgtcacgttcaaaaccggatctgcttttgataaaagtaacagcaaccagcataggaatttgacggataatattagaattgtaaacaggggtataatcatcagcgatctttttgagaatagaggggtcttcaattgcaatataacgagtgatctgtgtgtttttccaagacggagaataggaagcagtagaaataatagaatcaataatagaatgatcaatatgatcaggtttatattttcttatgcttctgcgcatcttgatacaatcagaaacgttcatttgtatacctcccaatgttttattcgagacgcttgaatcagataaaaaccgattgttctcgtattccataccatgatatactaaaacgagaagattttcaacaggaaaataaacttttttcaaaggatagattttgtggaaaaaatgtattatacttggtactgttcatgcagtgtttttactatgttaattgtgttacaaatcagtataaaagagatgcagtatggatggagttttttagtaaggagaagttaggatggcaacacttgaagaactgagagtagagctcgacaagatagataaccagatggtggaactttatcagaagagaatgaatgtctgccgtgaggttggagattataaggtgaaagccggacgtaaagtgtatgaccggcagcgggagcaggagaaacttgcagatgtggcatcaaaggttgacaatgattttgataagaacggggttcgtgaattatatacgcagctgatgtctatgagcagaaaactgcagtatcagaagctggtagaagcaggcgcacttggaaggcttccttttattcagattgattctcttgagaaggatactgccagagttgtgttccagggaacagaaggtgcttacggagaagcggcaatgcatcagttctttggagaagatgtgaattgctttcatgtaagaacattccgtgatgcgatgactgcgattgaagaaggtgctgcagattatgcggttcttccgattgaaaattcatctgcaggtccggtgaacgagatgtatgatcttctggatgaatttgagaattatattgttgctgagacgatccttccggtagtgcataccttgtcaggacttccgggaacaacacttacagatatcaaacgtgtttattcgaaagcagaagcccttatgcaaacgacagggtttttgaatgaccatgcagaatggcagcagatcagtgtagtgaatacggcaatcgctgcgcagaaggtagtaaaagatggagataaggcacaggcagctgtatgtagtgcctatgcggcgaagattcatgggttggaagttctcgcagataatataaatgacgagccggataactgtacacgctttatcgtggtgacgaatcagaaggtttatctgaagcatgcgtcaaagatcagtattgaattcgaacttccgcatcagagtggggctcagagtgggtctctttatgatcttctgtcacattttgtatacaataatataaatatgacaaagattgaatcaagacctgtgaaaggaaaacagtgggaatatcgtttctttgtagattttgatggaagtctggaagatgcagcagtgaagaatgcattgcgtggactgagagaagaagcaacgaatttgagaattcttggaaattactagatattagaatagatagaaaagcagaatacagagcaggtggagcgaaagctccagagggatttactggaaaagaggttatttagaatgcgtacaaacgaactgatgctgtataaaaatatggaatatggagagattctaaaggatatcacattcctgattgataattatgagagtgaattttataacaaagaagatttaagaggactcctttttgattgtatcaatgaacttttggaattatcagtaagccacggttttgaagggaatctgtggcatacttatctgacatttcttcttgcgagtgatgagaatgcatacagcacttcctgtgagatcgtaggagagattgaaggtagtctgaatgagattgcacttcatgattttgctatttttaaggaaatgtttgactatgatttcgaggaactggaaaagagtctggacgctgactgcctgaagatcatcatggattataagagcggtaacagtggcggtaaagtgttcaaccgtcgtgtcagggacagaatctgtgatctcagccgtgcccttgctgcaacgcagaacgtagatcatttcaagcgtacactgacgcagttttataaggaatttggagttggtaaacttggacttcacaaggcatttcgtgtggagcatccggagaattctgatgtggagatcataccgatcacaaacattgcccatgtacatcttgatgatcttgtaggttatgaagatgcaaagaaaaagctggttgataacacgaaagcatttgtagaaggaaagaaagcaaataactgtctgatgttcggagatgccggaacaggaaaatcttcctcgatcaaggctattttaaatcagtattatgaccagggacttcgtatgatcgaggtgtataaacatcagttccaggatctgaatgatgtaatcgctcagattaagaatagaaattataaattcattatttatatggatgatctttcttttgaagaatttgaaatcgaatacaaatatttgaaggcggtaatcgaaggtggtctggagaagaaaccgaagaatgtgttgatctatgcgacatcaaaccgccgtcatctgatccgtgagacattccgtgataagcaggacagagatgaagatatgcatacaaatgatacagtacaggagaagctgtcattggttgcaagatttggcgttacgatttatttcggttcaccggataagaaggcattccaggagatcgtgcgtgtacttgcgaaaaagaatggaatcaatatgccggaagagcagctgcttcttgaggcgaatgcatgggaactgtctcatggcggtttgtctggaagaacagcacagcagtttattgattatttggcaggacgggagtaatgcattgtgtggaaggcttttagagtcaaacagagcttggaaaatggaataacagaagaaaaaaacaagagtggatttcgcaaaaagatgatatctgtacagttactgatcgtacttgttgcggttatgctgttttgttctggatgtgccgggaagatgaatgcaaagaagatttttcgtcagtcttcggaaaatatgcagaaagtaacttcttcagcaaaccatgtggaactggcaattcagatgtctgatattttaaatctgatggaagtaaacatggagatggatctggagaacacgacagagccgccggccggtcatgcgaaaggaactgccagggtgacgatcaaagattctgaggtatctgcagatctggaactttatcaggtggaggaagacggaaaacaagtgacatatagtggcacgaatggatcctggaagaaagagagtgcagaaggaagcaacgagaatcaccttggtattgacggaaatatttttgcgcaggaagggaaagcgcttgagtctttccacctgtccgagcaggagacaacagtaaatggcaaggcatgttatcagttgtatggcaatgtaacaggaacggagcttatgggtcttcttggcaaagagatggtagaagcatatcatctggtgaatctcccggaggaggatgcaatccgtaatttgaaaatccctgttatttttgacatttacaaagaagaactgcttccggcgaagatcgttgtagacatgagtgatgtaatgggagatttatataagtcttacggagagactacgaaagtaaatctttactcgatcgtgcttcagtttacggactataacaaggtggatgaaatccatgttccggatgaaataaagaattctgcgaaataaaagaaacattgccagaaatcctatggttgatgctatataaaaagaaggaagcttcaggccgggcacatgccgctgaagtcttccttctttttgttattaccacttatttcatattatacaggtttcatattactcaagttcttctatattgctgatatcgctgtcaatcaccatggagtaatttgtataatagacgacaaatccaggtttcccaccatttggttttttgacctgttttttctccacgtagtcaatctcaactttatcggaaccacgcatgctggaataataagctgcaagtctggctgcttcttcgaatgtacggtccggaagttcatccccatgtgttttgacaatgacatgggatcccggagcttgttttgcatggaaccaccagtcatttccgactgcaaagtggaatgtcagttcttcattctgaagattgttctttccgacatacatatgataaccgtcactggaaatgtaatggagtggtttgtttttgatcttgacttttttctttgtatattttctgcggatgtagccggagtttgtgagctcttctttgatttcggcaagatcatcttctgtcagtgcaatatcaagtgccgtctgaatggattccagataagtgatctcgtccagtgtctctttgcaaagaacagaaagtgcttcaaaagtacgtttttgtttgttatattttgcaaaataacgctgggaattctcctgtggtgtttttaatggatccatcggaatggataccatttcattggtgtaatagttcagacattcaagagtctttgcaccttcttccagattgtatccataagtattgatcaattcgccgtacactttatatttttcacgattttctgtgtctttcagctgacgcagctgcaagtcatattttttccggtttcgttctaatgcagtctgaactacgtgacgcagatcaaccgatttctgtcggatgcgggtaatgagactgcgtgtcgaataataagtctcaagtacttcggaaacagaatcatattctacccttgtatagttgacaaaatgactcagtggaagagcagagaattcttttggctcttttccatcgaaataaataccgggtgaaaaggtatcttctttgatcgcggataaataaatctcaaactgtgtatatagatgaagtaaaatatcagcagaatactcctgggccgggacagaagaatccattcctgcaagggagcagatctcctccgcggttacaggactgattccggtaaaacttgtataaattgctttggcaagtggcattggtttacctgtcagatgcgctgcgaattcttcagaagttaccgtgagcggatccactttctgcatggtgtccggaatgaaatactctcttcccggaagaacttcccggacagaactcatctgtgcagatacatgtttgatactgtcaatgatcttaccctgatcgttacagaaaatgatattgctgtgttttcccatgatctcgacgatcagatctttcctgcagaggtcaccaagttcatcgagatgttcaattgtaaaatgaataatacgctcaagtcccggctgccagatatcaacaatgcggccgccgctgatatgtttacgaagaagcatacagaagtttggggcagtcatcggacttggcttattcttcgaggtcagatagaccagcggaagagaagcatccgccgaaatcgacagacgatactgaccttccgttgatttgactgtcagaagaagctcatccgcttccggttgtgcaatctttgaaattcttccgtttaataatttatgttttaattcgctggcgagactcgccacaacgattccatcaaaagccatattgtttcctcctgaataaaaggtttgttttcacattttttaattgtaacataaatcgaatctttataaaagacttgttgaccatttacaaacatttgatgtataatagattagattatagtaaacagaggatgaagacaatgatcaaaagtatgacaggctttggcagatgtgagattcagcaggattccaagaagtttaccgttgagttaaagagtgtaaaccaccgttatcttgatgtgaacatcagaatgccgaagaaacttaatttttttgaaacatccatccggacacttctgaagtcttatgcgaaccgcgggaaagttgatatctttattacatatgaagatctgtcacaggcgcagagctctgtgaaatataatccattgatcgcggcagaatatatgaaatattttaagcagatggaagaagaattcgggctggaaaatgacatcagcgtatctgcacttgcaagatttccggaagttcttacgatggaagagcaagtggaagatgaagaggagctttggaatggactgaagaaagcactggaaggggcttttacacagtttgttgagacgagaataacagagggtgagaacctgaagaaagatattcttgcgaagcttacatttctggagcaggaagtctctgcggtagaagaacgttctccacagattgtggcagaataccgacagaagctggaagagaaagtggctgagttactggcagatacacagatggaagaaaaccgcctggcagcagaagtgattctgtatgcagataagatctgtacagatgaggaagttgtgcggttgaagagccatattcagcatatgagagcaacattggaggagaaagaaggaatcgggcgtaagctggatttcattgcgcaggagatgaatcgcgaagcaaatacgattttgtctaaagcgaatgatatcgaggtttccaatcatgcgatcagtctgaagacagagatcgagaagatcagagagcagatacagaatatagaatagagtaaaagagggcaggatcatgaataagaaaggtattttgattgtcgtatccggattctcaggagccggaaaaggtacattgatgaaagaattaatgagaaaatatccggagaattatgctttatccatctctgcgacaacaagaggtccacgtgacggggaagtagatggcagagaatatttcttcctttccagggagaaatttgaaaaaatgattgctaataatgaattgatagagtatgctaaatacgtggaaaactattatggcacaccgcgtgcatatgttgagaagatgttggatgaagggaaagatgtgattcttgagatcgagattcagggagcactgaaagtgaaagaaaagttcccggatacgcttctgatgtttgtgacaccgccgaatgccagagaactgaagtcccgtctggtaggaagagggacagagacgatggaggttattgagtccagaatgaaccgtgcctgtgaagaggcagagggaatgagtgcttatgactatcttgtcgtgaatgataaactggatgattgtgttgaagagatgcattctattatccagggagaacaccacagaagttcacgcaatgtgaattttatgaatgaaataaaagaagaattggaagagttgaaaggagaaaattaatatgctgcatccatcttatactgacttgatgaaagtagttaacaaagacgttgaagagggagattctaaggttgtaaacagccgttattctatcgtaatggctacatctaagcgtgcaagacagctgatcgccggagaacttccgcttgtacctgtgaaagacggacagaagccgctttccattgcaatcgaagaactgaatgaaggtgagcttaagatcttacctgaggacactgacgaagagtagaatcagaacagtaacggagcagatgcagaaaagtgcaatctgctcttttgacgttgttgttgaacgttttgtacatgcatggaatgtatgaaatgatgcacagaaggtgagatttatttatattttttagagaggatgaccaggaggttttactaatatatgaagatactttttatatccttaggatgtgataaaaatctggtggatacagaagtaatgcttggaatgcttgcttcaagaggttacgagatgacgaatgatgaacaggaggctgatattattgtgatcaacacctgctgttttatccatgatgcgaaagaggaaagcatccagaatattcttgagatggcagaatataagaagaatggcagtgcaaaggcattgatcgttacaggatgtatggcagagcgttatcgtcaggagattcttgatgagattccggaggtagatgaagttcttggaacaactgcatatgatcgcattctggatgcggtagatgcggcacttgccggacagcatgaagttatgacagctgaccttgatgctcttccattaccggagacgaagcgtcttgtaacaacaggaggacattttgcatatctgaagattgcagaaggatgtgacaaacattgtacgtactgcatcattccgaaaatccgtggaaactttagaagtgtaccgatggaacgccttctgaaagaagcacaggatctggcagagcagggcgtaaaagaattgattcttgttgctcaggagacaacgctttatggaaaagatctttatggagagaaatctcttccaaagctgctccgtgaactttgcaagatcagtggaatccgttggatccgtattttatattgttatccggaggaaatcacagatgaactgatccaggtaatgaaagaagaaccgaagatctgtcattatcttgatctcccaatccagcatgcgaatgataccatcttgaagagaatgggacgcagaacttcaaaacaggagctgatcgacattgtgcagaagcttcgtaaggaaatcccggatatctgtcttagaacaacactgatcacaggctttccgggagagacgcaggagcagcatgaagaggtgatggaattcattgacacacttgagtttgatcgtcttggagcatttacgtattctccggaggaagatacaccggcagccacattcgaagatcagattgatgaagaagtgaaagaggatcgtcaggcagatatcatggaacttcagcaggaaattgcattcgataaagcggaagacatgattggaagagaagttcttgtcatgatcgaaggtaaagtcgcagatgagaatgcctacgttggaagaacttatcgtgatgcaccgaatgtagacggcctgatctttatcaatactgacgtagaattgatttccggagattttgcaaaggttaaagtgaccggagcattagattatgatttgataggagagttgatgtagtatgaatttaccaaacaaattaacagtattacgtgtgattatggttccgttttttgttttctttatgttgacagatgtaggcggagctgcgaataaatggatcgcacttgtactttttattgttgcaagtctgacagatatgttggatggtaagattgcaagaaaatacaatcttgtaacaaattttggaaagtttatggatccgctggcagataaacttcttgtctgctcagcaatgatctgtctgattccttcaggaaaacttccgacagcagttgttattgttattattgcaagagagtttattatcagtggtttccgtctggtagcatctgataatggcgttgttatcgcagcaaattactggggaaaattcaagacagtatcccagatggcaatgatcattgttctgattgctgattttggcggtgtattcgacatggttggaacagtactgatctggattgccacagcacttactgtgatttctctggtagactatgtgtgggcaaacagagaggttcttacaaagggaggcatgtaagagatgtatctggagtggttttttaaagagaaagctgcaggtgagaaaagtctggaagaagttgtagtagatcttcttgcagagcgtaaacttcatgtgacaacagcagaatcctgtacaggtggattgattgcaggaacgttagtcaatgtggcaggagcatcagatgtgctgaacgagggatacgttacgtattcgaatgaggcaaaggaacgtctaattcacgtttctcatgagacacttgaagcttacggtgccgtgagtgaacagacagcgcatgagatggctgagggtgcggcaaaggctgcgaatgcggatgcggcactaagtgcaacaggaattgcagggcctggaggtggaacagaagaaaagccggttggtcttgtatatattggatgttatctgaatgggaagacgacagtgaaagagtgtcgttggaatggaagtcggatggagaatagactggatactgtgaacgcagcattggagatgctgaaggaacgtctggtggaagagatgccggtggagtaagaaaagattaagttgaagcagtaactgtttccaaaaggatacagaagctgcttttcttatacataaatttgtcaagtgtcatatttatataattctttccctcagatggtgaaaatcttgtcaaagttgtgattgacgaatgcgacaaattgtgcgaaaataaatacatatggtgcagggagaaagagtttgtggcaggtgacaaatcaacttctcaccgcgcagacagttcagtgttaaaaaataatgcagagctgtcagtttttgtgcgaaaaaaatagtgtaccgtatacgaagaaaatcatacatattgaaaggagtattaacatgatttattcacacgaagtagaaatgatgtgtccggtagcccagggcgtaaaccatggcgcagctccaattccagaagaagctaaatgggtaaaggcaaaagaaatcaaagatatctccggacttacacacggtgtaggctggtgtgctccacagcagggtacttgtaagctcacactgaacgtaaaagacggaatcatccaggaggcacttgttgagacaatcggatgttcaggaatgacacattccgcagctatggcttctgagatccttccgggaagaacacttcttgaagctctgaatacagaccttgtatgtgatgctatcaacacagctatgagagaactgttccttcagattgtttacggaagaactcagagtgcattctcagaggacggacttccgataggagcaggacttgaggaccttggaaaaggacttcgttcacaggttggtacaatgtacggaacactgaaaaaaggacctcgttatcttgagatgacagatggttatgtaacaggaatcgcactgaacgaagatgacgagatcatcggatatcagtttgtaaacttcggtaagatgatggacttcatcaaagctggagacgagccggctgtagcgcttgagaaagctaaaggacagtacggacgtgttgacgatgctgttaagatcattgacccaagaaaagagtaaggaggactatttcaatggcattatttgaatcatatgaaagaagagaaaaacagattcttgcaaaactcgctgagtatggaatcaactccatcgaagaagctgcagaagtaactaaagcagctggtcttgacgtttacaagatggttgaaggaattcagccaatctgtttcgagaacgctaagtgggcttacacagtaggtgctgctatcgcaatcaaaaagggatgtacaaaggcagctgatgcagcagcagcaatcggagaaggacttcagtctttctgtattccgggatctgttgcagatcagagaaaagttggtcttggacatggtaaccttggaaaaatgcttcttgaagaagatacagagtgcttcgcattcctggctggacatgagtcattcgctgcagctgagggtgctatcggtatcgctgagaaagcaaacaaggttcgtaaaaaacctctgcgtgttatcctgaacggtcttggaaaggacgctgctcagatcatcgcacgtatcaacggatttacatacgttgagacagaacttgactatcacacaggagaactgaaagaagtattccgtaaatcatactctgaaggacttcgtgcgaaagttaactgctacggagctaacgacgtagtagaaggtgttaagatcatgtggaaagagaatgtagacgtatctattacaggtaactctacaaaccctacaagattccagcacccagtagcaggaacatataagaaagagcgtatcgaagctggaaagaaatacttctcagttgcttcaggtggtggtacaggacgtacacttcacccagacaacatggcagctggaccggcttcttacggaatgacagatacaatgggacgtatgcactctgatgcacagttcgctggatcttcatctgtaccggctcacgttgagatgatgggacttatcggagcaggaaacaacccgatggttggtatgactgttgctgtagcagttgctgtagaagaagctgcaaaggctggtaaattctaagaatagacaaaaatagtcaaatataagcaaaaaattaggaggtaaacacaattatttgtgaatacctcctttttattccattgcccacaaatcatacacggtgctttgcccacactttgcccacacaaaaactaacttgtgggcaaaatatagatggctatattatcataaattgattattttttataaataaaagatatgcctgtatggatgatggcttttaaaagagcagaagagtattgttctgattatgatttcggaagatttttgatcgcatttaatgatatgaaagaaatattttaatccataaatattacccacaaaaaactgtcttatttcaagatagtttgttataataataaaacaatgagttatataggataataaaggaatataagaattaatgattacgaacggtatttattttcagaaatagttaaagtttgaatatatgacgattttgaaattaattttactacaatctagaaaaaacgaggcatcacacatgaagataaagatggtagacattgcaaggcatctcggagtttccaaagcgacagtttcgcttgcggtgaatggaaaacccggtgtgaatgaagaaaccagaagaatggttttggaatgtctggaagaaatgaagaagaataacggagtgatcccggtaaaagagaatatcgttacagtgtctggccatccggtgaatcagatgatcaaaatagtgatcgttaatcacagcaaaggtgctgcgtgtaattcagaaacagatctctggtcagatgtacttgctacatttgattctgaagcaagaagacttggatatctttatggagtgacgtatttaaatgatgacattacgcaaacagaagcagtaattacggaatgtaatatggattttgtggcaggcgttcttctttttggaaccgaattaaaaaaagaagatcaaaacctgcttgaaagaatcaaaaaaccattggttctttatgactgtgaactttcagatagtcggtatagcagcgtatgtgcagacaatagacaaatgctaaaaagtgctgtggattatctgtacaaggaaggtgtatcagatatttattatttctgcacagggaaagataattataattatcgagtccgtaaagaagcatttttaaatacaaagtctaacgaagatactgcatctgcaaaacatattcttgatcttggagatgaaattccaaagataacggagactttgttagactggttgagaaaaaatccgcttccgcaaggaattttatttgaaaatcaacagatttcaatcggtgcgttgacggcgcttcgaaagtatggagtgaacatcccacaggaagtgaaagttgtcggatttggtatgattcctgactatatataccaggatctaaagctggtacaaatgagaacatctgacacagaaggtgttcttcttgcaatggatttactggataaaaagattcatcagtactcaaggtctaaagttaagatatacacagaagcagaaatgattgtaagttaaaataatcgtaagacaaaagaacggaagaaaacaaattggaggaacagaaaatgaatgaatattttccacatttatttgaaccaattaagattggtaagacaacggtaaagaacagaatctttatgccgccgatttccacaaacatggcagataaaggctatgtgacagatgcgttggttgagcattattcagccagagcgaaggggggagtcggactgatcgttacagaagttacgacagtagagccggtatatacatacttgccgggagatatgtcaatctatgatgattcttatattccgggatggaagaaactggtagatgcagtgcatcagtatgatacgaagatcttagcacagctatttcatccggcttatatggcatttccaattccgggaacacctcagctgatcgcaccgtccaatgtcggtccttattatgcaaaatcagcaccgagagcagtaacagtagaagaactgcatgtacttgttcagcagtttggagaggctgcacgccgtttccagatcgcaggcggagacggagtcgagatccagtgtgcacatgcgcatggactgctcggtggattccttacaccactttataataagagaacagatgagtacggcggagacattaacggacgtctcagactgacacttgaagtaattgcaaagattcgtgagctttgtggtgatgatttcattattgatgtccgtatttcaggagatgaatacagtgaaggtggtctgacactgaacgatatgatctatgtatccaaacagcttgagaaagcaggtgttgactttatccatgtttccggaggaaatacgatcaagagaggaagttctatgcctgcacctggcacatcacctgcaccgcatgcacacgcaagtgaggagatcaaaaagcatgtgaacattccgatatctacagttgcaagaatcaatgagccatggatagcggaagaacttatcgcaaacggaaagacagatatctgtatgatcggtcggccgaacctgtgtgacagtgaatttgttaataaagctgcagaaggaaaaacagatgatatccgtccatgtatcggatgtggacgctgcctgacaggaatcatgtttggtaatccgatcagctgtacagtgaatccatctgtagagtctgacgagatcaaagaagcagatgagaagaagaaagttcttgtgatcggtgcaggtccggcaggaatggaagcagcttacgttgctaagaaacgcggacatgaggttgttctctgcgaaaaaagcggagagttcggaggactcttaagacttgcagcagttccaatcgccaagcaggaactttgtaaagtaatcaaattcatggcacgtcgtctgaaaaacgaaggaattgaagttcgtatgaactgcgaagtaacaccggaaatgcttgcgggagaatttaaggattatgaggttgtctgttctacaggagcagttccgaaagaaatccctccattcaaagtatttaagcagacaatgacagctgatgacgttcttgccggaagaaaatatccgggaagaaagattgttattcttggaggcggatcggtcggatgtgagacagcagattatcttgcaccactgattgatgacatgttccctgcaaaccgtgatattacagtgatcgagatgacgccatcactgatgccgggtgaaggcggagcagctaagagccagcttacaatgagactcaagagaaaaggtgtaaagattgaactgaacagtcaggtgacaaaggttgatgagactacgatcacttatgagaaagacggacaggaatatcatatcacagatgcggatacactgatctttgcagtcggttatgcaccaaacaaggtagagactacagaagagagagttcattttatcggagactgtgataaagtcggaactctgaaagatgcaattgctgcaggacataaactggccgaagaactgtaattgaaaaaaaggagaaaaaagatggggaataaattatcagaaccaattaaagttggaaatcttacttttaaaaacagaatcatgtttccaccgctcacaacaggttatgaagaaagagacggatcgattggggagagaagtctgaatttctatgaaagacttgcgaaaggtggagcagcatatgttgttatcggagatgtagctcctgtaagaacagcttcaccgacaccaaagctttatgatgacagccagattccggtatataaaaatctggcagacacattacataagtatgactgtaagcttgcacttcagctgttccatccggaatatgatgttccgggtgtcggacgtatgatcatggaggcaggtattgcaagacaggctgcggcaaaagcacaggcagagggaaatgcagaagaagcaaagaaacagatggaagaatgcgacagacttacgaaaggcgcttatgcaaaacttcatcatgatatgcagcattttgtaacagaggcaactgttgagcagttagaagatattaaaaacagtatcgctgcatgtgcagtaaaggcgcagaaagcaggaatcgatgcgattgaagtacatggagatcgtctccttggttccctttgttcaaaaattctgaaccatagagaagatcagtatggaggaagtcttgagaaccgtacaagatatgcactcgaagtagtagcagcaatcaaagaagctgcaccggatcttatgattgagtataaactgccaatcattacagtaaatcctgatggatcacttcgtggaaaaggcggacttgaggcagaagaaggagtccggtttgcaaagatgcttgatgaggctggaatcgatatgattcaggttgctcaggcgaaccatacaggaaatatgggagatacaattccgccaatgggagatgttccatataactggacacttccggtagccagagaagtgaaaaaactggtatccgttccggttgcaacagttggtcgtgttgtcagcttagaagcaggagagaagatcctcgaagacggagatgccgatatcgtagcttatggacgttccatgcttgcagatgcagatattgctaataaagctatatccggagagtgcatcagagaatgtctgaactgtaacaaaggctgtgtagatgcaattcagggacgtaaatacatttcctgtgtattaaatgcagagaacggaaacgaaggaactatatttatcaaacctgcagacgagaagaaaaaggttgcagttgtaggtgcaggaatcgcaggacttgaggcggcaagagttgcagcaaaacgtggacatgaagtaaccgtatttgagaaatcagataagattggtggacagattcatctggcagcagttccaccgagaaagagcgagattttaagatctattgaatattatgagaagattctaccagaactttctgtagatgtgaaattaaatacagaagcagattgtgaagagctgaataagtttgatcatgtaattcttgccatcggtgcgcataacatggatcttccaatgtctgttacagacagcaatgttgtttctgcctgggatgttcttgcaggatgcgaagtgaatggagcatgtgtagtacttggcggaggattagttggaactgaaacagcagaattccttgcacagaaaggtctcaaagtaagcattgtcgagatgctggatcagattgcaacaggagaatccgagacagtaatgccactgatcaaaaaagactttgaagaacacgatgtaaaagagtatgtgaatacaagagtgaattccatcgagaataatgtgattcatgctgtgaatacaaaagacgagtcagaggttacaattgaagctgatacaattgtgaatgcactcgggtctaagaagaatctcttcgacgacagtaagctgacagttccatttgtatatgttggagactgcagcggtgagagaacagcagatatctcagcagcaatccgcagcggatatcaggctggaaatgaaatctgagaatttttaaattttattcagtgagaaaataagtaaaatacagggtggtgctgtaaacagaaaatctgtagacagtatcaccctgtttcagttataataaaataaaatttttgttataaaaaatgaaaatggagcaaggctatgataaacaaagaactattttataaagtaacattaattgattgtaacggaaaagaattggaagttgctaaatttctgcagattttaacaggaatggaaaaaacagaaacaagaagaattgtagcgagtttaccgtgtgttttgtatgaagagcttgacggagaggcgtgttcttatattgaggaggcactggatttctatacagcaaaatataagtttgaaccagtcggtgatgaaaaagaagtgtatgaagtagatccatcggtgtatccttcaaaacaggtgatcgcgcttggaagtatggttgactacatcggtaagaggtcagagtttgtaagcatcgcgagaaaatatgatttcccgaagaatgtgagtctgaatgatacgcctttcctggtaaaagacggtttggcagaggggcaggcagtgaaccttcggcaggatcttcgcaatatgggaatgtttgcattgatcatgagaagcggagcagaagttcagcaggtgaagaaaagaggattttttacggggctatttgcacgttgagatgaataaaagggttgtttgatacagacagctgtgagtagtgattatatagccgatttcttacagaaaattcaattggattttattgacacttttgctgagaaggactacaatatctttagattgttaatttaataacatacaaataaggagtttaggaggcagacaaaaatggcaaatattttatgtagtccaagcaaatatgttcaaggtgcaggtgagatgaaaaagctgggtgaatatgctcagaagtatggtaaaaaagcacttgtactgatcacagagtcggggtataaacgtattgaagacgttctcaaagttggatttgaaggatatgatattgaaccagtgtatgagtatttcaacagagaatgtagcaagacagaaattaatcgtttggtagccgttatgaatgaaaagggctgtgatgttgttattggtattggcggaggaaagatccttgatactgcgaaagcagttgcttattacaaagaagtgccggtactgatctgtccgacaattgcatctacagatgcgccatgcagtgcactttctgttatttatactgatgaaggcgtattcgaagaatacttattcctcccagctaatccaaacatggttctgatggacacagaaatcattgcaaaatcaccagtcagactgacagtttccggaatgggtgatgcacttgcaacttattttgaagcaagagcctgtcaggctagcgaagcaacaacttgtgctggtggaaatgttactatggcagcgatgtcactcgcaaaactgtgctttgatacattgatgaatgaaggtgtgaaggcaaaacttgctttggaagcaggagcctgcacaaaagctgttgagaaggtaattgaagccaatacattgcttagtggaatcggatttgagagtggcggtcttgcaggagcacatgcaatccataatggattcacagttttggacgagtgtcatcatatgtatcatggagagaaagttgcatttggaacaatcacacagcttgttctggaagacattccggcagaagaactggaagacattatagattggtgcattgaactgggacttcctgttacattaaaagaacttggtattacagaagtgacagacgagaagcttatggcagttgcgacagcagcctgtgcagagaatgatacacttcataacatgccatttgaggtgacacctaagactgtatgcgcagcaattaaggcagcagatgcttacggaagatatttcctgggagaatagaatatgggaaataggacaccatttcgttaaaatagaaaaaccaatttgacaaactgattttctgtggtataattttcatgttgtgaaaaacagccgacagttcatttgtaccttcctgtcgaaaaacaaaaccagggctagttaagaagattctaggctctgcgtgcaaagaagtacgcagagctttttatattattcaggaaatactttcccatatatataaaacgctccgcttaggatacacagctcttaaaaggtacatacatttcaaatacaggagagttgaaatatgtattatttgcaaacaaaagccagttttgacgcagcacattttctctggaaatacgagggaaaatgcagaaatatccacggacatcgttggaatattgtcgcaaaaatcaaaagtcagaagctggagcaagaaggacagacacggggaatggtagtggattttggtaatctgaaaaaggatttgaaaaagctttgtgattcctttgaccatagtttgatttacgaagtgggatctctgaaagcagaaacagtagctgcgcttcagaatgaggactttcatttggagaaagtttcctttcgtcccacagcagaaaattttgcatattatttctacaagaaattaacagaacttggatacggggttcattgtgtggaagtatatgagacaccgaataattgcgcggtttatgaggaagagtagatgaaagtagtagaaaaattcaccagtattaatggggaaggcacacgggcaggagaattggcagtctttgttcgtttcaaaggatgcaatctgcgttgtagctattgtgatactatgtgggccaatgaatcggattgcccatatgaagaggaaaccccagaagagattttaaattatgttttaggaaccggaattcgcaatgtgacacttacaggtggagaaccgttactgcaaaaagacattagagaattgatctaccttcttttacaagccggcttacaggtcgaaattgagacaaatggcgcagttgatttatctgcattttgtgaagaacgaccggtatttacaatggattataagttaccgtcaagcgggtgcgaagaatatatgataacagagaacatggaactgctaggaaaagatgatactgtaaaatttgtatgtggcagccaggaggatctgttaaaagcattggacatgattcagacttataatctgacaaacaggtgtcatgtgtatcttagtcctgtttttggatccatagaaccagtgcagatcgtagaatttatgctgaaacatcgattgaatggtgtgcgtctgcagattcagatgcataaagtgatctgggatccaaatgaacggggcgtataaataagtagtgaggtgatggagatgaaagcattagttctctttagtggaggaattgattcaacaacggcattaggactggcaatcaaaaagtacgggaaagagcaggtgattgcactctcggtttcttatggacagaagcacgataaagaaatcagggctgcaatagcagttgccgaatattatggcgtggagcatctgttcctggatttaagcaagatatttcaatatagcaactgttcactgcttcaacagtccacggaagaaattccggaggagagttacgcagagcagatttcaaaaacaaatggcgataagcctgtaagcacatatgtaccgttccgaaatgggttatttctttcttcggcagcaagtatcgcactgagcaaggaatgtggagtgatttattatggagctcatgcagatgattctgccggttttgcttatccggattgctcaccggtattcaatcaggcgatgaatgaagcaatctgggaaggctccggacatcagctgaaaatagaagctccttttgtaaatgtatccaaagccgaagtagtacggattaatctctgccaccgcagacagaacagaaatcatcagctttccactatcttttgagtttttctttctgagcatccaaactgtagccatctacctgcatggttgtagacactctagtatatatatcgcatttaatctttttattcactttttctcccctcctcagaacatcccaaagcaatctccaacaattccgttgcaacttgtgaatttctgatacgcattaagttatcccagacatcagcttttccaagtagattcatcccaccatgccatactatttcatcatcaataacagcaaaacattcttctacttctgttcttgttatcacatttattcctaccaattgcattgttctgattaattcataacatatatccgattttccataagtaatatcttccggatctgttgtaataactgtaacctttacccctacttcctgtctcttctttattagtaataaaaatctatcaattttatcctgtctgatatccggactggaaattaccaccattttttctgactctacaatatcttgctcgaatttttcggtataatttacagaatcaaatattgcatttattatttgtttaggttgcaactcttgcgtccagattgaaaatcccatcttcctgtacgttctcaatctttttgcatacattttatcaaaataacgcacatgagaatcaatataatcatacacataaacggcttcttttccgacataatctctgtttaatctacctacatactgttccaggcgtccttcaaaagatacaggtgctgcaagcattaatacatccagtcttgggaaatcaaacccttctcctattttctgaccagttgccaccaaaataagcgattcattttcaggtatctgctttaattttactcttatttcagcattttccttatccgaattatccccatacagaaggaatacatgatctgctttttcctttaaggcatcatgtaaaaattttgcatgttccttaaatcttgtcaaaattacaggagtttgttttcttgcaacacaagttataacatcatctatgattatttcattgcgcaccttactggtacttatcaaattatatgctttattaatattatccttgctttctgcagtatcaactactcttgtgtatcttgggacaaaataatgtccaatcccctgttccttagccctctccaacgcagtaaatctatgtctcaaaggtcccagcagcatatagataatccgatcaagactgtcaccacgtttaggcgtagcagaaacaccatacacgtattttgcatttattttctgcaataattccatagatgtattagaagctgcgtgatgacattcatccataattaccattccgtaagaattaattcgttcattaaattttcctctgctgtacatcgaaccaaccattgcaacatctatgatccccgtcaatgtatttttatttccgtgcaaaacgcctatcacactatttctttttttctttcttcctgtttttgtttcatattccggtggttcttctcttatctctaagaaatgattcaattcatcaacccactgattaagcaaatctttactttgcagcaaaatgagcgtatttacttttcgctctgcaataaggtaactacatactacagtctttccaaatgcagttgccgcactcagaaccccatctgaatgtgataataatttttctgctgcgaattcctgttgcattcgcaaatcacctttaaaagatactctgataggttgtcctatttctctttgatctgaaacatcaactgagatgcctgctttttcacattcctgtataatattttcccgcagtcctctcggaatctgtatatatccatctatatccttacctaaatatacagcactgaaattataataattagaatatcccagccttttatttttgtaaaattccggattatcaaatgccgccaaactacgaatctgattttgtattcttggcataagattcagagtatcaatataaactccattgcccaataccatgtgaagcttgcccacaacatctgacttacaaaactcacatttcttcttccatggtttcggtctgacattcttctcaatattagtaagcgttcctctgacttctgctaattctccctgccattttgccatgcattgttcaacatcttctattcccagctttcttgttttattaaaaagagcatcccattgatcaggatatgcattccaattttcatctacaaaagcactatttccatttttaagcgcctgcccctgtaatggcagtgcaatcaaattacctatgctgcttgccacatcctgcgaaggatacattctatcataataatgaaacgatttcagattgatggaagttgaacccttgtctaacaggagaaatccaaaatttcttgccgtagccgccggtattgcttttttaaagaaaatccatacatgggcaccttttccagatcgagatctctcaactaaaggtctgataccattaagctcacacatttttctaagcgcatccacttctttatgccactcattatccgtatttgcaaaatccgtaacctctgctcctttttcgtgattatcaaaatcaaatacaataaatctgcatgtaccatttggcagtaaaggatatacacctattacatctgatccatcttcttttgtgcctaacaaatgatcaattatttttttaacatccaaactaatccatttggtattttcacattcatcacacaataccttctctttacgttgtttagggcaaagccggtcattccaacgatttgcacattgtggaaaataacccccgttctttccccgtctagcatatacatcttctcttccccaaaacatcgaaaagaaacgtattgccattttctctgtaatatatggcagatttacaatacgattcccttgatccaggtcatatttttctgcactttctattttttcttcaaaaggattcacctcttcatatgaaatgcctgctttcttcaatttatcttttaatatcttgttctcatattcaagcaacctaaccatctttctcaatgaatccgcatcatatgcttctatgttcaaaccttccacctacaattcttatcatttcgtaatctaacctttattttgtgtcccaactttattttagtacttgttccaactatttttaatacttatttttcctattgacgcatttctctgtcaatcgcataattaatacacaaaaaccccaaaaagaggaggtgttcgtatggctacttcaagtattactcataattttgtcatatccaatccaaacagcgtaaaactttttattgcagcgattgacgaagccgaccgtgaccgcacaccaaagcagacacttcccggacgtcagtcaaagtccgtgcttgcacgagaccttggcgactgccgcgataacttgagaaactcacggagcgtgtttctcatagtttctgtcagcaaaaagaaacggaactgacatttttaataatatctgtttctgagatttcttgtataaacaccgaaccagatcaatacaataaggaaaataatcattgcaactgtatctactattgtcattgtatgaacataacagtgaatcacatcgatcactccatagatcacagataccagtccaaagacaaaaagcgccggagctgtttttgctatataagcctctttatccttacattttttataagtataatcttttcccaggagaattgatgcattgatctcgccctttactttcattataacaaaggaatacaatgcgtaaattccacaacatagaacaaaaatacctataaatccccacaagctgttatccatttttttacaccccaagaatattttttactgtctctttcatctgatctgcatcacactctgttgtatgacgaacctctgcatcacggatttctttgatcgcatttggaatcgggaagccagatactttttcaagctcatcaatcagtgcaaagtcttccatctcatcatacttcggatcaattgctgtcataacgttgcgtacgaacttgtacggacttgctgtggaagcaaccagacatttcttctcgtcctttgtatctttacgatactgtgcacacacatgtgctgcaactgctgtatgagtatccatcacatatcctgtcttctgatatgtgtcatggatcgtctctttcacttcttcttctgtcgcaaatcctccgacaaagtctttcagaccttccttcatctcagctgtgatctcatacacacctttttctttcagctgtgtcatgagctctacatccttctgtgcatcctgtcctgcgattgtgtagatcagacgctccaggttgcttgagatcagaatgtccatggacggtgaagatgtcaagataaattctctgtttctgtcatagacacctgtctggaagaaatcaaagagaaccttgttatcattggaagcacagatcagttttgcgatcggcacgcccatctgttttgcataatatgcagcaaggatatttccaaagtttcctgtcggaactgtaacattgatctcctcgcctgcctggatctcttcattctcaagcagctttgcataagcatatacataataaacaacctgcggtacaagacgtccgatattgatggagtttgctgatgagaactgatatcccttcgcatctaattctgctgccagctctttgtcttcaaagattgccttcacaccgctctgtgcgttatcaaagttaccatggattgctacaacagaagtattctctcccttctgtgtcaccatctgtaattcctgaacgtggcttacgcctccctttggatagaacacgatgatctttgttcccggaacatctgcaaaacctgcaagtgcagccttacctgtatctccggaagttgctgtcaggatcacgatatcatttttcacctggttctttcttgcggaagtgatcatcagatgcggcaggatagaaagtgccatatctttaaatgcgatcgttgctccgtggaacagttccagatgataagtatctcccaccttcacaagtggtgcgatcacttctgtatcaaactttgaatcataagcactgttgatgcagtgtttcagttcttcttctgtaaaatctgtaaagaactgtttcataactgcataagctgtctcctgatatgacatgtctttaagttcatccattgttacatccagcttcggaacggatacaggaacaaacagtcctccatcatcagccagtccctttaagatggcctgtgaagctgtaacagtcttgtctgaatttctggtgcttttgtataatagattcatccttacatccctcttttatcttgatttcttacttttagtttccagtgaaaatcactcttgtctgcaagtataacacaacttttcttataccacaagaaaatatattatttttgcttttttaagttaccactttactttactgtagttttttactctgtggccggaagatgattgccaaaactccgcatactcccataagaagcggataatacagattcggaataatctgaagcggtgtcaatccggtcagtgttgctgctgacagaagctgtgctccgtatggaatgataccctggcctacagatgtaaacatatccagaagtgaggctgatcttctcggatccacatcaaactcttcactgatttcttttgcgattggacctgtcataacaatggcaaccgtattatttgctgtacatgcatcaacaaaaaaggcaagaagtgcgattccgaattctgctcctcttcttccattgatcttgctcttgatcagattcagaatgaactggattccaccatgctctttcacaagtgatacgatacatgctacaatgatagaaataactgtgatgtcatacattgatgtcacaccatttccaacaacctggaacatttcagaaagtgcaatatgtcccatgcttacacctacgatcagggagatcacaattccgctgatcaaaacaacaaatacattgattccgataagtgctccaagaagaacaaccatatacggaagaacttcccaaaggctgtaacttacgttttcctccaaatggaaattcatatttcttgttgcaaaccagaagattaatactgtaataatcgctgccggaagaacgatgaaaaagtttgccttaaacttgtctttcatctcacatccctgtgtcttaactgctgcaattgttgtatcagagatcatagaaaggttatctccaaacatagctccacacacaactgctccgatgcagatactaagtgcaaatcctgtcttttcactgattccaactgcgatcggtgcaagtgctgcaatcgttcccatggaagttcccatagaaaccgaaataaaacatccgatcagaaacagacctgcaactgcaaaatgtgccgggatcaatgacaatcctaaattgactgtactgtctactccgccggctgcagtaactgcacctgaaaaacctccggcgcagagaaagatcaggctcatcgtaatgatgttttcctcaccaacacctttggcaatcacttcaatcttcttgttaaaactcaattctttattctgcaaaaatgcaacaaacaatgcaatcaaaaacgcaacgatcgccggcatcgcataaaaatcctggaacacaattcctgcgccaagaaaaatgatcaaaaacactcctattggaagtagtgcaatcgctcttccttttttctccttctccataaaatcctcctgctcataccatttttatttttatccccattttctttcatcgaattggcagctgccttcccgacttgtatacgtataaaaggcagtgactatttttgtactgccactgccttttctattttcttattttgctgcaatatatccttttgctgtcaatgcctctgcacagagaactgctccacctgctgcacctcttactgtgttatgggacagtccgataaacttgtaatcgaacattgtatcttctctcagacgtccgatagatacgcccattccacgctcgtagttcacatcctctgttacctgtggacggttgtcctcttcaaggtactggataaactgcttcggagcactcggaagttctgcttcctgtggaaatcccttgaatgctacaagcttctcgatcagctgctcttttgtaggcttcttctcgaagttgatgaatactgctgctgtatgtccgttcagaaccggtacacgcacgcactggcatgtgatcttcggaagctctgctttcacgatctgtccgttctctactttaccaagtacacgaagcggctcctgctcgctcttctcttcttctccaccaatgaatgggataatatttccaaccatttccggccagtctttgaatgtcttacctgctccggagattgcctggtatgttgtaacaaccagttcttttggtccgaactctttccatgctgcaaggcaaggtgcatagctctggattgagcagtttggttttactgcaatgaatccgcgtgttgttccaagacgtttcttctgatctttgatcacttcaaaatgatctgcattgatctccggtactaccattggtacatccggtgtccagcggtgtgcactgttgttagatacaaccggtgtctctgtcttcgcatatgcttcttcaattgctttgatctcgtctttagacatatccactgcactgaatacaaaatcaactgtagatgctacatgctctacatcatttacattcaggactaccagcttcttaactgcttctggcatcggtgtatccattttccaacggtcacctactgcttcttcatatgtcttacctgcggaacgcgggcttgctgctactgttacaacttcaaaccatggatgattctcaagcagagaaataaatctctgtcctaccatacctgttgctccaaggatacctacttttaatttctgctccattgttttcttctcccttttcttcttattttctattttctatccaaacgttctctttcaattcccattatataatgaaagaaaatattcagttatttttgctcgctgtgattatccattactctgtcacaagataagcttcttcgattgcgatcactttctccattgccacttttcccggtgcaccgatcgtatttctcatctctacacaggtcttcatgctgatcgcatcataaatatcttcttcaaacaccggtgagatggctttgaattcttccattgtcatatcatccagtgctttcttatgctcaatgcagtacagtacgagttgtccaacgattccatgtgcatcacggaacggaactccatgattcaccagataatctgctgcgtctgtcgcattggtaaatccatgcttcgcactctcttccatgcgtgcatcgttaaacttcattgtcttaagcattcccgtaaagagtgccagacatccttttgttgtatcaattgcgtcaaatacgagttctttgtcttcctgcatgtctttattataagcaagcggaattcctttcatcgttgtcagaagagaggtcaatgctccgtaaactcttcctgtcttaccacgtacaagttctgcaatatccgggttcttcttctgtggcataatactgcttcctgtactataagcgtcatcaatatccacaaactgatattcgttggaattccagatgatcacttcctctgagaatctgctcagatgcatcatcacagttgacattgctgacaaaagctcgatcagataatctctgtcagatacagaatccatactgttcagtgtcggtcctgcaaaatccagaagctctgctgtgtactctctgtcaagcggataagttgttccggcaagtgctccggctcccaacggacagtaattcattctcttataaatgtctttcattctggatctgtcacgcttgaacatctcgaaataagctcccatatgatgtgcaagagtgatcggctgtgctttctgaagatgtgtaaatcccggcatgtaagtttcgacattctctttcatcagtttcagaagaacttccagaatctctttcaagagtccgtcaagctcaataatctcatctcttgtataaagtctcatatccagtgcaacctggtcgtttctgcttcttcctgtatgcagcttctttcctgcatccccgatccggtcgatcaggtttgcctcaacaaagctgtgaatatcttcatatttatctgtaatctcaagtattccgttttccacatcctcacggattccgttcagtccgtcaatgatctgcttcttctcatcctcagtcagaattccctgctttgcaagcattgtcacatgtgcaatacttcctcggatatcctgctcatagaatctcttgtcgaaagagatggatgcgttaaaattataaaccagctgatctgtctcttttgtaaaacgaccgccccataactgtgccatctgtctttccccttttctattatatcgtatttgcccattagtttatcacactaaagtgtcaaatgtctactataaacttgcaaaatatacctgatttcgacgaattctgtagattttttcttattttctgctattttgattgcttcttccgtcatttcacacacatttttctgcctgacgcgctttataggagaactcacatccacaataatcctgacggtaaagaccatagattccagacagttcgatggatctcttatatccgttcttcttcttgaaatcagaaagcagatactgtacaccatattcttcgccgacacgttgtccgatttcattcaacttctgcgcattcttcatcggacttatgctaagtgttgttgtaaaatagtcgaatcctccggccactgcaatttctgcggattccttcagacgaagttcatagcatcccatgcatctcgaaccgccctctttcacttcttccagtccttttgccatctcatagaaccggtcgcggtcatatttaccggctaaaaatgataccggataccggaaatgcatctcttcaatcaatttctgttgttccaggatgcgctttgtgtattcactttccggataaatattgggattataatagaagacagtgattttaaaatactgtgataaatactctaatacataactactgcacggtgcgcagcaactatgtagtaaaagagttggtactttttcttccttttccagtcttgtcagaagcttctccagttctttctgatagtttattttctgtaagttcattttcatcattctcctgtatctttgttccagatcaatcattccttttttctaaaacgcctgacatgttcattgattcactctcaggattatttttacatatcataacattaactactactgaaatggagtcttcaatgaattctcttctggaacttcataacatatattattcttatcacacattggacgcagaaacaagggctttatctgatctttccttttccgtgcaacctggaaccttcacagcagttgtcggtccttccggatgcggcaaatctacacttctctccctgatctgtggattgatgaagccagatgcaggagaaatcctgttaaatggtatccctctcaaggaaaattcccccctgattggctatatgctccaacacgatcatttactggactggcgcagtatttaccggaatgtcaccctcggtccggaaatctgcggcacactgaatactgcaaccaaaaaacgtgcgtatgagcttctcgaacaatatggtttaagacaatttgcttctgcacgtccctcccagctttccggaggaatgcgccagcgtgccgccctgattcgtactctgctgcctgatccgcaactcttactgcttgatgaacccttttccgctctggattatcaaaccaggctgaccgtcagcgacgacatcggccagattatccgacagagtggaaagaccgcacttcttgtcactcatgatctatcggaagcaatcagcctttccgaccgggtcattgtcctcaccaaccgtcctgccaaagtccattgcgaaattccgattttctttaaattagaacaagacacacctttaaatcggcggaatgcacctgaattcaaacactactttaatcaaatctggaaggagctaaaccatgacaactgagcatcttcgttttctcaaaaaaatccgcagacgccgacggatggtcgtctttctgcggatcctgattcttttcttattcctgttacaatgggaaatctgtgccgataccggagttgttgattcctttatcttcagcagcccttcccgtatcgtaacctgttttctgaaaatgacaaaggatggttctgtctttcaccatattggaatcaccctgtatgagacacttgtcagctttcttctggtcacacttaccagcattctgattgcaatcctcctctggtgtttccatggactctccgaaattcttgacccttacatggttgtcctgaatagcctgccaaaatctgccctggcgcccttacttattgtctggctgggtgccaataccacaaccattgttgttgccggaatgtccgttgcaattttcggaagtatcctgaacctctacaccagtttttctacgatcgaccaggaaaaaattcgtctgatctacacactacatggaaaacgcaggcatacgctgaccaaggtggttcttcctggttccattccggcaatcatcagtaatatgaaagtcaatattggactttgtcttgtcggagttatcatcggtgaatttctagccgcaagaagcggacttggatacctgatcatctattccagccaggtatttaaacttgactggcttctgatgagtatctgcattctatgtatcattgcagtgctgttgtatgcgataatcggtctgatagaaaagtggtatctgaaaaagacggggtgacagtattgatctgtcatccctacttatttattttttagaaacattctccctgaaaatgctatgtgcgctctctcataaaactcgcactcaaccgggcagattgggcgatacaatggatctgctactacgatctgagcgtttttcagggcgttttccatctcttcttcaccgcatatcttcagatcatgctctcccagcaatccttctgcattctctaagggacagagtatccttgttttataatggtatcttctttcgataattgcagcaagagatccaattgtaaccggttctccgatcaacgtaattatttttttagagttaccagttccctgtaaattctctcttctccgatcttctatagcgggaatctggatgcgtttttccaaagcttcactgattctctctgcatattctttataaggtgttccaatcacataaggcgttccatatttttctttcagcatcttcgctgccctaagcccgacagaggatatcacaagattcatctccgcttttcctgcctgtgccagatcttccaaagaatctcccatcgcccatgcggaaatcaccttccacccatactgctcaagattcttttttagttcttctacttttgaaatcgggccaaaatcgagaggtgttgctccaagcagatttactgtacgttctgaaccatttctgtcttccatttgctccggaacaaatcttctcgcaatttcctccagtgcctttcctgcaccatacacataatcatgcattccattcgttggcactgcaaaggccggaatccccgtctctgtctcaagcactttcgccaaagccggaaaatctgttccattcataaatggaatcggtgaacttacaagagcaataaatttcggatgtaattcacctgccgcctctctgatatcagataagaatttttcatcattccccatcactgcatcaatctctgttaatccggaaataaagatcagactgtcctgattgtaccacctgatttcatcatgcgtgttataagtggaattacaaccggaaggatcatgtataacaaccatcccacctaattcatatagtgcagaacagactccggatacatctgaggtataaatcggtatcattcgatatgcctgtctcatatacagcttgtacacccccatcctttttttacaataagcgtttttggatctttttcctctaaaaatgcttcttccattagttcggcagtcctgcggattccgtcaaccccctgtaaccctgctccctgaacaagatttacaaaatatcggcttcctgtaaaccatgctgccttctggccgattgccagaatcttatccgttgcatgctcctcatgtagcagacgcattttcgcatggactgttgaacgaagttccaactccggtttcttctctttcagccatgcaaaagcttctttttcttctgggcttatactgtccagatacaccgtctctacgttgaacccatgtgtcagtaacagtttcgccaatccaagcggacgcggatggaatgtatagtcgattgcaatcggtgtgtttccgatcacttgcctcgtgtgttctaatgcagcctcacagagtgaaattttcttttctatccatggtaacagttcctgattgtcttcaggttttaaagtattccacaaaatctcttcttccttcttgatttcttcataatcaaaactcagtggaagataaagaaatgttctgtccagtcgttttgccaaaagttctatcccatattttccagatggataacaacagagaaatgttcctgcatttcccaattctttatactcttcccatgttctgcagctctgcaattccctaactgtataacctgcttttgataacaattctttcagatcactactttgatctaaagcaaagtcacttcccaaaatagaaatctgttttgtatccattttgtcaggttctgaatccaatgactcatacattgcttttctgagtttctgatccggtgtcagtccgtgcttctgcatgattggatccatatagcatctcagaaatgtaatttccgggaattgttcttccaattctctgtaaattctttccagatcacatccgataaaatgatgaagacaaactgtaaacaaaagaaccgccttcggcattttctttaattttcttataagatctgccgtcccttcgattgtcagatcttccaggtctccattcaacagattctgttcttccacgatcacaaaggaaaatctgtcttctgcatgcatctctgctgcagtaagcacaacgccccgcatacagttgtccgcacagacataaatctgatgtgattccggaatcagcattccggtatgaacgatattccaacagccatgtgccggtgaattaaattccagcccttgtcggaacggaataggataggatgcgtcttttatgctgacaaccgcatctttctcactgatcggccaggctgattctccaacttttctaagcatttgacacctcttgtttttctctcactttcatcaggattgctttggcaagtatacgatattcttctgccatttcactttccggaaatgcttcaagaacggtctttttctgttcttctgcctgctgaacaagatcacttcttgtcaaagttcctacgatacttgtatgaaaatcttccgccagttcttctactttctcctcctcacgcgggacatttcttcgattcaggatcagccctcccagtgtggcatatccgcgattcttaaagttttctaccgccatagcaatattcgcacctgcatgaatcgccatattttctccagatgtaacaataaagatcttgtctgcatacccatttcgcatcggcatagaaaatccaccacagacaacgtctccgagcacatcataaagcactacatccggctggtatttctcatatgcacctgtctcttcgagtttttccagtgcagttatgattccgcgtcctgcgcacccaagtcccggtgtcgggccgcctgcttctacacagacaattcctttgtatccaattttcacaatatcttccagtttcaggttctgtttcttttcctgatacatatgaagtacggtcggaacctcttccccatgtcggagcagaatcgttgaatctgcctttgggtcacatccaatctgaagaatctttaatccctgctcagccagtgctgctgccacattggagactgttgttgattttccgattccaccttttccatatactgcaattttaatcattctgtgcctccgcttttgtaatgatgtttgaataggcagtcttcgctgacacaccttttaatcttccgatctttccggaaaggctgctaatcatatcctgcggtgcatcaattgcaatactgatgatattaattcctttttccctgtatggaatccccatacgcccgataatataatttccggcttcatgaagaagatcattcagtgtaacgatcgcttccggattttccacaattatggagattactgctactcttgtatccatttcgattcctttctccgcattttgttatatcactctcttccgttcctcatgctacagctcaattccactcacgcttcatttcgctgtatggcgttcgccatatggagaaagttgtctcttcttgcttatgcaagctagcttgcagcgcatgaagagacaactttctccgcatttcggaactggtttagcatattctaggcaacaactctccacctggctgtgggaggagggactgggttcctatttctgtcatgcgtattaccttgcctgggttttcttctgtaatcgttccgatgattgctgcattttgagagtatggacactggtgaagtgtctctacgatcttttctgcctgttctgccggagcaatgatcaccattgttccttcgcaggcaagataaagtggttcaagtccaagcattccacagactccctgcacttcggtagctaccgggatttttgctgcatcaatctgtactccaacctggctctgtcctgcaatctcatataatacagttccgacaccgcctcttgtcgcatcacggatcacatgaagttcatgtgtcgtgtccataacagcctccaccgtcttccaaagtggggcgcaatcgctcttcacatctgcctcgattccgaaatcttctctcgcaagaaggatcgtgcatccatgtctgccgatatctccggttacgataactgcatctcctggcttcgcaagttctccgccaacctgtacgccatcttcaatttgtcccattccggttgttgtgataaagactccgtctacctgtccttttccggcgaccttggtgtctcctgatacgatgcgaacacctgcttctttcgctgttttagccattgcctccgcaatctgctccagtttctccattgggaatccttcttcaatcacaaatgcacaagtcagatataatggttttgcccccatacaggccaggtcatttactgttccgcagatagacagttttccaatgtttcctcccgggaaaaatgccggagatacgataaatccatctgttgacactgccattttcccaaccggcggatttaatacggctgcatcatctgctgtcagatctggatttgcaaaatgtgctgcaaatactttgtcgatcagttctgaagtctgttttccgcctgctccgtgtgccattgtaactgtctggctttctattttttcgctcatattatttcctctttttccgtcactgttcacagtaaccatttctattttcttctatactccgtacatgaaataagcggaacacgcaccttcatttgaaaccatgcatgctcctaccggatgctgcggtgtacagacttttccaaatactttgcaatctgatggcttacattttccctgtaaaacatctccacaacgacaagccggatttgctcttccttccatttccggaatctgatatttcactcttgcatcaaacatttcccactctttacgaagcttcattccggaatctggaatcactccaagaccacgccattcactgtcgcaggattccatcagttcatctacaagacgctgtgcctctttgcttccttctgctgttactactcttggatagcagtttacaaaaaatggttttccttcctggtagcgtttcaatgaaacagccaatgctgtcagcagttctttcgcagtaaatcctgctacaactccactgactccctcctttgtcagagattcacacaatgccgttccggtaattgcatttacatgtcccggataaagaaacacatctgcacttccttttaatgcttcataagctcccggcatcgtcttatttgccgtcaggatagaataattctctagttgttcttctttcgctttctttactgataagcaagaagaaggtgttgttgtctcaaaaccaacggacaggaacacgacttgttcctccggatgtaacctcgcatatttttctgcatctgccggtgaataaacaatctggatctttgcgcccttttctctcgctcccgcaagactcatctttgttcccggtacacggacaagatcgccaaaagtacagactgtcgcacctgcttgaagtgcaagccacactgcctcatcaataaacccaaccggtgtcacacagaccggacaccccggtcctgagatcagttccacctgctttggaagtaatttgcggattccaaggcgaaagatctcatgtgtatgtgttccgcacacttccataatgcgaaccggggggccatcatactgctcgatgatttccctcgctgtttttctttgtttctcatttctttcagatgtttgattttttgttatatcctgcatcatcatttattcttttcaccccattgttcactgctctatagcagttcttccataagctgatcggtctcttcgtcatcttcttctgtgatctttgcaattgcgactccggcatgcaccatcacgtaatcgcccggctccagatcttctaataactctgaagatacttcccttttcgcaccacctgcatctaccactgcagttccgtcactgatgcgaaccactttagctgataatcctacacacatattttctattcctttctttcatgattcattccataaaatgcctgaccaagcgcaattcctccgtcattcggcggaatcatctgatgtgtcagcacatgaaaaccatttgcaattaatccgtcttccgtcagacgaagcagtaatccattctgaaatacaccgccactaagtgcggctgtccggcatccggttttctctttagcatggatacatgctgtgacaatctgctctgcaagtcctttatgaaattcataagctgccttttctattaagtcctgatcaaatgtatcttctgccactgcattttcgccaatattgctaaccacttcgactgctgccctcaccagtcgacttgtcagaagaagttctcttccgtcgtctgctgattcagttaaacacttctgcccgtctaagacatttattttcttctcaccagatcttttttcataagcttctgctgcgaattccaatgccatggaggcttctccttcaaaagaagatttctttcgaattctaagtatcgcactgattccatcaaataatcttcctgtactggttgactctaccgcattgatctttctctcaagcatcgcaagctgaactttcgcttctttttcctcgcaaagaccaagtttccgaatgatctgcatcgcctcatcttttgattcagatatttgccagattaaagaaactgcgatacgccatccttcttttgctgataggtcgcctccagcctgtaaaaatggttcaatacttccgattctccggaatccgtcaaaatctgccagaagtatttctccgccccatatggttccgtccgttccatagccggttccgtcaaaagatactccgatcacctgttccatccagtcattctctgccatacaggataagatgtgtgcataatgatgctgcactttcaaaacaggaagtcccagttcttccgcaaccaccgtcgaattatatttgggatgcatatcgcagacgacaacgcttggttccacttctaacaatgtttccatccgctgtattgtctctttcaatgcatttaccgttcttaaatcttctaagtcccccacataagccgaaggataaaatctactatccacaccgatacagaatgtatttttcaattctccgccgacagctaatacctgtcctttccattttcctgacgtctggatcggaagtggcgcatatccccttgatctgcgaatcatatatggtctgtttttatagaaatccatcacggaatcatctgctctcacacgaatttttcgattgtgagacaagatgcagtcacaaaattccgaaagctcttcgagtgcttcctcatccgatctgcagattggcgcaccggatacatttccactggtcattacaagaaagtccggcatcttgattccatccggatattgaaatagaagtaactgcaccggcgcatatggaagcatcactcctacttttggattgcctggtgcgacagatgaacacagctgcttcgtttctatctctttcctcaccaaaagaagaatcggcttctgatgtccagtgagaatttcttcctgctccttactcaactcacagacactttgcactacctcaagatttcttgccatcactgcaaacggtttcgccgggcggcgttttctctttcttaacagttccactgctgcctcatttgatgcatcgcagcaaagatgaaatcctccgattcccttcactgctacgattccgccttcggaaatcactcttcttgcttccgtaattgcatcagaacctttcatgtctatcgttctatcaaaagttttgatcaaataaacttccggtccgcacgcattacaacaaaccggctgcgcatcgtatcttctgctttccggattgtaatattctgcctcacattccggacacatcggaaattctttcatactcgtacgctctctgtcatatggaagagcatccagaatcgtaagccgcggaccacaacacgtacaattaataaacggatgtaagtatctgcgatccttgggatcatacaattcttccttgcattcctcacagattgcaatatccggagaaataaagatctctccttttgtcttctcgctttctatgatagaaaagtctggatatttttcctttgtatccagtatttcttctgaaactttaagaatcgcggcacgttttggcggacaggtacgaactttctcaataaacagattcactgccgtctcgcttccctgtgcgaagatttcaacataaggtccacgattactgacacttcccctgatcttacaggaatctgcatgtcggctgacggtcggacggaatcctacgccctgtacaattccatagacacggattttcttcgttatctccttctccatagactttttcctcccgttatgattcctgcagttttcctgagactgcaaaatgccgtacattaacaaatgttcctttgaatcccggtaccaggcctctcatattttcatctgcaaagacaatgtcatagttcccattttgaacaagcttacaataatccatctcttctttcagtgaaagatctccttcttctgaaagctcagatttcatcataaaccagcttgccaccgtaacttctgtattctgttcatcacttcttgtacgaatttcctgtctgatggcatttgcaatcacctgctgatgaatgatcagtatctttttcctttcataaccaagttcaggtatcaattcatctacaaatggatatcccacttcatacggtgtgccaaattctttttccagatattttgctgtctcaagtgccgccggtgctacaaccagattcttatctgcagagcctgctgtctttactttatcaatacctgctctcattccatagcaaatataatgcgtattctcattttctgatttccggaacttctcttctatcttcaggtcactgacatcatgtggcgtcagaccgagaactccgattttcatctttttagaagaatcgtcttcttctgaagcttccttctgtgatgctacatcttttcctgcaaatgtcttgaataaagtcagccatgccttctcttctcccacatcatacagttccattccgttcgtatctacagtcagaatcggaagatttgtcttcttctcgcacattctctgtaatgctctataatccgttgcgatcacagccggaaccggagtaccgatcaccgctgcaaaatttgcatcaatcttctctgctgcatccgtaagtttcgcaacaagcctgtcatctcttccaaggattgcatccatgtcacgcaagcccgcactgaaaatcgcactacgttccccgaaccagcgcggttcatcgaatccacatacatttcctgtacagcctcccgcatcacagataacaagaattcctcccagttcatagaaaacggacgctgcacctgactgatccggtgcaaatggagtcagtcctttccaaaggtcacgtacataaacgtcttcttttttgtccacttcctctttgaacagtgattcttgactctgctctgcaattgcttcttgtgatttagaaccaatcacttccacctgtttctgcaaaacattaccttctgcctgttctgtcacagccagttcaagcgcctcaaacagtcttctcacgcctgcatatccgaaaggctgtctctcctcattccaatggattccttttgtgttcggatgataataacaggcatcctttccgattgtcagtgtcacgccactttccgttggatcataatagagcatcgtcggttccatattggaaaaaatctttgtctgcggacttaactttttcaactgtctgatataaataaagttctccccagtaatcgttccgtagatttctgctactttaaatccatatttcaccaatgctaatgataattcaaacggatccgcatttgcacattccccaacagcaaataccggatccggacagactttacgaaaactttcaattgcttcctgtgcctgttttttctgttcctctacatgaaattctattccaagtgctgcgccaaatgcctgatactggcttccaattttatcaatctgataaagtctgcgcagttcgataaatggaatctttaatctatcatgaaaatcctctgctgcaaatcgtgcctccgggtgaagaacaagattaaaattcgcctcagacattttcttatattcttcaaaatcttcacatctcgaaatctcatgaatcgttttcacacctgcctcttgaagcagtgtatataattcacagtcatctacgagtggtgaaaagtatccgagcagatttactacatttccttttttatgtcctggttcaagaagtgaatacagagactgtctcacatgaaccattggtggctttcgtccctctcgtgtcaatgcatacatataacatggacgcaccggaagtccggctttttcttccgcttttctacagacacgttccatatctgttccaagaagggcatccacacatgtaatacagatcatcacaacggatggtttcttctcaagactttcacagattgatgcaactgctttcgggatcttctttagatgacgccctgttacaatatcagtctcatccatgcaaaggtaaaagaaacggttattatattctttcattgaactgatcatggacgtatttcttccacagcaccccggtgccacgatcagcatgatcgatcccggcactgcaagtcctgctcttttcactccgaacccttctgcccctggagagttaaaggcaagcgtagccggcgaactatagattaaatgttcccctgactgaaactgttttggaagattatcctttcctctttgttccagttcttccgctgtacaaaaatatgctttcttcatatattttccctcgacttatattttatctcacatgttctgtttcatcctctaacagcttttctgccagttcaaagaatctcttactgatctcagaatctgcgtcgccttcgatcacagtctttccctgatcttcccagtgtataatctcatcacttcttggaatctcaccaacaataggaatctttttttcttctgcaaatgcctgtaccttctcagtctcattttccacatttctatgattcaggatcaatccaaaaattcttgcataactgcgatcttcaaagttacgtactgcgctggaaatattgttagccgcatacaatgccatcttttctccggatgtaacaatcacaaccttctctgcatatccttcccggatcggtgctgcgaatccgccacagacaacatccccaagcacatcatacagaacaacatccggtttgtatgtttcaaacaaccgcaagtcttctaataactgaaatgtcgctatgatcccgcgtcctgcacatcctagtcccggtgtcggtccacctgtctcgatacagagcacaccaccgaatccttcctttgcgatctgttctaattcttccggctcctcatcctcttctctcatataattcattaccggacgcaatggctcgccgcctaacagattgatcgttgaatctgcttttggatcacatccgatctggattacgcgcttccccatagcggcaaatgctgctgccagattcgatgtaatcgtggactttccaatcccaccttttccgtaaattgctacctttaacatattgctgatcctcccattttatttccctggtaaagagaaagacccttcttccccaacggaaaaagagtctgttaaaatcacaaaatatttttttgtctaaacgcttctttacaactattcccgctcggtatctcttacttccttgccgtcagagtctatattctattcaaaatccatgtctttattgctatgagatatctctctgctgcattcagattgaaacgtattctttccgtttggaacagttgtaaatctcttgcaaaaccattagttaaattataacttatcactaatagaatggcaatgaatttctggttattatagcgttttttatttcacaatattgttattgttttatccaacaaatttactccaatatccctgcacaaagataaataatacgatcaatggcagaatataggatacatagaatctggcccaacccgggaacttgattccacttcctgcattcgcttctttctggaacttatcccagccccaaccatagcggcttgtacagaacagaaggtagatcaggcttccgatcggaagcaggttattacttacaataaagtcctcaaggtcctgaatactgcttcctgctcccagaggcatgaagccgctccatatgttgaatccaaaaatacatggaagggaaagtacaatgatcgcgatcagatttcccacaaccgcctttgttcttgaacaattcgttaaatccatcacaaatgcgatcagattttcaaacacggcaatgattgtagagcatgctgcgaaaaacatacaaaggaagaaaattgttccccagattctccctgcactcattgcattgaaaatgttcggaagtgtgataaagatcagactcggaccactgtccggctggacattaaatgcaaagcaggccggaaaaataataaatccagcgatcaatgcaactaatgtatccagaactgttacgcagactgcttctcctgtcagagttctttcttttccgatatagcttccaaagatcgcaatcgcaccgattccaagacttaatgtaaagaatgcctgtcccatcgctgcgaaaataacttctttcaatcctgcttctgctgctttcttaaaatcaggaagaagatagaactccagtcctttctctgctcccggcaatgtcacggaacgcactgcaagaatgatcatcaacacgaaaaggaggatcatcattttctttgtgatctgctccacacctttctgaagtcccatacagacgattccaaagcacagcacaacaacaaggatcatacagattgtcattgtaacaggctgtccaagaagtgatgtaaatactccggtcacaccatccgcatcaagtcctttaaactctccgattgccatctttcctgtatatagaagaagccatccgccgattgttgtgtagaacatcattaaaagatagtttccaccgattccaaaccatttataccagtgccactttgttcccagtggttccagacggtcaaaggatagtgcaatacttgcctgacttccacgacccactgcgaattccattaccatgattggcaatcccaacagaacaagaaacagcagatagatcagaacaaatgctgctcctccatactttcctgtaatatacggaaaacgccaaacatttcccaagccaatggcacatcccgctgagatcaggataaatcccagacgtgagccaaatttctctcgtttcatttcttagttgtcctctcttccttctttagtgtcataaaatgctgtaactgaacttacaaccattcgataagccatctctgctgcatattccggtgtttccttttcgcctgtttccaaccatgttttcacaaaaccgagacaaccgttcaggcaataagaataaaaatatttcatttcacctgatttctccggtacaagagctgcaagtgactcccgactcttttcctctaaaagctgctctaacttatgtacaaaaccaatatccccatgtggtcctacaagcgcacttgcaatctgacgattttcatcaagcacatgaaataaatcctgaataaaatagtaaacgctatcttttcccggatcaattggatgttcgcggattgcgcgctgcatctcttccatcatttcattttcaacttctgcaagcagccccggtatatcagaataatgcagataaaaggtagaacgattgatatccaccgcatctaccaattcttttaccgtaatctctctgatactcttctccctcatcaattgagcaagacctgttttaagctgactttttgtctttctgactctgcgatctgtcttcttctgcatcttctcttcccccctttataacttacagtactactgaccaataactctctactctgtttctatgacttaaatgaatgattttgttactgttcactcccgtgtgaacagtaacatgattttctccacctgctagacatttttcaatctttcgtctattattagacatatccagtgttgattaatggttgtaaattagtttctacattaatataatactttttgacatgaaaatcaacattgtatctattactagaaatatttttaagaaaaggagttttatccatgagaaacgcatttcggatttttcgccgcgatatgaaacgcctgctccgtaatccggcagcaatacttgttttgatcggagtatctattctcccctcactctacgcatggtttaatattgcagcaaatattgatccttatgccaatacttccggcatcaaggtagcagtagcgaatctggacaccgatgccacacacgatgatctgacgatcaatgccggcagccagattattaaccagttaaaggaaaacgaccagttaggatggacgtttgtttccaaagatgctgctattgaaggagtcaaatccggcgaatattatgcagcaatcattattccgcaagattttagtgaatccctgctaagtgtcctatccggaaagattgaaactccggaacttgaatactatatcaatgaaaaactcaatgcaattgcgccaaagatcaccagttcaggtgcaagcacgatccagacacaaataaacaatactttttcctctgttgcatctgaaacaattgcagaacttttgaaagaatctgtattcaatatttctgactttgttgattccacaactgaggatatcaacagcctgcttaccaaagctgagaacaatattcaggaatatgctcagctcctggatcagtttcaagctggttcagctgatacaaatgcgctgatacagaatgcgaaaaatgcagccgattcactcggaactgctgcctcttccggtgcaaatgcactgtctgatgcagacaagatcatgcagacaacaagatcctccgcaggagaattttcttcttcactctctcaggcactttccgacggagaactgctgcttgggaaagctaacagctctgcatctgccggaataactgatcttgcaactgctgccggcaggataaatacctctgtcagtaccgctcttggttatgccaatcaggtcaacgaattaaatgcagacattcttgcagacatgcaagatctcgcaggccagcttcctggaataattggtgatcagatcactgcaaagatttccacacttcaggcacagaaccagcggaataatgaattgatcagcagcctgcagacaggaaatgacggaatacaggatgcattggatacaactacagcaacccaggaacagcttgctgctcttacaaaagaaaatattgataatctacatacattccgctcttctctggatcagaatatcctgccactgctcaaccagacgttggataccttttcctctctgaccggtcaggtaaccggaatgcttaacggtgttcctgccacttctgatcagatgaacagcatgcttgatcagctgactacaggattatcaaatacaactgaattactgaacagaacaaaagatgcattaggcgctgttgagaataaattaaacacacttcagacagatctcaatgccatcacaagttcggctacttatcagaaactgctctctttagaaggcattgatgcagattcaattgcttccttcatgtcttctcctgtagagatcaatacagagacatactatgctgtcgataattacggttcttcgatgacacctttctactccaaccttgcaatctgggtcggtggtatcgtactgatcgcaatcttcaagatggaagtagataaagacagctccatgcatggctatggaccgacaacattatattttggccgctggctcttatatatggttgttgggcttattcagggattcattgtctgccttggtgatacactccttccgggagttcaatgtaatcatccgtcacaatttatcctgacaggaatggtttgttcctttgtttatgtaaatattatttatgcgctgtcacttacatttaagcatattggtaaagcgctctgtgttattctcgtaatcctgcagattcctggttcttccggaacctacccgattgagatgacaccggcatttttccagaaactgcatccacttcttccatttacctatggtgtgaatgctatgcgtgaagcaattgccggtttctacggttccaacttccgcaacgatcttctgatcctgcttctgtgctatgtaccgctctctctgcttatcggacttggactacgcccggctctttccggactgaaccatctgttcgacaagaaactggcagaaacagaatttatgatgtgcgaaccacacgaagcagaacttagcagaagtacacagctttccatgctcttacaggcatctctttccatcgaagaccttcgcctcgtaacagctgaacgggcacagaaatttgaaaataattaccggaagatggttcgtatcggtttccttgccattgcgatcatccctctgatcttcctgattctgatgttcagtctagaatcaaagatcgtgttcctgactttgtggattatctctattatcgcaatctctgtatggctgattgttatagaatatatccatacaaaactggaggaacaaaaagaaatggccggtatgtcctatgaagagatgcttgaaaacttccgtggaaaggaggcggaataatttgaagaatattttcttaatctttaaaaatgatgtgatgaagattcacaaaaatgttatcgctatgatcgttatcatgggaatcactgtaattccgactctctatgcatggtttaacatctcagcgagctgggatccatacggtaacacaggcgaactgaaacttgccgttgcaagtgatgatgaaggatacactggagaacttatcgctgtaaagatcaacatgggggatcagattctttcttctctgcataaaaataagcaatttaactgggttttcactgattctaaatccgcacagaaaggtgtaaaatccggaaaatattatgcagcgatcgtcattccgaaagatttcagccagaaaatgatgagtgttttctcatcaaatacagaacacccggatctgacttattatcaaaatgaaaaagaaaatgcaattgctccgatcattacaggaaaaggagcaactgctgtccaaaagcaaattaacgaaacgtttattgaaacagtcgcacagactgcactggatgcttttcagattgtaagttctgctgcacaggaagccggggatgactctatggttgatcatttgatcgataacttaaatcagatgggaaccgatcttggttctgttgccggaaccgttcaatctttatccgatatgactgattcagccatcacaatgttaaacacaacaacggaattccttcaggaaagcggttctggtacaaagtccagcgtcagctccctggaaaattcagatttaagttccctggcatctttagtatccggtacatcaaagacaatttctgatgctctgacacaaaacgccagcttttacaccgctgtttctgatgctgttgacaaagcattagactcctataatagcgatgcccaggctgcgtcaaatgccctgacttctgtcagcagtcgtgtacaaactgtaattgatgaatatacaaagctgtctgatgctctgacagcgattgcaaatgaacaccctgagctcacgattttaaatgatgctgttgccagcattaaccagaagatacagctggcaattgatcgtcagacggcaatccgcgataaaataaatgctgctgccgaagcacttcctacagctactgcaaatgctgctgaattaaaaagcgaacttgacaccctgatcgctcaggcaacatcatctgtcacagaagttaagacaacatatgagaataatgtaaaaggaaatctggacagcctttctgccaatctggattccacaacagactccatttcttccatgcttggagatcttgataagagcattcagaacattgctggtgtcacaggttctacttccgacggactgacaggacttcagaagactctttcgaattccgctgaactgttgaatgaggcctccggaaaattaacttcactggctgcaacactttcctccgaggattcaaaggatctttccgctgtgacaaacctgttatcagaagatccggagacaatcgcctctttcctctcctctccggtcaaactggatgagaaaaagatttatccaattgaaaattacgggtctgcaatgactccattctactccactcttgcgatctgggtaggtgctgttgttatggctgccatgctaaaagtcactgtagctgattctacaaagaagaaactattccatccgaaagaatatcagctctatatcggacgtatcctacttctgatcattatcggtttcatgcaaagtgcactcatctgtcttggagatcttttcttccttggtattcagtgtaagcatccggtaatgtttgtactaaccggtatgttcacaagctttgtctatgtgaatctgatctatgcactgactgtctcctttggagatatcggtaaagcaattgccgttgtcctgatggtaatgcaagttgcaggaagtggtggaacattcccgatccagtgtgcaccgaagtttttccaggttgtttatccacttctgccgttcacacacagcatgaatgcgatgcgtgaatgtattgcaggattctacggaacaacttatgctacagagctcagcaaactggcaatcttccttgcaccgtcactgctgcttggtcttctgctcagaaaaccaatcataaagatgaacgatgcatttatggagaagcttgaaagtacacatctgatctaatgtaatggtctaaaatatataactacaaaaagccccctaaaacattaccgtgaacggttctgttttaggggttctcttattatttcatattattttctaccgtctgctgtacttccttcgatacttcatctgtaaaaatcggaataaaaatttcttcttcgatacctactccataaacttcattaccattgagttttccatccatataatgatccaaaatccaggaatatatttttccgaaatcaaacttaatcgatgctgcaaccgttcccggagcaagatcattttgattctctgaaaatccaatcacctttactccattttcctttgcagcctcaatgcagccatttccaactttatttgcgtaaataaataaaacatctgcaccttttccgatcatttggtttgcaatctcttttccaagttcctcatcttcccaactattcgcataggccctgagtactgttgcattcggaagctttctatccgcagccagctgacgaacatccttttcatactgatccagcaaggtctccattgcctcattcggataaccggcaatgatgccaagtattcctgtcttcgtcagatttccaccaatgattcccgccagatggcttgcttcctcttcttttggataaacagaaaatgtatttttacctgatgccgatcggccatttaaaatacaaaaatcaactttcggataatctcctgacacagaagaaacaacctcctcgaactgtgatcctgcaagtatgatcagattataattatcttctgcatatctacgaatcactgcctcaaagtctttctcttcgacattactctgatactccagatcaattttcttatctttgttctgatttgcaagaatcccttcgtaatttcccgtattccaactttgatcatttgcatctcccggaagaattacaacaactttcggctgattggccggaataatttttcggtaagtagttccttcgattactgcaacaatgataagtaatactgcaacaatgatgcctgtctcagcttttattttcttttttttcctggtatcttccatgccttgttatcctttatttttgagttctgtatatttcagattctctggctttcgattataaatctcctaaaaaaggttttctgtagagatactttccatctcctcgattacctttaaattcattattttcagcgatgatatttcctctctgcattacgagatcaatctttccgtgcagatctgttccttcataagaagtataatcaacagctccgtgcatcatctcgtgagtcagtgtctgttttgcatcagcatcaataatcacaaggtctccatctgctcccggttcaataattcccttcttaggatacattccgtatacctttgccggatttgtgcaggcaacttctaccagcttgttgatgctgattttgtttttcattacaccttctgagaaaagaagaatcattctttcttcaactcccggagctccattcggacattttctgaaatcatccttgccgtcctgtttctcttttgcataattgaatggacaatgatctgtcgcaacgatctgaatctctcctgcctctaatcctttccacagcgcatcaagatcctgctgtgtacgaagcggtggagacataatatatttcaatccatccggatctttatatctgtcttctgtaagtgtcagatactgtgtacatgtctctacaaaaatgtttttttgtccgtttcttcttgcttcttcaactgcttcaagactttccttacaagaaagatgtacaatatacaccggtgcatcacctgcaagcttcgcaagataaaggactcttcttacagcctctgcttctgcaagattcggtctgctctttgcatgatagatcggcgctgtctttccggcatcaccatattctttcttcagatgctctaccacataatgattctcgcaatggaatgctgtgattccatgcagttctttcatcttcttaagaacttctaaaataccatcatcatcaatcttatagccataagtcatatatacctttgtgctctggactccgtcatccatcattgtctcaagctcatttaaaatagactcgtctacatgctggactactccatggaatccataatcgataacggctttatcgtctgccagtccatgatatacatccagttgatgatgtagcgggcatcctgccggtccgaatcccatatggtctacgattgttgtagttccgccgcatgcggctgcaacagtacctgtataaaaatcatctactgctctcgcgattccgacatcaatatccatatgcgtatgaacatcaatacctcccggaagaacatattttcctttcgcatcgatcaccttatctgcatccccaaattttgcttccaagttctttccgatacattcgatcacaccatcctcaatcaggacatctgcttcataagtgtcctccggtgatacgatcattccattttttacaagtgttttcatgatacttccactcctctcttagtttcagttatgcttctaccgcagtctatgctttccatagctgcggtgatttttttgcctgatgagtgctgtttctaacctctttttgctgctttaatatagataaagtatgcaagacctgcaccaatacttcctactacatatgcattgtcaaagataaatttcagtggtgcaatatattttccggcaaagataatgatcattgctgccacaaaaataatgatgatcggtacattaaagccttttgaataataatattttccgccgtcttccttgtacatatcaaccatatcaacctctgtcttatgctcaaacagataggataccagatataatcctgagataggtcccagcagcgctccaagcattccacatacattataaatcaaatcgtacgcacttgccagtgcattccacggttgagcaaataaagcaagtactgctgcaatcaaagcagcctttttgtagcttactttctttgcaaataaagttgcgataacatttgtcggtggaaccagatttgctgcaacatttgttgtcagtactgccataataatgaacaacgagaaaataattacaataaacggattgtcaaatttacttacaagaactgccggctcccagattgcttctttaaatacaattgctgctcctgctgttccgcaaattcctacaaaggaaatgaatgctgtcattacaggtgccccgacaagctgtcctactgcctgtgccttctgtgttttacagttctttgtgaaatctgccatagacagtgcaataccaccgtcaaatgcaatcattgaagacaatgccgggaaaaacagtgtccagaaattcttggacggatttccctgaagagatgggtcagaaagaagtttcgacacactccaatctgcacttctaattccccagatgattacgataaagctcaacacaatcaataccggtgctgcaaacttttccagtttctgtaatgcactggatcctgatcctgcaatatatacgttcattgcccagaataataagaatgaaataaataaacctttaaatccaagtccatgccatgctggaatgattgctccgataattgcattaagtgcctgaccgccaatccatgcctgaacaccgaaccagaaacacccaagtactccacggacaattgacgggactacagttccttttgatccaaacaccattttactgagcatcggataaccaagtccatactttgtaccgaaatgcccaagaacaactgcaaaaatcataacaagtgtatgtcctaatacaatcgttaacaatgcctgtgcccatgacatgccagatacgatcagtccacttgccacctgatatactgcgatagatacaatcataccaatccacagatttcccatgtcccatgctgaccagttacgctcttttgaactcaatggttttgttgcatctgcataattatttttgtatttatggatttccttttcaccttccggtgtcaattctaccatatcgcctatctgtctttgaaaagcccccataatgtacctccattattttttatttttgtttcgatatatcatttgcgcattgatatcttatgcttcaattttagtacattttgttgcattttcaatgtgataactttctacttttgtttaatatttacggtttttatgttagattttctacatttccatgagagaattattatttttttatcttttattgtttgtttctgtattctgtcggcgtaagattatattttttcttaaacatactgctgaaataacgaacatcgttaattcccactttttctgaaacttctcctattctaagctgcggattcttaagaaattgacaagctttctccaaccggtaatctataatatattcagatacattctgacctgtatgttttttaaacaactcactcaaatagttgggcgtgatacaaagttgttctgaaatctttgtcaaggtcagcttttgtgaataattcatagaaatgtagtccatcgctttctgaacaaaaagatttgtcactttcatttcttgtttttcttcactccgaggtttctgaatatttttctcaatttcttccagaattccaatcaattctctggcatttgtaggctttgtcagatatctggtcacaccaagctctattgctctctgtgcaaaagaaaaatcactatacccacttaatataataatttttgtattctcatccttttcacggattcgattgatcagatccagaccattaatctccggcatcttaatatcagtaataatcacatccgcataagaaacagacaactgttccagcgcttccatggcattttcaaatacacctataatctcaaatccaggtctggatgacaataattttgatagaccattcctgatcttcggttcatcatctacaattacgattttcatcttctgtaacctcctttgcctgatccacttcttctaccgggagaagaatagtaacggttgtccctttcttccattcactgtcaatttttaatccatatgcctctccaaaatgcaactgaattctacgatgtacatttcgcattccaatatgctttccactaatttcatctgacataatactctccctaaacctcatcaaacgatctggctgcataccgattccatcatctgttacacgtatctcaagagttccttctctaacgatcgcttgaatctggattctgcccatctccttcttcttctcaattccatgcagaatcgcattctccacaatcggctgaagaatcagcttcggaacaaaacacagctttgcttcttcatctatttctatctgaactgtcagacgatcttctaatcggttcttctgaatacaaagataactttcaatatattttaattcttcctcaaaaagtacaagcatctcttctccatgaagtgaatatttcaaaatatctcctaaagatactacaacatcacttatctcccattctcccttttcaattaacatccaattgatagaatctaatgtattgtaaaggaaatgtggattgatctgagcctgaagtgctgtaagttctgcattcttctgtgccagtttttgttggtatacttccataatcaattggcgtaatctactgaccatataattaaaagactgaatcaacattcctatttcatcatgtgcttttgattctacctgtatttcaaaatctcctgcttcgacctgtttcatagcatttttcaatctcccgattggtcttgtaaatgtataggacaaaataaaaattccaactcctgccgccagcattgccagcaaaacaaggcccataattgcttctcgaagtctctttgcctgtggaaagaaatcatctgtcgaaaccactgaataagtctcccatccggtcagtccattatactgcctacaggcaaaataatccttattatcccagttgaattcatatcttctaactcctttttccatcccttttgttacgatatctccccaatcataaatatttgtcttattcgagcacagaacatttccgacgcaatccaccagataagtgtactgattttgaaaggtactataattattcaacatcaaaagtccaaacgtctccggattcaattctatcgcaagaattaccttattgatagaacttataaatgttactacttcttctgcatttttctgacaaagcgaacttcctttttccgtccaggtaccatctccaacaaggttgcttgctgcattctcatatacttccatccgccttttatcattcactgcctgacagcctgaatagctgtaatacacggttccatcttcattcatcagtatcaaatctgtgcagcttgatataagatttaaaagcccttccatccaatcatttaattcttctgtttcttcctgcgtatgtatctcttttttcaaatatgccctcacgatttgactggattttacattttcagccagacgattgatctgctgaacctgactattaatagagatatcaattctgttaattgtatcagccatctcttgttctttgttttccaatacaagattttttgcattttgataagaaaaatatccaatcattgatcccatcaaaagcaccagtatcaaaaaagagagcattaacttctttcgcaaagtcattttatctttctccctccatacttttctccatgtcattccacttgtgttatcatctttgcaacatattccattttttcacaatcaacaaatgaataattcataacataaatattttcatactttttcttcttctcacttgaatgataataggatgacaatgcagccagcttaattcctttgctcttcattttatccagaaattcttcttcactcaggtttgtatctactttcattaaaaaatgtactcctgcatcttcttccagaatcttgattttagttttcaatactccctgtaaaaatgcttccaggatccggtctctcttctgctgataataattacgcagccggttaatatgtttctcaaatgcccctgaattcataaactgcgctaacgtatattgttcaaaatttgataccgtacaggaataaaaagaaagttctctgtaaaatcgttctgccaattcatccggcagcaccatataactgattcgcactgttgaacacaaagtcttggaaaatgtattcatataaatcacttttcccgatacatcaatgctctgaagtgatggaattggcttaccattcaatctaagttcactgtcatattcatcttctataatatatctatctttcgtttttgtcacccagccaagtaactcataacgtttactgattggcattacgattcccgttggataatgatgtgacggagaacaatgtatcacattgatttctttttcttccagttcttctaccttcggtccgtcctcttctatttctatatactcataacaagctcccatactgcgataaatttttgcgattttatgatatcccggattttcaactgaatatttcaatttctttcccaaaagctgaatcaaaagactggacaaatattctgttccagcaccaataatgatctgttccggccgcaccgtcatgtttcggaatgctttcagataatccgcaatgctttgtcttaattccattactccgccacacggtggattaagcatcaattcagtctgatagtcattcattactgcccgcatcgtctttgtccaaatagaaaatggaaatgcactctgttccgtctgattactcgtaaaatctgcgatataagcattctttccaccggtaaggtttaacttattgctgtaaatcttattttctgataaaccactctcgcttttcattctgtcatcccgcaggtctgctacataaaatccactctttggaacggaataaatatatccctctgctgcaagctgaccataggcattctcgacagtgatcacacttatggccagattttttgcaagtgcacgctttgatggaagtttttctccactcttaattttcccttgaataatgtcattcttaatacatttatacaaatattgataaagcgtatctgaccctatattttcaaaattatacgtcaacatatttactttttctccactctgacctttttgaatatattaaaactgagtatttttatatagtcactttgtcattatactattacctatcgaattagtaaagaaaaggagatttaaaaatgagtacaaataatgaacgttatgaattgaataaaaatctggcacagatgttaaaaggtggagtgatcatggatgttacaactccggaacaggcaaagattgcagaagctgccggtgcatgtgctgttatggcgctggaaagaattccggctgacatccgcgctgctggtggagtttcccgtatgagtgacccgaagatgatcaaaggaatccaggaagctgtttcaatccctgttatggctaaatgcagaatcggacattttgcagaagctcaggtacttcaggcaattgaaatcgactatattgatgaaagcgaagtcctttcacctgcagatgatgtctaccatattaacaaaaaagagtttggtgttccatttgtctgcggtgcaaaagatcttggcgaagcactcagacgtatcaatgaaggagcttctatgatccgtacaaaaggtgaaccgggaaccggtgatattgttcaggcagttcgccatatgcgcaaaatgaacagtgaaatttccaaactagtaagtatgcgtgaagatgaacttttcgaggcagccaaacagttgcaggttccttatgatcttgtcctttatgtacatgaaaacggaaaacttcctgttgtaaactttgctgccggcggtgttgcaactcctgctgatgctgctcttatgatgcagttaggcgcagagggagtctttgtcggttccggtatcttcaaatccggaaatccggcgaaacgtgctgctgctatcgtacaggccgttacaaactatacagatgcaaaactgatcgctgaactttcatctgaccttggtgaagctatggtcggcatcaacgaacaggaaattgaacttctcatggcagaaagaggaaaataaaatgacaatcgcagtacttgcccttcaaggagcattcatagagcacgaacagatgcttcaaaagcttggagttcataccattgaactccgacaggcttctgatctgcaaaaagattttaatgggattatccttcccggcggtgaaagcaccgttcagggaaaactcttacacgatcttaacatgttcgaacctttaaaagaaaagattcaatccggaatgcctgttctggccacttgtgccggaatgattctcctggcttctgacattgctgaacaagacgaaagctattttgaaaccattcctatgacagtcaaacgaaacgcctatggtcgccagcttggaagcttccatacaaatactgaagcagccggtatcggtgaaattcctatgactttcatccgtgccccttttgtagaatccgttcatgctgacgcttccggaaacacacctgagatcctcagtattgtagagaatcgtattgtcggagtgaaatataagaatcagatggcatttgcatttcatccggaattagatcaggacacacggattcatgaagcatttctagggatgatcagatagttatcgcagcattctccaaggtctcgtacaagtacggactttggctcgttgctcgcgtaaacaaaagaaaccgacaggatgttttctaaatgagcttatcattttcatcctgtcgatttctttctttttactagtactattaagcaggttttttacattggtgttccaacctctatcaaattcccatccaaatcataaaaacgaacaatcttctgtccccagctatgcgtcatcaaacgattcacaaactttatatctggataaagtttgtccagtttttcgacaaaggcttcgatattcttctcctcaaaatatagctcacaggaattgctctctgaaatgatagttctttccagaaagttcttccaaattgttttctcctgaagaacaagtccctctgtcagaatgacatttccttcattatcaagtattacatcaagtccaaataaatcatgataaaatttcttcgatttctcgatatcttctacaacaatcaaaatatttcttaatctcatacttcataatctccttgtgaggttttatgcatctactttccactctgccagcggttttaactcaatctttgttccgtttggaagcgaaaaccaatggtcattaattgcttttaccggatacgctttgattttctccataatctctgcctctgaatctactgcaatggaaatgtgatcatatccattttctgatgctgcattcagctcctctacttcgcaaagctggataccttctttgtaccagcattttcttcccggtttttcaccaagttctctccacatatgcatctcaaatacatcttcaaagaatctctgatcttcttcgtatgcttttgtgcggattgccgcgtgatcgattcttgccattttgacacactccttttacttattctactacctctatattacgtcatttctttttatttttcattataacctcaaattgttctagaacaaagaatgtgccttggcacattcttgcgcctgcggcggtcgcttgcgacagagtttctcaagttatcgcggcagtcgccaaggtctcgtgcaagcacggactttgactcgttgctcacgtaaaaagaaaggggcagtctcttctttatgaaggctgtcccttttttaagccctgctttaccaagcaatgactctgttacttttttctttcgtcctgatactgttcttaaacaatatcgacaacgactttcttgtcttcctttgttgctgctgccttaacaacagaacggattgcttttgcaatacgaccctgcttaccgatcactttacccatgtcgccatctgctacatgaagttccagtacagtagttctgccttcctttttctcagtaactgagacttcatccggctgatctaccagtgcctttgcaataacttcaactaattctttcatgatactcgccctccgcggagacatcgttatttatctgcagctgatcactcagctacagacattactcatacagattcgattatttctcgattcctgctgctttgaagatctttccaacaacttctgttggctgagcaccattgttgagccatttcttagctgcttcctcgtctactttgattgcgcttggctcaaggttcggatcgtatgttccgatttcctcgatgaatcttccgtctcttggagatctagaatctgctactacgattctgtaaaaaggagccttcttctgtcccattctctttaatctgatctttactgccatttttttcacctcataatttttcttaattttttgttattgtttcatttatatgtcaaaagggaagcttgaatttgcccctttttccacctttgccacccatcattccaggaagtttcttcatcatctttctggattcgttgaactgttttaccatacggttcacatctgcaatatccacacctgcacccttggcaattctgtgctttctggatggattcagcagatccgggtttcttctctcttccaaagtcatggagtagatgattgcttccatctgagccatcttcttctcattctcttcggaatcaagatcaggcatcttacctccgagattacccattccaggcagcattcccatgatgctggacaaaccgcccatcttacgcatctgttccatactgtcaagataatcttcaaagtcaaactgagctttcttcatcttatcagccatcttcttggctttctcttcatcaagctcagcgcctgccttctcaatcagggaaaggacatctcccattcccagaattcgggatgccattctgtccggataaaactgctccagatctgaaagcttctctcccatgccgacataaaggatcggtcttcctgtcactgccttaatagacaatgcagcaccgcctcgtgtatctccgtcaagctttgtgacgatcacaccgtcgattccaatcttatcgttaaaggaacttgctacattcaccgcgtcctgtccggtcatcgcatcgacaaccaggatggtctgatgaacttccacagcttccttgatctcctgaagctctgccatcatatcttcatctacatgaagacgtcctgcagtatcaaggatcacaatattgttaccattctttgctgcatgctcaactgctgccttcgcaatatccgccggcttattcttgtctcccatggagaacatctctacgccctgcttctctgcgttgatctccaactgcttaattgcagccggacggtaaacatcacatgctaccagaagtggtttcttaccttttaacttaaactttcctgcaagctttgcagttgttgttgtcttacctgctccctgaagacctgccatcatgatcactgtgattgcactgcccggttgaagcttgatctctgttgtctcagatcccataagcttaaccagctcttcattaacgatcttgatcaccatctgtcccggattcagtccgttcatcacatcctgaccaacagccctctcctgaacatccttaatgaagcccttaacaaccttgaagttaacatctgcttcaagaagcgccatcttaacttccttcagagctaccttaacatcatcctctgtcagtcttcccttgcttcgcaggttcttaaatacattctgaagtttttcacttaagctgtcaaatgccattctataactcctctatgatcgcatccgcaatcttacggatccgcttcaccatctcttccgggtcattcttctcgcattcccactcagcaagtgtatcatcaatcttactgaccttctccttcacggaaaggaacttctctacaagatgaagcttcatctcatatccttccagtgtcttctgacaccgcttcacaagatcatgtacaccctggcggctgatccccttcatctcagcaatctcactgagcgaaagatcttccagcgcgaactgctcataaatctccttttgatgatctgtaagcaattccccgtagaaatcaaacaataatgcctgctctaaaaacttattcattatcttcacctctgctatcatacacgaaacgcaagatggtgtcaagtgttttttctttacagcgcagacatctttatcactaatttagtatcaggcatataataaagaaaaaacaaaggcttttccttcatgaaatgggtaaaacaatccattcactactggtgtccggacacaaaggaacacaaatttctcggacaaaatgtcactgttgctattcttgataccggaatttctcctcatcctgattttaaaggtcgtatcctttcttttcgggatttttccagtaccactggttcttccgaaaaagttcttttttctttctctcatttctcccctctcatcgacaatagtggacacggaacccatgtagccggaattcttgcgggaagcggacttctctcttccggaacttatgccggaattgctcccttctgcaatcttattattgggaaagtattggatcagaatggaaacggatctatcaaaaatgtcataaatggaattcaatggatccgtgatatctacacgcaattccatatccggatcattaacatttccgtaggtacacgaccggatctttccattcatcaaaaacttcttttattgaatgctgtggaatccctctgggatcttgggctcgtcgtagttgtctctgccggcaactacggacctgctcccggttccgtcacagttcccggaagcagcccaaaagttatcactgttggtgttcccgacacttttcctctgatccacacccaaaggcatcctctcaattattccggccgcggtcctacagatgactgcattgtcaaacctgatgtttttgcccccggcacaggaattgtaagctgcaattctttttactctcaatttccaaatgctccgccttatctttccaaaacaggaacatccatggctgctcctgttgtttccggtgcaattgcctgtcttctttcaaaatacccgtttctcaccaatgcagaagtcaaattaaaacttcacacttcctgtgtgcagattccgggaactgaatccggctggggaattttagatttttcccggctgctcgaataatttttgccacttcacatctttatcactacaaataatttctcatctcacattttctttttctccgcatactataacattgtaaatcaaaaaatctttcggaggatttaacaatgagtgaattaacagctacaaactgcggatgcggttgtgacaacggatgtgcaaacagctgcggctgtggcggaaacggaaatggatgcggactgaataactcctgcctgtggatcatccttctcctctgctgctgcggtggctggggtggtaatggttgtggcggatgtggtaatggctacggcaatgacagttgtctgtggatcatccttcttctttgctgctgcggcggatggggcaataatggcttcggatgcggcggttgcggtaatggctgcaactgtggcggatgctgatatctgttccttcttccacttcagaaggggcatgcggaaaaaccgcatgccccttctggcttatcttttcaaacgattcggttttccggtaacaacactctgttccgctctcttctcgtctgatgttatcttcttttctttcagttctccaagctttttctttaacatacacttctcatcaatttcatatactgcattcccatcaataattaactttctggacattttcgttttcctttcctcttcttattattaagatatgcccctgattacaaaaggtctttaaatcagtatacgcatgatccgatttttcacacatctatattcatgaacaggaatatattttttctgcatttcatatatatgtatcagttcagctgaaagtcaggagggtttatttttttgaaaacaccgacgcctatgaccccctttgacgaagcaactgcttccggacttcgcatgctgaaacttttccttcctcttttcccgccagctacacagagcatgcttgccgtcttcattaaattcatcgaactgcaaaatgttcttcaccatcaggctcctgtcagttatgatgcactttctgcctgtgacttttcttctggacgaggaatagaaaatctttttcaagacaacgcagattctatttttgaccatctgtcaccttatctcacatcagaagaaaaacagctcttttctactttcaaaaacataaaagagatgatgtctatggcagatatgtttacacaattcttttcatctgctccaccttctgatgaagagccagaagacactataaacaataactcaccgaaaggagatcttaacaatggaaaactggatgaaccatcctgcaatgaaaacgatcgatccgctcaagctggaactgatcaggacagccgcgaaacagacgaaaggaaaatccggaaatgaacttgccccggtcatgctcgcacttatcacaaatgcaaaccgacagggacttcgtttcaatccggatgaagtttcattaattcttgaagtattaaaagaaggtaaaagcaaagaagaacaaaatcaaattgaccacatgatggaaatgaccaaaaatatctttcggaaacattttaaataaaatcagaatcactctcttcgcctttgcagtcttatttctcttcttttctctatacatttccatctgcatcagttaaaatacaaaggatgacttgtctggaaacagacattatttataaatggagaacgatatatgcagaatattaaattaacactccaatatgacggtacacgttatcttggttggaaacgcccggaaaaagaccacaatgatcgcacagtatcttataaaattgaaaatgtattagaaaaagtaacgagaactcctgtcactttattttccggattccgaacagaaccgggagttcatgctcggaatctcacagtcaattttcttacggaaagccaactgactcctgcagaatttaaaactgttctgaaccagtatcttccacaggatattgccgttttagatgcagtatcaacacccgaacgctttcgagcagacttaaatgcacgcgagatcacttatgaatatgccatggatttatcaccgatctatgacctgttccacaaaaactatcgcggtcgattaactgatctgttatcagattcattatttgatctgtcacctgaacaaacagcagaacttccaaatattcttcttatggaaaccgctgcccactcattacttggaacgcatgattttaaacatttctcttcgattcgaaaaaagaaaggaaccgaaaaagaaataaaaacaattacttttgttacagaagagtctacgctttatattcgtatgacagccaatgattttctctatcagatggctccatttattctgggaacgcttttggatatcggcatagggaaaagacccgtcgaatgtatcaatgcgatcctggaaggaaaggaaaagccttctgcatcctgcgacacaaaaggcttgatcttatacaatattgtttattaatttttgagtaatacgaaaaagactctcaatttccatattaccgaggtggttttacattgtcttaagtgcaacacttaaaatatgtttcgcacagcgttgtaaatctgctttggtaatttcttttccttcgttcactgcttctacgatatcatccacattctgctgacatcccggcatctgaaggtcatttcctgctttaatgcactgtacactgctggaatgactatattttccggatggtgataccattcccatctctgttgtatcctgtgaagtataccagtctgtcatcacaagaccttcaaatccccactcatcacgtgcaatattctgcagcatgtcatagttgtttgctgaatgaactccgttgatcagattgtaggaagtcataattgcatatggttgtgctgtctttacagctatctcaaatcctttcagatagatttctctcagcgcacgctcgctgatatgtgcattcgtaaacatacggttgtcttcctgattatttcctgcaaaatgtttgattgttgttccctttcctttttgagactgaacaccttccgtctctgttgcagcacaaagacctgtcaatacaggatcctcagaatagtattcgaagtttcgtccacaaagcggattacgatgaatattcatgccaggtgcgagccatagatctacatgtaactgcttcatctcttctccgacaagctctcccattctatgaatcagatccatatcccaggattgtgccagtgttgttgcgattggaatggcagtacaaggtatctctaaacgaagccctgccggtccatctgcctgaataagattcggcacttttcgtgtttcaagtaaactggaagtggtgtctcctgctgcacccggcacacaggaggatgctgaaccaattacatttccgtcgccatttcttctctctgttccaacacaaagttctgccatttcttccacggtaagctgcgctgtcagttcatccagagtcgcgttgcctgcttttacatcttccaacgtcagaacttcatctttcctcttatccataagtgtcctgcgcatcacttcatattctacaagttctttcttaaagttctctgcctgaagcataattctaaatggaatcgccggcacaccgaaatcaaattcaatatcgaaaatcggaatcatatggtgaagctctctgactgcaattgtatcacgcatcagacgtttcagttggagtgttgtcacctgctcatcaaggtcgatgactgccacagcctccgtattacgtgaactgtttcctacgcggatcgtgtattccccttcttccataacccaggccgcgtcatacgcatcaaaagatgccatatttgtcgttgcaaatgtgatcgtcacgacatctttttctcccggcgcaagcaatttagtcttagcaaatcctgcaagttcctgtgttggtttctccatgattccatccggtgcggaataataaacctgaaccacctcttttccaggatatttgtcaccaatgttcgtaacctcaacttcaacctgtacctgcttttcatctgctgttacattcattgtttttatttcaaattctgtatagctttttccatatccaaagcaatatagaggcatcacaccaaacgtatcaaaataacggtatccaacatagattccatcactgtaatattcgtcgtcaagatttccatccctgtggctaaatgttgcagatgacggataatcctcataagatcttgcccatgtatcagtcagctttcctgaaggaatcgtcttggcagtcagcacatcagcaactgcataacctcccatatttcctgtctgtcccacaagcataattgcctgtacaccttcaattgccttcaatgaagtcagatcaatgactccacctacattcaaaagaacaatacagttcttatagtgttctgtcataaaacggatattctgaagttctctgtcgctgagataataatctcccttctctgccctgcggtcttttccctctccggaatttctagaaattacataaattgccgcatccgcttcttttacatccacttctgtaatctccggctgttccggttcctcaaaagggttctcgaaggcatatagcatcgatggttttcctgttttctctgtaaattcatttaactttttcgcatacgcttcctgcgcatccgcataaagtctgtcatactgatccagccagccttctgttacaaatttaaatcctgcacgctcaagcccttgtgcaatcgaaatgttttcacgtacatttacatcaccggatcctgttccacctttgatcgtatgtcttgctcctgttccgaataatgcaatcttctttgtaccagcctgaagtggaaggactccgtcattttccaaaattaccatacactcgcctgcgagacggcgcacttcttcctgatgttctatctcataattctgtatttcatctgtttttaacgcatctatctgtgtcatatacaatccctcttttctgtcgattattataattgtaataatagaaacgtcaaatgtccaccccctaaaaaatgatctttttcacgctgtcctctcgccttttattatttttgttaatatctactataccaatcgattatcttccggaaatatcggtaaattttaacaagtttttttttcttttcaggttgtgtgtgaaagtttttatggtataattattcgtatgaacataggtgtcaggtttcgctatttcctgatacctttttcaaatcttactaaaggaaagagggagattttatgcagtcaaacattattgtaaccgctgtcgttgttatttatcttcttgttatgttattgatcggttatctgtcatccaagaagattgaatccaacacagacttcgttgttgccggaagacgactcggaccatttttgatggctggaacgcttgctgctactgagattggaggaggaagttctctcggtgttgttcagcagggtatggaaagtcacggactcagtgccgcatggtacattatcacaatgggattcgcttttgtgattcttacattccttgcacctaaattccgtgcagcaatggttaaaaccgttcctgaatatttccgccgtcgttatggaaaaccttcaggaatcattacatctttgatcatgtttgttccattgatcggactgacagccggacagtttatcgcatcttccgttattctgtctactatgctgaatctgaattataaaacagccgttctgatcgtaggtgtcgttgtaacaatttatgcgatcatgggtggtctttggagtgttacacttactgactttgttcaggtattcctgatcgtgatcggaatgatcatcgcacttccatttggaatgaatcttgccggtggatgggacaatgttgtagctaatgttcctgctgaaacatttgacatgtttaaaggttataatgtaatggatgttatcagtttaacaatcatgtatgttgctacatttactgtaggacaggaagctgtatctagatattacgctgcaagagacggaaaagcagcaagacagggatctgtccttgctgcgatcgtaaactttatctacgcttttgttccgacacttatgggaatcatcgtacttgcactgatcaacatgggcaaattcaatgctgcggacttccaggatgttggtgcccgttatgcacttccggttcttgctatggaagcaatgccggcaattatctgcggattgttatttgcaggtatcgtatctgccacaatgtcaagtgctgactcagaccttcttggtgccggatcgatctttgcaaatgatatttacaagattgtgattaagcctagcgcatctgataaagagatcatgatcgtaactcgtgttacaatggcagctgtaggtgtttttgctactctgattgcattatttaatacttcaagtattgttacaatcctgatgtttgccttcacccttcgtgccgcaggttctttcttcccatatgttctcggacattactggaaaggagcttcccaggcaggaaccatggcttctctgatcgccggaactattgttgtagtatacctggagcatgtttccaaaggaaatctgttcggtctgcacttcaatcagccgatcgtacctggactggttgctgcgttgatcgcattccttatcttctcactgattatgcctccaaagaagcagacaacagagcttgcacctgaagagtaattttcaggaatcatataccagacataaatctataaatatactaaaacttctttttaaaaaatagcagatataagaaacagcaaggctactgccaaaagcattattattaaaatgctttcccgacagtaaccctgctgtttctatttttgtttggatttctctttttgtttggatttctctttttgttcagatttctcttcttatttaaattactttatgctccagccattttctgctgtggaatcgccaggtgaaaataatacttctgaccgtccagtccgcaaacattccgatccatactcccatcgggccaaatcccattacacggatcagaaatacacacagacagaatctgcatgcccacattgtacaacaggatgtgatcatagaaaattttgcatctcctgctgctctcatgccatatgccgggataaacgacataatccatacaagcggttttacaattgtgatccacattaccatatggaaacacatcttcgcactctccggttccataccgccgagaatcgtaattggtttcgtcagtgcaaaaacaatcacacagctcgcagccataacgatctcagcaatcacgcaaagctttttgatgtaataaactgcctcatccttccggtcagctcccagacattgacctacaattgtcatcaatccgattccgactccgataccaccgattccgttcagattctccagaatgttcgtcattgcctgcgcagcgattgctgttgttccaagtattgatactgtggactgaatcgccagctttcctaactggaacatactgttctccacaccggatggaattccgattccaaggatcctgcggatcattctccagtctggacggattttcagataatctcgtaccacaattggctgacgatccagacgaagctctgccaatactacaaccgcacagaaaatacgtgaaatcaaagttgccagtgcagctcccgcgactcccatatggaagccccagatcataattgcatttccgacaatattcatcacgtttgataccattgaaatgagcatcggatctctcgtgttctcctgtgccctgaagatcgatgccgctgcatcatacgccgcaataaacggaaatgataatgcagtgtagaagaaatagatttcagatgctctcataacatctgcttcaactgctccaaaaatcaggtgaagtaacggtttctgaaaaataagacaaaatgcgctgacagctactgatataagagtgatgataaatagtacctgtcgtgcagactcatttgcccgttctttattcccctgtccaatgtactgggcgcagacgatcgcacctccggctgccaatgcggaaaatgcctgaatcaccaatatgttaatggaatccacgagcgatactgctgagattgccgcggatcctacattactaaccatcatcgtatccgcggtacccatgatggaattcaataactgttccagtatgattggtactaaaagagcacggatcatcttgttgctgaacatatgttgttgatttatgttcgcgttcatttatactccccctgatcttgttactacttagattgtctttttacattacgacttagtatacacccggcgaatgtaaaatttctatactttaacctgtttctatttgagtacaattaaatataactagaaaaagatcttcatgccagacattttaagtctgcatgaagatcttgtctcttactctttattaactattctgcttattccagaatggttgtctcctcaactttatctgcctgagcttctttcttctctgtaagctttttaattccctgaattgctacgattactccaaggataagaagcagaacagcaaagatcagctgtaatgtatttccaaggctcagacctgttgtcataaactgacctcccagtttacagattgtcattccaagtgctgtaaatgttactgccatcataaagaccattggaatccagagcattgctccctgacgttttgtcttcttaaggaatactgcacatgcaatcagtgcaagtactgacagaagctggtttgctgatccaaacagtggccagatttctgcatatccaacctttgcaagtaagtatgcaagtaccagtgtaataactgttgagaaatatttattggttgctactttcttgtacaatggcagattatccatatctgtgtcatcatcgataaagaattcctggaaagaaagtcttccgacacgtgcaacggaatcaagtgatgtcaatgcaaatgctgatactgcaaggttgatcagtgtaaatacaagtgaatgcggtaagccgatcacttcaaggaagtttgcaattgctcctgcaaaaatctgtggctgtgttgtcagtccttgtgctgctgcctcgccatcagcgaaggaagcaactgcgatcagtgcgattacagcaagcatactttccatgatcattgctccgtaagatacagggagcatgttcttctcactcttaatctgcttagaagcagttcctgaagataccagtgaatggaatcctgatacagctccacatgcaattgttacaaacagaattgggaacatataacttccatctacattgaagcttgtaaaagctttcaggttacaggatggatttgctacaaatactccgacaattgctgctgcaatcataaagatcagcaagtaactgttcaggtaatcacgtggctgaagcagcattgttaccggtgcgacactggcaatcagaatgtaaataaagatcaggatatgccatgtctctcttgtcagatagattggaaaataaagtccaagtgctaccgctgcgacaagcataacaattgcaattgctgtattaacccatttattcagttttgcatatttcaaaatgcagccaagtgctacggcttctacaatgaaaagcatggatgttgttgctacagcaccatttgctgctactttgcttacaactccggcatcatcggctacgaatccgttaaatgttcctgcaactacatccgcaaatgcagcaacaacaagaatacagaataaccagcagaataacaggaataatttctttccaagtttaccgatatactcttcgataatgtaaccgattgtacgtcctttgttctttacagaagcatacatagatgcaaaatcctgtaccgctccgaagaaaacacctccgatcagaatccacaaaagtaccggaagccatccaaagattgctgcctggattggtccgttgatcgggcctgctcctgcgatagatgcgaactgatgaccaaatacgatattcgtatctgccggcacataatctacgccgtcttccagctcataagcaggagtctttgcattcgggtcaattccccatttcttctcaagatatcttccatagaaaagatatcctccacctaatacaacgatggcaatgaccatcattataactccgttcattttctttccttctttcttaactataatccagatgctctcgtcaataaatagatcgcgctctgtttttatgttaagagtttagcacttcatcatgctaaattcaagaaggattttatataaattttatatttttttaagattttggataaacatattgcacaagagggtttttatttgttttcttattccacactatttcgctcgaaccatctgtacagtcgatacgataatcaatatcatcatcactccaagcatcatatacatcggccagattggttttgttgggttgactttatactgattttatcatacctaccatcttcggcatttcagtatttacatcggcatgtaaatatgctatcctatttcaaagcatattttctaaaacatctaaattcatataaagatttcattacaggtaaatggtacctgtcaaatcaggaaattcatgcttttaaaatccattatttaaagcagaggttttctgatagagagaacttctgtgaaaatcacataaggaggtctcttagatgaaacaaaagagaaagcaattgccggaagcgatttaaaatggcgagatgcgttgctggtcgcacatcgtgtgaacagtaaccgggttatgtcatgtgatacaaaataataattacaatgcttgacattgttgttgaaacagtataaaatttaagtgttgtatttgagtaatatgtacaatgaaaatcgaataaggaggtgctcctgtgcagataagtctaggtttatttataggcgttgccgtggccctcgcgttgatagtcggaatcattactcactttgttacagtttccaatctgagaaagaatgcggaaagcaagattgggaatgcagaagcaaaagcaagagaaatcattgacgatgctgtaaagactgcagagacgacgaagaaggaatctcttttggaagtaaaggaagagtccatcaggacaaagaatgaacttgagaaagagacgaaagaaagaagagcggagttacagcgttatgagaagcgtgtactcgcgaaggaagaatcggtcgacaaacggtcagatgtactggaacatcgtgagaacaaactgacagcgaaggaagaacatcttcgccagcgtgaagccaaagtagaagaacttagccagaaacgtgtgcaggaactggaacgaatctcaggacttacctccgaacaggcaaaagaatatctgttaaaaactgttgaagatgacgtcaagcatgacacagccaagatggtcagagaactggaaactcaggcaaaggaagaggctgacaagaaagcaaaagagtatgttgtgaatgcaattcagagatgtgcagcagatcatgttgcagagactacaatttctgtagttcagcttccaagtgatgagatgaaaggaagaattatcggtagagaaggaagaaatatcagaacactggaaacattaaccggtgtggaactaatcattgatgatactccggaagcggttgtattatcagggtttgacccaatccgccgagaagttgcaagaattgcacttgagcgtctgatcgtggatggacgtattcatccggcaagaattgaggagatggttgaaaaagctcagaaagaagtggatacaatgatccgcgaggaaggagaagctgcggctcttgacgttggagttacaggaattcatccggagttgatccgtcttcttggacgtatgaagttcagaacaagctatggacagaatgcattgaagcattcaatcgaagtagctcagttatcaggtctcattgcaggagaaatcggactggatgtcagacttgcaaaacgtgcaggacttcttcatgatattggtaaatcaattgatcatgatgtagaaggatcacatattcagattggttcagatctttgtagaaaatacaaagaatcagcaaccattattaatgctgtggaggcacatcatggtgatgtggagccgcagagtctgattgcttgtgttgttcaggcagcggatactatttcagctgcaagaccgggagcaagaagagaaaccatcgagacatatacaaacagattgaaacagttagaagatattaccaaccagtttaaaggtgtagataagtcttttgccattcaggcaggtagagagattcgtgttatggtagttccggagcaggtatctgacgatgatatggtgcttttagcaagggatattgcaaaacagattgagtttgaattagaatatcctggacagattaaagtaaatgttattcgtgagtcacgagcaacagattacgcaaaataagagaatcataacagaagatgaaagttggcccttgtcgaaagacaggggcttttagtttactgagaaagctattacaggtaagagtaaaagtctttgatatagaatgcatacggtgatgtaaggtaaaagaagggagaacggaatgagcgagaagattaaaagaattaacagagaattgaaatttaaaggaaagattcttgatttttatcaggacacgatagaagtggacggggatcataccgtagtatgggattttataggtcataaaggagcagcagcggtagttccggttacagcagatggtaagattttgatggtgagacagtatagaaatgcgctggatcaatatacattggagattccggcaggagcacttgatgaagtgggagaacctggtatagagtgtgcgtctcgcgaattagaggaagagacagggtatcgcagcgagaatcttgagtggctgatcactttacggacaacagtagcattttgtaacgaacggattgaagtttatgtggcacatgatctgataccgtcaaaacagcatttggatgaagatgaatttattgaacttggcgcttatacaatagaagaattgaaggaaaagatcttttcaggtgagattgaagatgcgaagacagtttcttctttgatggcttatgctgtaaagtatggaaaatgattgaatgccgacaataagtagcatcgctgccgcatgagaaaaaccagacactcatataatggtgtggaagattgaggataaaaatatatccgcagaacattttatagggtgggaggaatactggtgaaggcatttcgtacaggacattactttttggctctgttttttacaggctttttgacaggaatcttgattgtcaattatatatggggagaacagctgagcctgatcggaacttttacagaagtttatcttatgagattaaagaatgagaagatatcttttcaacagtacatttggtatttgattcaggtacggggaattttttttctgatgctgtttttggcgatgggaatccggatcagaaaaattgtggcagcgttttttcttctgtggactgggatgtcaggaggaattttactgtcagaggcagtggcagaattaggaatcaagggaagtattctttgtgtggcaggactatttccacagttccttttttatgttccggcagttcttgtgcttttgcgcttttgttggaactatccacagaatcagtggaacagacaaaaaacgttctttgtatgcggtttgtttttaattggaattttttcagaatcctgtcttaatccgtggctgattcaacagattgtaaatattcttttttgatttcgtgggaaagtgtgagtaatgcaacgagacagacagttgattgactgatgaaaagtccccataggtatcctgtaattccatagtgcgggattccgaaatatacactaagaatgcggatggataatccaagaagattgatcatcagcgtcagggttgtaagtcccagtccattaatcgcactgagaagagcggaacttgtgtacagaaaaggacagatccaggcaagtgttacgatgaaattactggctaaagtactgtgaaacaggaagtttccgagaaaagacccggtaagaagaaagaagacagaacacagaagaccaagggagaaacatcctccggcagccttttttataaggagaaatgtctcttttgaagagctttcagcttgcttttgtgcgactgctggaattaaaagcaggctgattgagttagtgagtgcacaggggaaaaggatacatggtaatgccattccggtcagtactccataaatactgagagcttcggaagcgctgtgagatgcaagctcaaggcagacagggattgaagctgcttcaattccctgcaagaatgtaattgctgtgcgattaactgtcaatggaacagagaggcgtagcaattcagaacaagattttgagatagaaagaatatatggagaatcggcatcaaaacccttcttcttcagtgaaaaaagcgagtagcctgctgctgcaagttctccgaaaataatacctgatacagccaatggaatcgcagggtgaactccactgtgtataaaaataaaatataaaacaaaaacagaagaaattcgaacaaattgttcgattaactgtgaaatagccgggacagaggttctttgcagaccatagtgataaccacagatacaactgtggacagaagccgccggaagtgcaagaacgatcagatataatagtgttgcacatcttggatctccaagaaaacgatttgaaagaaaaacggaattcttctgtaccagaaaagtgcaaatcagagaaatcagaacagaaagaatcagacctgtctggaaaatcaactttccgtcctgcgttcggccaagggagtgaaagcgagagacacttctggaaatggcagtttcaagacctgaagtactcaaagacaggcagagtgcgtagaaagggaaaattaactgataaagtccgacctgttcttctccaaaggtatggcttaagaaaatacggaaaaagaatccgagaacgcggcttacaagaccggcagatgtgagaatcagtgttcctttaatcaaagaatgtttttttctaaacataataccctcatgtcaaaatgattgctgccacgtgcaacgcggacagtaaccagaaatgaacttatttttaaacaacatattcaagaaacatccttgacagaacgtaagactggtgatatcctacaaaaggaaaccctagcataatactaggaaaaggaaaagaaaaagaaggtgaagatgtgaaactgtcaacaaaggggaaatacggattgcgtgccttgatcgatctggcccaatacagtgaagattctccggtttccatcacaagtattgcaagacgtcaggatatttcagaacgatatctggaacaattgatgtcgaagctgaaaaaagcaggacttgtcaagagtatccgaggtgcaaatggtggatatgtcttagcaaaggaagcaaaagatatttctgtaggagatgtgcttcgtgcactggaaggaaatcttgaaccagtagaatgcgccggacttgatccggaaggagaatgcaaaggtgcggacagctgtgtgacaaagtatgtgtggaaacgaatcaatgatagtattaaccagacagtagatgaaatctggctgaaccaactggtgacagaaagtaaatgtcttggacatacagacaatcatctggattatacaaagtgtaaaaactgaaaagaatcattgtctacaattatttgtgaacggtaagaaaacaaagcagataaaataaaagtgaggtaacaggtaatgggaaaattaatttatcttgataatgcagcaacaacaaagacagcaccggaagttgtggatgcgatgctcccatattttacagagcattttggcaacccatccagtgtttatggttttgcggctgcgaataaagaagtgatcacaaaacagagagaaatcatagcaaaagcacttggtgcgaagacagaggagatttatttcacagctggtggttctgaatctgataactgggcgctgaaagctacagctgaggcttatgaatcaaagggaaaacatatcattacaacaaagattgaacatcatgcaatccttcatacaggagaatatctccagaagagaggatatgaagtgacttatctggatgtagatgagaatggtattgtcagtccggaagctgttgaagcagcgattcgtccggatacaattctggtcagcgtaatgtttgcaaacaatgagatcggaagtattcagccaatcaaagaaatcggagagattgcacataaacatggagtacttttccatacagatgctgtccaggcgtttggtcaggtaccgatcaatgtagatgagatgaatattgatatgctcagttccagtggacataaactgaacggaccaaagggaatcggtttcctttatatcagaaaaggtgtgaagatccgctccttcgtccatggtggagcacaggagagaaagcgccgtgcaggaacagagaatgtacctggaatcgttggacttggaaaagcagttgaacttgcaatggcttctatggatcagagaatgaaacaggagacagaactccgcgattatgcaatctccagaattgagaaagagattccatattgtagattaaatggagatcgtgtgaaacgtgttccgaataacattaacttcagcttccaatttgttgaaggagaatctttgctgatcatgctggatatgaaaggaatctgtgcatccagtggttccgcctgcacatcaggttctctggatccatcccatgtccttcttgcaatcggactgccgcatgagatcgcacatggttcccttcgtatgacacttggagctgatacaacaaaagaagatatcgactatacagtagatcagcttaaagagattgttgcccatctgcgcagtatgtctccactctacgaagattttataaaaaagcagcagaagaatgcataagtcagaatgatttaaaagaaaaatacagaataatttttggataaaaagatatattaaatggaggaattacattatgtatacagaaaaggtaatggatcattttcagcatccaagaaatgtaggagagattgagaacgccagcggtgtaggaacagttggaaatgcaaaatgtggagatatcatgagaatctatcttgacattgatgacaaccagatcatccgcgatgtgaaattcaaaacattcggatgtggagcagctgttgcaacatccagtatggctactgagatggtaaaggggaagagtgttcaggaagcaatggaagtaacgaacaaagcagttatggaagcacttgacggacttccgccggtaaaagttcactgctctctgcttgcagaagaggcaatccatgcagcactctgggattatgcagagaaacatgggattaagattgaaggcctgaagaaaccaaagtcagatattcacgaaggtgaagaagcagaggaagaggaatattaatgagcaaaggcaaagttgttgtaggtatgtccggaggagttgactcctctgtggcagcctggcttttaaaagagcagggctatgatgtgatcggtgtgacgatgcagatctggcaggatgaagacaacgtcgttcaggaagagaatggaggctgctgcgggctcagtgcagtggatgatgcaagacgggttgcggcgtctataggaattccttattatgtaatgaactttaaacaggaatttcagaaaaatgttattgattactttacagaagagtatctcaacggaagaacaccaaatccatgtattgcctgtaaccgctatgtgaaatgggaagctcttttgcagagaagtctttccatcggagcagattatattgcaacaggacattatgcaaggattgataagctcccgaacggaagatatgcaatccgcagatctgcaacgcttgcgaaagaccagacttatgcactttataatctgacacaggaacagctggaacatacattgatgccggttggaaattattcaaaagatcagatccgtgagatggcagaaaaaatcggactgcaggtggcaaataaaccggatagtcaggatatctgttttgttccggatggagactatgcatcttttattgaagaaaacgcagatgctccgattcgtcagggaaatttcgtgacaccggatgggaagatccttggaaaacacaaaggaatcattcattatacagtaggacagcgtaagggacttgggcttgcattggggtatcctgcatttgtactggagattcgtccggagacagatgaagttgtaataggaacttatgaagaatcactgacttatacgttacgtgcaaatgaactgaattttatgagcgtagaggatattacagaaccaatccgagtgtttgcaaaaatccgctacaatcataaaggggcctggtgtacagtggagaagacaggcgaagatgagattatctgtacatttgatgaaccaattcgtgcagtgacaccgggacaggcagttgttctgtatgatggagaatatgtattaggaggcggcacaatattatgataagatgtgatgcccacatgcatacaaggttttctgaggatagtgatgcatccgtacattctatgcttgatgcagcaatagaaaggggaatggaagcagtctgtattacagatcatctggataaagattttccgaagacaccggattttccggcgggtgcatttctgtttgatctgggaaactattttcagaggctgacacagttaaaagaagaatatcagaagaaactggaagtccgaatcggtgtagagatcggacttcagccgcatctgggggaatattatagagaactgacagagaaatatccatttgattttgtgattggatctgtgcacctgatccatggacaggacccgtattatagaactttttttgaaggtcgaagtgatgaggaagcttatcaggaagcttttcaggtgacgatagagaatttgaaaaaggtaaattcttttgacagcctgggacatctggactacgttgtccgttatggaacgcatcaggcggaggaatattcctataaaaagtatgcggaagagatcgacgaaattctgaaaattctgattgcacagggaaaaggacttgagatgaatatggccgggatgaagtatgggcttggatttccgaacccacatccggatgtgatcagaagatacagagaactcggtggtgaaattgtcacaattggtgcagatgcacaccgtccggaacatgtcgcttttgactttgacaaggctggcgagatacttataagctgtggttttagttattatgcagaatttaaggggcggaaaccgatatttaagagaattgttccataaaaatcgaattatatggatttaagggttgaatttttgttcctgttttagtacaatgaatctagttgatgaatatttaacaattatcgctttgttaaattcatcgccatggctggagatacagtcataaattttttaaactttttaggaggaattaatcatggcagtaaaagtagcgattaatggttttggacgtatcggacgtcttgctttcagacagatgttcggagcagaaggatatgaggtagtagcaatcaacgaccttacatctcctaagatgcttgctcacttattaaaatatgactcaactcagggaacatacgctcttgcagatacagtagaggcaggagaggattccatcacagttgacggaaaagagatcaagatctacgcaaaagctaacgcagctgaacttccttggggagaaatcggtgttgacgttgttctggagtgtacaggattctacacatccaaagcaaaagctcaggctcacatcgatgcaggtgctaagaaagtagttatttctgctccagctggaaatgaccttccgacaatcgtttacaatgtaaaccacgagacactttcaaaagatgagaacatcatctccgcagcttcttgtacaacaaactgcctggctccgatggcaaaagctcttaacgaccttgcagcaatcaagtccggtatcatgtgtacaatccacgcttacacaggagatcagatgacacttgatggaccgcagagaaaaggtgatcttagaagatctcgtgcagctgcagttaacatcgtaccaaacagcacaggtgctgctaaagcaatcggtcttgttatcccagaactgaacggaaaacttatcggatctgctcagcgtgttcctacaccaacaggttctacaacaatccttacagcagtagttgacggagaagttacagttgatcagatcaacgaggctatgaaggctgcttccaacgagtccttcggatacaacacagatcagatcgtatccagcgatatcgtaggaatgagatatggttcactgtttgatgctactcagacaatggctcttccagttggcgatggtacaacagaggttcaggttgtttcatggtatgacaacgagaactcttacacaagccagatggtaagaacaatcaaatactttggaaaacttcttgaggcttaattctttttgaggaattagaatctcagagatttatctgaattattgactcacaatggggtccggtcttattgtaggaccggaccccattttctttgtgcagaacagattctgcacgtgaaagtgacaggaaatagaaatacaggaggctatgaaaaatggcagcacttaataaaaaatccgtagatgatatcaatgtaaaaggaaaaagagttcttgtaagatgtgacttcaacgtaccgcttcaggatggaaagatcacagatgagaaccgtatcgtggcagctcttcctacaatcaagaagctgattgctgatggaggaaaagtaatcctttgttcccaccttggaaaaccgaagggagagccaaagccggagctttcacttgcaccagtagcagtaagactttctgagctcctcggacaggaagttaaatttgcagctgatccggaagtagttggaccaaacgcaaaagcagctgttgaagctatgaaagatggagatgttatccttcttgaaaatacacgttacagagcagaagagacaaagaatggtgaagcattcagcaaagatcttgcatctctttgtgatgtatttgtaaacgatgcattcggaacagctcatagagcacactgctctaacgtaggtgttacacagtttgttgacacagcagttgttggatatcttatgcagaaagaaatcgatttccttggaaacgcagtagagaatccggaaagaccattcgttgcaattcttggaggatctaaagtatccagtaagatttccgtaatcaacaaccttcttgacaaagttgatacactcatcatcggtggtggaatgtgctatacatttacaaaagctcagggcggaagcgtaggaaattcccttcttgaggaagattacttacagtatgcacttgacatggttaagaaagcagaggagaaaggtgttaaacttcttcttccagtagatgctgttgcagcagatgctttctctaacgatgcaaatacaaaagttgtagctcagaacgagatcccggacggatggatgggtcttgatatcggacctaagacagctgagatgttcgctgatgctgttaaatctgcgaagacagttgtatggaacggaccaatgggatgcttcgagatgccgaaattcgctgaaggaacaaaggcagtagcagaagcacttgccaacacagatgctgtaacaatcatcggtggtggagattctgcagcagctgttaaccagcttggatatggtgacaagatgacacatatctctacaggtggtggagcttctcttgaattcctcgaaggaaaagaacttccgggagtagcggcagctaacgataaataataagaatctgtaattacagatcagaagaaacccgtgttgttacatttcatacgggttctgaatataaaattcaaggagataagaacaatggcaagaaagaaaattattgcaggaaactggaaaatgaacaaaactccaagcgaggcagttgcgcttgtagaagagttaaaaccactcgtagctaacgaagacgtagatgtcgtattctgcgtaccggctattgatattgtaccagttgtagaggctgctaagggaacaaacatccaggttggagctgagaacatgtattttgaggagagcggagcttacacaggtgagatttccccgaatatgcttgtagatgcaggtgttaaatatgtagttctcggacattctgagagaagagagtacttcggtgagacaaacgaagatgtaaataagaaaatcctgaaagcatttgagcatggtattacaccaatcatgtgctgtggagaaactcttgagcagagagagcagggcgtaacaatggacttcatccgtcagcaggttaaggttggattccagggtgttacagcagatcaggctaagacagcagttatcgcttacgagccaatctgggcaatcggaacaggaaagacagctacaacagagcaggctgaagaagtttgtgcaggaatccgtgcttgcatcgcagaagtatatgatgaagctacagcagaagcaatccgtatccagtacggcggatctgtaaacgcagctacagctcctgagctttttgcacaggctgacatcgatggaggtcttgtaggtggagcttcccttaaggctgacttcggaaagatcgttaactacaaataataagatctaaggctgtttcattataacagataattaagaaaggtcatctggtcagaaagatatttatattgccgggcacaggtagtgcagacagtagcgatatagatagcaattctgacaggatgaccttttttcttgactttgaaaatcatttgagtgtatcatagaggagattgataaaataatgtaacagcttaatgaagaaaataaagcaattaagaaaagggaatataaaagataggagattaagaagctatggtaggaattatcggagcgatggaagaagaagtccgtgagctgatcgaggatatgacagaatgcgagatgcaggaaaaggcatccatgaaattttataaaggtcagctttatggaaaagaagcagttgttgtacagagcggaatcggtaaagtgaacgcgggaatctgtacacagatccttgcagacttttatcaggtggatcagctgatcaatacaggtgtagccggttctctggatgcagagatcaatatcggagatattgttgtatctacagatgcagtagagcatgatatggatgtcagtgcattgggagatcctgtcggacaggtgccgcgtatggatgtatttgcatttccggcagataaagaacttgtgagaaaagcagtggaagcaaataaaaaggcgaattcagatattcgtacatttacaggtagagttgcaagcggagaccagtttatttctgaaaaagaagtaaaagaacgtattgttaataattttggtgcgaaatgtgctgagatggaaggagcagcaattgctcacggtgcacatttgaatcatgttccatgtgtgatcattcgtgcaatctcagataaggcagatggaagtgcacaggtggattatcctacatttgagaaacaggcgatcgttcatggtgtaaagctgatgaaagaattgcttccgacattataagatttttaatgtagtgatttttacatgaattcaggcgaaaatctgcttattttcggatatatttgaccagagctctgacttgcaaaattgtgctaaaactagtacaataaagcgtagagttaaaaaatagacaatcttaatgcaaaggagatattgagatgagcaaaaaaccaaccgtattgatgattttagatggatatggattaagagataagacagagggtaatgcagtagcacttgcgaatactcctgttatggataaactgatggcagagtatccgtttgtaaaaggaaatgcaagcggactttctgtaggtcttccggatggacagatgggtaactcagaagtaggacatatgaatatgggtgccggacgcatcatttatcaggaacttacaaagatcacaaagtctatcgaagacggagaattctttgagaacaaagctcttcttgcagcttgtgagaatgtaaagaagaatgattctgcacttcacctgatgggacttgtatctgacggaggagttcatagtcatattactcatatttatggaattcttgagctcgccaagagacagggaatcgagaaagtatatgttcattgtttccttgacggccgtgatacaccaccggcatcaggtaaagagtatgtagagcagcttgaagcaaagatgaaagagattggtgtaggtgaagttgcatctgtatccggacgttactatgcaatggatcgtgataaccgttgggatcgtgtggagaaagcttacaaagcattagttgcaggagaaggcaatacagcagaatccgcaacagcaggaatccaggcttcctacgatgaggatgtaacagacgagttcgtagtaccatttgttgtaacaaaagacggtgctgcaacagcaacaatcaaagaaaatgattctgttgtattcttcaacttccgtcctgacagagcaagagagctcacaagaacgttctgtgatgacagttttgacggatttgaaagaggagacagagtgaagactacattcgtatgcttcacagagtatgatgcgacaatcgagaataagatggttgcattcgtaaaagaatctattacgaatacatttggacagttccttgcagataacggactgaaacaggctcgtattgcagagacagagaaatatgctcacgtaacattcttcttcaatggtggagtagaagagccgaatgagggagaggacagaatccttgtgaaatcccctaaggttgctacttatgacctgaaaccggagatgagcgcttacgaagtatgtgacaagcttgttggagcgattaagtctgagaactatgatgtgatcgtgatcaactttgcaaaccctgacatggtaggacatacaggtgttcaggaagctgcgatcaaggctgtagaagcagttgacgagtgtgtaggaaaggctgtagaggctctgaaagaagtagacggacagatgttcatctgcgctgaccacggaaatgcagagcagctgatcgatgaggagacaggtgagccattcacagctcatacaacaaatccggtaccgtttatccttgtaaatgctgatccggcttacaaattaagagaaggcggatgcctggcagacatcgctccgacactgatcgagctgatgggaatgcagcagccggctgagatgacaggaaaatctctgttagtgaaataattcataagtgttgaatttggattcaggcaacttgaatgattctttcaagagaaaagaatctagaagaaaattgcgtggattaagatagaagtgaaaagggaaagctattgactgcgataacaacagtgcttgttttagtttatcgtaattgatagctttccttttccctataggttgttgttcgcagtagatgtgtacagcaatgcctatagttcagagaggaaaggaaaagtcatgcgtgaaagattgacaaaaaatgatgtagaaaagattcaggcagagattgagcatcgaaaattagtagaacgtaaagaattgattgaagcagtgaaagaagcaagatctcatggagacttgagtgagaacttcgaatatcacgcagcgaaaaaagcgaagaatcagaacgaaagtcgtattcgttatctggaaagaatgctcaagacagctgagattgtggaagatcattcgaaagaggatgagattggcctgaataataccgtagagctttattgtgaagacgatgatgagatcgagacatatcgcattgtaacttctgtaagaggaagctctttgaacggactggtcagcatagaatctccgattggaaaagccctgctcggacataaagaaggtgagagagtctatattaaagtgaacgatgatttcggctattatgtggtgatccgtaaagtgattaaaacagaaagtgaagaggatgatcagattagaaaattttaatagagtgaggaattggaaatgaaaataacaactgtactgtttgatctggacggaacacttacagattcaggtccgggaattatgaattctgtaaaatatgcgctggagaaggtgggagaaccgacacctgacgtagatgaattacgtaaatttattggaccaccgctgaagggtcagtttatggaacactgtggaattgatgaagaaaaagcagcagagatggttactctttatcgagaatatttcacagtgacaggtatttttgaaaacagtgtgtatgatggcgtagaagagatgctcaagaccttgaaacaaacgggaatcaagattgcgatggcgacatccaagccggaaaaatttgctaaaatcatcgcagatcactttggactggctcaatattttgatgtgatcggcggggcatgtatggatgagacacgtacagaaaaacaagatgttatccgttatgtcttggaacagtgcgaagagaaagaactggataaaatcgtaatggtcggagatcgttcttatgacatactaggaggccatgcggaaggactgaaagtgatcggtgttctgtatggatacggagacttaaaagaactctcagaggcaggtgcagatgctctggcaacaacaccacaggaagtagccgaactggttctggaaacagaataaagtaaatcgatttaacaatagtttgatttattttacatagatttagcattggaagaaaatgagactttacaaataccctctatactaagaattgtcaaaaggaaaaacacttagacatttttagtagaaagagggtaatttttatgtatggaaaactttggagttttgtaaatcattatatagatgcaggtcatgcacttgcagtatatctgccaattttaattgcaggatggacaatcataggaacactgtttggattaggagtatgttctgcaatcaggatagatctgatacagagtctggcagatatcctctgtgtaggaggatacgcaggaattttcttgggacttttcgggggaatcctttacttgtatcgtaaataaaatttagtgtagagattcttgttcgagtatcggacgaaatcagatatcgcatataaagtttattcgaatagacagacatcgagggcttgatgcaggctccgggttctgtatacaggaaagactaagaaaaacgagagattactaaaaacaaagcaatgctcggcaaactcgctgccgcttcagacagctacctcgcattgcttcaacgtaagctttcgttttttaagtctttccaagcacacagaacagtcccctgaatcaaaccctcgatgtctgtctatcggtaagttttcagcgatatcagagttctacttcctcgaaagaagaactctacttgagaggtaggcgcaacggaagtcctatagaatgatacctattttccaaacgtgtttacgcttaatagaatttgacgtagaagaactatcatttccgataagcagaaaacagcgactatgaagtcgaaaaattgtcatgttagaagatggaggcagggacgaagatgaatgtggagcatgcttgctcatacttgaaaaacaatagattgcgttaaagaaaggcgatttaaaatggcgagatgcgttgctggtcgcacatcgtgtgaacagtaaccgtttattgacctttcgatgtttgcattatacaatagagggtgtaaaattcctgttaagaaaatggagaaaaataaattgagattattagttgttgaagatgagaagaaattatgtgatatgattgcgaaaagtctgcatcaggcaggttatgaggtagacacgtgtaatgacggagaggaagcactggatatgatttatgcggaaatgtatgatctgatcgtgctggatcttaaccttccggggatggatggaatggatattcttcgggagcttcgcaaggaaaatgaagagacaaaagtattgatcttatctgcgagaagtcagatcgcagataaggtcgacggtcttgatgcgggggcgaatgattatatggaaaaaccatttcatctgcaagagctggaagcccgtgtgcgaagcctgacaagaagaaagtttgtacagaaaaatgtctgtcttgaatgtggcagtcttcgttttgatacaaaagaaaggactgcatatgcaaaagacaagccggtcgcattgacaagaaaagagaatggaattctggagtatcttcttttgaatcagggaagaccggtcagtcaggaagagttgatcgagcatgtctgggattcttctgtagatagtttcagcggttcgatccgagtgcatatgtcttctctgagaaagaaactgaaagcaggacttggttatgatcccatcgtgaataagattggtgaggggtataagataggagatggaaaagcatgagaaaaatatcgctccagtggagactgacgattcttacaaccgtgctgatcacagtattgtgtggatgtctgacatttttcctatataagaatggtgtctattatatcgatacgcttcaggagaccgttacagatcagggcactacgccggaggcagtctacattgatattccggataatgagtgggatgattttgcagcgcagtttgccacgaaggtttataattcgaaatcagattatagaaatagaagtttgttgatcactggtgttgtagcgctgattggcggagcagtaacttattttgtcagtggccgcgcattgaaaccactcagagaattctcagaaacagtagaaaaggttcaggcgcagaatctgacagagtatacaattgaggaaaataaaatcgcagagttggatcgacttcgtacatcttataataagatgctcctgcgactttcggaatcattcgagacacagcgtcagtttacggggaatgcagcacatgaactccgaacccctttagcattaatacaggcacaactagatctctatcatgcggcggagaattcagagaacgaagcagctgcacaagagacgatccagatggtaacagagcaaaatgaacgccttagcaagcttgtcagaacgcttttagatatgagtgagctgcagacggtagcacgtaatgaaaagattgaaatgcaggggctgatagaggaggtgctggcagatttggaaccgctggcacaggaaaagaatattgaactgatacagaagacacagaattcatcggatggaagaacagatggaacagaagagtcgttgctggtcgcatgtagtgtgaacagtaacgaaaagccagaggatgaactgatattgacaggaagtgatattctgatttatcggatgatttataatctcgttgaaaatgcaattaaatataatcgggtagatggaaccgttacagtatcggcgaagagagagaagaatgaagttgtcctgacagttgcggatactgggaatggaattgatgaggcatttcgagagcagatttttgaaccatttttccgggtagataagtcaagaagccgtgagcttggcggtgtgggacttggacttgcgttagtgcgtgaaattgtgcgggtgcatgatgggaagattgaggttcgcggaaatgagcagggcggaacgacatttgaagttagaatggggatgggatggaatagaagaataaaataggtaattgcgaaacaagttcgcaatctcgataaaaaatgcggtaagaatcctgcatcgcaggattcttaagatgaaaagtaggtgtttctaaatttggacatgatcaaaagacttcccagataaactgcgaagaaaagatcgtatggatctgaaagcaacgagaagagtgactatcgcaggagtcctgatgaacataagcctattggatcacatcatcataggtgcggatggaagatagtgctgaatttatcatcactctgattcgtataagtaatattttggtcaccgtctaacatgaaaaaatatgccttttcatcatatcctttaaggtttaacattgaatctaatttcgcattgtcatacacagctccaatttcatactaaatacacactccgtttctaactcaagtccatccattgcctgttgaaatctaagcctaataccgcctaaaccaacaaataaatcattcgtggcatgagtaatcctccttcgttttggttccactaaactatgagatgggggagctccctttttcaaggaaactaattttgtgactatttcacaattgaaatgtaaacgttttcccgtatgataaatgtatagaattcttccggaggaattttaaatatggaaaatatagacattaaatttatcgcgaaaaaaagcgagtgttcgattgctacggtttctcgtgtgatcaatcgttccaaaccagtcagcgaggagttacagaaaagagtaatagatacgatcagaaagtacaattataatccaagcatttacgcgcagaatctggcgggtaaaaagtcaagactacttggttttataatgacaaactacatcaatcaatatcagctgctactgtttcgttatctgaatgagtttgcatgcaagatggggtatggttgtattattcgttattgtaattctggatttgaggaaaaactagaggtattaagagaactggaaatcaggggaatcgaagtctgctttagcctttttctgctttcgcaggaagaggaagcgtacataaaagaacatttcagaattaaagtctgccatatgcagtcaccggaaatgcacttgaacatcatagaaaaaaacgaaagttctgtttatgaggctgtgtgctatcttgctcagcttggtcacaaacgaattggaggcattttttgtattgacgaaatagatgatagtttcctcatggcaaggaaaagaggctttttaaaagctataagtcagataaatctcgatcaagatgaatctctgatcggccagcttcatggagaatgtgaaaaagacagtgtgatttctgtgatagaaaagatatttgtacctcaaaagccgccaacggcattgttttgttatagcgatgaagttgcgatcgaggtaatgtcctggatcatgaagcagggttatagaattccagaggatatatctgtgctttcatttgacggtattccgtttgcgggacgcgtaacgccatctttgtctacaattagccagccagtagaatatcaggcaaaatgtattataaacggcatgttgtatctacaggatggaatagaaagaccatgtgatgaaaagggaaatgaatatcttctgcagattcgggacagtgtggggtttcctagtcattaaaaagattggaggaaaaatatgaaagcgaaaaaattaattgctactggtattgcaacatcaatgttactgctggcgcttaccggatgcggagcaggtggaaatagtggtaaatccgcaaaagatacagataaaggatcagtatattttctgaactttaaatctgaactttcttctgaatgggaagaagtagccggaacctttaccaaggaaaccggaattgatatgaaagtagttactgcgggaagcggaacctatgaacagacattaaaatctgagctttccaaaaaagaaatgccgacactttttaacgttaacggtccgattggatatcagacatggaaagactattgtgctgatctgaaagattcaaaactttatgaatggcttactgacaaagatatggcaattaccgatggcgatggtgtgtatggtattccgtatgcagtagaaggatatggaatcatctataatgatgctattatgaagaaatattttgcgcttccggataaagcagttgatatttcagatacaaaagagattaaaaatttcgacacgcttaaaacagtggtggaagatatgacaaaacataaagatgatcttggaattcagggagttttcggttcaacttcatttgctcccggcgaagattggcgttggcagactcatcttatgaatatccctgtgtactatgaatacaaggctgacggagtggataatctggatgagatcaaattcacatataataaaaactttaaaaatatttttgatctctatctgaataattcatgtacagaaccgtctatggttggatctaaaaatgtcgaggaatccatggcagaatttgcaactggaaatgtagctatgatccaaaacggaaactggggctgggcaatgatctatgacctggatggaaacgtggtaaaaaaggaagacattaagttccttccaatctatacaggagtagaaggcgaagaaaaacagggactttgtgtcggaacagaaaactatatctgtatcaacagtaaggtttctgaagctgaccagaaagcatctgagaagttcttggaatggctgtttaacagcgagagtggaaaagcttactgcaatggaatccttggaatgatcccgccattctccacctttggtgaggatgaaagacccgataatccgctcgtacaggatatgcttagttatatgaacgatgattctttatattctattccttgggacttttcaaccttcccgagccaggaatttaaaaaccagcttggaagctatctccttgaatatgcgcaaggaaatatggcatgggatgatgtagttaagcagacaactgattgctgggcatcagaaaaagctctgcttgcacaatagtagagtttataggctggcgttttccgaacggaaaatgccgcatgatacagtgaatgtagcagatttcgctgctttggaatgcaaagcagcggtaaaatccgttgctgtttgtgcaatgcgtgaaaagcaacaaaatttatggggcagagacaaaaatgtttctgccctatgtacgaaaagggaggctgtatagaagatggaaaaagcttttaaaaagagatttgtgatattaatgttaccaacgctgatcgcatttattattgcatttattattccatttgtactgggaatttatctttcattcactaaatttacaacagttacagatgcccagtggattgggctgagcaattatattgtggcattccgggataaagatttccttgcatctctcctgtttactgttaaatttgtacttgttaatcttgtgacgattaacttaattgcctttatgctggcatatgtgttgtccagaaagctccgtggaacaaatattttccgaacagttatatttatgccgaaccttctgggcggaattgtgcttggttatatctggcagctaattattaatggatttctttcttttttcaaaacaacgcttactgcagatgcggcatatggattttggggaatggtgcttgctatgaactggcagatgatcggatatatgatggttatttacattgcagctatccaaaatatttcagaggaagtaaaagaagcagcacttattgatggtgtaacgcgaggacagatgattagaaagattattctgcctctgatcatgcctgcaattacaatctgcttatttatgacaacaacaaatgcatttaaaatgtttgacttaaaccttgctctgaccgcgggacttccgggaaaatcgacttctctggttgcactggatatctataattcattctacaacagaatgggttatgagggagtcggacaggccaaagcagtgatgtttttactgattgttgctacaatttctgtgacgcagcttattattactcggcgtaaggaggttgaaaactaatgaaaaataagaagagtaaaatcatactgatcttaattcttactgtaatctcggttttatttatcgctccgattgtgattgtatttatgaattcgtttaagagcaaactgtttattaacagtacgccgtttgcgtttcctaatgccgactcttttgtaggtttggcgaattatggagaaggaatgatcaaaaccggatttttgcaggcattttttattactttatttataactgtagcctctgtgtttcttattgttgtcctgacttcaatgacagcatggtatctggtacgtgtaaaaagtcgttttactaaagtaatgtactatctgtttgcttttgctatgatcgtaccattccagatggtaatgtttacgcttgttaaagtatcaaatatgtttcatttggacaatctgattggtatcatatttatttatgtcggatttggtgctggattgtctgtatttatgtttaccggtttcattaaatcaattccagtttctctggaagaggcagcgatgattgatggatgttctattatgcaaatttactttaaaattgtgtttcctgtgatacgcccgattattatgacagtcgcaattctgaatgccatgtggatctggaacgattatctgcttccatatcttgtaattggttctgaatataaaacaatttctgtggcaatccaatatctcagaggtggatatggatcaattgaccttggacttatgatgtccatgctagtactggcaatcataccaattgtaattttctatatgatctgccagaaatggatcatacagggagtaatcgccggagcagtgaaaggataaggagactagaatgaaaaaagtattatatgaggaattacttccggaagaatgcgtgcagagaatacaggagatgccggttgcttatctcccgcttggcacattggaatggcatggtccacatatgcctcttggggctgacggaatccagtcaaaagagttgtttgtccgagtggcagaaaaagtaggcggcgtagtacttccgatgttgtttatgggacctgatcgtgtgttttatgacagggggactgagttttatggaatggatattaataccgaaggcgcactgaatacatattgcgtccagcagatgaaaggcagtgcctattggatggaaaaaggtcagtttcaggacaatctgcgcagtatctttgcccaactgtccagagcaggtatacgtatcgtagtcggacatggacatggtccatcaacaaatgcatttcaggaactaaaggaagaagcagcagaaaaatatggcctgcgcattttgactgcttggacatttgcagatgatgatcggttgaaatatcagaatgaccatgccggagcgaatgaaacatctatcgtaatggctgtacgtccggagttggtagactttggacaggtgaaagaaaatgaaagtaatctgatcggaatcgcaggacgtcatccagtcagagaatcatccgtagcatacggaaatgagatccttgagtatacaatgaaaacacttatttcaggtattgaaaaggagtacaaaatactcaaagaaagctagatgcaaatgagtttgaactgttttatgaaaaaagaatcctgctcgcaggattcttttttcagcatttgttgatttttttacaaattcaattttcttctcgtagcaaagctacgatatctgagtcattatccattgccgatttgtcggtaatttctgttttctccaattcttcaactgaaatttgagattcagtactattgtctattattttcaaatgaaacacttcttttttctctgcagcctacacgtacattctattgtgtttgtcaacccttaaaaaatggttagaccacttattgaaaatctaaccatttaagatacgcaatgctaatcaaatgacattgggctctgaacagttacgcataaaaaaggctgcgcacctatagttcaatattattgtttcatcatccgattccgcccagcactgcgccggcgatcagtgcaacaagtgcgagtggaacaaggacatattttccaagtggcaagaaccaagtcccgatttttttctcacgtccagtatttacagctttcagtgcgaattctttatctgcgatccagaagaacatgatcgctgcaagcattgctccaagtgggcagatatagatagaaactgcgtccatccatccggagacgatgccctggatgagaagtgcgatacagcagccgaatgctgcaatgattccaacagctgagacacgctttaatccgaaacgttcctgtaatgtagcaaccggagcttcgtatagatttaccagtgaactcattccggcaaaaagtacgcagatgtagaaaatgattcctacaatcttgccgccgggcattccgttgaatacattgaccagatagataaacatcagtcccgggccgccagaagataattcagcaccgccgactgccattcccggaatgatcacgaaagcagcgagtaaggcagcgattgtatcgaagatggcaacattttttgcagaacttaccaggtcttcagaatcctttaagtaggaaccatagatgacagttccatttccggcaatggacagagagaagaatgcctgaccaaaagcatagatccaaagtcttggatctaaaagtccctttggattgattgtgaagatgtaacgatatccggtcgatgaaccaggaagggagaaaatatataccccgagtccaagaaacagtacgaacaataacggcatcattacgccgttggcacgctcgattccaccggcaattcccattgccatgattacagcagttacaaggactgcaattacaagccaaaggttattaccaaaagcagaagcagtactgtcgaacatgcctccaatttgattcatatcttgtttcatgtcggcaatctgtccggtcagcgcaaggaaagtgtatttgaaaatccatccgacaacaacagtgtatccgattgcaagcgcgagggagccgagaaccggaagcagtccgatcaattcacctgttttcttattgccagttcgcatttctgtacagacaccaaaagctttgattggtccacctttggcagcgcgtccgagtgccatctcttcgatcactccggtagaagcaatcaatattacaaataagatataaggaatcagaaaagtcataccaccccagtctgataccatgtaaggaaatcgccagatattccccataccgacggcagagccgatgcaggcaaggataaatcctgtccggcttttgaatccatcacgttctttctcatgttttctcatgtgtagtcctcctgtaaaagtgcgtatacttttgtacacgaacgtattgatgtattatagcatatttacataaagaaaagaagcaccgagatgatgcttcttttggtgtaatatttttttcagtacaatgtgagtggcgattttatgataaaatcaaatttttttatctaaccattttttaacagtagttgtatctaccagtcggctccaaggattaattgtggaaaatttgctaaaagttctaactcgccgtgctgactgtgtattaaatcaattttgtcatcaaataaatcaagaagctgtttttcaagagcttttccttctaaagtctgttgcagccaaacgtagactctttcgcaggtgagatgaatgttcgtgcaataatcaacaaaaagaggactgatttctaacatgatagaacaaatctcactgtcgtagatttggatttccggataaatatacagagagtaatatcgtttccaggcatcaatattttctttatttttcataaacgcacggattctgtttttcatttcttcggcatattgcaaacagccgtcgtgatctaaagatgctacatagttgatatgcttgtctttctttttgaaaagtctgtcaatgtcagtaatgtcaagtgtatgaagaaactgacgaatcttgcgacagttttcattatactgaatgtttgtaagatgatttaatttctgccacaaaaattcctggtactcggtcaacggtggttcgggaaggaaatgaatccacaaaatccggttaacctgaagcttatcatttgcatcaaaagaatcactttccggataagagcatatttcaggaatatggatctgagttcctaaggaatatagtttatcaatatctgtgttaaccggaaggcgttcgaaaagatcattcatagcagataaaattccttctaaacgttccttttctttatggagctctttgatatgctgatttaaatatagtccggtgctgtcaggcgtattcagaatagatctgatcacggaaatagaaaggccggcattacgaaacagacgtattaaagatagtcgcttcacttcttcctctgaaaaatcataataaccgttctgaacatcagaagcaggagaaagtaatccttccttaatataatagtgaatatttctttttgtaaatccgctgattttacagatttcctgcattctcataacgtatcctccttgtcacgttatctgtataatttcagtatacttattctaaagcgtacagtcaactgtacagaggaaatggctctgttttccgataaaagatttctcatggggattttaactaatgtagtttggaaaaaagtaaaaagtagggcatgaagtttggcaataatgtgtcattgacgttcattcatctgtacagtgtaaactataggtaacgcaaaactcgtagcaagaatgatggagcattcttggaaaatgaaataagaaaaaggaggctgatttttgtgtttgagaagttatttagtcctataaaaataaaagatatggaattaaagaaccgtattattcttccggctatgggaacgaaattttcaggtgacggaagtgaagttacagacaaactgatcgattatcatgtggctcgtgtaaaaggtggaagcggattaaacattgtcgaagttacaagtgtttacacaccagcagcaccaaaacgtttcttatcccttagtgaagacgagtatattccgggtatgaaaagattaacagatgcaatccatgcagaaggtggtaaggccggcgttcagttgtggcttggagctctggcagtttcttctgaccgtgcagcgcagatcattatcccaagtgatatgccgatcagtgcagaaatcacaattccgggaatgcctaaagaattgattccggttgtagtagatgcctatggaaaggctgcaaaccgcgcagttcaggcaggatatgactgtattgaattccattgtgcacatacctacctgccacactctttcttgtccggtggaattaacagacgaacagatgagtatggcggatcttttgaaaaccgtgcaaaattcccattagagtgtattcgtgcaatccgtgctaatatgccggagggtatgccattgttaatgagaatcgatgcacatgatgattatcttgaaggtggacttacaatcgaagaagtaatcaaattctgtaaacttgcacaggaagcaggtgttgacgttctggatgtttccagaggaaatattttgtcaaatggattgaaattcgaagttcctcctgtagatcttccacagggatttaatgttgacaatgcagctaaaatccgcgaggaaacaggaatgttgacaatcggagttggacgaattaatacacctgaacttgcagaaaagattctggaagaagacaaagtagatatggttgttatgggacgtgcacagcttgcagaccctgacttctgtaagaaggcagaagcagggcagacagacgatattgattattgtatcggatgcaatcagggctgttatgacggatttgaaaatatggatatggaatgtattacctgtcttcgtaacccggctcttggacgcgaaaaagaatgtgagatccatctgacagaaaaaccagagacagtacttgtagccggtggaggtattgcaggactggaagctgcaattatcctgaagaagagaggacatgatccgattctctgcgaagcgacagacacacttggtggtcagttcttaacagcaggtgaggcaccgcgtaagaaagaaatgaaagcggcggcaatctcaatggctaagaaggcggaacgactgggcgttgatattcgtatgaatacaaaagttacaccggaaatgattgaagaaatcaaacctcatactgttatgaacgcaatcggtgcagagtcaatcattcctccgattccgggcgtagataaggcatttgtaaaagattctcatgatgtattagacggtaaagcagaagctacaggaaatgttgttgtgatcggtggcggtatggtcggcatggaaacagcagaatatctggcagaaaagggagcgaaagtaagcgttctcgaaatgcttccggatatctgttctgatatgggaacaacaagaaaaatatgtatgggtgaagaaatccagaaatccggcattatcccggttacatccataaaagtaactgaaatcggtgacaatgttgtgatcggcgaaaaagacggagaaaaagttgaattcccatgtgatacggcagtacttgcaatcggtgctaagaaacgtgacggaagtgctcttgcagagacatgttataaaaacggaatcggctactttgagatcggtgatgcagcaatggcaagacgtgcaattaatgcaaccagagaagcaatggatgcagcacttacatttgaccgtgaagatgtgcacagagatgtatcaaaaccgaaaaaacttgttttcataacaggtgcgagcggaatgatgggaggccagacactgaaacagttgctggcaagaccaaacagattcaaagtacgtgcgctgctcagaccatccgataagaatcgtgtatttgcaaagaaacatatgtgtcctgcacttgaagttgtatggggagacatgtcagattacgacacaatcaaaaaatgcgtagatggttgtgattatgtattacatattggcgcaatggtatctccggcagcggataaatatccggaagagacattgtatacaaatatcggatcaacattaaatatcataaaagcaattaaagagcagccagatccggataaagttcatttggcatatgtcggaacagttgctatgacaggaagcagactggaaccggtacattttggtagagttggagatccgatgaacccgtctattcacgattactatgcattgtcaaaagtatttactgaggcagcattgtatgattgcggattaaaatactgggtatccattcgccagactggtcagcatccaagtgcagagacggcagctcaggaaccaatcatgttccatcagccaccgaacaatgtattggagtggagcacacagattgagtctggtatctgtatggcaaacttatgtgaagactgggtagatgaaagcttttggagaaaagcatataacttaagtagtggaaaagaattccgtaagactacatgggaattcatgaatcttaatctgaatccgatgggttataattttgaagatatttatgaaccacagcagatggcaagatttaacttccatggacagtactatacagatgcagatgttttggaaaattatctccacttccgctgcatttccggaaaagagtattgggaaaaagttgaaaacacagcaagacgtcttttcaagaacccaatggttgcggcaatgcttccgaatattgagcagttaaaggaaaaaaataaagcgatagcttcaaaagaaatgggaccaagatgggcagaagaaaataataaaaccgaatggattcaggcattctacggatctttggaagaaaaacacaaattgatcggaacaaaattcgaacttcatcgtccaagcgaagaagaaacattccttgatcacggatatgatgaaagcaaagatcttgagaatctgacagctgaagatctgcagaaagcggcagaattcagaggaggcgagtatcttggcggagaaatcgaagatatctatactcctgtaaaatggaagtgtgcgttcggacacgaatttgatttatctgtaaatgcggctcttcagggaggacactggtgtccagaatgtatgaagaagagttgggcttatccaaagattgcaagaaagaacccattctatgcacaggtatgggatccacagcacagtaaagatgagacttacgaaattccaatgagattcagcgcatatgagattcgtgaagaattgaagaaaaaacttgatttataaacacaataataatcttttctgatgaaagggctgtcgtatgacagctcttttaatttacgcgggcaacgagccaaagtccgtgcttgcacgagaccttggcgactgccgcgataacttaagatagtggaaagctgatgatttctgttctgtctgcggtggcagagattgaacgagagaatatccttgttcagacaatggaaggacgtaagcagaaagccagggaaggaaaatggaacggaggattcgctccatatggttatgaattggtaaatggagaattacagattgcagaggacgaagcggagattattcgtttgatttatgacaaatttattcatacaaatatgggaatctctgcgattgctgcatggctgaaccagcatggatataaaaagaaaaaacgacagaataatacactggacgcatttgcctcttcctttataaaaggcgttctggataatccggtatactgtggaaagttggcttatggacgaagaaaaaacgagaaagtttctggtacaagaaatgaatatcgcattgtaaagcaggaaaattatatgctgcacgatggtatccatgaaggaatcatctccgaaacagactgggagcttgctcatcaaaaacgggaaaaaacaggtgtgaaatatgaaaagacacatagtctcgatcatgagcatattttatctggaatattgagatgcccgttatgtggaagcggtatgtatggaaacgtgaatcgaaagaaaaagaaagatggaaccttatataaggattatttctattatgcctgtaaacatcgtcgtctggtagacggtcataaatgtggatatcgtaaacaatggagcgaggagaagattaacaatgcagtggaagaagttattcggaagctggtgaagaatcctaaatttgaagaagcaattctgaataaaatcggttcaagaattgatacagaagaaatagaaaaagagattgaaggattggaaaagcagcacaggcagttgaccggagcaaaagcaagacttggacagcagatggatagtctggatatcatggataaattttatgaaaagaaatatcaggatatggagacacgattatatcgtctgtatgatgaaattgaaggcgtggagaacagtatagaagaagttaagaatcgcctgttgaatatccggcaacagaaaatatcagaagaaaacgtctatcagcggtagtaccatttctttcctttttttcttacagatccttttgccataatcgtatatctcctttcgatattagacaatcggaactgatgaaatgcttcgtgcgtgtaagtatatcataactccggttgtcttactataccgattcggaatcttcgtataagacttctgataaaagatttgcaagcctttgttctgctgtttttggtttcttggaatagagccttacaacgtccgccatctcattaagagcattgatggtaggagtgatttcccttaagaacataatctcattatattcctcattcgattcaaaccctattgttttggcaatatccgtctgacctgcatttcccttgaagtttttgcaggcgaactggaaggaatccaaaaacagaccatattgttttaacatcagcagtaataaatcttttgaaaaagcatcttcttctttggtaagggcaagcggtaactgttccagaatatctcccatcgcatcacgaatctgtaactctctcttatccgtaatgtcggtttcatattcatctgtttcccctttgagccattccacagatacatggagtgcttccgaaagaccttccagcaccatttttttcgtattgtcaatcgaaccattctcataacgcaggattgtagaagcagtaacacccatcttttctgcgacataaggctgtgtcagattcaattccagacggcgctgttttattctgctgcctatcagcttgcgtaattctttatctttcatgctgactgcctcctttttcggtatgtatgaattatagcattgtttttccaaaattgcaatatgcaatacaaagtttgtttttaatatttcgtaacgcttgacaaaaagatatgaaaaggatatacttacatcacaagaattgcataatgcaatttataaggaggtgattatatgacgcaaagaaaaattgcattatccatcgaagaagctgctgactatacgggaatcggcagaaataccttaagacagcttgtagaatggaagaaacttccagtattaaaggttggtcgcaaagtcctgattaaaaccgatattctggaaatgtttatggaagcgaatgaaggtcgtgatttgagggatagaggaaatgtaaaagccgtaacaagaactgcggcaaattaaaaaggcggcttccaaagaaaccgccaaaggttctatcagaccgaagccatgatatacctacacgcaagaagattataccatgtgcttcttctgatacgcaaccaagaacttatgtttgcaaaagaaaggggaatgtaataatggcaaaatcaacaaaaagttatgaagaacgaatgcttgaaatggaaaagaaggaacaggaaagccttgaaaaagcaaaacgatatgcagcacagaagaaagaacttctgaaacgaaagaaagccgaagaaagtaaaaaacgaacccataggctctgtcaggttggcggtgcggtggaatccgttcttggtgcgcctattgaggaggaagacatcccaaagctgattggttttctgaaaaagcaggaagccaatggaaaatttttctcaaaggcaatgcagaaagaaacaaataccgatatggaggaagtgtaatgacggaggggatgagtttttcattcccttcattgctttttcatgaagggcgcacttatggacaaccagaggtcgtccaaataagtttgccacaagtggcaaccggtctgcgctcacgcttgccgggctcgttccgtcggcggggctttcagccagacctgctcatgccgctcgccccatcgccaaaggcgatttaaaatggcgagatgcgttgctggtcgcacaacgtgtgaacagtaacaaatatacagttgacagtaattaaaaaaggagaaggcatatgtgtggatttgcaggatttgtcggagaagttgatgacagagaacaggtacttgttaatatgatgaatacaatcgtacacaggggaccggatagtgcgggaaagtatgtggatgaagatgcagcactcggatttcgccgtctgagtatcatagatctttcttccgttggtgatcagccgttgtacaatgaggatcgcagcatggttcttgtatttaatggagagatttataattaccaggacctgagagaagaactgaaagcggcaggtcatgagtttgtatcgaatacagattcagagacactgattcatggatacgaagagtggggcgagaaactggtagaccgtcttcgcggaatgtatgcttttgcaatctgggatacaaagaagaaaagattgtttgcagcgagagatattttcggaatcaaaccgctatattatgcaaatatgaatggtacattgatgtttgcttctgaaatcaaagcatttatggagcatccgaagtttgataaggtgttcaatgaagaggcgcttggcaactatctttctttccagtttgttcctacgaatgagacattttttaaaggagtgttctgtgtacagccaggacattactttatatatgaaaatggaaaaatgaacattacacgttattttgaacctcatttcacaggagactgtaagaagcctttcaaagaagtggtggatgatgtagaacgtgtgatgaaggattccgttgagaagcataaaatcagtgatgtagaggttgcttcttacctttccagtggtgtggactccagttatctgacttatctgggacaggtggatcgtacttttacagtcggatttgatgaaggaaagtacagtgagattcaggatgcaaaggaatttgcagcaagcattaacatgaagaatgacgctaaggtgatttcaccggaagaatattgggataagctttcggatattcagtattatatggatgagccggtcgcagatccagctgcaatcgcactttatttcctcagtgcagaagcgtccaagaaggttaaggtagttctttcaggagaaggttctgatgaattgtttggaggatataacatatattgtgaacctttggaacatacttcttttaataaaataccgatgccggtacgccgtttcctgggtgcgtttgcagaacgctgtctgccacgtggtatgaaggggagaggtttccttatgcgtcacggaaagacattggaagagagatatttcgcaaatgcgacgaatatttttacagagcgtgaggcaaatcgtattttgaaaaaaggatgtaagccgggaatccaaaaagtaacaaaaccattgtatgcacgtgtaaaaggaaaagatcctgtgacaaagatgcagtatgtggatcttcatctgtggttagtgcatgatattctgatgaagggtgacaagatgggaatggcgaattctcttgaagtcagagttccgttccttgacagagaagtacttgaacttgccgagacacttccgttaaaatacaaagtacgtgcgccaaagacgaaggttgcattgcgtgctgcggcagagcgacatatcagaagtaagacagcggagaagaagaaactgggattcccaattccgattcgtgtatggttgaaggaagagaagtattataatattgtaaaagagatgtttgagtctgatgcagcgaagaagttctttgatacgaagctcttgcttaagatgcttgatgatcataagaacggaaagaatacgaatgagaagacggataacagccgtaagatctggacagtttatatcttcctcgtatggtatgacagattctttgagcatggaaaaccggttcatccggcgatgagtgttcaataataaaaaatgtatctgctgtttattaattgggaatgttaaaaaatagaatggatacagattttagatgggagtatgtatgagaaactatgagagtgatgcttataggaagtatcgaagctcaatggagcagagacagaaggttgtgagaacgtcaggttctccatattctcagcagactgcggtacagagggaacggcaaatagcggaaaggtctgcgagtacaaaacgtaaaaggacaagagaaaagggaaaaccttattatgattatgatctgcttcttgtaattatttttctgatgtgctttggacttgtaatgctttatagcagtagtgcctacagtgcacagaatgattataataatgatatgcttttctttacaaggcaggcgattatcggtattatcggatttcttgcaatgtttatcgtttctaagattgactatcatctgtatggtgcgtatgcaaaagaatttttttggttttcactgtttttgatggcattggtgcagacaccacttggtaagactgtaaatggagcaagaaggtggatcaggcttcctggtggcttgtcattgcagccggcagagtttacgaagattgcggtgattctatttatggcatatgaaatctgcctcttggggcaaaaggcgaaaaaatgggatgggattaagattctgcttggttatggtcttgttgcaacactgggagtttttctattgacggataatctgagtacagcaattattgtgtttgcaattacatgtattttaatttttgttgtacatccgaagacaaaaccatttgttgctggagtaattgcagcaggaatcgtgggaatcattggaattatttttttgaaatatacacttgcagaaagtgataactttcgtatgcgccgaatcattgcatggctgaatccagaggcgaatgctgataaagacagctatcagtttttacagggattgtatgcgatcggttcgggaggcttctttggaaaaggacttggaaacagtacacagaagctgcatgcgattccggaggcacagaatgatatgattcttgcggttatctgtgaagaacttggagtgtttggtgcaattctcgttttgtgtctgtttgcctttatgctttatagattattgttcatagcgagaaatgcaccggatctttacggctctttgattgcaacaggaattttcgcgcatatcgcgctgcaggttactttaaatattgcggttgtaaccggattgatgcctactactggggttacgcttccgtttatcagttatggcggtacggcaattgtgatcttgttggctgagatgggaattgcgcttggaatatcatctaagatacggttgaaataaattctccctcttttcaacttgactgaagtgtgttatattaatatgtagtattaaaaaccacgtaaagcaggatggaaaaatatgcgatagagcatgggaggatataagttatgagttacagagtgatcgtagatagttgcggagagctgaccctacagatgaaggagagtggaatttttaagacggcttctcttagcatggaagtggatggctttcacattctggatgacgagacatttgatcaggctgattttttaagaagagtggctgcaagcgaggaatgtccgaagtcatcctgtccatcccctgagcgttatatggaattatacaaatgtgatgttgacagagtctatgcagttactttgtcaggggaattgagcggatcttataacagtgcacttcttggagagaaactttataaggaagaaggcggagaagaaaagatccatgtatttaactctcgttcagcatctgtcggagagacgttgatcggacgaaagattcaggaatgtgaagaagccggaatggattttgaacaggtagttgaaacggtagaagcttatattgaagaacagcatacgtattttgttcttgagaatcttgatacacttcgtaagaatggacgactgacaggactgaaatctctggtagtcagcgcattgaatatcaagcctgttatgggttctaccccagagggaacaatctgtcagttggataagagcagaggaatgaagaaagctttggcaaagatggcagagcatgtcgcgaaggacgctgtaaaaccggaggagaagattcttgcaattgcacattgtaactgtccggaacgtgcagaggtcgttagaaaattgattttggagaaagtaaaggtgaaagattcctttattgtagatacagcaggaattagtagtatgtatgcgaatgatggtggaattattgttgtactttaagatgtgctgtggtaaaataattgctaaagacctaataggaagggagcaggcaagagatgagtcaggcgaaggtggatcgttataagaaggaaaaggcggaccgaaagaagacaatgcgtaaagagaagatcatgcgcaatgtaaaaagatgtgtagcgggagtaattgtacttgcaattgttggctggttcggatattcagcatatgatctgcattcttccaatcaggaacgtgcagttgcagaagtgaattatgactctgttaaggattatctaagtacactttcagcagaataaaatgaatagcatttgataacgtgagatatggcatgtgccatatctctattttattcaagtatttgcaactatttctattgacaaagcaaaaaacaaccattagaatgatacagataattattcggattaaaattagggagatacctatgatgaaaaaaagaaatattaaccttgatattattcgaagtattgcagtgttttctgtattatctgtgcatttttttttgaataatggattttatacggaaataataaaaggaaagcggatgtttgtcatgtttacaatgcggacagcgtttatgatatgtgttcctctttttgcaatattaacaggatatcttatgaataaaaaaatcttgtcaaaaacctactacttaggattagtgaaaacatatataacatatttgctggcgagcgtttttgacattctatttttaagttgttatacatcagaacatattggaatacggacttttattttaagaattcttaatttttctggtgctggatattcatggtatgttgaaatgtatattgggttgtttttaatcattccgtttttaaatttgatttataatggattaaaagataaaaaacaaaagcagcttcttgtagctacaatgcttttcttgactaccattccctccttacttaatatatggggaatcgatggtccgattaaagcaatattctttccaactgaatcaacaagaattctgcagataattccagattattggcagtttttatggccacttacatattattacatcggatgctatcttaaagaatatggagcaaaactttcttctggaaaatcactcttattgtttatgggttttctgacaatatttggcttttttaattttggacgtaattataataatgtctttttcggagcttcatattatgaatggtatggatttgagccgctgattctatcggtacttacgtttatttgtattttgaatcttgatacttctaaaataacagaacgaactatactttataaatgttttaccaaaatttcagagttgtcattaggaatatatttagtgtcttcggtttttgatacgattatctatagtaaacttaatgcatatgttccttctgttccgggaagactagaatattatgtactggttgtacctattgtttttcttctttcatttattacatcatatatcttacatgttatacaaagcacattgactagatatgttcaaaaaagatatagatatatttctaatcattaaaataattattgctgttttagacagtgtatcaatgatcgttaacttttaattataagaaggttagcgatcattttttatgacgttatttcggtagatagacctgaatgaagtttggaaagaaacaaaaaaagttaaaaaagggcttgaaaaagggagacacgtggtttacaatggagctaagtggtgagaagtggtagaatgtggtgcaatatggagagggagtggaaacaaaggggttacggtagtgatacctttagtggacatgaagatttccatagattccagagaaagggtttcgaatgttattaggagagtttaaccataacatagacgaaaaaggcagactgatcatcccggcaaagttaagggaagatcttggtgacagcttcgtgatctgtaacggattagagggctgtctatttgtctattcccaggaagaatggaataaattcgtagccgaactcgaaagcttaccacgaatgaacaaggatgccagaatctttaaacgctacttttttggaagtgcatctgagggcagtttcgacaagcaggggagagttcttgtcccaccgtcacttagaaagaatgcacatctggagaaggaagtagttctggtcggagtccaggatcgtgttgagatctgggacaaggcactctgggaagagaaaaaccagatcagcgaggaagatctggatgcgattgcagaacgtatggaagcgatcggaattcgcatctgatgacaacaaagaccgccaagtgaggcagtcagaaggaggagtctatggcattcgagcacgtttcagtgctgttgcatgagacagtagacggtttgaacgtaaaaccggatggcatctatgtagatgccacgttgggtggaggcggacatgcatatgaagtctgtacaaagcttggcgagcaggggagattaataggtatagaccaggacgctgatgcgattaaagcagcaggaaaacgcctggaaggtttcggggagaaggtcacaataatccggagcaattattgtgatatgaaaccgcggcttcatgagataggaattgacaaagtagatggaattacagtagatcttggagtttcttcttatcagttggatacagctgagaggggattttcatatcgggttgacgcacctcttgatatgcgtatggatcagcgtcagaagatgacagccagagacattgtcaacgactatagtgaatcggaactttatcgtgtgattcgtgattatggcgaggacagatttgctaaaaatatcgcgaagcatattgttgcagaacgcacaaaaggtccgattgagacaacaggacaattgaatgagattattagtcatgcaataccaatgaagattcagaagacgtcaggacatccgtcaaagcgtacatttcaggctcttcgaattgaattgaatcatgagcttgatgttttgcgggatacattagatgatatgatcgatctgttgaatccaggaggaagactttgcattattacatttcattcgcttgaagacagaattgtgaagagttctttccgtaagaatgagaatccgtgcatttgtccaagtcattttccggtttgtgtatgtggaaatgtatccaaagggaaagtgatcaccaggaagccaatccttccgtcagaagaggagctgacggtaaacagcagatcaaagagtgcaaagcttagaatctttgaacgtgcataatttgatatcacagggagtatttagagtataaacgaaacgttcctccgggaaggggagagcccggcggaacaagaatccagagaaaggacaggaaagcgatggcgagaaacacaggtcgcagacagcagaatagaccagcagcagactggaaccacttctatgtgtacggtagtgccgtgcgtcagccagaagctttaccgtctggaaatgggacagttcgtaagccgaagaaaaaaagaacaagccgtcaggtgattaaaaaccggcatcgtgcgcagcggatcagtcaggcatatgcgacttttctaattgtggcggcagtctgtgcggtttttatatgtgttatgtatttacgcttacaggcagatgttttgaatcgtgcagatcagatcacagcgctgcagcaggaactgacggatctgaaggaatcaaatgatactgcacatcaggcagcggaagattctgttaatcttgagagtgttcgtgaaaaggcaatgaacgagatgggaatggtttatgagtctcagggcaaagtgattcattatcaaagcccgacaagtgactatgtaaaacagtatgataacatcccggaagatggcgttttagcgcaatccaaggatgtgaaaaataaggaataatggaagatggcaggaagaaaaagaaggaagaacagatttcaatttctgactaaaaaattcccggtaagaatgcagagaaagctggtactgctgtttatagcagttatactggcttttcttgttcttgtaggaagaattacatacattaatgttacaaagggaagcaagtatacaaagcttgtactgaatcagaaaatttatgacagtaagacaattccatataaacgtggagatattctggatagaaacggtacaaagatagcgacaagtgaaagggtttataatgtgattcttgatgttgttgtaatgacagataaagaagaatatatagatcctacgattaaagtattgaataaatgtttcggaatcagtgaaaagacagtacgagagattgtagaagaaaaacctaatagcagatatgttatattgaaaaaaggaatcgattacgagacggctcagaaatataatgagataaagaatgatactgagaattatccaaatgtaaagggaatctggctggaggatgattataacagaacatacccatataatacgctggcaagcgatgtgataggctttacttattccggaaatataggagcaattggaattgagagtgcttacaatgatgttatgacggggacagatggaagagagtatggttatctggatgaagatgatacagtcgaacagaatgtaaaagcagcaaagaatgggaataatgttgttacgacaatagatattaccttacagagtattgtggaaaaatacattcaacagttcaatgaagaacatgccggagaagaaggaagtggagtgaccggtagcaagaatacagcggttatgatcatgaatccgaataccggagaaattctggctgaggcctcttaccctaattttgatttgaacaaaccaagagatctgtccagtatttattccgaagaaaaatggaatgcgatagatgagaaggatcaattgaacatattgagtagcatctggagaaatttctgtgtcagtgatgcatttgaaccggggtctacgatgaaaccattcactgttgcagccggattggagacaggaactcttaccggagatgaatcttattattgtggtggttatcttcatgtgggggataatgatatcggatgtcatcttcgttccggacatggaacagaaagcacaatggatgcgattgctaattcctgtaacgttgcattgatggaaatggcggaaaaaatcggaattgataattttatcagataccagcatatttttggctttggagaatatacgggaattgaccttccggcagaagcatcaacagcaagtcttctgtatacaactgatacgatgacaccggttgatcttgcaacgaatgctttcggacaaaactttaatgtgacaatgactcagctggcagcagggttcagttctctgatcaacggtggttattattatgaaccgcatgttgtaaagcagattcaggatgagaatggaaatgtgattgaaacgaagaatcccgtattgctccgtaagacggtttcgacagaaacatctgaattagtaaaaacatatttacaggcggtaatgcagtatggtacaggtaagagagcccaggtggaaggatatgatatcggagcgaagactggtacggcgcagaaacttccacgtaaagatgggaaatatctgctttcttatatcggatatgctccacaggagaatccggaagttgttatctatgtggtaattgatgaagcaaatgtagatgcacaggataatagttcgttggttcttgaacttgcgaagaatatcatgtcagaagcatttccgtatcttggtatcacaaccatagaagaggcaggggaaagtcagacacagcagagcggtcagagctttgaagatacagagtattctgattatgatcaggactatacagatgattacagtaatgaagacggctcatatgttgatgaaaattataagccggatttggacagctgggcaacatcatccaatatagattaagtgttatagcagacaggcaaacaggaataactccgaaaaagacataatacattgtagaaatgtctttttcggagttgttttttgtgaaaaataaaacatataaccgaaaaaaaacaatggttgtttttttctgcgcagttcttttgatttcggctcttttcggaagacttgtttatctgatgatttttgatgctgcacattatcagaagctggcgaaagatcttcatgagcgagaaagaaaaatcaaagcggcaagaggagagattgttgacagaaatggagttgtcctggcaacgaacaggacggtatgcacaatttccgtgattcataatcagatgaaagatccggagcaagtgattgcagctctctgtcaggaacttggagaagaggaagaaaacatccgtaaaaaagtagaaaaagtgtcttcgatggaaaaaattaaaacaaatgtggaaaaagaaacgggggatagaatccgtaatctggatcttgcaggagtaaaagtagatgaggattttaaaagatattatccttatgatacacttgcatccagagttcttggatttacaggtggggacaaccagggaatcatcggacttgaagtgaaatatgaagaggtattaaaaggaaccaatggaaccattcttacagtgacggatgcgagaggagtcgaacttgagaaagtagcagaagacaggattgaacctgtggccgggaacacgcttcagatcagtctggatcataatattcagaagtactgtgaacaggcagcaaaaaaggttcaggaggaaaaacaggcggatagtgtatctgtattgcttatgaatccgcaggacggagagatatttgcaatggtaaatacaccggaatttaatctgaataccccttttgaattgattggtgtggatgaaaatacagaacagacggatgaacagactcaggagatgttaaatcagatgtggcgaaatccctgtattaatgatacatatgagccgggatcaacgtttaaaatcattacagcatcagcatgtcttgaagaaggtgtcgtttctttgtcggatacattttcctgtccgggataccggattgtagaagacagaaaaatccggtgtcataaggttggtggacatggacaggaaacgtttatccaggggatacagaattcctgtaatccggtatttattgatattggtcttcggcttggagcagagaaattttatgcttattttaaacagtttggattacttagtctgacgaatatcgatcttccgggtgaagcgggaacaattatgcataacgtagaagatattggtcttgtggaattggcaacgatttcatttggacagtcgttccaggtaacaccggttcaaatggcaacaacagtaagttcgctggttaatgggggataccgggtgacaccgcattttggagtggcagttcttgaaaaagacggaacagagatacgaaagctgaaatacaaaaagaagaatgggattgtatctgaaaaaacatcggagacgatgagaatacttctgaagagtgtggtagaagaaggatctggtaaaaatggatacattgaaggatattcgatcggaggcaagactgcgacatcacagactcttccaagaagcgcaaacaagtatatttcatcatttatagggtttgcaccggcggaagatccgcaggttcttggaattgtagtgatccgtaacccacaggggatttattacggaggaacgattgcagctccggttttgcgcagcatctatgacaatgtacttccgtatctcgggattgaaaaaaactgaccaatggagtatactgtaaagtgcattttgagaatctgatgttcgaggattgcgggaattgcatagcaatggagcaatccggttacatcagtgagtggcaaaatttatttttgacactcacatcatctgatgacagaaaagtacataagaaggattctctgtgtaaaacaaaagaaatgaagaggtgtatatatgaacagtcatgtagtgattccggtattgattgcatttgttataagccttgtgcttggaccggtggtcattcctttcctgagaaggttaaagatgggccagacggagcgtgtggagggtgtacagtctcatttgaagaaggcaggaacaccgacaatgggaggtattatcattctggcagctgttgtgattacgtccctgttttatgtgaaggactatccaaagatcatcccggtacttttccttacagtaggatttggactgatcggatttctggatgattatcttaaagttgtcatgaaacgttcagacggactttttccaatgcagaagatggcactccagattgtagtaacagcaatttttgcgttttacatcgtaaaagtagcgaagattccgcttacaatgatcgttccattctccggcggttatgaattgaatcttggatggtttgcgattccggttcttttctttgcagtaatcggtacagttaatggaacaaactttacggacggactggatggtcttgcatcaagcgtaacagttctggtggcaacatttttcacagttgtagcaattggaacgaaaagtgggattgagccgatcacttgcgcagttgtcggtgcattgatgggattccttctttttaatgtgtatccggccagtgtgttcatgggagatacaggttctcttgcactgggtggttttgttgcaggaacagcgtatatgatgcagatgccgctgtatatcattattgtcggatttatttatcttgtagaagttatttcagttattctgcaggtaacatatttcaaaaagacaggaggaaagcgtctctttaagatggcaccgatccatcatcatttcgagctttgcggatggtcagagacacgggtagtggcagtattttctattgtgacggcaattctttgcctgatcgctcttatgggggtatagaacaatggttgtaaaagataaaaatgtattagtgtttggctctggaatcagtggagaggcagcatgtgcgctccttttgaaagaagaagcaaaggtcatattgtatgatggtaacgataaattgaattcggaagagatacgtgcaaagattgaaggcggggacagtgagtcactggaaatcgtccttggaacacttgagggagacaggaaagaagaacttcttgataaactttctcttgttgtaatgagtccgggtgttccgacagatcttccaatcgtgaatgagatgcgtgagaaaggacttccaatctggggcgagattgagcttgcgtatgtctttggaaaaggtgatgttctagcaattactggaacaaacggaaagacaacgaccacttctctgcttggagaaattatgaaaaactatgcgcagagcagctttgtggtaggaaatatcggtaatccatatacgagtattgcactccagacaagagaggattctgtaattgttgctgagatgagcagctttcagctagaaacaattcagacattccgtccgagagtcagcgcgatcctgaatattactccggatcatctgaatcgccatcatacgatggaagcatacatagaggcaaaggaaaatattgcgaagaatcagacagagaaagatacttgtgttctgaattacgaagatgatgtaacaagggtatttggagaaaatgtaaagtcaaaggttctatatttcagcagtcagcgtatattagaagaaggaatctatctggaaaacggtcagatcgttcttgcaatgaacggagagaagacaccggtatgccatgtagatgaattgaatattcttggaacgcacaatcatgagaatgcgatggcagcagccggaatggcagcagcatatggggttccggtagatgtgatccgcagaacgctgaaagagttccagggagtcgaacatcgtattgaatatgtggcagaaaagaatggagttgtatattacaatgattccaagggaacaaaccccgatgcagcaattaaggggattcaggcaatgaatcgtccgacagttttgatcggtggaggttatgataaggattctgcttatgatgaatggatcgattcctttgatggaaaagtaaaaaaattagtacttcttggtgcgacacgtgacaagatcgcagagacagccagagcacatggatttgaagatattgagatggcggatacatttgaggaagcatttgcaaaatgtgtagagaatgcaaaaccgggagatgcagtactcctttctcctgcatgtgcaagttggggaatgtttaagaattatgaagaacgtggagataagtttaaagagcttgtaaataatctgtaaagggtgaactgtattgaagcgtcctgcaaagaagcacacgtatgatgatacactgcttgtgacggtgctgattctcgtactggttggtctgatccttctgaccagtacaagtgcatataacggcagggtgaagtttcatgattcttattattatctgaaaaagcagggactggctacagttcttggaatggcaggaatgctatggatcgcgagaattgattatcacagatggattccacttgctgtgccaggatatctggctgcaatcggtttatccattgctgtcatggcattcggaaaagaatataacggatccaaaagatggttgtctttgggtccgttttcttttcagccttcagaatttgctaaagtagcagtgatcttgtttctggcctggctgatcaaccgaaatgtgaaaaaaatatcaaaacttcggataatgtccggaatgatgctttcaatccttccggttgtcggtctggtaggagcaagtaatctgagtacagcaatcattatcctcggaatcgcagttacattgatttttgttgcaagtccaagatatgcacagtttatatggatggccgtatcaggagttggatttatgggaatttttctcgccttggaaagctatcggctggagcgacttgcaatctggcgaaatccggagaagtatgaaaaaggatatcagacattgcaaggactttatgcaattggaagtggaggactgtttggccgggggctgggaaacagtgtacaaaaactgggattcctgccggaagcacagaatgatatgattttttctattgtctgtgaagaattagggcttgttggtgcggggactatcattgtactgtttctgattttaatctggagattttttgtgattgcaacacacgcaccggatctttttggtgcgttgattgcagtgggagccatggcacatatgatgattcaggtaatattgaatattgctgtcgtcacaaattctataccgaatacaggaattacacttccgtttatcagttatggtggaacgtcagttgtttttctgcttttggaaatggggcttgtccttagcatatcacgtttggtacaatagagttgcctgtatttcatacagatggagtccgggtatggaaaacatgaacagaggaaggaatctgatcaatgaaaaaaaagaagaaaaagaagagagggatgttccgctttattgtagtattactgttgattgtagtatttgttctactctttcagacacgcagtataaaggtgaagggaaatgaatattacggagagaattcaatcatcagctggctcgagaaagataaactctccatgaatacggtgtatttattctggaaatataattatacagatgcagaagttccgtcagttgtggaagaaatgaaattgacatttgaaaatccatggacgcttgttgcgcatgtgaaagagaaaggaaaatccggttatgtttctttcaatgatacaaatttatattttgaccggaaggggacagcactttttgaaagcaagaaaacttttacaggagtaccttatgtggaaggactttctttcgatgcatcgaaagtagagatcggaaaaaagattccggtggaagatgacagtgcattcactttgatcgcagaggcttcaaagtatctggtgaaatattcacttacaccggataaactggtatatgctaatgaacagagtgtggtattatattttggatcagtagaagttttaattgggaataaagaatatgagatcagaattgcacagatcaaaccgattcttgagaagctgaaggaacagtatccggatcaggcgggggtacttcatcttgagaattatgaagcagattcagcatcaattaactttacaccgcagtcttgaagctgaattgttggaaaaaaaccaaaaataagaaaaaatctattgattatttacggaaaagactttattatatacttattgaattgtatcgttcaattaaaataagggatgtatataagaattaataagacgacaaaggaggaactactcttgttagaaattaaaaccaacgaatctgaagcggctgcaagaattattgttgtcggagtcggcggaggcggtaacaatgccgtgaaccgaatgatcgacgaacagattgcaggcgtagaattcatagctgtgaatacagataaacaggcattacagctgtgtaaagcaccgacacttatgcagatcggtgaaaaactgacaaaaggacttggtgctggtgcacagcctgagatgggagagaaggcagcagaagaaagcgctgaggagatccaggctgcattaaaaggtgcagatatggtatttgttacctgcggtatgggaggcggaactggaacaggtgctgctccggttatcgcaagaattgcgaaagagcagggcgctctgacagtaggagttgtcacaaagcctttccgtttcgaatccaagacaagaatgcagaatgcaatcaatggtattgataaattaaaggagaacgttgatacaatcatcgttatcccgaatgacaaactgcttgaagttgtagacagacgtactactatgccggaagctttgaaaaaggctgacgaggttcttcagcagggtattcagggtatcacagacctgatcaatgtaccatctctgatcaaccttgactttgctgatatccagacagttatgaaggataaaggtattgcacatatcggtatcggtgcaggacgcggagatgacaaggcactcgaagcagttaagcaggctgttgccagtccactgcttgagacaacaatcacaggtgcatctaatgttattgttaatgtatctggagacattacacttatggatgcttctgatgcagctgattatgtacaggagcttgcaggagaaagtgcaagtatcatcttcggtgctatgtatgatgatacaaagtctgatgaatgtacaatcacagttattgctacaggcttacataatgtaggcggaagtgcatccaagctgaaagcaagactggaaggacagcagaagacaagttctattcttccgaatggtgtagaaagtcatgcaagaccatcttatgactatacagcacaaagaacagctcagacatcaacagtaagaccgcagggtggaacaatgccaacactgcagccaagatcaacaactggtggagtaagagagcagtctattaagattccggatttctttaagaaataattgaattgaaaaatgatgaaacggtctgaggtatcaggccgtttttcttttatgtcgaaggatgtcagaaattcttctattttctttctgttttactgtcagtatctgacaaaatttccaaagagcaaattttataattctatatgatatcgaggatgactcgaaatgaaaaggaaggtggaagatgcactatgagttgtacatagatcttttttttctggaaaatttcatgatggatagcctgttacttttcgtgacagaacggattacgggtggaaaatatagttttaaaggagttttatccggagcattccttggaagtgtgttgacatgtctgatggtggttgtatctgttcccgcctggatgaaaaacatagccttttatctggtgattccattttgtatgctttggttaaaaaataggaaacaatgtatgctccagatactcaaaggaatgggattgctttacctttttggaatgttcctggggggcacgttgatgatgtttcgtccttatctgcattatatcagtctgttttatgggattgcggtgcttagctcacaggggattctgatggcctggaagttcttgaaagttcttaagatagagcaggaacggtgctgtgaagtgattttatttacagaagcagatagttataaggttcatgcattgagggatacgggaaactgcctgacagatccactcagtggtgaaggggtgcatgtactggattgtaatttttatcatcaggtaatgaaagaagcaatggaattcaggtatattccatatcggagtgttcatggtagtggcattatgaaaattttccggatcaggaaaatgtgtgtggaaataaatgaaaaagaatggatagaatctccgttgatcggtgtgagcgaatcaccgatcagtgggaaggaagattatcaattgatattgaactgtaaggtgcagatgctgtgaatgaaaaactgtgctgcaacagaagatgtaagaaagaaaccaggaggaatttatatgatggttaaagtggctgtgccggagaaatttaaattaaggattgtaccaaatgtcaggacggttttatttggtggccaacaggagattcattacataggaggcagtgaggttcttcctccaccattggaaaatgaaaaagaacgtgaggtggtaaggtggcttggaacagatcgagatgaaaaggcgagaaagatactgattgaacataatttgcgtctggttgtttatatagcaaagaagtttgataatacaggagtaggtgtagaagatttgatttctattggtaccatcggtctgatcaaagcaatcaatacatttaatccatcaaagaaaattaaactggcaacatatgcttcacgttgtattgagaatgagattttgatgtatttgagacgaaacagtaagacgaagatggaagtttccattgacgaacctttaaatgtagattgggatggaaatgaactgcttctatctgatattcttgggacagaagaggatacaatttatcgggatctggaggatgaggcagaaagaaagattctgtttcgtgccttgaataaactgtcaggaagagagaaattaatcgttcgtatgaggtttggactggatcatccggagggaaaagaaatgacgcagaaggaggttgcggatcaacttggaatctctcagtcttatatatcaagactggaaaagaaaattatgcacagacttcggatggaaatggtccggtatgaataacagttacaaaaatttaataaaaagaaagatgtacaatttcccgtatggtgttaaaataaaagaaaaagtatctgaagcttaaaaagaaaagatacaggacagaaagggttgaggatgtatgaaattaacatttgtaggtgcagcccatgaggttacgggaagctgtcattttctgcaagtagcaggaaagaatgttttggttgactgcggtatggaacagggaccggatctgtatgagaatccgggacttccgatcagtgcaacagaagtggattatgtattcctcacacatgcacatattgatcattccggaatgttgccaaagcttgcaaaggatgggtttaaagggcagattttcactacctatgctacagcggatttgtgtgatatcatgcttcgtgacagtgcgcatattcaggaatttgaggcagagtggagaaatcgaaaaggcaggagagcaggaaagccggagtatgaaccggtttatgagatgcaggatgcacttaatgcgattgaattgcttgtgccttgtcagtatggggagcgcattacaatctgtgaggggatccagatccggtttacagatgtaggacatctgcttggatcagcaagtattgaagtctgggcaacagaagacggagtgacaaagaagattgtattttccggagatattggaaatctggatcagccgattattaaagacccggcttatacagagagtgcggactatattgtgatggagtctacgtatggcaaccggctgcatacgcaggaaaaaccggattatctgggagattttacaagaatcctgaaagagacatttgataaagggggaaatgttgttattccttcctttgctgtgggcagaactcaggaactcctctattttatacgtgagatcaaagaaaaagaattattaaaagaatatcagaatttcgaagtatatctggacagtccgcttgcaattgaggcaacgaagatatttacaaaaaatatgagagagtgttttgatgaggatgcacttgcacttgttaatgcagggattaatccacttatatttgatggacttaagactgcaacaacaagtgatgattctaagatgatcaattttatcgagaaaccaaaggtgatcatctcagcttccggaatgtgcgatgctggtcgtatccgtcaccatctgaagcataatttgtggagagaagagtgtacgattctttttgttgggtatcaggcaatgggcactttaggacgcagactgattgagggcgaaaagaatgtgaagctgttcggtgagccgattgaagttaaggcaagaattgagagtcttcatggaattagtggtcatgcggatatgaatggactcttaaaatggctgggagcatttaaagaggctccacaacgcgtctttgttgtgcatggtgaagatactgtaacagaagagtttgcaaagacggtggaagaaaagtttggatatcaggcttatgcaccgtttccgtgtagtgaagcagacctcttgacaaatgagatcttaagtgaaggtgtaaagattccggtgaaggcgaaaaaaccggcacagcgtaaagcggatgcggcgtttgaacgtcttgttgcagcaggaaggcgtttacttgatgttatttacaagaacgaaggtctcgcgaataaagacaaagcaaaattcgagtcgcagattaataatttgtcggataaatgggatatttgattgtcaaggactaaaactttataaaattcagcacttcatggaatatcttattcaaagagtgagaatgattctaagtagaaaaaaacttaggaggtttcttacaatggttgtgaataaggtagaactgtgtggagtgaatacatcaaagctcccacttctcagggaaaaggagaaggaggagctttttcgcaggattcgtcagggggacaagttggcgcgggaagaatacatcaaaggaaatcttcggctggtgcttagtgtgatgaaacggtttgacagcagtaatgaaaatgcagatgatctgtttcagattggatgtgtggggcttgtaaaggccgtagataactttgatccagatcgccaggtgaagttttctacttatgcggttcctatgatcataggagaaatccgccggtatctgcgagataacagttcccttcgcgtgagccgctcattgcgtgatatagcttataaagtaatttatacaagagaaggttatattcgaaaaaatatgaaagaacccagcattcaggaaatcgcagaagagattggactttcaaaagaagaagtagtttatgcactggatgcagtacagacaccaatgagtcttcaggaaccggtgtataatgatggtggcgatgcactgtatgtgatggatcaggtcagtgataagaagaacagagaagaaaactgggtggaagagttgtccttagaagctgcgatggaacggctgaatgaaagagagagacggctgatccgtttacgattttttgaaggaaagacgcagatggaagtttcggaacagattggaatttcgcaggcacaggtgagccgtttagagaaaaatgctttaaaaacaatgagacaatatcttcttggaaaatagagagaaagtattgaaatttttatgacttcatactatgataaatgggaagaaaatgttacagaaagtaacagaaaagagcagatatggttatggtgtaatgtaaccaatgataaagtatggaggcagctatgataaaggcttgtatttttgatctggatggaacgttgacaaacacattagattcactggaatattcagtcaatgagacgatgaaagaaatcggaatgccacagatcacaaaggaacagtgccggcagttcgttggagatggggcgaaggttctgcttgaacggacattaaagacaggcggggatacacaactgtgtcatcttgaagaggcggtggaagcgtatgccaggatatttgatgcaaattgtatgtataaggttgctccgtacgaaggaattccacagatgttgcagcagttgaaagagagtggtatcaaacttgcagttttatcaaataagccagacagacaggccgtacatgtggttgaagaagtatttggaaaagaactttttgaccatatacaggggcagaaggatggagttcctaagaaaccggatccgacggccgcgttgacgattgccagttcatttggggttttgccggaagaagcagcatacatcggagattcagaagtggatcttgcaacagggcacgcggcaaggatgcagacaattcttgtgtcctggggattccgtggaagagaagctcttttagaggacggagctgaatgtattgttgattcagcggaagagatacgaaagattgttaagaaacaggaggagaagtaatgggagagtacaatgaagagtgtctgaagacttttttggagaagcaggagcagctttttgatgagccagtagcagagacccttgaggcagcagaagcttttctggaggactgtatggcagttgttgtagaatctctggctgaagtaagagaatactttgaagagaatggcatggatgtggacgggatgtcagaggaagaattggaagaggcttctgaagtgtttgcactgccggatggtacttatctgatcgtagaaggataagcagaattaaaatagtagtgattgtgaaaaagcaattgaaaagccacagaaaggatggactgtggcttttttgctgtataaacccggcaagcagcatttttgagtgcttatgaagaaatgttagtttcagcaatgcagcattgcggatcggattttgctgactgctcttttggatggaacataagaatcagaagaaggatcagaagaatgccgagagcagcaaaaataatagtatagatgatctctttcatatgaaggacaatgattttagtttttgatttcatgagtatccccctttttatacaatttatgaatttacagagcaattatgcatgacaaatattcacacatgcggtaaaataaagattactgtttgcaagaggaaaacctatgaaaataagtcattgttgcttacagtgggaagatgagaatggaaaatgtatttgggaaaggaagaagaagatgtatattatagcaggattaggcaatccgacgaaagaatacgaaggaacaagacacaatgtcggatttgatgttatagatcgactttctgagagatataatatagatgtaactatggagaagcatcgtgctttgatcggaaagggtatgattgcaggacagaaggtgattttggtaaaaccgcagacttatatgaatcttagtggcgagagcatccgaagtgtgattgactattataaagtggatcctgagaaggaactgatcgtgatttatgatgatatcagtcttggggtaggacaattaagaattcgtgcaaaaggcagtgcaggtgggcataatggaataaaaaatattattgcacatcttggcggacaggtttttcctagaataaaagtaggagttggagaaaaaccaccgaagtatgatcttgcagattatgttttaggacatttttctaaggtggaacaggaactgatgagcgaaggttatgataatgcggtaaaagcggtggaactgatcgtgagtgaccagatgagcgaagcgatgaacgaatataatcgtaaaaagaaggacgagtagagatgcaggcttttttagaaccattaaaagaactggctgattatcaggagattgtcagttcgagaagaaagaaaacgggtttcctgcaaatcgcaggatgtgtgaattcacagaagatacatcttgcgaaagcactgagcgatggctttgagtacagagtcatcgttttttccagtgaagaaaaagcaaaacaggcttatgaagaatggcgtgtactggaggaaaatgtatggttttatccggcaagagatcttttgttttatcatgcagatattaagggcgcatttttgacagggaaacgtatggaagtattgcgtgcgattgtagagaagaaaggacgggaagcaattactgtagttacaacaatggacgcatttctggatgggcttccatcgaaagaagaactgtacgggaacaggattaagattcatgcagaagaggcgctggattttcagaaattacaggaaaacctttcgatattaggatatgaaagggaaaaccaggttgaaagtccgggacaatttgcagtcagaggtgggattctggatgtatttccactgacagaggagaatccggttcgaattgaattatggggagatgaagttgattctattagaagttttgatgtggaaagtcagaggtcgacagagaatttacaggaaatagaaatctatccggcaactgagaactggaagcagatggaaacggaaagctttttggcatattttccggtaaaggagacaatcttgtttttggatgaaccggtacgtcttcaagaatctgcagaaatcgtagaaaaagagtactttcacagcttggagagcagagaagaagcaggtatcgaggcagatgagattccgattcaggtagaacagacagatcatacgattggaaagatgaacaagtattatggaattgcatttaccatgttggaatcaaaatgtggaatgtttaaagtaaggtctgtctacagtctgcaggttaaaactgtcaatccgtataatagcagctttgagctcctgacacgagatctgaagaaactgaaaagaacagggtatcgcgtgattcttgtttcgggctcaagaacaagagcaaaacgtcttgcagaagatctgagagattatgatctgagcagtttttacagtgaagagatggaacggcaggtgaatccgggagagattatggtaacctgtggttatatttcagagggatacgagtatccaatgttaaagtttacggtcatctcggaatctgatatttttggtaagaaaaagaaaaaaaagaaaagaaaaacttatgaaggaaaaaaaatccaggaatttgccgaacttaaaccgggagactatgtggtacatgagaatcacggacttggaatttatcaggggattgagaaagtcgaagtagatactgttactcgggattatatgaaaatttcctatgcggacggaggaattctatatataccggcaacacagatggatctgatccagaaatacgcaggagcagatgcaaagccaccaaaattgaataagcttggtacacctcagtggaaaaaaacaaaaggacaggtaaaaaaagcggttcagttaatcgcaaaagatcttgtaaaactctacgcaacgcgccagcagacagaaggttatgtttatggaccggatacggtctggcagagagagtttgaggagatgtttccatttgaagagacagaggatcagcttcgtgcaattgaagatacaaagaaagatatggaaagtacgaagattatggatcgtctgatctgcggagatgtagggtatggtaagactgaaattgcgataagagcagcttttaaggcagtgcaggaagggaaacaggttgtttatcttgtacctacaacgattcttgcgcagcaacactataatacatttattcaaaggtttaaagattttccggtgcgtgttgacttgatgagccgttttcggacgcaggcgcagcagaaaaaaacagtagaggatttgaaaaaaggtctggttgatatcgtgatcggaacacacagagtgctttcaaaggatgttggatataaagatttaggacttctgatcatagatgaagaacaacgttttggtgtgacgcataaggaaaaaattaaaaaattaagagaaaatatagatgtgttgacgctgacagcaacgccaatcccaagaacacttcatatgagtttgatcggaattcgcgatatgagtgtgcttgaggaagcaccgatggatcgtatgccaatacagacgtatgtaatggaatacaatgatgagatggttcgtgaggctattgagcgtgaacttgccagaggtggacaggtttattatgtttataacagagtagaaaatattgcagatctagcacttcgtgtgcagaaactggtgccggatgcaagggtatcttacgcacatggacagatgaatgaacatcagttggaagatattatgtatgattttatcaatggtgatattgatgtgcttgtatcgacaacaattattgaaacaggactggacattgcgaatgctaatacgatgattatacaggatgcagatcgatttggactgtcacagttatatcagttgcgaggaagagttgggagatccaatcgaatggcatatgcatttctgctgtatcagagggataagatgcttaaagaagttgcagagaagaggctggctgcaattcgtgaatttacagatcttggatcgggattcaagatcgcaatgcgtgatcttgagatccgaggtgcgggaaatcttctaggagagtcgcaaagtggtcatatggcagcagttggatatgacttgtactgcaagatgcttaatgaggctgtcagtcagttgaaaggtaaaaaagaagaagcagactacgctacaacgattgatcttgatatagatgcatttattccggaatcttacattaaaaacgagtatcaaaaattggatatttataagagaattgccacaattgaaacagaagaagagatggatgatatgacagaagaactgattgatcgttttggagatcttccgaaaaaagtacagcagcttcttcatattgcagcacttaagagtcttgcgcattctgcatatattacagcgatagaacaaaagggaaaagactacaaatttatcttatatgaaaaagcaaatctggatccggcaaaaattccggcacttttaaagaaatatggaaataatatgactttcaaagcagaagcagtcccgtatttcctttatcaaaagaaagggagaagcggaaaagagaaaggggaaaatgttctgcaaatgctaagagaaattatagagagtattcgcgaacttcgattagatcagggaagttgaggagattctgtgtttggggttgtgatagaacaaaaaacacgatataatgagcggtagtatggctgcgtaagtaaatacgtaaaaagaggaggatttaccagatggtacgtttggcaaaaaggctggcagtgcttgcagtggcaggcacattgacagcaacatctttgacaggatgcggaacaataaatacagatgagacagttgcaacagttggtgatgagaagattacacttggagtcgcgaatttttacgcaagattgcagcaggctcagtatgaaacctactatgcgagtatgatgggaacaacagcagaagagatgtgggcaaaggaagtatcagacgatcagacatatgaggagcagacaaagaagagtattcttgagaatctggagaatatgtatcttgtttcacagcatgcatctgactatgatgttgcactgacagaggaagagcagcaggcgattaaagatgcagcagcaaaattcggtgaagataattcggatgatgtgaagaaagtggtatcaggagatgaggaggaagtggctaaagttctcgaactgatgacaatttcgaataagatggaaacggcaatggaagctggtgtggatgagaatgtatcagatgaagatgcagcacagaagagtatgcaatatctcttattctcatatacaacaacagatgattcaggagaatccaagacattatcagatgatgagaaagaagccttgaagacgaccgcacaggcatttgatgatcggttaaagggtggagaagatatggagactgttgcatcagcagcaggacttacagcccagacagctacatttgattctgaaagtacaagcccggataaggatctgatcgcagcagcagatgcattgacaaatgaaggcgatgttacagatattatagagacagagaatggaatttatattgcaaagcttacaagtcttttggacagagaggcaacagacagtaaaaaagaaagtattgtaagtgagagaaaacaggaacagtatgattcacttctggagcagtggaaaaaggatacaaaaatcaaagaagagaaaaaagtatggaagaagatcagttttgaaaaacagggtgtaacaattaaaacgtcagatacatcagatacttcagacagccagaattaaaaaaacagggacaaaaactttgtgaagaccaacaagtttttgtccctgttatatttacacgagcaacgagccaaagtccgtgctttcacgaaaaattaaatgtattccagtttttcgaaataatgcattaagatatcagcacagttttcaacaccaagctcggaagtgtcaagaatcatgtgataatcattcacatctccccaggtcttgccggtgtgttcataataataagcagcacgctcttcatccgtatgctccaccttttcttttgcggcatcatgatcaagattttcttttttcatgattctctgaatgcggtcctctttggcagcactcacatagatatttaatacattcatccggtctttcagaatatctgaggcgcatcgtccgagaataatgcaagggttttcagccagtttccggattgcttcagcttcactttcatatttgtgatcagagagcttttcttctatataggccttgtcatagaccggaatatcaagtcgtttcgaaagctcttcagcaataatgctggctccggtaccgaaacgacgactcatagtaattactaatttcataatgaagtcctcctttgtagaaataacattcagatgaattttattatagcacgttctgtttgatttgtctcggttttacttacttgtatccaatgataggaagctgctggtaaaaatgtatccatttttcaggagaaataaaggaggaattttaatgaaaaaatggatgtaaaactttatacaatcccccattgcaagatcatgtatactaatgatataatttatagtagcgtttttggcagttgccagaagcaaacttatggatgattaaaaatttgagtaggtgacggatttgaagaataagatcaaacgttttgcaaagggggattttcacatcccgcagccggaaattatttttcctgagactcacattacgatgcgtgtcggagaaggagaaaaatatgagggaagcttttctctgcagaatgaaggggaagggacaatacgtggacttgtatatccttcttcctatcgtgtacagtgcgcagagcagggttttgatggaaatccggtaaatatttattatacatacgatggaagaggacttgtgccgggacatgttgaacatgggaaatttacgattgtatgtaatggtggagagtatgatattgcatttactgcaattattgagaaaccatttgttatgactcgatatggaaaggttcagagcctggaagattttaagaagcttacatatcgtgatgcagctgaggcagtgaagttattccggtccagagatttctttgagattctcaaatatgaagatacgaggatcaaggcgctttataataatatgcgtaaatgggaactggatcagcacgcccttgaagaattcctggtagggtgcaagcagaaagagaagatttttcttacattggaagaagaaagccgtgcttttatttctcttgtagaagacagaaaagagacttttactgtgaagaaaaatacctggggatatctggagattgatgtaagaacagaaggcgatttcctttctgttgagcacagacatctgacgacagacgaatttataggtaatgcctatcgtctggaatatggtatttctatggacaagcttcacagaggaagtaactttggaagaatcattctggaaactccatatgaaacattgagttatgaggtcgtagtggaaaaggatatttgcagagatgaggaacatcgtgcaaatgaaaaagaatttaatggaattctgaaagattatctgaaatatgaaggtgacaagatgtcactggaagattggacagaggcttctataaagaaaatttcacatcttcgcgaggtagatgaacgtaatgaattttaccttcttgcccaggcacatatctgcattttgggtaatcggatggatgaggcaaaatggcttttagaatcttataactacaatcgttttgcaatcggtaaggatgttgaattgagttcctattacctttatctgacgacaaaactgagtaatgattcgattgggcagagaagggtcgcagaagaactttcacgttcttttatgaagcatccggacagctggcgaattctttgtatgctgattgaggttgattcagaatataaaatctacagtgaaagactgaatgtgcttgagaagcagtttatggagtataagtctcacagcttatggttctatcttcaggcattccgttgttttaaagagaagagctcatctcttaaaaaactcggacagtttgaagtacaggttctgctttttggcgtgaaatataaactgatgacgaaggaacttgcattatatacagcaaacctggcaagtcagatgaagaattttgataaacatctgtataatgtacttgtgaagtgttatgagatgtatgatgaagcgatgatattgacttctatctgtacattgcttataaaaggcagcagaacagaacacatctatttccattggtatgagaaagcggtagacgcagagttgaagatcgcgcagctttacgaatattatatggcggctgcgagaccggaagaatttcataagcagcttcctcgttcggtatatttgtattttatgcatggaaattctctggattataagaaatgcgcatttttgtatgcaaacctgattacttatgaagatgagacaagtgagatttatgcgcactacagggatgagatggaagaattcacatggaatcagctggagaagagaaatatagatgaagatctgcggatcatttataagcgattccttgtagagacagacatgagtcaggacagaatccgcgctctttatgatgtgtgtcacgcatattggattacaacaaaggttccgaatatgaaatttattcatgtaatcgcagctgatggaacaattacacagaaggcagcatatacagagaatggagccagagtatttctgtatgcaaagacggatcgcattgtatgggaagcaaaagatggaagacattatacagattctatcccatatgagagtaaacgtctgttttatgaacttagatatatggatatctgcagaaaatatgcaaatagcctgaaccgaagcaaagcgtttgaagaagaggaagagctgacactggaaatcgtaaaggaaaagggtctggaaaattttccggaggatgagatccaggtactgtgcagcaagatgattcgtgagacaaattatgagaatgatgatttcctgacctatgtttgttatgatttatttaagaaaaaacagtatgataaagtgattcttacgtatttggcaaacttctactgtggagcaacacaggagatgaaggaattgtggaaagttgccagagagtatgaagtccatacacacaaactggcagaacggatcattacacagatgcttttttcagaggaattattccaggagacaaaagtatttgaagcttattatgatgaaggtgcatacttccggctccagcaggcttatctggcatatgtctccagagaatatgttgtagaagcacgtaagatagagaaatctataattgatattatctgcagggaagcagagaagggtgaggcaataatcgatatttgcatgattgctgttttgaaatattattcggatcaagagtatgaaacaagccttaagaagacgctgaaaaagtttatgcaggaactttgtggcaaacagatttatttcccatttttccttaagtatgataaggagtggctgattgaattccagttgtgggataagacactggtagaatacaagggccagaaggatagccgtgttatgttgtattatcagttgcagaaaggtggaaacggagattctgattatgcaacagaacttctgacaccaatgtatgagaatttgtatgtgaagaagtttgtgttgttctcgcatgaacgactgatctattattttaaagaaacaattgacggaaattcttacagaagtgagaaaaagatctgccagcatacggttgaaaaaggtgaaccgggcagatatggaaggctcaatgacattattctggaagaagatccggaagaacgagagaagaagatgaagcagtatgcactggaagatgcggttgcatcacatatgttcatacagtattaaggaggaaatcttttcatgggacagggaagtataattggatatgagataaatgaaaagacatgccagatcagtttttataatgataaagagatggaacctcagacactggaagttgactcagataattttcagattcctttgattattggaaaactaagagacacatgggcatatggaaaagaggcaaaacgtcttgcaacactgaaagaaggatttaccgttgcccgtctgctttcgagaagtcttgcaaatgagaaaattgaatttggcgatgagacatatgatgcagtatggctgctttcgcagtttatccagatgtctttacagtcatttcctaaaattgatggaattgtgttcagtgtaccggttcttacagaagaactggcacagatgcttcgaaggatcgcagttcgcatgaatattgataaaagacatatctttattcaggattataaagagagtttttgtaattatctcttctatcagccgaaagaactgtggcagtatgatgcagcattgttctgctgtgaccgtaatgagatcaaagcatatatgctgcgcagactgaagccgggacttggtggtggaaagactacatttgttacggttgatgaagttgcaaatgcacatatgaaagaactggcgcttgtttatccggttttgaacgaggacaaagcaaaagaagccgatgcgatgttctgtaaatttatacagagcgtgtttgataagaggattgtttcttccgtattcctgacaggagaagggttcgaaaataactggtatccgaagtcattgcgggtgctttgcaatggaagaagagcatttatcggaaataatctgtacagcaaaggagcttgctatactgcatacagaaaactgtatatgcatatagagaatccggtttatctatcggagactaagctgacagatcagattacagtcaatatgcgtgtggatggtcaggaaatgtggtatccgcttgtttcctggggtgcacactggtatgagtcaaataatcagtgggaagtgatccttgaagagggtgatgatatagaatttcatatcgagtcactggttcagggaacggttaagacagaaaaaatctctttggagagacttccaaagagagcagagtactctacaagacttcagatagaaacgatgtttcaggatgaaaaaacctgcaagattacagtacgtgatgtcggatttggagatttcttcctgccgacggatttccgtgaggaaaaggtgatacatttaggaggtaatgatgggaaatttaattctttgtcatgacagacacgcagcacatccttatgagatttccaggatccactgcaggatctttacgatagaagaattgtgttactatctgtgtaataatttatatctgatcgattatacgatcatgaatgaaccgctttgcacctggctggaagaagagattgggatgaaagaactggcagagcagcttcgagatttgatgcgtatgcgtggatctgtcgagaattttgttcttacaatcttgaaagcttcaaagatctataaagaatcggagatgatccgaattcagaatgttttggaacatctgaaaaatcagaaggatgtagagcgtaagaagtataaaggcgataatcttcttgaaagcggtgagattgaagaagcgatcatcgtttatcaggaaatcctgaatcaggaaaaagatgagagtgtagatgaaaaattctatggaaagatctatgcatgtcttggagctgcatatggacgattgttcctttatcaggaagcggccaaaatgtatgacagagcctaccagatctgcgaagataaggaattactaaaaccatatctgtatgcgtcttataagtatatgtcgctggaagaatttcacattttgcttacaaagcacagtgaatatcaggaagtgaatgcacagatgagaagcgaaatggacgaagtgaagcagaatcttcagattgagccaaatgaagtacttttggagaagtggaagaggaaacatagaagaaatcatacataatacagactttttgtgcagctgttcacagaatctatgagcagctgcattgtttactgttcacacgatgtgcgaccagcaacgcatctcgccattttaaatcgcttcctgctgaaccatatccataagaaccaaaaccgccgaatcctccaaacgggtcgtaacctccataacctgaaccatcactcgaaccatatccggaagtatatcctttttcgcgttcatccataatctgctgataagcctgctgcacttccttaaacttcgcctcagcctcatctttcttcggattattgatattcgcatccggatgatattgtctgctcagctttcgataagctttcttcacatcctcatccgtagcatttctgtctacacctaatatactgtatggatctgacatccttcccgtcctctcattctttctctcgcattcattctaacactcactacctatcataacagatggtttctctccagtaaacacatcaactcttcttaataaatgttgttccacacttcgggcatcggatctcaatctttcctttccccttcggaatacgaatcttctgtttgcaccccggacatttataaatatgatatgcctttctttgcgccagactgttcttctgctgctgaatataagtcctaatcttgtatgtctttgcaagatacttctgattttccgcatatcgtttagatatatttttggaaaatatacggaaataacaataaatgatcaatacccatccaagtaaatagaataatgatcctgcccttccccctgcaaaaaatgaggacaagagtactactaccagtccagcaatgagcagacctttagaaaactgatccacaccatatctgccctgcataaaacgtaaaaatttttctttcatacaaatccttctttcttgataaatctgctcatgcacatttttactgcccctacttctctgctgtgcatctcgccaattatattatctctaactgttcagagccaacctccaaaatgctatgcattttctataaaaacgatatgtgctttattctgcgctgttttcgaataaaagtcaattaaataaatataaaatgtggtaaccgcccggaggaaatataccgaatttttcactttcctctgaacgattaccattctttattgattcaaaatatttttgcagatttcatcagaaatcagataaacaattctagaatcatttatcatgacatatctgtctccacttccattttctcctccgatgtaaagcgtcattgtctgatcttcatcatcgcttgtataagtaacttctactgtgattctggaagtcgcatccagaccataccctgcaagatccgcatcatctacagaataatccgccgcctctgacagcttcacagcaccaagtcctccggctactgctgcaacatcttctgcctgatcctcattttcggaatcataggttgttgtctcaccgttctgtgtgatcacttcttttttcagatttccacttccgatacttggataagtatccagctgagcgatctgatccagttctgtctggatatcatccaatgaagtcgccggaattgtataaaccttttccgtatcgtccactgtcgcatagtaatcatttccggtcgcattcccaaccttgattgttgtcacagttccatcttcacctgtcagtgtaactgtataagtcggatgatctaatccatattcttccaacgcatccgcatcctcaagttctcgatccgcactcaactgtcccatggcatcagctactgtcttcggataactctgacgcaatggaaaatctttatctgcggtatagtaccaggtatctccgtctttctcaaaattcatttcacccgtaccaagatcatatttcaccccggtaatctctgaggtcttcaggtctgtcactttcaccgtttcttcttccttggaatcctgcttcttattccatgtgcttaaggcaaaatagaggataaggagcaacaccagaacaccgatcagaatcaatggccctttctttttcttcattctaattttcttcctccttaagcttttcttcttctgaaccatacgctgaatccggcgataagaatcactgccgggattccaaagattacaagaaggctgaacagaccggcatgctgtatcgtattatactctgttccaagactctttgcctcgatggacagattctgtactccgtcaaagtttgcacttactgcattcataaagatctgtgtattctcaagctgtgaaaatgcatctgtaatattctgatcgatcagacttcctgcggagatcaccgtcagacgggcttctgttgtactgctttcctcagaatcttccgtactttcaccatcatcagttgttgtatctgttgcctcggcatctgaactatccgaagaagaagcatctcccgaagaaattgtctctgttgcgacaactccaagttcatacgttccctgtttctgttcggactctgttactgcgtatccattttccgatgtctccatgaatgcacttgttgttatcgtatctcgtgtcggatctgtcaatgtcattccttgtgcattcgtcaaaagcaccatctgagaactgattccattcgcaagatcaccggatacattcagctgagggaagatataatatggctggttctgataacatcttgtcggatccgcaatataaccatctacaccttcaattccatacaccttcagcacacttgccagatttggaaaatccgtcagagagatatccccaagcagacacatcacttttccgcctgctgccagataatttgtcagaagtgtcacttcattttctgaaaggtcattcgtcggtgcattcataagcagaagatcacaatcatccggaatggaatctgccatcagaaggttcagctctgtcagcgtgtaattatttttactcatcaaatctgtaactgtagatgacagttccgcctctccatgcccgcttactttatagattgtcttctgcgcatcacttgtcacataattcaccgcacttgtcagctgaccatctccgtcaaattctgaataagatgcatttcctgaataataataggaagacatatccataacaagaatcttgtcaaaagaaatagttgttgtctttcctgttgcttcacaagatacaacgattgtattttcggatgcattatactctgtcaatgctgacggatgcagaaccggatcgatccactcaacattgattttatctgaaagtgctgcatatttactgataaatgtcttaatcctgtcatccgtgtctttctttaccgcaagaactttcatatcgactttatcattcaatccgctcagcagatcctttgttgtatctgaaatttcataaatctttgtactgctcatatccagattgcgataagcttccggaatctgtccgattaccagattgaacacaataacaatcgcgattacaagtactgtcagccccacactgtaagatccgtgctttgtaccggaggtgtggaacatccctttgatctttcctgttgttttctttcttctatccactttcatgccctcctaattccaacgtctcttctggattgcctgtactgtcaggaacacaaagactacgatcagtgaaagatacagcgcgattcctgttatatctacaatactgttcgaagtgatattcgtaaatacatctgcaagtgccagtcttccaagcatctttgtcagcaggttttcataaaggcttgatttcacaaagtacacgaccacaccggcgatcacaccaactgcttcgatcacaccggcaatcactatatttcctgtcatctgataaatataaacaacaatcagagtcagaatgataagcacaccgaccaatccgctgactgcactgcttggaagcatggaaagaattccattccaaagatacaagataagcagaataccaaatgtactgataaatgcgatcatctgactttctgtcagagcagacaggaacatgccgatcgccgcatatacacagcccaacaggaagaataccccgatggatatgtaatctactttcagatatgcagttccctgtgccttaatgattaatgggaacgcacagaagatcacattcgggattccaattaccgttaccattgcaagatattttccaagcacaaccttccacagactgaccggagctgtcagaagcagctgatctgtcttatttttacgctcttctgaaaaactgcgcatcgtgatcagcggaattcctacgataaatacgatcaatgtacctgaaagcgtataggaaaagtatggatatccggctgtcaggttatatgccataaagtagattcctgtaaatgcaataagaaatgcaacaaacacgcatcccaccatagactgaaaataggagcgtacttctcttttataaattgccagcatctttcatgtcctccgtttccttcttcttcgccttttctgcatattcttctgctgccctgtcgctctgcgtcagttccataaagacatcttcaagacttacctgcagcggattcagtttcagcagtggctgatgattctgtgcaaatgcctgaaatactttctcacgtatatctgtatttttcttttcctgaacctgagcccatgtgattccattttccagatgctttgtagaaatgcttcgaattccatctactgtctcaagaattcttcgaacttcgtccgggcttgctttcgtctcgatctcaatcagatcagaatctcctagattccgttccaggttctccggcgtatcgcttgcgaccagttttcctttagaaatgatcaaaatataatcgcagacttcacggacttccgccagaatatgagaactcaggatcaccgtatgtttcttcgcaagctgacggatcagttcacggatctctatgatctgttttggatcaagtccgacacttggttcatcaagaataatgatctttgggaatccaagcactgcctgtgccagtccgactctctgacggtatcctttcgacagattcctgatcagacggttttccacttcccagatcttcaccatcttctctacttcattgatagactcttctcttttattcttagcgattcctttcaactccgctacaaattccagatattcacgaactgtcatctccatatacaacggtggcaattccggcagataaccaatctgctttttcgcctcctcaggttctttcagaatatcatgtccattaatcagtacttctccttcggtagcaccgaggtatcctgtcataatattcatcgttgttgatttccccgccccattcggtccaagaaagccgtagacatgcccttcctctattgtgaagtttaaatgatctactgctgtatgatttccatacttcttcacaagattctttacttctatcaaagtcttacctccctatatttcttccagtctatatctatgcagacaaaccgagatttttgacctttcaaaagtatcaggattctgtgaatgttttgtgttataaatgtgacagttctatttcttgcaaaaagaacaaagcactctctgcattgttccatacaagaaccaacacaaagaatgcttcttttttacttttcgtattccttacaaaccagatctgcaatgatctgctgcccctgagaatccggatgtactccgtctttctgcagatgagatatcacagatgactgatacacatccgcaacttcataatcgtattttcccgcacgtttttcaatgatcgcgttcatattttcaataatgtcttctacaattttattcagcgtagatggaagcttcatatttcctgccggattataaattgtagtcacaatcacttttgcatcgtcctttttcaatgaatttactgtcttcatcatctggatccattctttttcaaaagaattataatcccagttgttcaatgcgttgattgcactcagcacaagcagcggattcttctttacagactctttcaaagatgcaagtgcctcatctgcacttttaaattttgtatctgtcttcaggatttcctgaaccacacgcttacattcgttgagcaggtcattcgaaccaattgttataaaaataacatctgcttttgcaagattcgtctgcacatcctgctttgacaaatacttttcgttcaatcctgctgtatcaagacctgttcttgcataattgtgataaatatatctgcacccttcgctatatgctatttcctttgctgccagacttccataattctccatccaggatttatcgcaagtgtaacctttcgcaatactgtctccaagtactgtgcaataaagctgatgtgggcgtgccgtttcctccgtattttctgttccgaataccggaagagtctctgtcagcagcatccctgcgctgagcagaactgccaacatccttcttccgtatcttgaaatccttccttttctttctctcattccattttgtttcattttccgcacctgcctgtattctgtccttcttcgtagctgtccctattattgccttatgcttttagatttcccattttgcctgacttccatgctccgtctttgtaatatttaatttccagtcaatctgctctttcaattcatttacatgggaaatgattccaaccagtcctttctctcctgcaagttctttgagaatctgaatcgcacgatctcttgatgcatcatccagagatccgaatccttcatctacaaacatcgtctccagacttacagctcccgccgtattctggataatatctgcaagtcccaatgccattgataaggctgccatgaaggattctcctcctgagagagactttacatctctgacagaatctgtcactagatcatagacatccagatcaagtccggcctgtccctgactgctcagatcctgaatctccctgcactgtaaaataaattcatttgatgtcatccgcgccagcctgcggtttgccgcctgaatgatctgccggaaataagtccgctgtacatacgtctcaaaatcaagtttcacactgccgctcaaattgccatttgcagtcttgctcaggttggaaagtacctcatattcttttcgcagagcttcctgcgaagaaaaatattgtttcagattcttgtacgcattctggttagctgtccatctgctgtgaagctgcatctgatgatcctgtttttctttcaacagatgttctacttcatttcgcttttccatctcctgctgcggatcttcccgcttttcgcctgcagtctgttccttcagcgtctcgatctttgcctttttctctaacagctggcggtcatgttctctcacttctttgtctttctcccgccacccttcgatccactgtttcgcctcacgaaattcttcctgtgaagtaaattcctgtcggctgatctcctctcggaactcttcctgctcttttacaaaacgcttctcaagttctgttttctgacttcgaagtccctccagctttcctgcctgacgtctgctttcctccgtcatcttacggcactgttcctgtgcctgctttgtttcattcttcttccgatccaattcaacctgcatcttctgaagctcttctttcacctgctcttctttcacaggattatctccgagaatacgttgttctgattcaagctgtgctttacatatctgaaacttttcctgctgctgtattcttttttgttccagcagatcacgtctttgcttcagtttctctaccgtctctttatccggtgcttctccggaaatctttgccggatacggatgttctactgatccgcagaccggacacggcgtgccttcctgtaattcctttgccaggattcccgcctgctcctgaaagaatttcgcatatgcttcctcatactgagctgatgcttcctgacaattctgtatacatcgctgcatcactttcgtctgattgtcatattctttcgaatacttacgcacatttgcgtaatgtggaagaagatccgataactgtgaaattcttttcagcatttccggttcttcctttgcaaaaacttcttccaattcttccgctttttctttaacctcagaaaattccttttcctgttccttctgccatacagtaatctgctcgatctcgccctgtatctgccgcacggatttcgctgttcgaagagcctgcacttccagatgtctcgcctgctctgcccggtgtccaagccctgcctgaacccgacaggtttccatctcgtcctgttttgcattcagaagaagcaaactcttctcttccatttccaaacggtcaaatatcttattcttctcttctttcttctgaatcagcatttgaagtgtttctgactgtttcttaagttcctctgattctttctttaagacttttccacaactttcttcatattcgagaaagtttttcacagcctccagaaccttttccccttccggcatggataactcacagagttctttccactggtctgccagatcctgctgatctgtgtcctccgattccacacgctccatctcacgccgaatgtctgattcactttccttcagcgcaatatacagatctcttcctttttctttcagtgcttcctggatttgccagtaaatttgtgtctgaaaaatctgcgagaatatcttttttcgttcttttgattctgcatgaagaagctttaagaaatctccctgcgcgatcatggcaatctgtgtaaactgtcccgcatcaagaccaatgatttcctgaatcttctggtctgtctctcgcttcttcccctgatattcccttccgtccggaagaaggagactaaccttcgctgtctctttcacatagcggaggcttccatctgcttttcttctcttccctacccggagatattccggattacggcgcacggtatattcctgtccccgataagaaaacacatattcaacataagtgtctgtgtcttctgatgcatactggctgcgcatcatatttccatctctgcgtccgccactcgtccggtcatacagcgcatacatgattgcatcaaagatggtcgtttttcctgcacccgtatctccggtgatcagaaataatccgctgtgaatctttgtaaaatctatctcctggacgcccgcataagatccgaatgcggacatcgtcaatctcaccggtctcatacgtcttcccctttcatttcacttagaatctctcttaagatcttttgttcctgttcagacatttcctgcccctgcatctctttgtagaaatcacaaaatgtttcaaacggagtaccgatccgtatctgttcttcagaaaattccagcttctgtcttgttctctcattatccatccgcacttctagaatatgatggaattttctttccagctgttcctttggtttgtacggatcaacctcatctgtcagcgttacactgacataatcttcgcttcctcttccatcctccgcttcaagaatctcttccagagttcccctgagttttctcacatcacgaagtggatgcatcggcagcttctgaatctccggctcgctccctttttctttcagttcgactacatgaagtgtcttcttctggcttgcctcactgacagaatatttcagcaatgttccacaatagcgaatcttctcctgtccgactctctgtgcaccatgtaaatgtccaagtgccacatagtcaaactcctgtactgcggaaatatctacattatcaatgcctccgatagataatacttctgattcacacgttgttggagtctcccccttccctgtataaaactgatgggaaaccagcacatttcttctggaaaaatcaatcttctcccgttccagaattccttgtacagctgccgtataactctccggcgcctctccgccaaagatcttgcgcacatatcccggcttcaaaaatggaagcagccagaaatccgtttcaccaaactcatctgtcaaagtaatctttttcagacgatcctcttcttcctctggagcctgacccgcaatataaatctgatggcttccaagcaaacgactggcataatcaagccgctgtgccgaatcatgatttcccgatatgataagaaccggaatcaccggttcaatcttagccagagctgtcaagaattcatcaaacagacttaccgcttctcctgatggcacggatttatcatagatatctccagcaataacaattgcatccggatgtatggacgctgcatatgaaagaacctccgcaaggatatgttcctgatcctcccggaggttataatgatgtaattgctttcctatatgcaggtctgataaatgaaaaaatttcatatcgtcacctcattacagtaaatttacttctttcccggattcttccagatccagattgctgctacaatgccaagcatatacagaatgttcacaagaacgaccggattatccttcagtaaagcgacaactgctacaattgctgcaagtatcgccgcaagctgaagcaccttgagaagcttctcattccggctctgtcttgctttctgtaagcattccagtctgcgctgttccaacgtcagatattccagcatatcttccggccggatcttagaaagaatcacttcttccctggaaaatttcttctccccactgcggtggaaaatactcttgatctgatcgatcttttccttccggttctgcggatctttaaccgcctgctcatactcttcctcggctacacgatcctccgcagtctctttgtaataatcttccagcttctgcgccggttctaccggtggctgtacaggatgtgttggttccgtattcaccggtggtatcgcctctgtcttcactggcggaatctcctccgcatccaccggctgctcgactactcctgatatattcacttcatctatcactttattttcctcagacacgctagtcctcctttttatcttctctgcatcaatcctgaaaatgatacctgctattcgcatatcaacatataaattatagcaaatgcacgaaaaatatacaaccaacaggaaatggacttagtgtcgattaatcacattttcattactacttttgttcctccgctcccggaagtttcaccatcttcggcgcatgcttaagtgccggaatgatctttgcgatcaaatcagatgtacgaattttcagactggatgtgttgatgcacggatgacagccaaaatacggatctttcattacatcctcatcgatcagaagctgtactttcccctctgtatcattcataagtcccataacgctgacggatcccggtgtaatatccagatacttctccatatactccggttttgcaaaggaaagtctggcagagcctatctgtgccgacagattctttgtcttgaatggcttgtcacccggcatcagaagcagataaaagtctgtttcctgtcgattgcaaaggaacaagttcttgcagattgcggttccatctccaagtgttctatcgatctcttcacaggcttccatcgtcattgccgcctcatggtctactctctgatattccacaccaagcttgtcgaggaaatcatataccctgatttccttttctaatcttccttctgtgttttctggtcttccattctctaatttcatattatcaactcctatgtcatactaacctaagtgctctatatctgtcaaaacatgcaaatatttcctgtcttctcggcactgccatacaggatacactggatgtactctcgcataattccgccagcgatttattctggatcacttcttccagctcatctacaatctggatcagattcttctttccatcgatcaaatgtttctgtgcatatcgtacacagtatccaagtgctgccacctgttcgctatccgcaatctgctctaagtatctcagatcgatcgtatcccggttgatcatcacagattctttccccatcgtcttcatcttgatcctgtcatttccgcgaaatgctttatccggtcgcggcactctgtcataagtcggtttctctgccggctgctccggcacgctgatctgtgggaaattctctgcttcttttttcgccagtactgtaatgtctttcggaacataacgatccatctggataatactgtctgcaatatggaaataagctcccgaacttcctgcaacgatcactgtcgagattccatagttttcatacaattccctgattctttcaataaatggtgtgatcggttccatctctctgtggatcacgcgctgcatcagctcatcacggatcataaagttcgttgcactcgtatcttcatcaatcaggaacagagatgttcccgcctcaatttcttcgatcacatttgccgcctgtgaagtacttccacttgcatcttctgtacagaatgatgtcgtatcttttccgttcggaagatcattgatgaacatggaaatatctgtcttctggatacttcttccatcctccgcacgcaatttcactgctgtcgcatctgtgatcacatactctcttccatcccctgcgatgtgattgtacactccaagttccaatgctttcaaaagtgttgattttccgtgataacctccgccgacgattaaggtaatccccttacggattcccataccggtaatctttcctttatgtggaagttccagtgtcacttcctgttcctttggagactggaaggcgattccgtcacgcatcggccgggatgagattccggattcccttggcagtacacttccgtttgccacgaaggcacaaagaccaagtttcggaagttctttacggatatactcctggtcttctgcaagatctacgattcttctcaatctctttgcatccagattcttgtaaaacagggatgcctttacacactccggaacaaaatcaaataaaatcttctctaactctctcgcattgattgttcgtccatttgccggaaatccgatttccattctaagaaggatatttccgttctccggctgaatctgacacgctgttctctccagaacttcctgtccgcatctgctgacagagatcagaccactcttacctgaacctttcgccttggatgcaaaccgttctgcccttcttccaaactggcgcagcaattcgtcctgaagtgcaattctctgatattttccacaatataattcctgtgggaatcctgctgtcttcccactcaccagtacacttacctttgacggtgacgcaaacggatctccctgtacgtgatcgatcgataaaacatatcctggaaatcggtactgtccttttgtatctttataagccggatatccccggtgatctattcttgataataaacttctaagttctgcttctgactgcatttttattccactctttctttttctcattcgtgcagaatacgctcaaactgcacgaaccacttctcattatacaataatttttgctttcttgcatgaaatagtcatgcagctttcccgattttcagagcaaaaagaagccattatccagactctttatccgaataatgacttccaatcatttacttcaaattacttttctgtaatacaattttatacctcgaagatcaggtctccgtaagatggcattggccaagcttctttatccacgatcatctcaagtttgtcaaccggtgcacggagtgcatccatagccggaacaacctctgtatgatagtatgtagcctgtacttcgccttcttcttttgctgctgcatctgctgttgtttttacaaggttatcaagtgctgcctttgtctcagccatcagagcacttacttctttcagagtctctgtctgaacagatgcgtcaacaccagctgcctttacagcatttactgtatctgcaagtgtctttgtatacttgataaatgccggcaggaactgtttgcttgccatatcgatcatagtacgggcttcaatattgattgccttagcatatgcctcatactggatctctgcacgggactcaagctctgcttttgtaaatacgctgaatctctcaaacaattctacagccttgtctgttgtgattgccggaattgcttcaaccatagacttaatgttcggaagtcctcttctctcagcctctgcaacccactcgtcagagtatccgtttccgttgaagatgattctctggttctctgtcaggtattctttgatcagatcatgtactgcaagatcaaagtcatctgccttctcaagaatatcacatgcatctgcaaatgcttctgcaacaattgtgttcagtacgatattcgggtttgcgatagaatctcttgatccaaccatacggaactcgaacttatttcctgtaaatgcgaacggtgatgttctgtttctgtctgttgcatctttgaacagatccggaagtgtgcttacacctgtctccagctttccgcctttcagactgtgtgtagcttctcctgtactgatcagctgctcaacaacatcctcaagctgttctccaaggaagatagagataattgccggaggtgcctcgtttgctccaagtctgtggtcatttcccggatctgctgcggattctctaagcaggtctgcatgcttgttaaccgctttcaggatgcaggcaagtacaagaaggaactgtgtgttctcgtgaggtgtcttacctggatcaagaaggttgattccgtcatctgttgtaatggaccagttgtcatgtttaccggatccgttaactcctgcgaacggtttctcgtgaagcaggcatttcagtccgtgctggcaggctactctcttcagtgtctgcattgtcagctggttctggtctaccgcaatgttcgcctctgtataaatcggagccagttcgtgctgtgccggtgcaacctcattatgctgtgtcttagccggaacaccaactttccaaagctggatatttacatctctcatgaaggatgcgattctctgacggattgttccgaagtaatgatcatcaagctcctgtcctttcggaggcattgctccaaagagtgtacgtcctgtgtagatcaggtcttttctttcttcaaacttctctgcatctacaaggaagtactcctgctctgctccaacagatggagtaactttcttagatgttgtatttccaaataaacgaagaagtcttaatgcttctttattgattgcttccatagaacgaagcagtggtgtcttctgatccagtgcttctcctgtgtaggagcagaatgctgtcgggatgcaaagtgtagctccgcctgcgtcctgtcttacgaatgccggtgaggtacaatcccatgctgtatatccccttgcctcgaatgttgctctcaggcctccggatgggaatgaagatgcatctggctcacccttgatcaattcctttcctgagaaagtcatcagaacctttccgctcggaagtggagctgagataaaggaatcatgcttctctgctgtaactcctgtaagtggcaggaaccagtgtgtatagtgagtcgctcctttttcaatcgcccattctttcatctcgtgagcaataacatctgctgtctcgagatccagatcttttccttcttcaattgtctttctcagattcttgtaaactttctttggcagacgctcctgcataactgtatcattaaatacattttctccaaagatgtcagctacattgaataattctgtgctcataccctataccttccttttctcttaattcttcgattaccgttcactgcaatgaacaatattcgattacactacgggaacccccataatagattacctctcaggaaatcatccgtctgatccagtcagatcagatctgattttattccatccaatctgattcaatcatgcggatcatttcccaagcgataaaaaaagggcactccaattataattggaacgcccttgttctgtctacgtgagtcagtatacctcaacttgctttaaaacgcaagtgcttttttaaaaaaattcttctcaggcttttccgacagatccgaataactccatcttctcttttactgtttccatgattgcgtctgcacctggtttgagaagtttacgtgggtcaaatcctttaccctcaagatcttttcctgcttcgatgtacttacgtgtagcatctgcgaaagaaagctgacactctgtattaacgttgatcttagcaactccaagagagattgctttcttgatcatatcttccgggatacctgtaccaccgtgaagtacgagtggcatatctcctgtacgctgctgaatagcgtccagagtctcgaagcttaatccttcccagtttgccggatatttaccatgaatgttaccgatacctgctgccaggaaatcgattcccagatcagctactctcttacactcttccggatcagcgcattcacctcttccgataactccgtcttcttctccaccgatggatccaacctctgcctcgattgacattccatgctcgtgagcgatcttaacgagttcttttgtcttctcaacattctcgtcgatcggataatgagatccgtcgaacatgattgatgagaatcctgcttctacacatttcaggcatccttcgtagctgccgtggtcaaggtgaagagcaaccggaactgtgattccaagttcttccatcattccgtttaccatacctacaacagtcttatatcctgtcatgtactttcctgcaccctcagatacaccaaggataactggtgagttgagttcctgtgctgttgtaagaatagcctttgtccactcaagattgttgatgttgaactgtcctactgcgtagtggcctgcttttgctttctgaagcatttctgtagctgatactaacatatttctttcctccaattcttaaagatcctgacacccgtgaaaatcatcaggaattatttatttagaattcttctatattatagcgtattaatttataaatgacaatcttatgttttgcataaaaaacaatccacagcggtgaatcttgttaacattttcacaatggctttccttttcttctgtggattgtttttatttttgtacaatataaccaacgattatttatcactcgctaaagattaacaagtctccattttgaattatcaacagtaagctggtatccacagtaggaacaacaaccatttttatcaggcatgaaattagcaccgcagctaggacattctttttcactgaaaaccgcctgaccttttgacttcattcgtcttggatggcgtgctctgtataatttcgattccatctttttatccttttttataatcttctggttcttttcgagaataagtttgtggagtactgcctggatcgtgatcgttgtctgggtttcggtattatctacagctttcagttgtaatttgtccacactgtaaaataatgcatcggatgtcagttctgcatcattaagagcttcattgaggtctacaagtaatactttttcatcataacgaacgatctgttcttctaattcttctgtaccattctttcttcttaggagcactgctccgagaatgacagctaatataactgtaagtacaaaaggaactgccaatatgatctcaatgctttggataaatcgaaaacaagggactgccggaagaaagaaaaccaggagtgttgctgccaccattttataattataatcattcggatttaaatcctgatagatcaggagctcttctatctgccagtcaaagaaatcttttttgatatatccgccacaataaggacagtgcgtttcattactattcagtgaaatctcagcgccacagcttgggcatataattttctgatattcagaataaaattgccgctcttcatttctgtttttactttcaacttcatcatgacggatatgcctggattgtctaagtaagattgcgccatgtgggaaaaagtcctcatacaggatttttccactttttttattacgataccggtttgatacggtaccttgcagtatggcctctctccattcacgtccggcatcattccaatgtttgaaatcctgtttctttccatttacctcaggcagtttcgcgtaagctatacgaatttcatgagttatgtcattcgcctgtaaaagtttcatctcatgttcgattttctggcgataagactgtcctatatttacagaagaattttgaatattacccttttctaatgcagataatatggtttcaaaaggggtaagcacctttcgagaaatcttcgttgctttgaaaaagattgtctttgatttatttaattttttcttgacgtaaagaaaccacagttttggctgcatccattcgactttccaatctaaaacatagcaggtgagggctccggcccacacacttgcccacaaaaacgcaaaaaatattgaatctccacaggaaaaattcatttgatcacctcgcattctttttttcaaacagattcttaatacaccaaagaccaatgaatataaaaagtgcgcccacaggaataagtatgcaagcaaaaaggaatgtaaatggatcactgtcgcctcttaatttgtagtcaccctgtgatgtcaaatagacttcctctgtaatttcttccccgatgtaagtatcatgataaagcgtatcttttcctttataggtctttccatccactacatatgaaacctttaccttatatgtatcgtaatcatcatcagagtcagaaatgtattcataatcttcaacatatgctgtgaccttccggacatctttcgagcggctatatgcaaatttagacataagcctatttccgcctgtgattaacataagaagtcctaaaatcactaatacgatcattgcgattatggtatttctaaattcctttgtttcgtttgatttatgacccatatgcaatcctcccttcaaatttctccattttatcaacattactttttatttataatactggaaaaatagcaagattacactatcacttgtgctagggaatcgaccatcatggcataactttaggacaatacactatccaaaaaggcaaaaaacagaacgtatggtttatttccatacgctccatctcgcatttcatattatatttttaaattctccaaatccagctttctatttttgtttccatagcatggtatactctttttcaccagtagcttcatccaaaccttcacattgaataatgaacccttctctttggtaaaaagaaattgctctggtattcttctggtatacatttaattgtaatctgacttttttatccttaatataattcaataaaagcttgcctatgccacatgactgcatctcatcagaaacaaaaataccttcgatatattcattatttagtcctacaaatccttgtatcattttatcctcttcaaatacatagacttcggattgtgacatcatttctttcactaattcataattacttgtccagtattgcttgggaataaaataatgtgcttttaaatttgtctttaaccatatgtcagcaactctatctatatctccgttcagcaactttctaatcataacaaatattctccacaactacattccttatgttttcttttttttcaattctacaatcatattatatgcttcagtgattttcaagcacaaaaaaagctcgtaaatacgagcttcctttagtgactccgaggggaatcgaacccctgattccagcgtgagaggctagcgtcttgaccgcttgaccacggagccttattcattttcgtctgtgtcttttttgttaccgccacaagacaatagttattatataccaggctttcagaaaatgcaaccccttttttaaatttttttcaaaaaatttttatttctatttcaaactgccgttttttcttgattttacgcggttttccgcgattgttcaataaacctaaaattcaaaaaaggggttattttctaaaatatcactgaaaatatttcagattatgtgttcagacttcctctgcttccaccaactgttcactcagatcttctacggcttcttccttaaccatgatctgaagtgcctgattcttattctgaatcacaacttcttcatgagtaccgccgtactctccatccagagtccatggaattgcctcaacagattcaaaacggacttcaccactcttgaaggagtatattctgtctgaattaatctgacgcatcacaactgccccaatcagttcgttcaactcgactggattctttggtgttttaaagagtgtcacctcaaaaacgccatcatcaaaaatgacattttctcctgtgattcttttgaatcctcctacagagcgtgaatttgtcaccattccaaagataaactcatcttcaatcgtctctccgtcatgtgtgactttgatcttataagacggaatattgaacagtctcttggttccttccagaatataagccatatgaccaagaatattcttcatactctgcttcgtctcatatgacacgtctgtgaaaataccaaaggctgcaatatatacgaagtagtcatcgttaaactgaccgatatcaaaggaaaatggtgttcctgttacaattgtatctgcggcctccagcatattcttggaaatatgcagactacttgcaaaatcattcgttgttccggccggaatatatccgattggcgtcttattttctcgcatcatcataccggtcacgacttcatccaatgtaccatctccgccactacatgccacgagatcatattcttctttgtactcactgacttttcttacagcatcctgacttctttgtgtaggataaaccgttacctcatatccgcccttcacaaaagtgtcgatcacatctgaaagtttcggcttcagaagtcccattcctgaattcggattgtaaacaaatagcattcttttcataaacaaatacctccttattcaaaaatcatttgtgttcacatcagctgcaaactctcccccatagaaaaagatggctgtactcctcctcaaagtacagcccctctatattcatttgtaatcacatggttatctctctgtgacttcaattaccctcttattgttattatacgttagcaaagaatgtcttaatgccttcagctgctttctgctcgtcctcgccgtctgtcacaacggtaatctcctcgcctccgatcagattcagactcatcatacccataatactcttggcattgatgttcttctcggctacctgaatgtacactttgctcgcatactggctggcttcctgtacgagaagggcgatcggccgtccatcaaaccctgggtctgctttcactacaacagatgtcttaatcataataatcctccttgttcttgccgaactttgtctgccatctcactcagcttacgcagtctgtggttgatacccgattttccaaccggaggattcagggattctcccagttccttcaatgttgcttccggatgctcgaggcgggcaagagcggcctcgactaatcctttcggtatattctcaaatcctatctgatctctcaaatatgtaatatcttccagctgtttcactgctgctgatactgtcttattaatattggcagtttcacaattcacttttctgttcacagaatttctcatctccttgagaattcttacattctcaagttccattaatgagacatgtgcctccatgatattcagaatatctactatctgtgctccttctttcaggtaaacaacatacgacttttttctgagcacgatctttgcgtccatagaaaaactgcagatcagatcacagatctgatgtgccatctcttctgtggaacagacaatctcaaaatgatatgccttgttcggatcactcatagatccggacgcctgaaacgttccgcggagaaatgctcttcgacaacaaacctgttggacaatcatcggattcacggcatgcaactcttccgcattctcctgctgttcccctatcatcttcgtagcctgtaagatacgtatcgcatcttcatgcttttttacgataacagaataggtctctgtctgcttctttatatttctccgaacggaaatatcactccttatattaaatgttttttctattaatgtaaagacctttcttgcaactaaaatgttttctgtacgaatcttgatactgcaccggtcaaaactattgattacaaccgtcccgcacatgccaataaaagccgtcagttccgcaatctggcaatgtctggctgaactgatgttcctcgcaagctcttccttcacttttccagaaaatgacatattttccaccttttactttctctttgtgatactatccttcccaatatcacgatgttcaatacggacgccataactttcctctgtctcaagcgtgtgatataacgcattcgccagcgttacagatctatgctttccgccggtacatccaattgcgatcacaagctggttttttccctccaaaatataatttggaatcagaaattcaaccatgtcttttaatttttcaaggaaaatcggtcccttgtcattctgcatgacataatcctgaacttccggatcatttcctgttttttctttcaatgtatcaatatagtacggattcggaagaaaacgcacatcgaatacaaggtctgcgtcctgcggaattccgtatttaaaaccaaaggacattactgtgatatagaggttgcaaaaactctcacctttcacaaaaatcttctcaagttcaatcttcagttctcttgtcagcatcttacttgtatcaagaatatacgttgccttcattttcaaaaatgcggtcttctcacgttctttcgcaataccggtatccacacgtcccgacccactcagagggtgctgtcttctcgtttctttgtatcgctttacaagtacagaatcctttgcgtccagaaacagaatctcatatttgattcccttttcatccatttgctcaaggtctttctctaatccagaaatatcctgtccgcttcgcacatcgactcccaatgccactttcttcattgaagtttctgaattctcaatcatctgcacaaatccaggaaacattgcgatcggcagattgtccacacagaaatatcccatatcctcaagcatcttaagtgctgttgattttcccgctcctgacatccctgttacgataacaaaacgcatatcaaaactctcctattcttcttacttccgcttccagacggactcctgaattttcttctactttatcttctacctgacgcatcagttccataacctctgctgcgcttgcattccctctgttgatcacgaaaccgcaatgcttttcagagacctgtgcatctccgaccctgaatccgcgaagtcctgcatcttcaatcagttttcctgcgaaatatccttccggacgcttaaatgtacttcctgcacttgcatactctaatggctgctttgtcactcttttttctttcagatcatccatcacttctttgatcttctccggatttcctttttcaagagaaatcactgcttcaagaacaatataattcttctgttctaccacacttgtccgataagcaagccccatctcttctaccgggatcgtgagaaattctccatctgctgtcatcacttccacactctcaagtacctgcttcatctctccaccgtatgcacctgcattcatgcgaacggctccgcctaatgttcccggaattcctgctgcaaactcaaagcctgtcagagattctgacagtgctgttgccgcaaccttcgacagaagtgcgcctgctccggcataaatcttattctcttctaccctgatctgattcattttcttaaaaatctgaaggattacgccacgatatcccttatctccaacaagaagattacttccgtttccgatcacggaatatgggatttcctcttttttgcataactcaacgattgcctggatctcttcccttgattcaggtgtcacgaaataatctgccggaccaccaatacgaaatgttgtatgtttcttcatcggctcatctttcattacattttcctgttttgtaatagtgcacaatctattgtacaattccatatctatactccgtttcttctatataatagtattaaatattcttatcagtcatcaacatcatacaccacccacttcataaagtaaagtatattgccttgccaaacactaataaaccatgtataatgaatgcgtatatctaaaattaaccaagcctatttggaggcacattttttaatcaaaggagtgaatatttaaagtggacgcaggtgacacgtacctattaattatactgttaattttactattgttttcatcatttttttcatcaaccgagactgcgctgatgtcagtgaataaaattaaactccgctctctcgcagacggtgggaacaagcgggcagctttggctcttgatatcacagagaatcacacagcgaagatgctcagtgcgatcctgattggtaataacattgtgaatgtttcagcatcttctcttgctacaacccttgcctattcatttggtggatacatggtcagcattgctacactgattctgacagtggcaatccttgtatttggagagattacaccgaagaattatgcaacgatcaacgctgagaagcttacgcttcgctatattccggtcatcaagtttttcatgacggtcatgactcctgtcattttcatcattaacttgttttcccgcggaatcatgctgatccttcgcgtagatccggatgcggcgaataaagctatgacagaagaagaacttcgtaccattgtggatgtcagccatgaagatggtgtaatcgagtctgatgaaaaagagatgatctacaacgtattcgatctcggcgatgccaaggcgaaagacattatggttcctcgcgtacatgttacatttgctgatgtcaatagtaccttcgatgaattgattgatattttccgtgaagacaaattcacaagacttcctgtttacgaagagacacaggataatgttgtcggtattattaacatgaaggatctgcttctttacgatcatgatacaccgttcaatatccgggatttcttaagaaaacctcatttcacttatgagttcaaagatatctctgaacttcttgtagagatgagagattctacttttaatattgcaattgttctggatgagtacggtgagatggcaggactcatcactttggaagatattctggaagagattgttggtgagatccatgatgaatatgatgagaatgaagatgaactgatcaaagagatttctgatcatgaatatattatcgaaggctccatgagtcttgatgatgtgaacgatcacttacatacagaacttaactctgaagattatgattctctcggaggactgatcatcgaacatctggaccgtttacctcagatgggtgatgaagttgtcactgaagatggaattcgtctggtggtcgagaagttggataagaaccgcgtagaaatggtacatgtttatcttcctgaaagagcagatacagaagaagcagatggagaaatttctgatgcttttgaaaatgataaacactcacatgaatagaactttttgaaatgtcggctgcattatcgcagccggcattttttgacgtttcacaggcaatgcgtgctttcatataatatatagaagcacaaaataatgaggcgattatatgtcttattctatcatgcttgatgcaggtcatggcggtcgtgaccccggagctgtctataacggccgccgggaaaaggatgacaccttatctttaacgcttgccattggagaactgctgcaggaacgtggaattgatgtactctatacacgtacaacggacatttatgaatctccctatcagaaagcattggaagcaaatgcagccggtgcagacttctttctgtctattcaccgtaattcctatccaacagataataccgtatccggcgtagaatctctagtttacaacaaatccggtctgaagtacacaatggctcaaaatattaatgaaggcctggaagctctcggtttcatcaatctcggcgtaaaagagcgccccggtctggtcgttctgcgccgtacacagatgccggcggttctggtagaggtcggatttatcaactctgacactgataaccggctctttgatgataactttgatgatattgcgcttgcgattgctgaaggaatccttgatacattagaagaaaacggagaaatcagcaatgcttcttctctccctcactatacagtgcagaccggggctttccgcagtgaacgatatgccagacgactcctgaatgaattaactgaattgaattttcctgctgttttgacagaagggaatggtttattccgggtaacggtcggagaatatgatacgcttgacgaagctgtaaaaatggaacgccggttgaagcgtgccggatatcagacagttattgtaactatttagttgcaggatttagattctgactattacatgtccgtaaaaacatttccaaaaaacagagtgcactcttgattttttcaattgacggtattataatagcgttaattagaaatcatacggtctttcgccgcataaaggaatggaggatttactacaatggagaaaaaaaacattgactgggaaaatatcggattcggatatatccctacagataagcgttttgtagctaattataaaaatggagcatgggatgaaggtggtctcacagaagatcctaacatcgtcatgaatgaatgtgccggagttcttcagtatgcacagacagtatttgaaggaatgaaggcttacacaacagaggatggacacattgtcactttccgtccggacctcaatgcgaagcgtatggtcgactcagcgaaacgtcttgagatgccgcctttcccggaagataaattcgttgatgctattgttcagacagtaaaggcaaatgaagcttacgttccaccttacggaacgggagcaacactttatatcagaccttatatgttcggaatcaatcctgtaattggtgtaaaacctgctactgactatcagttccgtgtatttactactccggttggtccgtacttcaagggcggcgtgaaaccactgacactgtgcgtatcagactttgaccgcgccgcaccgcatggaacaggacacatcaaagccggactgaactatgcaatgagccttcacgcaattgttacagctcacgcaaatggttttgatgaaaatatgtaccttgactccgctacaagaacaaaagttgaggaaacaggtggagcaaacttcctgttcgtaacaaaagataacactgtagttacaccacactccacaacaattcttccatctatcacaagacgttctctgatgtatgttgctgaacattatctcggactgaaagtagaagaaagagatgtttactttgatgaagtaaaagacttcgctgaatgtggtctgtgcggaacagccgctgttatctcaccggttggtaagattgtcaaccacggagaagaaatctgcttccctagtggaatggaacagatgggacctacaatcgcaaaacttcgcgatacactgacaggtatccagatgggacgtatcgaagcaccagaaggatggctgaaatatatcgactgattttaaatcagataagaattttcgatcagatattgaaagaagggattcatttttcgaaatgtttctcttcttttttagtgaaaaaggacatcctgcagagatttactcccgcaagatgtccttttcatagctgttatccagcaaccctgttccattcttaattatttactcgcaaagtccttcgctttcaattactttcactacgctgtctacatacttctcgcagatttcatcagaagctgcttctaccataacacggattaccggctctgttccactctcgcgaacaagaatgcgtccgtctgttccaagttcttcagctgttttctctactgccgcctgaactgctgcgttatccagtgccgtctttttatcctttacacgaacattcttcagaagctgtgggaagatcttcacttcatctgcaagtgttccaagtgtctgcttcttctcaatgatcgcttccataaccataagagatgtcaggataccgtcacctgtacgtgcatgcttgctgaagatgatgtgtccggactgctctccaccaagaacatatccattcttaagcatgttctcataaacgtacttgtcaccaactgctgtctgctcatacttcataccaatcttatcgcatgctttataaagtcccaggttagacataattgttgtaacaactgtattgtctttcagttttccctgctccatgagatatttaccacatacatacataatgcggtctccgtctacaacatttccattctcatcaactgcgatacatctgtcagcatctccgtcataagcaaatccgatatccagatgtttctcttttacatactcctgcagaacttcgatatgtgtagaaccacagtttgtattaatattcacaccatttggctcattgttgattacataagtctttgctccaagtgcatcgaatacactctttgcaacgcttgacgcactaccattcgcacaatcaagtccaactctcatatccttgaaggaacgtgttgcaagagagatcagatgaccgatataacggtttcttcctgctgcatagtcaactgtgcggccaatgctctcttttgttgccagcgggatctcatcaatctccccatcgatataagcctcgatctttgcctcaacctcagcctccatcttatgaccttcgctgttgattaccttgataccattatcatagtatggattgtggctcgctgaaatcataagtccacagtcaaaatcctctgttcttactacatatgaaacacttggtgtggttgtcacatgaagaagataagcgtcagcgcctgatgctgtcagtcctgctgcaagtgcatactcaaacatatagctgcttcttcttgtatcttttccgattacgattctggccttgtggtcctgtccgaaataccatccaagataacgtcctactttaaatgcatgctctactgtaagaactacattcgcctcaccacggaaaccatctgttccaaaatattttcccataataatcttccttttctttcttgtgatacccttttgttatcagatctattcacaaatttactaccgtaaaacatatttttattatataagacatgctttacaagttattcctattatattacctttataaatcagatacaagcttttttctcttaacattcctcgttatgttactgttcacacgatgtgcgaccagcaacgcatctcgccattttaaatcgcctttggcgatggggcgagatgcattcaagccaaaacatgcatcctccgtgtcaatcagcgaagtgattgacacgggagtgaacatacaccacctttgtgcaagcaccggtggtttcagaccttttgaccctggtatcatattttatttcttcacacctgctgtcagtttaccgtccttcacatcgatcaagatcgtgtctccacgtcccacatctcctgcaaggatcagttttgcagctaatgtctctacattcttctgcaagtaacgtttcagtggtcttgcaccgtacatcggctcatatccaccttccacaacaaagtctttcgctgcatctgtcagctcgacactcagttcacgttcttccagacggcggttcacatcagcaaccagaaggtcaatgatggaacgtacatttgtctttgtcaatggtttgaacatgataatctcatccagacggttcagaaattccggtctgaaatgtgctttcagatcatccattaccatctcctgactctgttcatcgatcgaaccatcttctttaatgccttccagcagataatttgcaccaatgttggaagtcatgatcaagattgtattcttgaagtcaactgtacgtccttgggaatctgtgattcgtccatcatccagtacctgcagcaatacgttgaagacatccggatgtgctttctcgatctcatcgaaaagcacaacagaatatggttttcttctgactgcttctgtcagctgtccgccttcatcgtatccgacatatcccggaggagctccgatcagtctggacacggaatatttctccatgtactcactcatatcgatacgaaccatgttgttctcatcatcaaacaggctctgggcaagtgcctttgcaagctctgtcttacctacacctgtaggtccaaggaacaggaaggaaccgatcggttttgtcggatctttgatacctgctttggaacggatgattgcttcagttacaagctctacaccttcatcctgaccgatgacacgcttatgcagttcatctgcaaggtgaagagttttgtttctctcgctctcgttcagttttgcaaccgggatacctgtccatctggaaacgatttttgcaatctcatcatctgtaacggattcatgcacaagagaaagatcttttgcctttacctttgcctcttcctcttccagctgtttctgcagctgtggaaggcgaccatactgaagctctgctgccttattcagatcgtactctctctgagctttctgaatctccttgttcacctgctcgatctgctcacggatcttctgcacatgctctacggaattcttctcattctcccactgtactttcttacttgcatactgcgctttcagttctgccagttcttcctgcaaatgttccagacgctctttacttaagcgatcttcctctttcttaagtgcagactcttcaatctccatctgcatcacacgacggcgaagctcatcaagctctgtcggcatagaatcaagttctgtcttgatcaatgcacacgcctcgtcaacaaggtcgattgctttatccggcaggaaacgatcagaaatatatctgttcgaaagtgtaactgccgcaacaagcgcactatctgtgatcttaactccatggaagacttcgtatctctctttcagtcctctcaggatagagattgcatcctcaacggttggctcatctaccaagaccggctggaaacgacgctccaatgcagcatccttctcaatatactgacgatactcatccagtgttgttgcaccgatacaatgcagttcacctctggcaagcataggcttaagcatatttcctgcatccatcgcaccgtctgtcttaccggctccgacgatcgtatgaagttcatcgataaaaagaatgatctttccgtcactgttcttcacttcttccagaacggctttcagacgctcctcgaattcaccacgatacttcgctcctgctaccagtgctcccatatccagcgaaaagattgtcttatctttcaggccttccggtacatctccgctgacgattcgctgtgcaagtccttctacaaccgcagttttacctacaccaggttcaccgatcagcaccgggttattctttgtcttacgggacaggatacgaatcacattacggatctcttcatcacgtccgatgaccggatccagtttctgatctcttgctttctcaacaagatcctgaccgtatttattcaatgtatcataagttgcttccggattgtcagaagtaactctctgatttcctcttactgttgacagcgcatggaggaaaccctctctgctgatgccatattcacggaaaatctgcttcaactcacggcttgcatacttcagcattgcaagaaacagatgctcaacagagacatactcatctcccatctgctttgcttcatcttctgcatggatcagcacattattcaagtcctgaccgacataagcctgacctccctgtaccttcggtctcttgccgattgcctgctcgatactgttaataaagagctggccctgaatgttcatcttctcaaataattttaaaatcagactgtcatcctgtgtcagcagcgcatacagcaaatgctcctgcgccagttcctgattcccgttatccgcagcaatcttctcacagttctgaactgcctgtaatgaattctgtgtaaatttattgatattcatggtctttccctcctttgaaccacaaatttgcttttcctgtgttctattaggaatatagcacgtattgttagcactgtaaagggttgagtgctaattcttttctaaaaattttgtgaagtccttatttcatgggcttcacaaaattttaaatttacaattacactcaatttgtaatgatttagaccattctatcttggccatctctcttttttattcattaacggtttaaaagcctgatgcggttcactctgataccaatatgctacactggcaacatcatcctgtctttcaaatagtcctttataacatacaccgatctgctggatagtaacttttaaattttcttcaaagcaaatcggatccatcagatgccatctataaaatcctctcattggcggacaatcatcattatgatatggattatgcaccagttcatcgtgtgctgaataatacggatatcctaaaaatggagaattataagtctgttctaccgtctttccgtttacctggtgagcaaaactccatgacccgccaaaatagtcctctgttcccgtgccacatattgtaggatattcttcatctccgtcaatataaaatttaacttcgccttctccccaccagtatctttcaagtgttgtcagagcaagatatgtaccaatataatggccttttcctttcacattatccaaaataacataatcctttgccagttctgttattctttgacgtctccactgtgcatgaaaataagctgtgtcttctggtaactcatcatacaaacaatagtctacctgataaaagaaatcaggaattggattatcatgttgattttctaaagtaattcttgcttttttacgaaatggcatttgaaaatagctattaaaacctctgtttggaattacggatattggcatagatgtaacaagacattctcttgcaaaaccacagcagaagaaatcacctaaaggactttcaactgatggaacttcctcatcatcccagtacatgcggagtactaaatcacggagtacataacaatccgcatctgatgttttattattaaccgtaatccatatatgctgaataatacccggtccatccatttcagctaatactaccgtttcattcggcataatatttttcaagcacggactaccttttcttgaagggccaagatgacttgctgcaattccaccctttcctttttctccagttggattttcagcatttatagctctcgatcttccatttcttaatctgaaaatatctgacattattcacacctccacttattgcttaacgccgccagccataacaccttccatgatctgcttctcaaaaataagtacgaaaataactattggcagcaggataatacatccaactgtacttatcaaatcccatggcatactatatgatgtctcccttggaatagttgtaatagcaacactcaatacttctattttttgtgcaaaaaacaatggagtgaataaatcattaaggcaatttataaaattaatgattaatattgttgcaatagccggtttcattaaaggcaacgtgatataaaacagtttctgaaacatattcgctccatctatttctgctgcttcatctaatgaaataggaatttcacttaagaaattacctaaaatcaacatagtaaatggaatcaatgcacttgtatacatgatgatcaagccaggaaatgtgtcaactaatccaaatcttttcatcagatcatataacggtcttgctgttacaattcccggaattaaagcagatgccactatcgctgcatatacaagtgtaagtccttttcctgaataacgagtaaatgcataagctgccattaagcagataactgttgataagattaacgaacatacagtaataattgctgtatttaaaatcttctcacccaaattcatctgcgtgaaaattctaatataattatccagtgtaggatgttttggcagatagtgaatcggtgaactaaacagctcagaagcaggtgaaatagatgatgtaaaaatccaaagtaatggaagtaaaataataaaagcaactattaaaatcaagccccatttgaatatcggtgccaaaactttttttgtttttggtttcattgtcaacctctccctcctatattttaatcaaactttttgattgctctaagctgtataaaacttaaaattgtcataacaataaacaggcagacagctattgcagacgcatatccaagattcaaattagtaaaagcctcctgcataattcgatatgccaacaaagatgttgaatcccctggacctcctgatgtcatagcatatactaagtcaaaacttgtcaatcgccacattgtaaagaaaatagaaaggctcagtattgtcttcattatatttggcagtgtaattgagaaaaaagctcgtaccggtcctgctccatcaatttttgctgcctcataaatatctgctgataaaaactgtaatgcggcaagcaccaaaattgcaaagaaaggtaagtccttccataaatcaactgcaataactgctccttgagctgaatttgcatgcacaagccaatcataatgaaaattcggtacaaatcttctaatcaaatcattgattaatccatattgatcattaaacgcccatcttgcagcaagtcccgctactaccatgggcattgcccatggtataagtactattgtacgcaggaattttttacctttgatcttcatatttaacattaatgcaagaatcacacctaatactagatggaaaaacattgatacaaccgtaaatttcacagtaaatccgatagaagataataatttttgatcttcaaatattctaagataattttctaatcctataaattgaaagttattgccttttaataaactcatatcataagtactgtttataaaggtcatgataattggatagagcgtagtaaatgctcttacaatcactaccggaagtaccagaagccatgcaatccacaatccttttgtcttctttttcattgtccttacctcccgtaaaacacgtaaaacaatatattaattatttgactacatatgtatcaactgccttttgtgctttttcacaaaatgagtctaatgttaactcgtcagatacatactgctggaataaagatcccatctcactaataaactccatcgcctgcggtgccataggacgtgcaagaagttctgtattatccacgtactcttttatttcatctaaaccaggcaaatccattgctgctaattcatcactttccaacacgtctgttcttgccggaagtctggatgtcatttctgtataatcaagttctccctgctcacttgcagcatacttgaggaatttctgcgccgctgctttattttttgaagcactattcaaaacatatccccatgtagaaatataagctgccttattttcaaatgtcggcataggggcaatatgctgtttatccggaccatactttcctgaattaacaaaagactgtattgctcctacatacataaagatagaagcatattctccatcaaaaaatttctgcatcattggatcgtactgatctgccagctgagaaataggtgtctcttttttcttcatcatatcatacatgaattttacagcttcctgagttttaggatttgtccaatcgtagtagtctccaccaaacaaattcacaaatgttccgatagagttaaatacatatgttttttcccacgcatctccatatccgtatttaccgtccgatgaattagcttctacatatttttcaaaatcctcttttgtcttaatctcagtaagacctgcatttgccatcttttcctcatcaacccagaaagcaagaacatccataaagcaaggaactgaataaacattgtctcctaccattgtcatttcctgcatatatttctgtggaaaattttccatgatctccggtgtcatgacggtgtcttgaagcggttctagataacctgtatttttaaatccactcatcatttcatcattaattgtaacgacatcaatgctatcatcacctgaagataatatagttgttatttttgcctgacgatcatctgtatttgtcgggcatgcgattgtttcaatttccagtcccgttgcttcctccgctttatggatatattcatcaaaagcttttccataagttgtatcttgtgtcatcaaggtgattttgtttgaattctcgttctgcttaacctctgtgtttcctccggacttcccgcatccactaaaaagtccaacagacattgttgctataagtaatacactgactattctttttttcatttctttccctcctgcgttttaatatgcaacctaatatctacaactatttgttaatatcatcatagaaaataatgctttaaaaataaatatattattttgcgcatactttataatttttttatttttcaaatcaaattattgcgttttattatttcttttattagaatgaagctgaaaggagcggttccataatatgaagctatttacgtcactaatcaatactataaaagaacactttcgcttaaaactaatcatttgctttattctttgcgccatacttccccttcttatattgggaacaatatcttataaaatatcttataatatagctaaagacaagattctgaaagaaacagcaatttcttgtgaaaaaaatcagcacctgcttgaaaatcgaatgactcaaatagaaaatttagaagattctattcattttaatttatgtatgttatgtacaacagcagaacaacctatgtcaaattatctcgacaaactttctgcggttcggaataatattgcttcaatagctgattcttttaatatttatcatgtaaatatctttttacctgatgatagttttgcttcaaaagaagggcttactttctgttctttatcagaccttaaaaaatataaggtacagttgagcgatttttcaaaacaggggcttactcctaattggatttttcgcaaagacattaacttcccttatatggtcagcaaaggtgaagaaccttccggagtactctcctgctataggtatgcaaaaatcaattcacaaaaaacttgtttggctgttcacataacaagtgaagaattaagcaactacttaaacacattttctgaaggcaatccttctctttcttatataataaattccgagggtgttgtattatcaagcacagataagaaacaaattgggggttctttatccaatgaaaaacttcatgcaatcacacaaaacttgagactctcacatttctcatatgataaatgtgagataatttccacaccggtacataaccagctatttcttgttactgaaactcctgattattatatacgccaaagttcatcctttctcgtaaaaatgattttcatttgtttcatgattattgtccctctgactatgctctcaattatctgggtggctgatcaaatgacaaataaaatcaatcatttgtctcattctatgtcggaaatcaaaatggacgatgtcatagattcgacgcagatcgacaagttagttccatcttcttcaactcacttggatgaaatagattcactaaccgtcacctgtgctaatatgatttcagaattgaattcaagctttgagaataaccttcaattaaaaatacaagaggaaaaactaaattatcagttgctgcaatcacaaatcaatcctcatttcctatataatattttagcatctgttcaaaatttgttgtcatttggtgaaatcacgaaagcgaataaaatgcttgctgatttatcgcttttttataaaggattgttacgcacctccaatgatctgattcctattaaaaaagaattagaaattgcacaattatatatggaaatggaagcattatgtaaagataatttatttgattggaatatagatatggaagaaggaatagaaaactttcttatttgtaagttcacactacagcctatattggaaaattcgattcaacatggttttaaaggaaatggaatccatatgcatatcgatatttctattagatatgatgatgatatgatagaaatcatgattgctgataatggaattggtatgtctcctgagaaactaaatgaactccgtgaaggtattgtttccaaacaaattcactacgaaaaacatttcggtataagtaacattaattcacgtatatgttcctctttacagggacatggtacactcagagttgaaagcaacaaagatactggaaccacaatttatataagaattccgcaattactggaggactactaatgtacaaaattatgattatagatgacaaccatatatctgttgatggtatttgccacaacattgactggtctgatttaaatgcagaagtcgcttgcaaagcctatgatggacagcaggctcttgattatctgcaaaataatatggttgatttaattatttccgatatagaaatgccacaattagacggtttatctcttgcacaaaatgcactaaagattaattcatctataaaaataatacttatcagtgcatttgataaatttgaatatgccaaacaagctatacgactcggtgcatttgactatatagaaaaaccgcttgattattcttatctaaagaaaatcattcgcaatgctcttagtatgcttaataaagaacagaggaatcttgaaatattaaaacaaagccgccctataatgatcgataatttttttcataaattaatacaatcttcaagtgatgaagctcgatatacactttcaaattatgccgattatcttcagttgaatcttgactatcattattatcaggccattgtaattcaaatacaaaatgcaacagacatcaaagaaaaaaaaggcattgaagagtatcacataaaactaatgagtatgtctgataccataaaagaacttttcaatgagcacttttcactgattcatactttaacaagttttgacgaaatcgtattggtgattgctcacaattattctaatcagaaatacttctataatgcatcttatgaactgttaacagaattattgcaactttataaaaacagctttttcgaattaaatatcggaataggaaacatcgtcaaatacttgtggactttatctgtttcgtattccaatgcattaaagtcactggaataccgttttttctttccacagaaaaacatatttacactgggtgatactatagacaacgattactctgctgaattatatgaagtttccggtcatgaaaagttaatacagcttttatgcgaaaatgacctggacggagtagaaaagtggattctttcattttcagaagaattaacacaaaactacaaaaacaaacaatttatatttatacgtatctatcagcttttgggacatttactaaaatttctctgcgatatgggcattagaagcaatgacatggaaaaagacattattaaaacctatcaacaccttgactctttttcaacaagtactgagatcttccaatggctttctagtttatgccagacaatatctgataaaattaatctttcagcacagagtcgtcaagaacatgtttgtactgctactatcaattatatacaccaacattatcaagacaacaccttatgtctaaatgaaattgctaacaatgttcatattagtctggctcatcttagtgctctgttcaaaaaacaacgccagcaaaatatttcggatgtaatcacagatattcggattgaaacggcctgtaatctattgaaaaatacgaacctttcactaaaagaaataagtgcgaaagtaggatattcaaatcaatactacttcagttcttgttttaaaaagaaaaccggacagacaccttcatcctatagatagtagaatttatatacttttttttattgtttatcagtgttataatctataattgtttcataaaaatacggttgctgacgcccaaagcgccgacaataacaaaaaacttaagagaggaaactatcatgaattttattcagaaaaatttcaaaggaattctggtctgctttctgattgcgattccatcctggctgattggaaaagcatttccggtaatcggcggacctgtcattgcgattctcgccggaatggtgattacctgcttttggactgaaaaaggaacagccgaatcaggaattaaatggacatctaaaattattttacagactgctgttgttctgcttggattcggcatgaatctcggagttatcttacaaacaggaaagcagtctcttcctattatcatcagtacaatttctacctctttgatcattgcatggctgctccgcaaggtactgaatgttccttccaacacatctatccttgttggtgtcggttcttccatctgcggtggttctgcgattgctgctacagcgcctgtcattgacgccgatgacacagaagtcgcacaggcgatttctgttatctttttcttcaatgttatcgctgctgtacttttcccggtgcttggaaatgcactcggcttcgacacaacaagcggaaatgctttcggtgtctttgccggaactgcgatcaatgatacttcatccgtaactgctgccgcctctacctgggacagcatgtggaatcttggaagtgagacacttaatactgctgtcacagttaaactgacacgtacgcttgcaatcattccgatcacacttgtgctctcactgattcgtgcgaaatcagccgcaaaagacggaaaatcatccggtaagttcagcttaaaaagagcatttccaatgttcatcctgtactttatcattgctgctgtcattacaactgtatgcatgagccttggggtaagtgcggatgtatttgctccgctgaaagaactgtctaagttcttcattatcatggctatggctgcgatcggtctgaacagcaatgttgtgaagcttgtcaaatctggtggaaagccaatccttctcggtgcttcctgctgggttggtattacagtagtcagccttgcaatgcaacacatcatgcatatatggtaaaatattgacaagatcgaaatccaaagtttctattcctgatacaataaggactttggatttcttattgctttttcctttacacgagatgtataatcttctttgactttaaaactatttaggagaaaatcgttatggacatgaaatcaacttctcaggcgatggagactgaaaagattccgcgccttctggcacagcttgcaattcctgcggttgtcgcccagatcatcaatcttctatataacattgtagatcgaatctatatcggacacatttccggtgttggagccgcggcattaaccggcgttggattatttacaccgatccttatgctgatcaacgcttttgctatgcttgcaggttccggtggtgctccgcgtgctgcgatatctatgggaaagaaagataataaaacagctgaaaaaatccttggaaactgttttgcacttctcatccttatggctgtcatacttactgtagttttctttacatttgcaccacagctgttgacactttttggagccagcgagaagacactgccgtacggagtagcatacgcaagaatctatatccttggaagtgtctttgtcttaatcgtgatgggaatgaatccatttattacaacacagggatttgccaagatcagtatgatgactactgtgatcggagctgtgatcaatatcattcttgatccgatttttatcttcgtattcaatcttggtgtaagaggtgccgcacttgccactgttttaagtcaggctgtcggtgcaatttggattcttcgtttcttatccgggaagaagacgatccttcatcttagaaaagaaaatttcagattacaaaaggatgttatcttaccatgccttgcacttggtatttccacttttgtcatgctttctacagaaagtattctctccatcagctttacttccagtctgtcaagatatggtggagaccttgctgtcggagccatgacgatcattacaagtgtcagccagcttgccacgctgccactgcagggaatctgccagggcggtcagccgatcatgagttataacttcggtgccggcaataaagagcgagtaaaaaaagccttctttacacaatttaaggtttgtacgattttcaccagctgtttctggctgatcatgctgctgtttcctaagctgtttgcaggaatcttttccaacaatacggatctgatcacttataccgcatgggcgctgagaatctatatggcaggtattttctccctcggattccaggttgcatgtcagcaaagtttcatggcattgggacaggcaaaggtcagtctgctgctcgcctgcttaagaaaactgatcttgctgattccgctgatctttatcctgccagtctttattcaggataaggtttttgcagtctttcttgcagaaccgatcagtgatattgttgcagccacaatcacaacaatcacattcatgagccgctttaatggaattctgaataaaggcagtaaaatgaaaaccgtagaataaattttatctaactattcttttgactccatttcatgatataattaatttatctgaaatttatgaaacggagccgttaatatatgaaaaagctaaaacttttatggatgatcctaaaacgcacgaaagcaacccagattctttccggttatatcgtatttctctttgtatccgcagccatcattcaactggtagagcctgacatcaaccactatggagatgccctctggtattgctatgcgatactttctaccgccgggttcggcgatattgttgccataactttcattggcaaactggtttcggtacttgtcacaatctacacgatcttcgttgttgcaatcgttaccggtgttgttgtcaattattacggacagattgtagagatgcagcgtcgtgaaacggcagtgatgttcctggataaattagaacgtctcccggaactttccaaagaagaactggaagacatctcaaaaagggtaaaaaaattccgctgagttttcactcaacggaatttttgtttcccacttttctcttatcaaataaggataggcatttgctgcctgctgccgcagccacaaaaatccatacgaacaatttcactggatagcatagaaatagaagcattgtaacggctaacggctttttcatcgttccacctagaagcgccgctgtaacaattgcagatgcgaaaactagatgactctctgcatttccgcagatcagcattcccacgccatatcccatgcatacacctgcgaagataaccgggaagaaatgtcctcccttcaaaccgaactgtatacaaatatttgtgagaagcactttcaaaaatgcaactccgatcagtgctaacggaaggtattgactatactctttcatcaacactcccatctgttcttctcccgaaaacataactgccgggattaacattccacagattccaagacaaattcctgcgagaacttctcgaagaactgccggtacctttttcgcagttttcttcgttatctgatgtgtcttttcataaaaaacagctaacacgcatcctgcaataatatagagaagtattaatgcatagtccatctttccgatctcaactgcctcaaagcttggaaaaccggaaagtcctgaaccgaatactgcggaaagtcctgcataaatacctgttgcagcagcaattgcgattccataaataaatatctttgatgaaattcctgccggaacaacagtttgttctgaattattctcttctaaagtgttttcttccacttcaaacaatccaaatagcggagcatggaataaaacacttaaggatgctgctaccccgatctgggagtattccttcgcatgctgtctggcaaacttcagattatctcctgcccagtaacacattccaacgataattccggtaagcccggcttccggtcctacactgcttccgatcaaaagtggtagcactgctgcgatcatcatgacaagcatatttttataatcataatgcttttccgttttcacttttgccataacagtttccatttcctccggataatctccgaacatcttccggaagacaccgacaaaaaatgcaccgatcacacagaccactatcgtatagtatggtaatgaaaaatgttccggaacccattcccagataagattcattccgactgccatgatcttcaaaagtgcccagaccaatccaccggcaactgcaccgataattgcacagaacagccagagctctaactggttttttatctttatatttctaatttctttttgactgttcatcaatctgtcctttacgttctctatttttcagatacttctgcatccgtatctctcacctgtggaattaaggaagctgccagttttccttttccacgatgtttcaaatataaaattccaatcacagaaaatacaacggctccgacaaaattcaccataagatctttcattgtatctacgattccaatgtctaaatatccacccagattccaagtctcaccgttgatcacaacagactgaacatctacatggattgggatatttgctcctgtcggattcagcttcactgaattgattgccggaacgatccagtctttctgcatatccagtccgaagaaccaatccatactgaattcaaagaactcccacaaaacaccaactgtcattgaaaaacaaaatgcaaaaaatgccacaaagtatggggacatcttaattgagaatcgatcacttcggttgaataaatcaatcagtgcaaacccgattgccgccatcaggaatccattcgttgtatgcaaaatggtatcccataccggaatctttacataaaatgcattgatctctccaagtatctctgctgaaaagataaaaatcagaataaccgtttccagaccaaccggaattgtcactccaagtttcttgtcgataaactgtggcaccataaacaaaatcaatgttagaattccaagaaacatattgtgatagtttcctaaaaagaattgtctgataatggagacaataaccaacattgtcagtaccatctggacccttgttctatttcttgcttttttacttaattcactcatttctcactctccttttctctcaacacattgcggtcagaaacactttttattacatgtttaagatataccgcatctgttttcataatatactaattttatctttttttcaacaaaaggtgtcaggccgaagtttaaaataacagcttccacatatgcctgacacctttctatctatcgtttatagattcactttaattttacttctattttcttcttctaataacataaatcattccaccgatcactgcaattgatcctgcaatcatcagaatccagatgtaactgatgctgtcccctgtctttgctgttttcacctgttttcctgacactgaagttcctgttggtttctttcctgcagtacctgtcggtgtttcctttgaatcggttggattctttgtttcttctttcttcacaatctgatactctatctgatagtctgtatcctctccgtgaagcacataattatcactctgttcaccaatcattccgacaatggtggctgtatatgttccggtcttgatttcatttccaccttctacaaccgccttgcagtcatcttcgaataatacccctgtaaattctgcagacacatttgcttctttccctgtataaatcacagttccgtccgtattccatgcaacgcccagaggttttggctgtacctgcagtgtccctggtttaaacagtactgcgtaattcgcattatctgctgtcagcggagttttttctgtaatatcataaagaccgaccttacagttttctttttctgcatctcctgcggtcaatgtgacatttattttcagatcctctatctgatcatctcctgccagacttccctcactgattgaccaggtatactctgtgattgtctgtccatattctttctccgtacggtccggtctgatcgtaatgcttctcggttttactgttacagaaatatttgacgtaactgtcttgtagttcggattagccggtgtgaagatcatctcttgttcactttgatcctctgctactgtaagcattgtcgtatcgtctgcaaaacggaatacaccttctcccgactgactggaaagtgttgctttctttaagcggtctccataaatcacttctgctgccgggaaagtcacttccggatctgcctgcaaaatctcatattcccatacatgcacgcggtttgtgccggaaaagatatagttttcattggtcagccctattgcaagtgccttgtaatttccaacttctgtatgatctgcattgagcagttttttaatcgcacaactatccttttctaaaaggctgtctgctttcacgtttgcttctattccacatgcatttcctgtatatgtatactgtgatgccgcattccattctatctctgcttcctttggtgatacattaaggaatgccggaagaactacaacatcataattcgtatttgtcgcattatctttcaggataacatatcttcctgcatttccatatgcgccaagaatgtcatctccatctgcatctgttgtgcttcctgtcagaatatcttccggtttaattgttgttgctttcaatgtcagtccaagactttcaacggtatcacccggaagaagtttcgccctttctgaatcactgatcgtaaatgtaagatctgcgctggtcaactcatctccatatgtctttgttttcttttctgcacggacaatgattctctgtgcactactgactgctccattttcgaatgtagtattttctgctgtgctgcttttggaacctgttgtttccattgtgttcactggattgatatcaagatcgtattctttcaaatgaatccagtttaccttgaatccgcctactgtttccggacaatcaatcttatagcttcctgcatcgattatctcatttaatgactgtcctgtctcctggattctcatttcatccgtaacatttgcaaaaagttcttccacttcatctgcgctcagtgtttccgttggtgcaacaacgtatgacatcttcggagtttcaccataggaaatttcttcatatccgagatacgctgtgatcacttctgacttattcactgtttttaccggaacccacatagtaacatttttgtattttttattatctgccggcaggaaggtcaattcaaattttgtctgatctgttacttcctgatctgttacaacatgggttgcatcttcaaacttccatgttcctgccggtgcattttcaatccccttcaatgtagcttctgccagtgtctgaccatattcaacctctacttccggtgtaggaagttttggttcaaatatcatgttgctgtttgtctcatagatcaaccgtgacattggttcatcaataaagttaagcattactgttccaaggaatcggttatcgatacaattctccttatctttatataaatccgaattgatatctcttgtcatattcaacggaattccatttgcacaggaagtataattaaatacccatgaattagaatcaattggatgacttgtatctattcctgttgtctgtttcattgttcctgctatatattcccacttctttgaataaatatcacagtcatatgtattatatgcatcctggatatacactcgattttttccatcatcatatgttttatatgcatacttataatctctataactcacatcatcccaattggtaagatcaagtcccattgcacgcgtctgccaggcttcataattttgagttaatttaaatcttcggataagtacaatttttccacgagcttccttcattgatggaatgtctccctcagtgtacactttatcctgatgatttttcacaaattctgcaactgcatgctccattcctactgtagaaccatcatccggttttatcgtaagaataattgtttctgaaggatgtttttccaaaaaagcaagtgatgtattaaagattgactgtaatgtaagatcacttccgtctttttcctgacactgccatgtatcgcctccatgtataatcttcacgtctgccgcagaagcatcgtcttttgttgcatttccacgaatatcaaaactacgtgctcccacattcaactgctcatcataataaagattctgacaagatgtgagtgataaacttgcaacaaggtcttgtacaacccctgctgttcctgtatcatgtgttgccggaatatttacagaagataatagtgcatcatctggaatatctgccatccattcatctgcgtaaccgtaagccgtatcatttgtacttcctgccaaaattgacacattcatagccgtcgctgtatgaccaatccatgtctcgccaatcccctcttttagatacataccgcttctggcattcatgattttatatgttccatcatcctgtctaaagaagcgccacaattggctggtattttgatttctgtcaaaactttccttattccagatatgtactattgtatttgcacaacctgattctcccagaacatctatcgcataattggtatctttctctccatccgatatagcttcaattctatatgcctgatagtctggataccaaaccagtttccatttactggcgatcccctgttctagaaaaagtaactgtgttcctgggagtgactcatttgaaggcctgtttattgcttcatgtgtttctgctttatagatttcagaaactacacttttatctccatcttttaaaatctgagtttcctttcctgtgagcggaaccaccgattttgtaaccagccagacttttctatctttttcttctgtctgaataatattaggattattattattcaaatttcctgagtatccaagccatcttccactttttctattctttatataatatcttttatttccgtttgcatcatttccaagataataaaatgcaaattgacgatgctcttttcctttgactttctcatcattactttcccatacatgtatctttgcaccgctatctttactttcatcttctacatctgcgaaacgatctgttccattcaccttaatgtgtttaattccataccatccgttttctattttatccagacgaaaacggcaattaccgccttctccggtatccaaatgtacatcgcttcctttctcgccactgtcatttacattccaacgataatctgtattttcttccaatgtaataaataattcactgttcgtctccatatttgtgtccagcgttccactggaatctgccgcttttacactgattggaatccccgtaagtgctatcgtcatacatatgagcgctgccattatcctttttattgttttcatatccgtttttcctcctcatttgtattttgctatattatcggcaatcatatttcttattattatatttttgataccagattgttcaatatttttgacatgaactgtctgaaaatggcacgaatcgtcattctgtggtatactaatcctatgtcaaaacgtttgtatttaatatgaactgtgcaaacctgcacgacaacactttatggattatctatttcaaaaggggggattttgatgcggactttaattttccagactttggaatttacagttttgattcctggtatgctgcttgcctatctgccggtaagatcatctctgaaacaaacacctaagaagctggctgtctggatgctcccgcttcttattatatgctcttgtttttgtggttttgcatgctatagattccatttgtcaacaagatctgttcttcttcctcttctatttgttctacttgttctatatcataacactttgttaatttcactttggaaatctgtcagcatctatcttgccgtctgtgcagttttttcctgctttaacagcctttccagagctgcttctgcaatgttgaattttggttctggacaccttgcattttccggtttttctacttttggaatcctgtataatcttttctgcattcttttcgtccttctcgtatggtatccagcctcccattcagtcaaagaaatagtagaagatgaaaatcttgctccgacctggtatgttttctggattctcccggttctggtcatcggattgaaccttgctttgattccaaaatataacaccgtcctgcacacgcagcgttttctccgcggatacattgtgattgtttatgctcttctactcatccttgcattattttactcgatgtttttaatgatggctaatatcctgaataaaaacaaaaaacttcagcaggaaaatctttttctttctgtacagcaggaacgatatgagaatttaagaagtgcgattgaagatgccagacaggctcgacatgatattcgtcatcattttatacaactttccaccatggccaaagacggtgatttagaaaagatcaaagaatacctgcaaaatgcaatggataaaattccaaaccttacttatcacttctgtgaaaatcagtctgtcgataacgtgattggatattattatgcgcttgcccaaaaagaagaaattccatttgctgcccgtgttgatcttccaaaagaactttccgtagatgaaatggatctctgtcttattctttccaatctattagaaaatgcattggaagccagtcgcaaaactaccgctgcgcagcagcagatatcgttggaaatctatcaacattctgcttctattcttttaatccgggtagaaaataattttgacggaacgatcaaagaaaagaaccatctgttccattccaccaagcggaaaggtctgggaatcggtacccagtctgtccgcagaatggcagaaaagaacgatggttcttgtaattttacttatgaagatggagtctttaccgcaaaggttatgcttcgcgctgacctttaaaaggctatgctttctttcttcctcttactgctgccacgatcatgcaaagaaggattgtcaaaaccatatccggaagtgtatttccaagcagcatatcaatattcatcagaacacggtataaaatgaagccggccagccagatcaacagattacaccaatcgaatcctgtttccgattttttctttttcagaataaagaaatctgcaatctgcactgcgatcattggcgcaaatacagagccgatcagatacaggaaatctgtgatatcgtccatcggatagacaattgctccgatggtaccgatcactgttacaactacagcaacgtattttcctttaagtcctgcaaagatggattcacttgaaattcctgctgaataagcatccaggaaagtggttgtaactgttgaaaatacaatgatcagaagacctgcgattccaagtcctgcttttaccatgatctgtgcgatatcactttctcctgtgaacaatgcagcacccattccgaccagatacataaaacagcttacaactccataaacaactgtactgactgcggttgccttcacaggatctttcgcctctcttgtataatcactgatcaacggaagccaggacaatggcattgcaaccgcaagttctactgctgctccaaaggaaaatgtctcatcggtaatggatgtaactacagttccatcaaagaaaataatcttaaaaagaatcaatgtaagaataaaaagtgctgccatcgcaactgtatttacctttccaagattcgtaattccgatcagaatccatacaatgatcaatgcacctattaccagacaccatacccagtgtcccactgtaaagatgcctcctgctgccagtgctccatcatagatcataattgcagtccatccgacaagctgaagcacattcaggattgcgaaaagctgtcctccatgacttccaaagctgtcttttactgtctccatggcactttttcttgtcttacctccaatcactccagccagaaacaacatgatacatccaatcacatgtcctaccagaatggctgccagccctctgccaaatccaagagctacaaaatatgtccctgtaagaatctcagcaatggagactcctgctccaaaccagattaatccgttctcaaataatgatgttcttttttccatagtttatgcctctgcttcttttgtatattcattctggatagcaaatccatgatccattggaccgcttcccttcccaaggtcaagcattgctgcaagtgccccagagatatactctttcgcacgctccacagactcctccaatgagaatccttttgcaagattagaagcaatcgcagaagacaatgtacaacctgtaccatgagtattcggattatcaattctttttccgttaaaccatcgatacgctccatctgcatacagcagatcattcgcatcatttaagttatgtccacccttgcagagtactgcacagtgatatttttctgaaatttctttcgccgcatcgatcatctcttctgcacttgtgatctttcttccgatcaactcctctgcctccggaatattcggagtcagtacacttgcaagcgggaataattcttccttcaatgtatccgccgcatcatcactgatcagcttcgctccgcttgttgctaccataacaggatctactacaatattctttgcttcatactgacgcagcttcgctgcaataactttgatcagttctttatctgaaaccatcccgatctttacggcatccggatagatatctgtaaagatactgtcaagctcctgtcctaaaaattccggtgttgcatttaatatagaagtaacacctgttgtattctgcgctgtcaatgcagtaatcgcactcattgcatatactccattggtgatcattgtcttgatatcagcctggattcctgcgcctccgctagagtcacttccggcgattgtaattgctgttttcatgttcttggcctccttcttttttaaaaacgggtacaaaaaaagcgggtgatgggaatcgaacccacgtatccagcttggaaggctggtgtttcagatgtcagtaccaccatgaatgtctatgcacactctacaagaaaagccaagcgggaatctgcaaggttacttgataaagtggcaggcaatgactaaataaaactttcccttatttcccttacaattatctcataagggcaaaaataagggaaaatacatatcattccactaatgaatgggctggaatgtctgtaaaattgggaaagttagccagatatttcggcaaacttgaagttagcgatttctttttccggtattctctgtcccacggatttcctcatgatagaaataatctacgatcaccggatgcccctgcgggactctgccataaggcatttcattatccacaaaggcacaatcatacttcttagccattttctcagcttttacttcaagtgcttcaaagtaactgcggttatgcttgttatagatctcatcgtaaagtggtacaagatcaggatattttccggcaatataatccataattgtctttttgaaaccgcctcgaagattgagattttcgagccagaacagatcgcactgatcctttacccgctcaaagattgcttcaaaattcgtgataccggggaataccggggatacgaaacaaactgtacggatacctgcctcatatacctgcttcatagcagcgatacggtgctcaatgctcgaagcagaatccatatcgttcttgaaattttcatctagtgtgttgatcgaccatgaaacggttacacgtccaagcttcttcaacagatcaatatcccgtaccacaagatccgactttgtgcagatcagaatatctgcgtcactgccgatcagctgctccagaagttttctggtattcccgaattgctcctcctgtggattgtagccatctgtcacagaaccgatgaccacccgctgtccgacatatttcttcggatttttaatttccggccaatgcttcacatcaaggaaagtgccccattcctccttgtgcccggtaaagcgcttcataaaagaagcatagcaatacttgcaggcatgtgtacagcccacatagggattgaccgagtaaccgcctaccggtagactagacttagtcatgatgttctttgtttccacctcacgaatgaggattccatttattacttcttccatgatttctgtacctctaacactttattaaattcttccggcatttcctgaatcatattttcatcccctatgatagggacaagatcttccttcataaacaccggaatgccgagcttatgtgcctggtccgtcagagaccatgcccattccggctccgtatgaatcttcctactctgagctccggtcatggtgccgacaacgatccaattgattccggaaaggtcaactgtgccgggatcatcgaataacggctcaaaggtaacatggtaatgttttgctctgacgtttttccgcagggcgtcaatacgccaccgttctgctttcctcgtcaccgtaacgccaaaccatgcgttttccagatcggtatcaaaatccagcaaatcaggtcgcttggtaaggaacaggaactgatgctgtggattttcacggatctttgcaaatacctcgtctctccattccggcttccatccagagagatcgctcatgccggtaagaagaaagttctgcggacgtttcttttccatcatcttgagcttacccggaaagaattcagggtcagcgaaatcatcaatcatatgccagcgtttcacgttgttgcgggcatagcaatatgtacaccccactgtgcagccaatgacgatattcatgttctgaatctgatctttgatacaaatactcatgacttctgccactcctcaagattctttctgatgcggtcgaggcattcctcaaaccggataatttcttcctctgaaaaacctttgtagtaaatactgcccatctcatcagatacagaatcgtactcaccctttaaggcatgtgctttctcagtcagaaacaggagtgttttccttttgtccgtttcagactgaacacggcttatcagcccttgattttccattctttccagcatcgtagtaagagatgttatcgctaatccgcatttagtcgagagtgacctaattgagataccatcctcctgccacagcacataaagaatacgtccctgggctccattaaacgcatcaatattcttttcactgagaatcttctcaaaaatccggtctccaagctgttttatttttgtgacaagaaatcctccattcatttccatacaaaagctcctatatagtagtttattaaaaacatactatataggagctttattgtcaagagtttatatgtcttaataggtaaattccgttttttcaattctccaaactgcaatttatataattatccctctaactttcccattttacaggctttcccgcctgtccattagtaaaatgatatgtagtttcccttgtttttgcccttatgagataatcacaagggaaataagggaaattttttagtcattgcccaccactttatcaagaagccgaaccgattttcgtttcgcatctcttgtggagtgagcatagacgttcattgtggtactgacatctgagtgtcccaacaattcctgcacatcttttggggcagctccatttgctaaaaggttgcttgtataggtgtgacgtaactggtggaaatgaaagccttcaaatccctctaatgtttttgctacctttctgcataccgttcccaaagtagtcggaagttccagacagccatcaggtcttaagcagacgaaagaaatttctttataatctgccgggacttcctctgttctgtctaagcaataatactcgtagtacactctgtttttctctttgacctctttgtagtagttcgtgtgataaagttctccatactgcattcgattttttaactgctctttccgggcattacggaaaatctctaccagcgtatctccaaaatcaacaatcctcacttttttccgcttagttggtccgatgatatatttgcgctttgagccatcatatcggatgctgcgtcttatggtaaggcattgttcttccagatttacgtcctgccatgccaaaccacaagcttctccaatacgaagcccggcataataggctatctggattggaagtattgcggctgggttctttttttgaagatacgcaagcagtctttcataatcttctcgtgaaattggttggatatttccgtccatgtcctcatccgaaaacaaatcaacttcgtccgtctgataccgcagtttaatatactgcatgggattgaacgtaatatactgttttggaaatactgcaaagcggaaggactgctgcatgactgcggaaaaagaatggatgtaatctttgctgtaaccctttctctcttttccatcgggatgaactcccccaaaggaaagcaaatcaaagaaggattgcaaatgctcagaggttacattttttaatttccgttctgccaatgggtgtttcttaatatttcggattgttccgaggtaattctccacagtaccattgctgagcgtacctgtttttaattcctcctctgcccacacatccagaagttgtccgactgtgagattttccgctttggcaacaaatttctttttctcataatcatccattgcctgacggagcagcttttcagtttcacttttgctttctgttccaacgcattctttctgaacaagattgccgcttgcgtcctctacatagaagcggtagtaccatttctttcctttttttcttacagatccttttgtcagatgtcagtaccaccatgaatgtctatgcacactctacaagaaaagccaagcaggaatccgcaaagttacttgataaagtggcaggcaacgactaaatgaaactttcccttatttcccttacgattatctcataagggcaaaaataagggaaaatacatatcatttcactaatgaatggactggaaagcctgtaaaatagggaaagttagaaagacatttcggcaaacttgaatttggaacgtgctttataaattttttccgattccctcaagttcgttcatggaatccttgtttttttcaagttcatctctggctgttgcgtaatatgattttttgaaaagcatatcccatgaaagatattttgccatacagtcaaactgcttatcaatcaactcatactggatactgtctacgggagaaccgcctacaacaatcgtgccaacttttttattttttaactgcaatccacggcagtagcacttatcaatgataagtttcaattgtgctgacattccccaccaataaactggtgtagcaaaaagaatcatatctgcggcagcaattttatcaattgtaggatttgtatcatccttatcgacgcatcccttagagcattgacagacatcacatcccttgcatggtgcaatgttgagtttgtcaggttcaatgatttcaatttcattcttttctgatgctccttttataaatgcattgattgctgtcaacgtgtttccttttctggcacttccattaatgattacaattttcatgcgtgtatcctccaacttccgatttgtaaaacacattcttttttacataggcacagtataccacatttcctgtgcctatgctatatcatttaatgcttcttccgatatgaactcatcctctccacagaaacctccggatagaagtaagtaagaatcgttgctttcggaactcctgcagccaatgctttcttcacttcctctttctgctctacttcatcctgcatggagaatcttctgcttaattccgcatcaccaagcaccataaactgctcataggtaagagaatctatatacacattctcgcccttatccttcagtttttcataatacttttacaaactccactgcgttttttatatcttcttcatctggatgccctttggcaataccacccaccagtttaaatggaccaaatgtgtcatagcccttgcatccaaattttcctatcactttagaacgcttcttgtccaaaatctgctctatggatttgtaattcgcacttccaccataagtacagatcagaaatacctttttatcgtccggtagattcttctctgcaaattccaatatcgactgatgaaattttgaaaaatagattcctgatgcaaacccaattatatcataactactcagatctgcatctggctgttttacagcatcaatcaaatcaacttggcactcttctgctatgttttttactaatttttctgtatttccatgatgtacagatgcatatacgattgcttttctcatttattttcctttctgcctactccatcaccacaaatcgtattgtttcatagtctctgcatttcgatattcatgtttctcataatatcctattaactttccctcatctctgagtgccaccatataaacatccttattctgtttctcattgtgaaaagtataaacgatattatggctttcatctactgcaaaccagtccactacctgctgtattctatcccttgattccggattatgacaatctaacagacttcttccaataagtttatcgccgcctcgcttcgcatagctgataacagctgccggattcatgtaaataatctcatgtttaagattgcatataacaacggatgccctgtcctgatcaacaatgctcttataaaaactgaccatatctatctttttatatatttttttcttcttacttttctccatttatgttgtccttaaaacttcactacttccggttcatgtgtaaatgatgaaaatgtagctgtcgcatttttaaaatagaatacctctgtatttccatcatctaccgagtacatattctgtaaagatggataagcatcaagcatagactgtcttgcttctcttctgtcatcttctacaagttctccggctacacgaagccactctccattcttaaatgcacagatttccacctttgggtttgcgtgaatctgttttgaaacatctttcacctttccggtctgaatatacagttttccttcaaaaacatgcgctgttccaaaaggtctaactcttggctggtctccttccactgttgccaaataatatgtctctgcttcttttaaaaaatttactactcgttccattgtataaacctcctgctattaaaatctatcaataatagaattataccattccatcgcttcttatgcactaatcaatcgtatcataaaacccctgtttcacatcattccagatgtaaaccaggggtttctcttatatcattctataccatagacagtgcatatactatctattcacttttactccgtctcataaaagactttcttatccagagctttattctgatgtgcaacgattgttgtacatacggcatcacctgtgatattaacagctgttcttgtcatatcaaggatacggtcaatacccatgatcagtccgattgcctcaaccggaagtccgacagagttaaataccattgtcagtgtaaccagaccaacacttggtactccggctgttccgacagatgccagtgttgctgttccgataactgtaatatagtctgccatactcagatggattccgaatgcctgtgctgcgaacacaactgcaacaccctgcatgatggaagtaccatccatgttgattgttgctccaagcggaatcgtaaaggaagaaatcttcttggaaactccgactttcttagaaagtgtttcaatagaaagcgggattgtcgcatttgatgtcgctgtagagaatgcaaatgccataaccgggaagaatttcttgatgaagcggatcgggttcagtcctgtgaaaatctttaacagaatctgatatactcccagacactggatcgcaagtgccaaaagtactgcgatcatgtattttgccagcggaacaaatgcactgaatccgattgtagcaaaagtacggctgatcaggcagaatacaccgattggtgcaaggctcatgatcatcattgtcatttccatcataatgtcattgaactggctgaagaagttcgcaactgtctctgcacgttcacccatcttcgcaaggataacaccaatgatcagcgcaaatacgataacctgaagcattgttccacttgccagggaattgatcgggttatccggaatgatatttaggattgtatctgtcagggaagttgcttccattgtctcaactgtagacgcacttgtcttgattgcactcatatcaagtccgatacccggattgatcagattaccaactgataaagcaactgttacagcaagagctgttgttgcgaggtagaataccaatgttctgacacctactgttccgagcttcttcgtatctccgattgccatacttccgcacacaagggaacaaaatacaagcggtacaacaagcatcttcatcagacggatgaatccctgtccgatcacatagaggattccttctacaataatatcattttttaccttgctgtctggaatcagataacaaagtacaattccaaaaacagcacctaaaagcagagcaatgaaaatcttggtcgtcagaccaattttcttctctttcttttcatctttcacattcttatttttcattctaattctccgttctttctttcatatactcttctaatgactctttccaatccggcatatcatacatatcaataatacggagaatgaagttgtccaataccgcatacggtggtctgacagaagaaaggtctgactgttctgtcggaactgcctttaattcaacgtttttccctgacaatctcaagatctcctgagcaaattcgtaacgattgcagactccactgcaagttacatgataagtaccatattcattcgtactgatcagatacaggatcattcttgcgagatctttggcacttgtcggggaaccaaactgatctcctgctacagaaagtgtttttccctgttctgccacttcgagcacacggttaacaaagttatttccaccttttccgtaaacccagttactgcggataatgaaatgcttgtgtgtgaattctttcacataattctcaccagctcttttggatgctccataaacagtcagtggattcgtatcatcaaattctgtatacggtttcttgctctgtccgtcaaatacatcatctgttgaaagctggacgatctttgcgccattctttcttgcgacgatacttaagtttcttgctccaagtgcatttacccggtaagcatgttccggttctttttcgcacagatcggtgtctgtaacaccgcagcagttgataatcacatccggacggttcacaataccgaagttaagaacttcctctgtgtttgtaatatccagatcatccagatccgtattcagcacttcgatctctaatggatccagaatgtcgttcagcgcccggccgatctggccgtttgagccggctatccatactttaatcatctctcatttcctccttctcatgcaatgaaaaaggcgctgaatccaatcaacgcctctcatatactataaaataaacgtcaataatattttatcaacctactgtttccgtgtcaagattacacttttagtctatcaagaaaatatcatggttttcctgaatcttctctataatctcatggctgcttatcccttgaagttctacactgttctgactgacataaagaaacacaagaaacagaaaagtggacaggatcaatctggtagtaaagcttcctctgctattttctttcttatccagatcttctgctccatttcctgcactttgctccagaccatccggatataattcccgatataaacgaccatatcttggatgaattgccggtgttatcataccggtattccgctgtcgtctgcgattttcttcccacaatctacgcctacggacttctgattctttttcctgcacgaaagatcctctccatcttctttttttctagtttatgaaagtttcttctgctttattcttccaggaaaatctgatacagcgttttctaccggtcagccagttctcctgtaatatcttcccaggtaatccctttttctaccatgagaaccattgcatgataaaggaaatcagataattcatacttcacttcctcgacatttggattttttgcagcgatcacaacttctgtcgcctcttctccaacctttttcaggatcttatccaaacctttttcaaaaagatagttcgtataggaaccttcttttggattctcttttctatccgcaattgtctgatatacagactcaaaaatctgaaccggattcttggcatcgtaatcatttccaacaattgttgtatagaaacaggagcggtttcccgtatggcatgctgctccgatctgttctacctttgcaagcatcgtatctctgtcacagtcgattgcaagagatttcacatactggaaatgcccggatgtctcacctttgatccactggcattttctgcttctgctatagtaagtcatgcgcccggttttcacagtatgctcaaatgcttcctcgttcatatatgccatcattaagacttcatttgtcttataatcctgaacaatcactggaattaatccgtctgaattcaatttaaactcaccgaaatccatctggctttcaaaagaagtcatttgaattccattttctgcacaaacttctttaaatttgttaaagtccatatccaaacgactgatgaatcttcctgatataccttttacaccatcactctttaaaatattaaggatctcgttttcatccatcgtatccgtgacaacaacacactgcgtttctgtaacatttacaacagaattcagatccaggcgatgcataaatatcatctctgtactatatgcttcgatcagatgctgctgtttaaacaatgcatcgaaatcatttaatgatacagcgattctctcttttccaaaacgcttggatacttcctcgattaattcaatggaaagtgctttggagaaattcagcattgcacgttttgctccggcataaagaatcttcttcacatcttctgcacgtctgatgtttcctccgacaaccattggaatactgattgcacggttgatctgtttgaggaggttgatcgtctcatcatgttcttcatctgagtctgacagatcgaaaatgatcagttcatccgctcctctttcattgtagtggcgtgcaagttccatcacatcatctgcgatcacagttctgtcatcgaaccactgcaccgctttccctctttctataaaaatacaaggggtcagtcttttatacataatttcttcttactccttctgtcacgccgttaaaggcttccctttgtagaccatacttcttttattcttggctcttctgataccgccatatccagagcctttccgaatgctttaaataaagcctctgccatatgatgattattccctgcatcaaggatcttaaggtgcaggttcattgcagcactataggaaactgcatagaaaaattcacgcaccatctctgtatccattgttccaagcgccggtactgtaaaatctgcctgaaagttcagatacggtctgccggaaaggtcaactgctccaagagcaagaacctcatccattggcagtacaaaatatccgtatcgcttaattccggccttatctccaagtgcctgtgcgattgcctgtcccagtacgattcctgtatcttcgatcgtgtgatgggaatccacttcaagatccccacgcaccttaacatttaaatcaaataatccatgtcttgcaaatccatccagcatatgatcaaaaaacggaattcctgtatcaatctgattctttccctgtccatccagattgatcgtcagttcaatatctgtctcttttgtctttcttttgcagcttccgattctgttctgcatcacactcacagctccttttctcttattttttaaatcttactttgattgaatttgcatgtgctgtcagatgttctgcctctgcaaatttctcgatatctgtgtggatcttctcaagtgcatttcttgagtaagaaataatgcttgattttttaataaaatcatctacagatagcggtgagaagaattttgctgttccgtttgtcggaaggacatggttcggtcctgcaaaataatctccgagcggctcactggaatattctccgatgaagatagctccggcattacggatctttgtcatcacctcaaacggattcgctgtcacgatctcaagatgttcggaagcaatagaatttgctgcatcgattgcatcctccattgtctctgcaacgagaatatgtccataattatccagggatttctgaatgatctcgcctctggaaagctcttttacaaatgcatctgtctgtgcagatactttctctgcaagttccatacttgttgtaaccagaattgcagatgccatctcatcatgctctgcctgagacagaagatctgctgccacgaaacgtggatttgccgtctcatcagcaagaacaaggatctcacttggtcctgcgattgagtcaatgcttacgaatccataaaccgctttcttagcaagagctacatagatatttccaggtcctacgatcttatctaccttcggaatagactctgttccatatgcaagtgctgcaattgcctgagctccgccaaccttgtaaactttatctgcaccggcctcttttgccgcaaccagtgttgtcggagttacctttccatcttttcctggaggtgttaccatgatgatctcatctacacctgcaaccttcgccggcatgatattcataagtacagaagatgggtaagctgcttttccgccaggaacataaacaccgactctctggagtgctgtcactttctgtccaagaattgttccgtccggtttactgtcaaaccagctgtactgcatctgtttctggtgatagtctctgatattcaccagtgcttttctgataatagcgatcagttcatcatctacctgctcatatgcttctgcgatctcttcttccgttacaagaagatgctctgcgtccagtctgactccatcaaatttctctgtatattcaaatacagccttgtctccattttctttcaccgcattcaatatttcctgaacacttgcttcaaacttcccatagttattcgggcttctctttaaaaggtcatccagaagattcttcttcgtattctcattcagtttctctatacgcatttgtctattcctccctcagaagatttcttaaatttgtgatcagctctttgattctgtcattttccattcgcatgctgaccggattgacgatcattcgcgctgacagcgggcacacttcttcaagtacgaccagtccgttttctttcaatgtagaaccggtttctacgatatctacgatgacttcagataagccaacaatcggtgcaagttcgatcgaaccgtttaatttcacaatttctactgtctgatgtttcttattgtagaaataatctttcgcaatattcgggtatttcgttgccacacggatcagttcatgatgtttcagtttttctgctgcctcttcatatccacacacacacatcctgcattttccgaatccaagatccaggacttcatggactttacgtccctcttcgataatcgtatcttttccgacaactccaatatctgctgctccgtactctacataagtcggcacatccggtccttttgcgagaaagaatttcaatcccagttcttcatttacaaaaatcagctttctggaatccttatctttcatttcctcgcatgtgattccaagacgctccagcatctccagtgtcttctttgcaagtcttccctttgtaagggcaaatgttaaatatctcattgatctgctcctttattgctgctttgttttcttttttgtattgaccagcttctcttctcctgtctgaagattgatcacttcaatcttccggtcctctcttaagtaaagcatacttgcaacagaagaacgctttccatacgcttcaaaagtctctctttcatcccaggagtttctcttcatcatctcgacattttttccttttgcacgaaatgacctcgcaagagaaattgcccactgttccgttgcatccgtataaacaagcagattacggtgtcctgtctctactttgatcttctgacgatccagtgcactcataagttcatccagaatgattgcgaatccgatcgacggtgtcttctttccaaacttctcaagaaggtggtcgtaacgtcctccacgtacaactgcatctccggtaccataagtataggcacggaaaatgattcctgtataatatccataacttccgctcatgctcagatcaaaagttacatgatcctctactccgtaaatcttcagcagatcataaatctggcgaagacgttctaccgcaagtcttgctgcttcacccggagcaatgcgtcctgcatctgcaaggatctccggtccacctgtcagttccggaagctgatggaacgcttctttcacctgatcggcaatctcataatgatcgagaatctcttccacaccaaagaagtttctgttcgcaatcaatgtacggatctcttctttttgttcgtcttccagattcgttgcctcgaaaagactctgaataaaatcaacatgtccgatacttacctggaattcctttagtccggttttcttaagtccgtccacaaccattgcgagcatttctgcatctgcctcgatagaatccacaccgatcagctctgcaccaagctgtgtattttctttcaggcgtccacgataactggaatgattgataaatgtatttccggcataacacagacgaattggaaaattctctgtctcaaacagtgttgctactgctcttgcaatggacggtgtaatatccggacgcaacgccagaatattcccctctctatcaaagaatttataaagatctctgatcgatgtcgaaccgatctccttgcggaatacatcaaaatattcaaatgtcggtgtctgtatgtcctgatatccatataaatgcaatacagtattcagctttttctgcaatgccaacttaatggcacattctctattataaatatcccgaacgccttccggggtatgtaacttctgctccatgtctcgttcaccttcctgtcttttcttggtttttcactttagcgtgctaccacgttaaaacctgtttgtaattatacggactttgtaggattctgtcaatccctcgtttccaaatctttctgaattaaatccagatacggcacaaaatagccatttttcagttgaaaaaaccattcaggatctaattcttccagccggacactcttgcgtcccccactctgcgcgcggtcccagaacttacggatctgtgtatactgcatataataaagctcatttcttgctgtataatagatcagaaaaaaagcaatcccgccctgccgttcaaacttttccataaagttcatctgatgctcatgtacattctgaagtgggaaggtatctacattacactctttcgcatcaaaacagaccgggattccctgcactgctccgatatagtctaccgtacttgctttgtcgaaatacgcaagtgtgatctgtctgtggtctttatccatacgtaccggagtgatcggtgtcgggattttctgcatcagtgcaagtcccatctcactgtatctttcattcgaatgattgataaattcctccagtgtcgaacctctaagtcctctcgagttccatgttgccatctcacatcactccctgcgctttacagatttgttcaaataaggccgggacaggtgctttgatgatctttcctgaaagctgtttgatatctccctcgcagttctccgggaattccagacggtaagcatgcagaagctgggaacgaagtccgtattcctttttcaaagcatcgttaaatgaccggttcccgtatttgtaatcccctgcgatcggatgcccaatggatgccagatgtgcacggatctggtgtgtcttaccggtgatcagatgcacttcaagaagtgttgtttctctatttcgtgcaagcaccttgtattcggtatcgatcgctgatgcttctttcccatcttttgtctgttcagccggctttttctgactcaccgtaactttatttgtcttttcattcttgacgagataaccatgaatcctctgattctcttttacctgcccttttactaggcaaatataatatttcttaagtgtacggtcacggaacatctcgcttaatccctgtaatgcctgcagtgtttttcctgctgccacgattccgcttgtatttctgtctaaacggttacagacagatggatgaaatgtatgcagttcttcttctgtgattttcccattttccaacagataatcaataaaatactccacaagagaagtatccgtcggggatgccttctgggagagcattccgaccggtttattgataaatacagcagcctcatcttcatataagatatctaactgtaccttctttcccgctgtctgttttcttgcagaggacgcttttttcttcgaaaactgtgaatgatcgataaagttctcaatcgtctcttccgcaagaaataacttaatcacatccccctgtttcagctgttcatttccaactgctttttttccattcagggtaatattcttttttctcatcatcttatagaaaaaactttttggcgctttattgagatactttgcaaggaatttatccatgcgctgtcctgcctcatttttctggatgctgatctctctcatcgtcttttcctctttacattgatatattcagaataagattacggatttcctgttctcttgctttcgtatcttcctgctctactacagcaatattttcaagtccctccacgcgggccagaaacggtgtatactgatttaaaatcttaacagtaaaacctgtgtactgattctgcgcaaggattgtcttgatatgctttccaagttcatctgtatttactttctcataatgtgtgtatccgtaaatgttgtgtcccgaaattacgatacagtctgttggcatgatatgctctttgcttgtaattataagatcataacaaactgttaaatgttttgattttcctgcgatttccttcgcctgtgacagttcaattgattgatatggataacgtgcgatcacacctacaagtgcctttgatgccggaagacatccaaggatagcaacaactgtcagaagattcagcctcgtatgtgtctgccagtaaccaagagcaaaaattgccagaacgattacaaaataaataaccgttcttaaaatctccacttttcttttataattcaaataacctggttttcctttttgtattttcttcatttttcatcctattctaaattcatatttgctgcatacgcacgagaaatccatgtggcagcagttttgttccaaagtaagttaatttcattgggattccataaacggagactgacttcccggatctgcagtccttcaacgcctgatgaaccactctgtctgccttcgccattgtcagtttcttcaagatattctgcggtttcccggaaaacttgaagaactctgtatcaaccggacccgggcagactgctgtgacgacaattcctttttttctcagttcttctcccaatgatctggagaagcttaagacataggacttcgttgccgcatatactgagaaatacggttgtgggcaaaatgcagatgcggacgcaagattgacgatcctgctgccagcacgcagaaacggcagacacagcaatgtcattcttgtaagagaccggcagtttacatccaccatatctgtctggatccggaatttttcagacaaaatctcttctacacttcctgacttgccaaatccggctgaattcacaagcattcgtaaatccggctgttctttctcaagtgcatctctcaattccttatatacctttttcttctgaaggtcacctgcaaaaatccgaagaggaactcggctttctttcgcaagcgcttccagacgctctttgcgcctggcgatcacccagatctcatccagatttttataaaaatatccaagctgacgtacaaattctcttcccattcccgaagatgctccggttacgattgcaattttcatcctgcttcctttcttgaatcctgtctgtcaaatacttaaatgtacctattttctattcttcttagaatgaacatttctgatagatttcttcttattcttcccttcaactctgcctctgtgttcagaattgttttgtcttctctgaccatttgaaccttttgatccttttttcggttcctttctgccggcttttttatcatttcctgaaccacgcatctgtctcggtctcacaagacatttcggtccgaatccgatcagatcagatcttcctgctttatgaagtgcttcaatcaccagatcatacagctccggattacgatattggatcaacgctctctgcattgccttctcatgcggactcttcggaacataaaccttctgcatcgttctcggatctaccccggtataatacatacaggtggaaagcgttgatggtgtcggatagaaatcctgcacctgctccggcatatagccaagatcacgacagtactctgcaagttctaccgcttccttcagagtagaaccagggtgggaggacatcagatacggaaccagatactgttctttcccgattttctcattcatcttataaaactgtcttgtaaactcttcatagactttgtgctccggttttcccatcagagacaggacaggccctgccacatgctccggtgctaccttcaactgtccactgacatgatattcacacaactctcttaaaaactcctgtttcttatctgcgagcagataatcaaagcggattcctgaacggataaacaccttcttaacttttggaatatctctcaactttctcaacagactgacataatctctgtgatctgcgtccagattcttacacggagacgggaacagacactgacgcgttttacaaacgccatgctccatctgctttttgcaggatggatgccggaaatttgctgtcggaccgccaacatcatgaatatatcctttaaagtccttatcttttgtaatttcttttgcttcttcaatcagagattcatgacttcttacctggacaattcttccctgatggaacgtcaatgcgcaaaaactgcatcctccaaaacatcctctgttgctgatcagactgaatttaatctccttgattgcaggaactccgccttttgcctcgtaagacggatggtaagtcctctgataaggaagagagtaaacatcatccatctccatctgtgtcagtggtgctgccggtggattctgtactacatacagatgatcagaatacggttctacaagacgttttccgttaaatgcatccgtattcagatactgtgtgtaaaagctgcgggcataattcatcttgtccgctttgaggtcttcaaaggacggaaggatttccgcatcataaatactgtctaatgattttgcttttacaaccgtaccggctatatacgtgatatcctcaaccggtatcccggcatccagtgcttctgcaagctctacgattgaatgttctcccattccataagaaatcacatctgcacccgaatcgagcagtacagaacgtttcagcttgtctgaccagtaatcatagtgtgccattcttcgaagacttgcttcgataccgcccaaaatgatcggtgtctttttataagtctgacgaatcagatttccatatactacgcaggcataatccggtcgttttcccatctcgccgcccggtgtataggcgtctgtctttcttctctttttggatacagaataatgatttaccatagaatccatatttcctgcagagacaagaaatccaagtcttggttctccgaacacctgcacgctctccggcttacgccagtccggctgtgcaatgatcccaacacgatatcctctggattccagaagacgtgtaatgattgcgtgaccaaaagatggatgatcgacataggcatctcctgatacatagacaaaatctacctgatcccatcctctctctttcatctcttctctggtaattggtaaaaaatttcctttcatgctttctccctgtttaacgtaataatgaacagtcacgtaatgcttccagttcctgtcctgttaattctcgatattctcctaatgcaagccgcggatcaagtacaaggctccccatctgcagacgtttcagataaataacctcttttccgactgcatggaacattcgtttcacctgatgaaactttccctctctgatcgtcagtcggatttcagaaatctcttctcttttcagaatttccagatgagccggaagtgtcggtttctcttccccgatttcaagtccttctgcaaatcttctcacatcttcttccgtaacttttccatcgattctggcgaaatagactttatctacatgcttcttcggtgacaaaagctgatgtgcgagttcgccatcatttgtgatcagtaaaagtccctctgtgtctttatctaatcttccgacaggaaagagatcctttctttgcttttcatcaatcaaatctaatacagtactgtcatttttatcttccgttgcagaaaccaccccggctggcttatttaacatgtaatattcatattctgcataagcaaccatctgtccctggtaaaacacatgatctttttcggtgtcaatcttgatctccggacgttttaccgtctcttcattaactcgaacctgtccttttgtgattgctttcttcacttctgtacgtgttccgattcccatgtctgccagatatttatccagtctcagtttcatgagttccaccgccatcccggaaggtacttattcttaagcatctgattcacaagctttccaaaaccaagcggatatccatccacacagatcagataccatcccttgtctttcggcttcacaagatcctccacatccaaagtctcgcctttcagatatttcataacgcgttcgtcttctaatggaaggtcgatcacctgatcatattcttcctttttcagattcatcgccagtgcctgactcggctcaaaacgattcttcttcagttcacccatcagtaggcctgttcttaagaaacggattccacgaagtgtcggaagtccttccggcatataatatactttctctccacgcagatccatgcgagaggaatcgaattttcgatcaatatgaccaagaaattcttccaattcttccggaagcttcttgttcttcccactctccggaagtctctttccttcttcctgtttttcacccttttgaagaagtgcgaggaaatgtccttctcccttcatacgatgagggaaaatacgaaccgtcttttcaagttccggattcttgctttctgtcacctgcggcattccatctgcaaatccttcgtaaccttccatctcacagatcttaaattccgggtattcctgaagcagatattcaatcgtctgttcattctcttccggtgaaaatgtacaggtggaataaagcagcattccacccgggcgcagcatctgggctgcctgtgtcacaatgcttctctggatctttgaaaaaaactccggtccgtgttcttcccatgctttcaccatctttttctctttacggaacatgccttccccggaacaaggtgcgtcgatcaaaatcttatcaaaatactctgggaaataagaaacaagctttccaggctcttcacttaagatgagcacgtttccgattccaaataattcaagattcttcaaaagtcccttcgctctggaactgctcagatcattcgcagccagtacaccggttcctccaagctttgccccaagttctgtggccttgcctccaggtgctgcacagacatcaagcacacggtctcccggctctaccggaagacgatctgccggtgtcatggcacttggctcctgcagataataaagtcctgcgaaataatatggatgtttcgacggctggatattatctccgtcataatagaatccattatggatccacggaaccggctctaacggccaaggtgcgatcttcaggaaatcttccacagaaatcttcgctgtgttcacgcgcagaccatagtgacgcggttcatcataacatgccgtatatgcttcatattcagaaccaagaagatccttcattttctcttcaaatacttttggtaaattcatatttattgtttgctcctttgcaatatcaagatcaaaatactttacatttaactatatcatatttccatagctccggtatagtttcttttttcttttcatagaatatttttgtaaaaggaggtttcctatgcttctggctctcatactgctttcactgttttttacgatgctcctctttcctgaaactgtattccagggagcttgtgatggcctgcttctctggtatcagattctgataccgaccctttttccttatcttattgtcacaggacttttgttgaaaacagatggtgctgctgttgtctcccgtctgcttttccgtcctttccatctgctctttggaacttccttctatggaagtttcgccgttctgtccggctttttatgcggttatccaatgggcgcaaaaatcattgccgaccttcttcttcaaggaaaaatttctcttgaagaagcttcttacctgctgtccttctgtaataatgcaagtccatcttttattattacttttcttgtttcaaatacaattcatcagaaagctttctgcattcccgctttactgcttcttttcggaactatgatcctcttaagctttcttcaacggattctaagacatttcatcaaaaataaagattggattttcccggaaatgtccgaagttttcacacaggagaattccattttttcaaaaccactgacgcacaaaatgaatttttccgtgttagaatcttgtatcctgaacagttcagaaacgcttgtaaaagtcggaggttacctgatgatcttttctgtacttcttgcattattggaacttctgccgattcgttcacctggttttcttctcctgaaatcttctcttgagatgacaaacggagttcttctcctgtctcaaagtctttcccacccccaggttctttatccgttgcttctcgcacttacctcttttggtggatggtgttccgttgcccagacacaatccatgattgccggtacaggacttaaactttcttcttatataatacaaaaactgaccgccgcactggcagtcagtcttttgacatttctctatctgaaatttttataatacaatgtaatgactacctcaggtctccctgtccattctcatcataatatccgtcatcggatggaacttcaagttctgaacggttagagcgaactgtatcgtagcactcctgtaaagaattgatcaatccgtcatactttgttgtataactgtccaaagtatgtccgataatgctttctgcatttgcaagaagatcatctgtatactggatcgcaccaacacggattgtatttgcatccattgttgcgttatcaagaatctcctgtgcctgtgctgttgcctgagttacgatctcatttgcctgagcatatgcctgctgcatgatctcatgctcactgacaagctctgttgtctgaacctgtgcttcctcgatcattgcatctgcttttgcctttgcatcagcaagaatcgcatctctgttcgcaataatcttctgataacgtttgatctcatccggtgtcttcatacgaagttcgcgaagtaactcatccagatgctccttatttacaataatctttgttgtagacaacggctgaaacttacaatctctgtctatatattcttcaatttcttcaatgatctgttcaatacggctgctcattgttacactctccttttttctttcatcttttctctgagtgcgatctcgacggcttccggcacaaactgtgatacgtctcccccaaaagcggcaatctcccgcactgtagtcgaacttaagtaagaatattctatacttgttgtcagaaacatggtctctatatcaggcttcatcctctgattcgtctgcgacatctgcagctcatattcaaaatcggtaatcgcacgtaatcccctgataaccacatctgcacctatctgttccgcaaagtctaccagcaatccatcaaatggtataatctcaacattcggcagatctttcgtcacttcctttaacattttaacacgttcttctacagaaaacaacggcatttttgctttattattcagtactccgacaattaatttgtctacgattttacaagatctgcaaatgatatcataatgtccacgggtaacggggtcaaaacttcccggataaattgcttttaacatacttcttcctttccggctttctcaataaatacatgcttgtttgtcttatatctcttctctttgatcaaagaatatcccaattctggaagatatccaaaatctgtatctaacgaagcttctacgatgatcaccgtatcttcatagatcagatccgatcctgcaaggtattccagaactcttttctcaaatcccatattatacggtggatccatgaatacaaagtcaaaaaccttttcaccttccaactgatataatgcgttcatcacatcctttgtcagtgtaagtcccttcttctccagacgtgtgaatttcaaattctccttgacacattccatcgccttaggatttttctctacaaatactgcttcttttgctcccctgctgagagcctctattccgattccgccacttcctgcaaacaaatcaaggaaaatacagtcatacatctgcggacttatcatattaaacaaagtctctttgatccggtccgttgtcggtcttgtctctatcccctcaagagtcttcagttttaggcttcttgcgcttcctgcaattactctcaaatatcgacacctcctgtcattaactatggtgaattttagcagaaaaaagcacccgggtcaatgccgagtgcttttctctttttcatttcttgtgttctttttactgtacatgacagtttttgaaccgcttttctgtctgatgcagaccgcttctgcagacgatttttcttcgcctgttacttttctgccatctgcttctcctgctgttcaatcatctttttaaccatataaccgccgacagaaccattctgttttgatgtgaggtctccattgtagccgtctgttaacggaactcccaactcggatgctacttcgtacttgaacttgttcatagctcctttcgcctcaggtactgctgttttgttagatgaacgacttgccatgatctttttcctccttttgcattttgtaactttactatttagctttgttacgctgttagtatgtggaggaaaattaattttaaactggtaacttctggcaatcactgatgcagccgaattgctccattgctgtacaattgctgtaatccgcaaacatcacaatgttgtttccagcatgatctcatccagttttatccgtaaatgttctttcaatttgcgatgctcagggaattccagttccggatcatccagaagaagtctgtctgcctcttcacttgcgttttgaagcaactttgcatcttgaaatacatcggcaactttaaaatcaagcacgccactctgccggattccaaaaagatcccccgggccacgcagtcggagatcttcacttgcaataaagaaaccatcatttgaatgattcaggatatctaaccgttccttcgtttcttttgatttcgatgctgtcatgaaaatgcaataggactgatactttccacgaccaacccttcctctcaactgatgaagctgcgccagcccgaaacgttctgcattttcgatcatgatcactgtcgcattcggcacatcaattcccacttcaacaactgttgttgaaacaagcacctggatttcatttcttccaaatgcattcatcacttcatctttctctttttccttcatctttccatgcagaaagctgacattgattgaatctcccaacgtttctgaaagcatctcgcaataatcgataacattttccgcttccattgcttcactttcttcaaccattggacagatcacatagcactgacgtccttgtgccacctgttttcttatgaattcataggccttcggacggtatcctgtatccacaacacagtttttaatcggaagacggttcttcgggagctcatcgatcacagaaatatccagatcaccataaagaataattccaagtgttctcggaatcggtgtcgcactcattacgagaatgtgtggcaggtttcctttacctgcaagcatttctctttgttttacgccaaaacgatgctgttcatccgtcaccacaagtgccagattgtgatagattgctttctcctggatcaatgcgtgtgttcctataataattgacgattccccactctcaatccgggcataagcttctctcttttcttttgctttcatagatccggtcaaaagttctgcccgcagtggaatctgatactgttccaacatgtctttgatattttcaaaatgctgtcttgcaagtacctctgtcggtgccattaacgctccctgatagccgttcaatcctacaaacagtaatccaagaactgctacgattgttttacctgatccaacatctccctgaacaagtctggacatgacatattgacttttcatgtctttctgcatatcatcccatacccgcagctgcgcagccgtcagttcatacggcagttgtttcaggaattcgctgatttgaggctgatcttcaaaatggaatccgttcttcatcctgtcctgtgtatttttaatctggcgcagagaaagaataaaaacaagaaattcctcaaaaacgaatcgttgtcttgccgcaagaaatgcttctctattctccgggaaatgcatctcccgcacagattgttcataaggccggaaatgatatttcttcgtaaattcatccggaagaaagtcatcctgttcccgcacctgttctaatgcctgacgtagtgctttgattactgcattgtttgtcagacctgctgtcaatccataaacaggctgcatggtgttgattttttcctgataacgaactgccggatcgtaaatctccggatgttccatcacaagggaatctcttttcttcacaaccctgccgcgaagaacaactgctccttttcgcccaagtgtatttcttaaaaacggcattcgaaaccagattacctttattgttcctgtcagatcctttaaatatgcagtcgtgatctgtcttccttttcccggagaaacctgtacacgcccaaaaacactgccgcagatcgtgcagactttgccttcctccacttcactgatcggaaccggttctccaaaaatctcataccctctcggataataatgaatcaggtcatccactgtgtaaactccgattttttcgaagagcttctccgttttttcgcccacacctttgattgttccaactcctgcttttttactcatttatgtctgtctcctaaacaaaataaccggaacacttttcccaaatgtcccggtctgttcctgattttaatacagtactgctgttctgtctctttactgacagttctccttattcaacagaaagtacataatagtagattggctgtccgccggaatgtacatcaacatctacatccggatataaatcttcaatctcctgtgcaaagttctctgcactctcctcctgtacatcctgaccataatacaggctgatcagctctgtgtcttcatccaccagctgtgcaagcatctcttttgttgtctcttccacagactgtccgacagcaagaattccactgtctccgattcccatgatatctccctcatggatctctttgtcatcaatgtgtgtatcacggactgcataagtaacctgtcctgtcttcacatttccaattccttcgatcattgcttccagattcgtctgtgcgtctgcatccggcatatagttaataatcgcagtaattccctgcggaactgtcttggaaggtactacaataatatccttatcctctgtcagtgtctgtgcctgattagcagcaagaataatgttcttgttgttcggaaggataaagatatgttctgcgttcacctgatcgatcgcattgagcatgtcttctgtacttggattcattgtctgaccgccttcgataatgtagtcagctccaagctcacggaaaatctcattcattccttctccgatagaaactgcaataaatccgacttctttgcgcggctccgcctttttcgcttcagcctgctgtgcagccagcttctccgcatctttgatcaatctctcctgatgctcttctctcatattatcaatcttcatacgtgagagctgtccgtatgtcagcgctctctggattgcaagtcccggatcattcgtgtgtacgtggatcttaacaatatcatcatccgctacacatacgatagaatctccgatagactccagatatgctttgaactctgtctcatctttcgctgtgaattctttttccagcatgatgataaactctgtacaatatccgaatttaatctctgtttctgcctgttcagaaggcttcaccatctttgtgccggcacttgcctcgattgcagaataatcaatctcttttccctggaatgcatcgtatgcaccacgcatcacttccagaagtccctgtccaccggaatctactacgcctgcttcttttaataccggaagcatctccggtgtcttttcaaggacttcctgtgcatagttgatcacttctgaaataaatgtatccagatcttctgttgtctctgcaagctctgccgccttctgggatgctccctttgctacagtaagaattgttccttccttcggcttcataacagccttataagcagttgcagttgcacgttcacatgccttcgcaagtgtaattgtgtcaatctctttatgttccctgatctcctttgtaaagccacgaagaagctgggacaagataactccggagttacctcttgctccacgaagagagcctgaagaaattgcttttgcaatcgccaccatatcaggattctccagcgcctttacttcttttgccgctgacaagatcgtcagtgtcatatttgttcctgtatcaccatccggcaccggaaatacgttcaattcattaatgaactccttctttgcctcaagattcgctgctcccgcaagaaacatcttctgaagcaattcggtgtttatcgttttaacagccacaattgttcctccttaatctatcactctgacaccttcaacgaagatgttgatcttatctactttcataccagtaaattcttctaccttatattttacattattcataaggttgtcagaaactgaaagaatattcactccataggaaacgatcacatgaaaatcaagcgtaattacattatcttctgtgatctcaacatgaattccccttgtcaggctttctcttttcaaaagatgcacaaggccatctttcatattaactgctgccattcctactatgccaaagcactcaattgccattgagcctgcatattttgcaatgacttcaggattgattgtaatgattccaagatctgtactcatacttcccttcatcatatattccctccaattctataggttctttccatatataacatgactattatactattactttttgttttttacaatacagttttgatttttttaaaataacacttgcattactcggaagtttctgatagaatatcattgttatgagtctaaaagaccagtttagattgttaggaggtgcagtcatggctaaatgtgctatttgtgaaaagggtgctcattttggaaacaatgtaagccactctcatagaagatcaccaaaaatgtggaaatcaaatgtgaagtctgtaagagttaagacagagggcggttctcagaaaatgtacgtttgtacttcttgcctgagatcaggactcgttgagcgtgcttaattctcgtttgatgattcaatatgacacggtataaagaactttatctgtttcttcggataaagttctttttttatctgcagaacaaacaatatgccagtacaataccggtaattgcgatcacagttccccataagacatcagaaagcagcatcatgacgatcattcctgctgcaaaccaaaacaatgcaaatccaaaaactttcttcacaatactgctcccaatattttctatattctagtaactattttattctgcatccagaatatctgctacatcttcttctgttaatttttcatcttttgatgtaaaacggtctaccacatcaggtaccatatccaaaagttttgtaattgtatcctgattcttgatattcacaagtttcgtctttccatcctgaataacgatcacagcactcggtgtgatctttccaccgattccaccgcctgctctgtctttcttttcagcgttaaaagaacctgctccaataccaaaagagacatctaccaatggaagaatgattgttccattgatatggatcgcatctccgacaactgtctttgatgaaacaacgctatccattccctgaaagagtgattctactgtttctttaaatttgtttccgtctgccataatcctgactcctctcattttatatattttctaatgtgtttgtaggtaatcttcacatctttattccagaacagtttccatgcaggaacagcaaagtaaataacccggatcttcccttctgcagatgcatttccctccaactttcgttcttcaaaatccggctgaatctgaacatactcaccaatcagtccgtaaatgctccccagaaaagctaacatatatcctgtccaggaaggatcactgaatccaaatgtaacattcgcctgaagctttttaggcttcagaacatgtaacagatggcagagttctttcttcactgcctcgaatgcccgttgatgtttctcataagttaaaaaagcggtcagaagttcttttttctctcctgctttttttatagtaccacagagtttctgaaatgtatatttgatttttttcaatttagattccgtctgtacgttttcgggcctgcgctcctctcgaactttcgtcttttctgtctctgactctttttttatctctggctctttttctgatgctttctcaattttcacatctttttccggtggattattctttacttccgtcttcttaccttccaaaggttcttcttccaacggctcaggaaccaccggcttctctgacgtttccttttgttcctcttccgaactgtcaaatttcttccaggcaagacgaagcttccattttaattctccatgttcataagacgctgatccggaaatcagatgaaacagccaactgacctttccatatgccacaagggtatcaagtgtattctccccttttgcagaaaatctgtatttcaccggataaaacaagattgttaaaatcagtaagagtaaaattacgagcaaaaaaagaagaatccatccaattattttcagtataagaaacaggatatgtatcatacgcttcgaatctcctttttctcaaactcttcctgacgatccaaaaggaactttctcaagtttacctctcccgtcttctcatatgcttcttccgcaatcctttcgatcagactcaatgcgccatcatacccattcgcaattccaacaataaataaagatgcattgtcaaatatatgttgctttaaaagaagcgacgaataatattctaaatggttctgctttccctgtgaaagcgtaattacatagacagaaggctgcagtttatttttctgcaatttttttattaatttcagttttttctcttcccagccttcgctgacatataaatcacagaaaaattttgtctgcatcttttctcctcccattagttgtaataggcgtctaaaatatccccggcgattgccactgcttttccgctggaacttccatccgaaccttctgtgatcacactgattaccagatccggattatccacatttgtaaatcccataaaccaggaatgtgtcttttctccatctgacatactgtactctgctgttcccgtttttcctgcagcagtataggatcttccttttaagacagatcctgttccttcctctacaacagctgtcatatactctttcaattgtgcagcttcatccgatgtcatgaccttcttataacttttcggaacattctttcgtatctgggagcccgtataattcgtcacactttccacaagatatggctgcatcatggttccaccgttcgccactgcctcggcaatcagtgccatatgatatggacttacggttgtctttccctgtcccattgccgtcatcattacttctccctcactggaattctgatccagtgcaaaggaacttttcgctgcattcagtacacccggaagcgatttattgaacaataaatcttccgccgtctgacggtattgcgtcagatccaggccaagaccaatattggcaaaagatgaattacaggaatttgcaaaggaacttctcagatcctctgagccatgtgcatttccattaaagcagtgaattgtaatatctccctgtgaaatctctccattacaatcatatgtataattcggataatcactgttctgacgcataaaagcaagtgttgtaaccactttaaacgtcgatcctggagcataagatccttgtgtcacacgattcaacagcggactgttttcttcatctgaattcaattctgaccagtcacttaaaatattattcggatcatatgccggtttggaaaccatggcgagaatctttcccgtactcgcctccattacaattgccgcacctttgtttgatccaagcgcatcataagccgcctgctgcagatttgcatccaatgttgttacaactgtatctcctcgattcttcttttcactgaattcattctgcagtttttcaagaaagaatgcatttgatgtcagaagctcaaaattctctaccgattccaggcccgtagttccaagtttggaatcactgtatccgatcacatgagcaaacacttctccataaggatactctctcgtctctgatccatcatccccaacggctgtctgtgcaagcacatttccattcttatcaacaatgcttcctcgtataatcgtatctgcataagcatcctgtctttgattatatggactgttcactacaagttttgcccgcacgaccataaaatatacaagatatcccatcaacgcgataaagagaatcacgaaaaagtaagtgactctagcgaactctttgttccgaacgcgttctccgctgtctttgctgccgctgttccgggacatcctcgaatctcggtctgctttttgttgttttcttaccggtcgttcttcccgattcatttcttaaatccctttctctttgtcttgctctgtctctgttatctccatcatattctcttcgtctgtcacgtccatcctgacgggatcttcctgattttgcattcgaactgctctggcggcgtctttcattctgcctgctgcggtttctctgtcttgcgcgctgcatctcaatctgatgctcttcttctgcttcttcatcttctctgacaatgtagagcccctgaataatcccaaacatgatcatcgtacttaacagagaacttccaccataactgacgaatggaagtgttactccggttaacggaatgaactttgtcactcctccgatctgcagaaatacctgaaaaatatagcaggttcccagaccaagtgctactaatttatagaagaaattacgcaattccatcgcaatattcaaaaacatcacataacagctgacgcatacaaggatcagacacagtgtaaaaatcagtcccatttcttctgtcattgcagagaagatcagatccgtctctgccactggaatcgtatccggctgaccacggaataatcccgttccaaaccagccgccacttccaatcgcaaacaacgactgggcgatctgatatcccccttcgctataagctgcaaacggatcctgccatgccgcaactctgaccttaatgtgggaaaacagatgatatccaatcactgcagctccacaccctgctgccacacctgcaattgcatataacggctgccttgtcgcaacatatagcataatcagatacacaataaagaagattaatgcagctcccagatccgttgacaatacaaggatcagaacatgtgctgccgctatcgcagtcgtaacaacaacattcttaaattctgtcgatttattcaggcttgctgctacaaaaaatacaaacagaatcttaacaaactcagaaggctgcagactcacaggtccaatattgaaactcagctttgctcctccaagtgttgctgcaaacaatgcaacgataagaagtgctgctcctccaactgctgcatagatataagtccagttctccaggaaagtcatcttccggatcagaaccggaacaataagaccaaaaacaataccaacaacaacaaatgccagctgacggattgcaattccataaggagacttactctgtgcggaaagccttgtgatcatgatcattcccgctgtgatcaacatacacatattattgacaaccagtcttgaaacattcgggtagatcagattgtataataagatgactgccatcacaatcactgccagtgcaccatatatgaacatcatcctcagatcctgcgttgcaaaatacattgcaataaatgcagtgatctgtatcataaatagaagtacatcctgacggatcaatactttgttttcctcatcttcataacttctcgtaaagattgaaaaacaggaaaaagtatatgccgccatcaagatgatgataaggtattttgatacctgaataataatattagccatatttcacctgcttcaaataattcctctgttgaaatgtcctgttgtaaaatctgtatcttcttttcctctggcaacagttttttcatctgttaagaaaaatgtattcagaactgtttctgtctgttctttatcttccagagtaaactggatacggcgcatctttggatacaattcattcactctgtcccattcctgtcttagattgatcggattttccgtataaatcacattataacagagatcacaatagttacgcgcaaagaatttttcgtctcttctgtcttgaagcactcgtactcccggtttcttagaacagcctgaagttgttctctcaatacactgtgcagataccataaccggaattcttccgtaaacaagaagttcaccgtttctgatatcaagttctcttagttctctgctgttaagctccaacggagctgtaaaatcctcaactttttgctgtttccaaaattctttgccatactgattaaagatatatagattatggtctaatataatctttttgtcaaatcctctttcttttaagaaaaagaaagcttcaaaatttcgaataacaacgccgtcaattggcaattgattaaagttttcaaattgtcttccaaaccattcctgcgcattctctctgaaaatatgtggaaataccagatacaattcaactccgctttttctccaaaaatcaatcctgtctctgacatgtatatccgaaaaacctgtaccaaacaaccggaaatctaatgcaatccgtccaatcctttgagttccctgtccataaagttcctctttctgattcaaaaagctgaacacggcctctaactgttcctctgtttcaataaacacagaatatctgttcagatttccattttctgtctcttctttaaatgtttctacctgtgtcgttgaaggattgcattccctgtaaaaagcagttgcgatctctcttctcaatccatccagtgctgctcttcttaaactattcagctgctgcatcggaagaaatgcatcctgatccatagatatttccagatctttcaggaaaaatagcgtaccgcctgtcttcgcaagctgtgtgcgaattctctcttcctccaatgggcgcttctgtgcacgttcaactgcatgttctgtatatgctgtataagaaaattccctgcagcagaccgtaaaagatgccggatatccaacctgaaggctcaaaaagccataaatctcctcctgccggtcttctttcctgtatttctgatccagactctcaatcagttcttcatttcggattcttctaaaaacaaagccttctttgaaacgcatccccttcggcacaagaaaacgtaacttttctccctttgtgatcttcttgccaagtgtataattatctttcccgctaccgatttcaagaacatcatgtgcatgcagatctgtcaaagcctgagctgtgacctcacgtccattttgcgacagacatctggctgctgctactccggcatgattcggacgatccagtgccagcatttctcttccattatgctgcttataatatccggtatctgaatcaccgcgattataaagatccatcaggttttcgcggtcttccggtttcaccgcataaccactcttcccttttttcaaatataaatccacatatttccgatacatagctgttactgctgccacatattccggtttcttcatgcgtccttctatcttaaatgagtcaatcccagcttcaaccagttccggaattaattccaacgtacagatatccttcaggctaagaaaatatttcttctgaccatctactgtataaggaagtctgcatggctgtgcacattgaccacgatttccacttcggccgccgatcacactactcatcagacactgtccggagtaacaatagcaaagtgctccatgaacaaaacactctacttcaaggtccgttgtttcatgaatctgtcgaacttcttccaacgaaagctctcttgccgggacaactcttgccgccccctgactctctaaaaacttcgctcctgccgcaccagtgattgtcatctgtgtactcgcatggatatcaagatccggaaaattgcttctgataaattggaatacacccgtatcctgaacgatcaccgcatccaaacctctctcatataatggtgccagataatcatacagttctgcaatctcatgatcttttaataatgtatttactgtaagataaaacttcttcccataaatatgagcacgctcaattgcttcgatcagctcatcctgtgtaaaattgtttgcatatgctcttgctccaaaacgtgttcctgccgcataaacggcatctgcacctgcattcattgctgcctgaaaacatgcaaaggatcccgccggagccagaatctccacctgtcggtcttttctcattcttctgtcattatccttttctttattattatgttcacataatctatgagaaacatgctccgcgagtttctcaagttatcgcgacaatcgccaaggtcttgtgcaagtacggactttggctcgttgttcgcgtaaatgaaaaaggctgccaaagtgacagcttttctcatttaccttcttcggtttttcatctctgtctcgagcttaacaatctgcatctgaaggtcattattctcttctttcatctttgcaagctctttctcagcattctcaagtttgatctgggctgaaatcaattcatgcttcagatcatacatctctttatccttgagctcgatatcgctttccagggaatctccctgtttctttgctttaaaataatcatctgcaatattaagtgcaagaaggacattccttgtgtctgcactctgttttctgtatccttcactgttcgtacattctgtgattttatgattaagataggaagatactttctgcagatactcttctccttcaaagccactgagagtatagacttttcctccgattaatacttctgtaaaatgttttgctgaactcatagcttcctcctcgagtttctattcttctattatagactatttatcctcaaaaaccaactattttttcagaatttctatacttctctcggaattccaagatgttggtaagctaattctgttacaacacgacctcttggagtcctctgaatgaatccatttttcaacaaatacggttcgtaaacatcttctaatgtgcctgcatcttctgaaatcgatgcggcaagtgtctcaagtcctaccggtcctccctggaacttctcaatcattgtgatcagaatgttacgatcaatatgatctaatccgaatttatccacgtcaagaagatctaatgcataatttgctacttcttttgtgatcacaccatcatatttaacctgtgcaaagtcacgcactcttttcagcagacggttcgcaagtcgcggtgttccccttgatcttctggcaagttccatagcaccttcttcttcaatctctacacctagaacatgtgcagaacgcagaatgattgtcttcaactcttcttcattatataactccaaatgatgcactacaccaaaacggtctctgagcggtgctgtaagcattcctgctcttgttgttgccccaaccagtgtaaatttgggaagattcagacgaacagaccttgctcccggtccctttccgatcataatgtcgatcgcataatcttccattgccgggtaaagcacttcttccacctgacggttaagtctgtgaatctcatccacgaataatacgtcatgttcctgcagaccattcagaattgcagccatctcgcctggtttctctattgccggtcctgaagtaatcttcatatttacacccatctcattcgctatgattcctgccagtgttgtcttaccaagccccggcggtccgtaaaacagcacatgatccagtgcttcgccccttgctttcgctgcttctatataaatactaagtgtcttctttgctttctcctgtccgatatattctgataaaagctgcggccttaactgtccctctatcttactgtcttcttccagattctctgtcgttataattctcttcgccataaccgacctctcatttcataactctttacttcaaattttgtaactgttcagagcagattctttaacgcttctctcaaaagatcttctacactcgcacaatcaacagataccttcttcactgcacgtaaactctctgcacttccataaccaagtgctgtcagtgcctgtaccgcttccgcctgcattccggtatctgtcgcctcaatttcttttgactgttcactgccatgtgctgcctgttccagaacatcctcaatgctcatcttatctttcaactccagaatcagcttttccgcggtcttcttcccaattccaggagctgatgaaattgtttttacatctccggccagcacggcaaaacgaagttcatccggagaaaggcaggaaagaatattcaacccggctttcggtccgatcccgctgacaccgatcaacagtctgaaaacctgaagatcttcgcctgttagaaatccatatagttgcattgcatcctcacgcacgttgagatatgtatgaattttcacttcttccccaactgccggaagcatggataatgtctgctgtgacatataaattccgtatccgattccacccgcttccacaatcgctttctgctcctggactgctgccagttcacctctaatatatgatatcatcttcctctatccttttcccgctgcaccaaaaccgcaacgcttccataataattataccagagaaattccctggatcctttttaaaacttcttttgccacaagtccgatcagcagcccggtcacttctcctgccactaacaaaaccggcagataataccccacctgatatgtctgtacaacaaccattgcaacaagaagctgcccgatattatgtgctgtacctccaccaatactgactccggcaacactgaacctgtctgatttcttaaggagaaccataacaaggaaactcaaaagtcctcctgataaactatatagaataccaaacagatttccgaacataaagcccgataaaataatccttgtcacggaaagtgccagtgcctcttttatccccatcttgtacagaacaagaactgtcataagattcgccagaccaagttttgctcccggtattccgaaattaatcggaatcaaaagttccacatagctaaaaatcaatgccaatgctgtaaatacgccaaatatcgctacttttctaccgtgcaatctcatccacctccggttcctctccgccacggatcgttactatagtctgattcggcaggcagattatactttccccatctcttgaaattgctctgtggtttacacaaatctgatccggacagtcagcatcttccatacgaacctttctgtcctttatgagtactttattcttatcatttacatcaatttcctgatcctgttccaagcggtatcttccatacaactcgccatttacctgaatctctacttcactgtattcatctgtagtttttaaaagctgtaaaccaatcattaaaacagctacaaaaaaaatagctgctgcaagtatccagtcattcttcttcattccgcaccatctttcttccataatggttttgctaattcatcatagcacaaccatattttgaatgcaaccacatgttcgattgtatttttattcaaacctcgttataataaacacatcattcatttatattaagaacggagattttatgaaacacaaaaaaatactggcttgtttccttacattttcttttctgctgaccggatgttccacaaaagatcagtcacagtcgctttctatgacaggaacctatttcgacaccgttgttaagattgaagtttggggagcagattctaagatcatggatggctgcaaagatatctgtgagaaatatgaacaactcttaagtcctacgatcgattccagtgaaatcagtcagatcaatcaggcacaaggtgcctccgtttctgtatcgaaagaaactgctgatttaattgaactgggaaaatattatggggatctttccggcggaaaatttgatatcacaatcgcttctgccagtgatctttggaattttcacgataatgcagatcatagcatccctgacgcagggcagctggctgaagctgttactcatatcaattataaaaatatagaagtcaacggaacaacggtaaccatgtcagatccttatgcaaagattgatctgggtggtatcgccaaaggctatattgcagatcaggtaaagaattatcttgtagaagaaggaatagaacatgcctatatcaatctcggtggtaacatactgacactcggtggaaaaacggatggttccaactttcggatcggtatccagaaaccatttgcagaagacgggacagttatggctgttcttccggtatctgataagtccatcgtatcttccggaaattacgaacgatactttaagaaagacggaaagatttaccatcatatccttgacccttctacaggatatccaatagaaaataacttaaaccaggtcacgatcatctctgacaaatcggttgacggggacgccttaagcacaacctgttatgcacttggactggatgaaggattaaaacttatccgaagtatggataatatagaggctgtatttattaccgatgacaatacgatttataaaagcagtgactctgtcgatttaatcactgatattgataactaaagaaaaggaagctgatcattttaaatcttcagcttccttttctgatctcttttttcaataaaatcctgtcgtattattaacgtaacgtaataatctttctcgggcatttttctacacaaacaccacactctgtacatttatctgcatcgatatgtgcaaggaaattcgttacagtgatcgctcctgcttcacagttcttctcacaaatgcgacatccgatacatccggcctgacagattgtcaactgtatttttccttttgcattggaattacagcgtacaaatgtcttctgctcatatggaatcagctcgatcaggtgttttggacatgctgcaatacattttccacatgctttacatgcttctttgtcaacaacagcaattccatctactacatgaattgcatcaaatggacaggcagcaacacaagaaccgaatccaagacatcctgaattacatccctttgctcctccattctgcatcatgcttgccatcgtacaatcctgaatacctgtgtaatcataatctaaaattgctttttcgcaggttccggcacattttacaaaagcggtctgtctctcctgtgtgcctgctgcaacacccatgatatcaccgatctttgcagcaacaggtgccccaccaaccggacatccactgacttctgcttcaccttttacgattgcagctgcaagtcctgaacagcctgcataaccgcatccaccacagttatttcccgggagaacgcctaaaatcgcttcttcacgttcatctacttttacagcaaacttcttacctgcgattccgaggaaaacaccgatgaataaaccggttccaccgacgactactgccgccaaaataattcctgtcatactcatttgctcttcctcctaaattaatcccgagaatccgaaaaatgcaattgccatcagtcctgctgtaacaagcacgatcggagtcccctgaaatgactcactgatatcattgtattcaatcttctcgcgaattccggccattagcacaattgatacaaggaatccgacagctgtagcaaatccatttacgacacctgtgagaagtccaatacctgcactcatgtcatcatagtagccattctgtacgtttgtcagtgctactccgagaactgcacagttcgttgtgatcagcggaagatatacaccgagcgcattgtataatgatggcatcgctttctttaagaacatctctacaaactgtacaagtgctgcgataacaagaataaatacaatcgtattcaggtaagataattctcctcccatgatatttggatttccgagaataaacttatagatcaatccagttacaaaagatgcgatcgtaataacgaatacaaccgctccgcccattccggcagcagtcttcacattcttggatacaccgaggaacggacatataccaagaaactggctcaggacaacattatttacaaatgctgaaccaactgcaattaataataattctttcactttctgtcccctcctttattcgttctttgcgtcttcttcgcctgtcgggaagatctttccactgcaggatgaagcattcccgcagcttgcacagccttctccgcatccgactgtctccggaaccttctttcctttctttgccatattgttctttactttattctgtaaagcaacaagacctgcaaggacaaagaatgctcccggtgcaaggatgaagattgtcagtggctcgtaagattccggcataacacggatatcaaagatcttaccagtaccgatcagttctctgacaataccgattgctgtaagacccacagtaaatccaagtcccataccgattccatcaaagatagaaggaagaaccggattctttgaagcatagctctctgctcttccgagaatgatacagtttacaacgatcaaaggaatataaagtccaagtgaatcataaaggcttggaacaaatccttccatcaggaactgtacaattgttacgaaagaagcaacaataacgatgaatgccggcattctgacagaatccggaataatctttctcaacatagaaatcaacatgttagacatgatcaatacaactgttgtagaaagtcccataccaacaccgttgattgcagatgttgtaaccgcaagtgtcggacacataccaagcataagaacgaaggtcggattttcttttacaaggccgttatacagccgttctgtacatttattcattacttccgcctcctaactcattttgaaaatatacaagtgcagagtctactgcatttgtcacagcgttagttgtgatcgtagcaccactgatggcgtcgatcatgtcatctcctgactctcctgtctttgtatatgtaaacttttctacattcttatctttaaactgatctttgaaatctgcttccttagctttcattccgagacctgctgtctcgctgatactgagcatttcaatacctgttactgttccatcttccctgatacctacagaaatatcaatgtctccgccgtatccttcatgtgatgtaacatttacgacataaccaaccgtctcaccggaagcgtcttttccctcagccacctcagaaatatcatctgaagtgtatccattttctttcagaagagcagaagctgcatcagcatcaaattctgtatccgattcaaatgtctctgcatctgaaagaacagaacgaaatgcttcctgttttgcctcctcctgtgctttagcgatcggatcttttgtcacaccatatacaactccgagaagaagacctgcaacaacagtgattgctgtcagaatcaacgtgtttttaacaattttattcattacttctctcctcctttaccaaatggttttggaagagtaaccttctcgatcaatggaactaaaaggttactgatgatgatcgcataggaaactccttctgctgatccaccaaaaagacggaacagacccgtcagacatccaagacagattccaaaaaggatctttcctttgctcgtgatcggagatgttacataatctgttgccataaaccatgctccaagcatcagaccaccaccacaaagatgcgctgtgatgtactgaggatcgaatccatgtcctccaaacaatgtgataaaaataacaaatgtcacaatgtaagttccaggaattctaagatcaattacacccataagaatcaggaacattgcaccgatcataattgcaactacagaagtctctccgattgttcctctgatatttccgagaagcatagacaatgtattcactgtttctcctgctttcagttctgccagaggagtcggtcctgtcactccgtcgtaaacaaaataagtcatctttcctgcaaaacagatcagcagaaaacaacgtgctcccaatgcagggttcatgaagttctgtccaagtcctccaaacaactgtttcacaacaatgatagcaaatactgcaccaagcacacccatccaccacgggagtgtcggaggaagattcaatgcgagcagaagtcctgttacaaccgcactgaaatcattgatcgtaattggcttatgcattaatttttcataaagatactcagataaaacagccgctgccgttgtaacaactacaagaatccaggcattctcatgacggaaattccagattccgaaaaatgtagccggaagaagtgcgatcacaacataaagcataatgttgctgcttgtcactttatcacggatatgcggcgaagaagatacgttatatttctcgttcactttacttcaacctctcttatttcttctttctattcgccaatgctgtcttacgcattgaaccaattgcctgtttcagctgacgtttcgccggacagacataactgcaggaaccacattccacacattccaatccattccatgcaacaaaagatgcctcatcttttctctttgaaaagtctgcaagtctggatggaataattctgcttggacatatctccacacatcttccacagttaatacatgcagtctcaagactctttgccacaacgtcttctttaaaaagcagaatagaggaagaagtctttgtaaccggtgcatccattgtcaccatggcaaatcccatcatcggtcctccggagatcagtttctgcggttccgctttcaaacctcctgctgcctcaaccagctctctgtggtttattccaaaaggagccataaagtttcctggtttttcgactgcatcgccgctcactgtaacaacacgttccatcaacggttttcctttgattactgcattgtggattccaatcaaagtctccacgttatcaacaatacatcctgcatctgccggaagcatggtagaattgattgctcgttttgtcactgcatagatcaactgacgttctgccccctgtggatattttgtcatcaatgctttcacatcaattcttggatcgccggaaactgctttctgtaacttttcaatacaatctttcttgttatcctctacagcaaaaacacctcttgcatttgggaataaagaaaggatgaccttcattccgctgacaagatcttctgtatactcgagcattcttctgtaatctgcagtgatataaggttcacactcagcacagtttgcaataatatattctatcttatccggttccttcggagaaagctttacctttgtagggaatcctgcaccacccattcctacgattccggcatctccaatcttattaatgatttcttcccttgtcatctcttccaaaggctttaccggttcatattcaacttccttatactctccatcgttttctacaacaatgcactccacctgggatccagttggattaaaacgttgttccaatcctttcactttaccagagacagatgaatagatcggagaagatacaaatcctcccgcttcagcaatcaactgtcctttcagcacacaatcgcctttcttaactaccggtttagccggtgctcctatatgctgcgaaagtggatagaccagttcaccctgaggtactacaggtctgattggctgatcctttgaaaaacgttttccatcatccggatggattccgcctttaaatgtcaaaagcaccatctcatttccttcctttcttttatcattgtcattacaacaataatcttttaattttgtaatacctattttactagaatgcgctctgaaaatctagcaaatatgtaataattcttgtatctttcgctatacatcttgtcgaatttttaacagaaaaagaacctaccaatggcaggttcttctaaaaaataatttatatcttattcctctgtctctccagcgttgtcagcctcaagagctttcatgctcaggctgatcttcttctctgcttcgttaagatcaacgatcttagctgtgatttcctgtccgattgcaagaacatcagatggtttctcaacatgagctcttgaaatctgggatacatgaagaagtgcgtcaactcccggtgcaagttctacgaatgcaccaaagtctgtcatacgtgcaacttttcctgtaactactgtacctacagcgaaatcttctgctgcatttacccatggatttgtctctgggaatttcaggctgagcgcaatctttgtatcatgaatgtcttttacaagaactttcagtgtatctcctacatggaatactttcttcggattatcaactcttccccatgacatctctgagatgtgaagaagtccgtcaacaccaccaaggtcaacgaatgctccgaaatctgttacattcttaacagttccttctactgtatcaccaacattgagtttcgcgaacagctctttctgcttctcagcacgctctgctacaagaagctgtcttctatcaccgatcacacggtttcttctcgggttgaactcgctgattacgaattcgatttcctgtccttcatacttgctgagatctttctcataagaatcggaaacaaggcttgccgggataaatactcttacttcatcaactgttgtacaaataccgccgccaagaatctgtgtaactgtagctttcagcacttcgtggttttcatatgcttcgcgcagtctctcatttcctttttctgcagccagtctcttatatgtaagaagaacctgaccctctccgtcatttactttcagtaccttaactgtcattgtatcacctacggatacaactgttgtaaggtcaagagactgatcgttggaatattcgctctttgtgatgataccgtctgctttatatccaatgttcaggataatctcatccggtttcacgtcgattactgtaccttcgacaacctctccattgtgaattgttttaaatgactcttctaacatctgttcaaaagataattctgacattattttgaacctcctcaattatattgttgggcgtggatgcccctgctgtaatacctaccgtttccactgaccctaattgattcaaatccaaatcgccaagtgtctgtatatagtacgtattgttacatgctttgcggcatatttcaaataacttctgggtattggaactatgtttgtcaccaataacgatcatagcatccaccgtctctgctatgctctgcgcttctgtctggcgctcctttgtagcattacagattgtatttaaaacacttacatcataactctttttttcaagaatttcaactaattctttaaatttattgtaattaaatgtcgtctgggcaacgatacaaatctttttcccttgctcacaagaataattttctgcttcttcctttgtctgaaagacctctacatgatctcctgcccagcccttaattccctgaacctccggatgttccggatttccaatgataataatattctcgcccatctcactgtgtttctgcacgatattatggatcttcttaacaaatggacacgtagcatctacaatctggattttcttactttccaatctgtcatacacatcttttgccaccccgtgagaacggataataacagttcccctttccagtgtatccagctcttcttcgctgcgaagaacgatcacgcctttctgctccagatctttcaccacttcttcattatggataatcggaccatacgtatagatcggaagattctgattctctttcacctgttcgtaaactgtatccactgcacgcttaacgccgaaacaaaatccagctgatttcgcctttattactttcattctatccaactcctgcaaatttatctatgacaatatctggaaatcgtgtttacaacttctttcagtgtcatatctgaactgtcaacaagtatcgcatcctctgcttttttcagtggcgcgatctttcttgtcatatcacggtagtctctttcttcaatatctttctctatctctttcagatcgcactgtactcccttttcaacaagctctttatatcttctctttgctctgatttctacgcttgctgtaagatagatttttacatctgcatctggaagcacatgggtaccaatgtctcttccatccatgatcacatccttctctcttgcaagcgttctctgaagttccaggagttttcctctgacttccggaatcgcagatgtcatagaagccatatttccaacttcttctgtacgaagctttgctgtaacattctctccatttacatagatctgctggattccgctttcataaccaatcgttacttccacatctttgcaggcctctataatcttttctgtatcttttggatcaattccaagattcagaaagtgaatggccaatccacggtacattgcgccggtatctacataaatatatccgttttcttttgcaacctgctttgcaattgtacttttccctgcccctgccggtccatcgattgctacattatatcccatttttattcctccatcttttctttctacattccattttcaaatctaacagtaacatctattcttcctgtcacagaattcagaaattccccagtaaaatttcaatcacatcctgcgttaattccggcaagatatcctgttgaccatgcgatctgaagattatatcctccggtcactgcatcaagatcaagcacctctccggcgaaatataatcctttcattttttttgattccattgttcctggatcaatctcttttacagatactccgccttttgtaatgattgcttcattataaccgcgaagccctgtcaatgtcattgtaaaatccttgatcagatgaaccagtctctgtcgttcttcttttgtaatctcattcacttttttctcaggttcaatctccgagagttctatcataacgggctttaattttgccggaaagagtgaatcgattgaatttttatactgtttattatggtttgcatcaaactctctgaggattcttttatcaagttgctcctcactcaatgccggttttaagtctatatgaagtgtaagttctttttttcttaaagtttttcccaccacactgctcgcgctcagaataaccggtcctgttacaccataatgtgtaaaaagcatttctccgaattcttcgtagagttttttcttcccatctgtgatacaaatttctatatttcgaagagataatccctgcaattctttcgcataccattgtctgacttccatcggtacaagtgatggaaggagttctgtcactctatgccctgtttctttcgcgaaacgatatccatcgcctgtggaacctgtggaaggataggaaataccgcctgtcgcaacgatcacagcatctgccttcattttctttccattagttaataaaaccccgcacactttatcctgttcacaaagcagttctttcacctctgtatgaagagaaacagctactcccaatgattttaactcccttgaaaatgctgcgatcacatcagaagaatgatctgaaacagggaaaactcgttctccacgttcaattttcgtcttcacgccaagttcttcaaagaaatcgatcacctgctgatttgtaaaactgtaaaatccactgtataaaaatttcggattacttgtcaccgccgtaaataaatcttctatatcagcggcattcgttatattgcagcgtccttttcctgtaatgaacagctttttcccaagcttttcattcttctcaagcaactgaacattctgaccatttcttgcagcgaaaactgccgccatcatcccggcagccccgccgcccactacgatcacattactcatgctctattcttctcctttattctgtctgtaagactcgttcgttcctgcgctgccaccttcctggctgctttcttctccgctgtaaacctgatattcaccccagattttctccagagtctctaatgtcgagacaacttctttctgttttttcatacagattgcaacaatcagagcattgatcacactcaatggtgcaacaagtgaatcgacaatagatgccatatcacttcttgcgatcagattgcaggaagaatactgattcataggtgaatggatactgtcagtaagtgtgattacttttgcctttctattgctcgcaaattccaatgctttcaatgttctcatcgaatatcttgggaaactgattcctataatcacatctccttccccgattcgaatgatctgttcaaaaatctcactggaactgtttgtatttactgtaattacattgtcgcatacaagattcagataaaatcccataaaagaagcaagtggtgcacagcttctgattcccacaacataaattctctttgcttctaaaagggtatcaatcgcccagttaaatgccttatgatcgattgcagacaaggtcatcttgattttctcaatgtctgactgaagaactgtttcaaggatctcactctgtgtaattcgtccataggtcacttccatacgctggattgaattcaacttattacggacaagttcctccaatgctttctgaaattccgggtatcccctatatccaagctgggttgcaaatcgtacaaccgtagattcactgacacccacaatctctccaagacgcgccgctgtcagaaatacagccttatcataattttctttcacatattctgcaaggcgcttctgccccttgctcatcttctcatattttgcttcgatccttccgatcagctcattcatattcgcttcaatattgcgttctgatgtttccattcttttacactattcctaatccctaaatatttcattgtccgtccagcagcttcaacagatacataagagttctgtcatacctctgctttgctgattacttcacagcccgtgtgtactctttcagccagattcgttcttcctctgaaaggtaaggggacactttttcataaacctgcttatgataatgattcagcatttctttctcttctgtactcattttctccggcaaaattgcatccagatcaattggtacataagtaagaatttcaaaattcataaactgtccatactcattcttaactgtttttctgacaagcagctcattttccagacgaattccatgggaaccctcaatatagatccccggttcatctgtaatcaccatattttcttccaatgccggagccggtctctctccctctttccaacggaaattgatcggtccttcatggatattcaataaataaccaacaccatgccccgtcccatgattaaagtttaatccttctttccaaaagacctctcttgcaatacaatccagattcgcaccactgcatccatagagaaatacagtgtttgccagacgcagcattgctcttgcaaccattgtgaaatgttctttttcaatattccccacttctccaagtgcaaccgtacgcgtaatgtcggtagacccttccaggtaatgacctcctgtatctgtcatgaaaagctttccttcttttaaagggacattgcttttctcatccgcactataatgaacaattgccccatgttctccatatgcactgatcgggccaaaacttggtccgaggaaatgctcctgctctgcacgtaatccttccagcctggcagaagcagacaactctgtaatctccactctgccaatattcttctttaaccagtacataaactttgtatgtgcaacagcatccttcaaatgcgcttttctcaaattctctgcctgtgtttcatttttaactgacttcatcaggatttccgggttctgcttatcaacaatcaccgtctctttggaaatggcctgataaagactataattcatgattgcagaatccagaagaagcttatcttctgatgtcatttctgaaactttgcgataaatatcctcatacggataaatcttcacttgattttctgctaacaaatttataatatcgtcagagaattttctaatgtcagcaaacagctcaactgaattattataaacgattgcgtaagaaagaacaagtggacaatatgcaatatcatttcctcttatatttaaaagccatgcaatatcatcaagactcgataaaacatgtgcattgcatccattttctttcatcacttctctgattcgttctaatttggatccaattttttcgcctgtatattcatcttctagagaaaatacaggttccatagacatttcaggtctttccttccagatattctgtgcaaaatctaagcggtatttcaatgatgcgccattctcgtctgcgatatgacaatatcgttttccttgtgcataagtcactgtacgaccatcaaatcccagaacatccccttctttcagctcactttttaaaaattcttctatcgttggaacatcagattctcctgatttatagagcgtgatcccgctccccttcaactgagcttctgcctgaataaaatatcttccatctgtccagagtcccgctttatcctttgtaaaaactgcggtacctgctgatcctgtaaagcccgttatatattcgcggaatttaaaataatcaccgacgtattcactgtgatgatagtcatctgtagggatgatatagcagtctattttctgctgttccattacatttcgtaatcgctctattctgtctaaaacactcatatctgcctccatatattccaacaatcaaactcatattataaaaaacttgattattcaaaattgtacacatctatgataccaccaaataaatttccttacaaatgaaaaagaccagaaaacacaaatctttcaatctgttatcttctgatctttctattcaattcataatctaactaaatcagtcaggattataccggataagatccgttctctgtatctgctactgtagcatctacttttgtctgctgagcctgtctgtatttgaagaagtcaacagcaacctgtgggaacagtgcatatgtcagtacatcctcatcctgctggatccactgtgcacactctttacgaagtgtatcaagctcatccgggataagatctgccggacggcaagtgatcggttcttcatctccaagagccttcttctgaagttctggatcaaccggttttgttgtcttaccgtatttacctgcaagcacatcctttgtctcttttgtgatcatcttataacgctcacccatcagtacgttgaatacagcctgtgttccaacgatctgtgaagatggtgtaacaagcggtggctcaccaagatctttacgtacacgcggtacctcttcaagtacttcgtagaacttatcttctgctccctgctctttcagctgggatgtcaggttggaaagcattcctcccggtacctgatacagaagagtcttgatattaacaccaaggttcttcggattgagcagtccgctctcaagagcatcgtcacggattggacggaagtaatcagcgatctctgcaaggagactctgatcaagtcctgtatcgtatggtgttcccttgaatgtctcaaccataacttctgtagccggctgagatgttccaagtgcgaatggagacattgctgtatcgatgatatcagctcctgcctctacagctttcatgtatgtcatagaagcaacacctgatgtgtagtgtgtatgcatctcaatcgggatatttactgcatctttcaatgcaccaacaagctctgttgtcttatatggaacaagaagtcctgccatatccttaacacagattgagcttgcacccatatcttcgattctcttcgcaaggtctacccagtactccattgtgtaagcatcaccgagtgtataagacattgcaacctgtgcatgagccttctctttgttcgcagcttttacagctgtctgaaggtttctcatgtcattgaggcagtcgaaaatacgaatgatatcgattccgtttgccacagatttctgtacgaaatactctacaacatcatcagcgtatggacggtatccaaggatattctgtccacggaacagcatctgaagttttgtattcttgaatccatcacggaactttctaagtctctcccatggatcttctttcaggaaacggagggaagcatcgaatgttgctccaccccagcactctacagcatgatatccaaccttgtccatcttctcaacgattggcatcatctgctctgttgtcattctggtagcaatcagagactgatgtgcatcacgcagaatagtttctactattttaactggttttttttcaatttctgccatttatttatcctcctaatttacttaacgccgaaaatagccataaatgttccggctgctactgcagtaccgataactccggcaacgttcggtcccattgcatgcataagaaggaagtttgtaggatctgcctcagcaccaaccttctgagatacacgggctgccataggaaccgcagatacaccagcggaaccaatcagcgggttaaccttaccatgtgtaaggacacacattaacttaccgaagagaactccggcagctgtaccgaatgcaaatgctataagaccaaggataacgatcttgattgtattccagttcaggaatgcttcagcacttgttgtagcacctacagatgtaccaagaagaataactacgatgtacatcagggcattggaagctgtctctgtcagctgtcttacaactccacactctttgaacaggttaccaagcatcaacataccaacaagtggagctgttgtaggaagaatcacacatacaacgattgtaacgataaccgggaagaggattctctcaagcttagaaaccgggcgaagctgatccatcttgatctttctttccttctctgttgtgagaagtttcatgatcggtggctggatgatcggcacaagtgacatataggagtatgctgctacggcgattggtcccatgatagctgtctgctgcagtttacctgcaaggaagatagatgtcgggccgtcagctccaccgatgatggagatagcagctgctgctttgtctgaaaatccaagagccatagctccaagataagctgcgaaaataccgaactgagctgctgcaccaagcaggaaactcttcgggtttgcgatcagcggaccaaagtctgtcatcgctccaactccaaggaagatcagagaaggaaggatggaccactcgtcaagctgataaaagtaatacagaagtccaccagttccgttcgctgcatcctcagcatgaagcataatatccggatagatatttacaagcaacataccaaaggcaattggaacaagaagcagtggctcaaattcgtggcgaattgccagatagagaaacacgcaggcaacagcaatcatgatcaggttaccaaatgtaagattcatgaacgctgtctgttctacgaggtttcccaatgtatttgaaatatattccatttgtaaaaacctcctggttcagttactagtttaatgtagcaagtacagctcctgattcaacagcatcacctactgccacatcaatgctggcaatagttcctgcctctggggcaacaactgggatctccatcttcattgcttcaatgataataactgtatctccagcctctaccttctgtccaacagatgtaggaacctggaatactttacctgctgctccagcttttacctggatgcttccagcgcctgctgccgctttcggtgctgctgccggagctgccggtgctgctgctctaggtgctgcaaccggtgctgctgccggtgcgcctgcaccattctcttctactgttacatcatatacatttccgtttactgtgattgtatagtttttcatctaattatcctcctgattaattccatctgtttgattttcttctcttaatagaacgaacaacaaatccatctgtagaagttccctctgctgctgcaattgctgctgcgattactgctacaagttctgcatcatcttctgctgcagctaccggtgccggagctgcctgtacaggtgcttccttcttctcttccactttcttatctttatttgccaacttctcctgaagtttcggaatgtatccaagcagataaataatgaatgaaatgaaaatcaatacaacgaatacagttcccataccaagtaccgtattcaaaccggctttctcaaggatttctcctgttgaataatgagcagaaacatccatactctccatgttgcccttttcgtcaaaactgaagacgatgtctgcatctctgttttcatattttgcttcagatgtgagtgaaactccatcgttctttacttccattgtccagtcgccatgttcaacataagcaccgcactcttcttctgctgcttcccaggagctgatcattgtaaggaagtcctctccatcaaccggaagtcctgcattcataagctgtgtgtcaagctgaagatcacgcatatcagaaaagctgtcaagctgctctgttgtcatcgcttcgaaattctgaacaacaaactcagcatactgttctaatgttgcctgatcatattctgttgtctcagacttaccacatcctgtgaagctaagaacgagaatgaggataagtcctaataaactgatttttttcttcacttcgcctcacctcactaaaccgttccgtgtttcttagccggacggtcctctctctttgtgaacagcatctcaaatgctccgatcacatattttcttgtatctgccggctcgatgatcgcatcaacatatcctcttgctgctgctgaattcgggcttgactgaagttctttgtattcagctgctttctcattaagagtctcagcatctgcgtctgcgtacatgatctgtgctgcaagcttcgcatccatcattccgatctctgctgttggccatgcataaacaagatctgcaccaattgacttactgttcatagaaacgtaagcacttccgaatgccttaccaacgattacatttaccttcggtactgtagcgttagcaaatgcatatgtcagttttgcaactgcgcttgccatgttcttctctgactctactgtagcagcaaatcctgttacatttgtcagtgtaagaaccgggattgagaatgcatcacagaagtttacaaaatctgttgctttcttgcatccgtctactgtaagaacgctgtcgaactcagcctctacttcagcttctgcattgtatactttagagcggtttgcaacaacaccaactgtcattccgttcaggcggataaatcctgtaaccatctcttttgcgtaatctttctttgtctcaacaagaatctgattgtcagcaatctgtgccagtgcgattgctgtatcttctgatgcgttagcaatgtctgcgcagatacggttcaggtcatctgtgcattcctcataagacatatcatcttcgttgtttgccggaagcatacatacaagatcacggatctgtccgaggatctctgcctctgcaccgattccgtctacaagacctgctgtcttgctctggtactcagcgcttgctgtgttacacttggaaatctcatttccttccagtgcatttggagaattaacgaaaagttttccgtcttttgcttccataaatgtgaaatctgtaagccccggaacaactgcaagaccgccgccgcacattccaaagattgctgtaacctgcggaatcacacctgatgcaagtgcctgtttgtgataaaggcttccaaatgcctcaagtgcatctgtagcttcctgaagtctgagacctgcacagtcgatcaatccgatcaccggtgctcccatcttcatagccatatcatagattcttgcgatcttcttcgcatgcatctctccgagtgctccacccagaacatcagcatcctggctgtatacataaaccaggttaccgtcaatcactccatatccagtgataacaccgtcagaaggagctgccttctcctgcaagttgaaagttgtgcttctagctgtaacagctccgccaatttcaacaaagcttccctcatcaagcagtgtggcaattcgtctgcttgctgagttttctgttgcattgtagctcatattttagccctccatacttataaaataattttaaaataaaccaaaatttctgcctattgtattatatactaggtcgattgaaatttcaattcatattttccgcaaattgacatttttttcacaggacattgtttttgtcgagcttggattcttccagctggtaaatacttttttatattttatatccgtgatgtgggggctttattgcatcggacaccggcccgctctacctcatccctttgacaatctgtaacagaaaagtcagaacactcaccgtgagaggttcgtgtctgtcttttcctaacagattctgcaaagtgtattcggaacgctcctgccttatatgtgtcctcaacaataaagtcccccacatcactacgctatctaaagaagaagtttttatcccaaacaaaacgaatccagaagacaaatacagaattaacagccgggagacggtgaatctttgtcgatgaagatttcttgatcctttgactttagtttctgtattttcgagtgaattttgtatttgtaggagaaagtttaattttgaactacgcaagcaagaacgggtctactgttgccaggggcacatgtaaggcaggagcgttccgaatacactttgttcagtatgttaataagagccagaacaggcaccacacacggtaactgttctggctcttatgttacatacatgcatcctccgtgtcaatcagcgaagtgattgacacgggagtgaacagtaacccagtctcagctataaactctcttactataaataatactatctatatgcctttctgtcaaggagattccaataaatctcaacacactttaattaagaatcaacaaaatccaactgttttatttgtaaaaacaacaaaaactcaagtttcttttttatacataagaaaaaagggaagtttttcacctgcaatacacaaacacacttcatgtaatttctgcaaatgaaaaacttccctttattttaactattaacttctatcaatttacacttcttctgcgatctctcttgctacgaacacaccacttgctgatgcgtgggacaatgaatgtgtcactccacttccgtctccaatcacatacaggcccttgtgttttgtttcaagatgttcatccagtttcacttccatattgtagaacttaacttctacaccatagagcagtgtatcatcatttgctgttccaggtgcgatcttatccaacgcgtagatcatctcaatgattccatcaagaatacgtttcggcaatacaaggctcaaatctcccggttctgcggaaagtgtcggtgtcagaaaactctctgcaatacgtgccggtgtacttcttcttcctcggatcagatcaccaaagcgctgtacaagaacgccacctccaagcatattagacaggcgtgcaatactttcaccatatccattactgtctttgaacggctctgaaaaatgtttctccacaagaagcgcaaagtttgtattctctgtctgcttcgccggatcttcatagctatgtccgtttactgtaacgattccgtttgtattctcatttacaacgattccattcggattcatacagaatgttctgactttatcttcaaacttctctgttctgtagacaatcttgctttcatacagttcatctgtaaggtgtgagaaaataactgctggtagttccacacgaactccgatatctacacggttggattttgttgtgatatcgagattttcacatactttttccatccatttacttccgcttcttcctacagaaacgatacatttcttacattcatctacaccatcttttgtaatcacgcgatatccgccgtcaatcgcttccacatcatctacatgacagttaaaacggaactctacagtatctttcaactttgcatagagattctcaagaacaacatagttgatatctgttccaagatgacgaacagatgcatccaaaagattcagcttattctgcatacagagtttcttaatatgtgttcctgatgtagaatacatttttgtaccctcaccaccaaatttcacattgatctcatctacgtaattcatcagctcaattgctgtctctttaccgatatactcatacaatgttccaccaaaattatttgtgatattgtattttccatctgaaaatgctcctgctccaccgaatccactcataatcgcgcatgtcttgcagttcacacagctcttaatcttctttccatcgattgggcattttctcttctccagtggattgccggcttcaaataccgccaccttcaattccggtgctttctctgccagctcataagctgcaaagattcccccaggtcctgcaccgataataattacatcataattgctcatatatttttctcctttcaattactttcttgtttcttaactacactactcttcgtctcttaatttcaagattccgacaatcagcgtcttcatatcatcaaaaatataatcaaacgcaccggcctgacacatatttataatgaccataccaaccggaacagcaaggatcatccagatcacaccaccaattcgatatccaatataaatcaaaagcagtgtaaccagtggattcaatccgacactgtctccgacaagcttcggctggatcagctgtctgacgatttgcgtaattgcatagatcacaacaagcataatcgcacgtttataatctcccataaagactgcatatatagcccatggaatcatcgcagttcctgttccaaaaaatggtaggaaatctagaaatgcgatcaaaaatgcagacaatacaaagtaatggactctcaaaaatccaagtcctacagccaaaatcaaaaatacaattcccatgatcttaaactgtgccttgaaatatccaccaaccgcatatttcaggttatctatcaccatgatcattcgttcagttactgactttggcgcaatctgtttaacccatgtcacaacttcttctcgctctgagataaagaaataagaagacataaccgcaacgattgttgataccagataacttggcacacgctttgcgatatttcctgcggcacttaccgttggctcactgatttttgacatcagacttcccatcgtgtcatccaaattcgcaacagttgtcgtccatccattctggattccatccggcagtttgctaaaaattccggacatagaaattccaatttgatggagtcctttttcgagctgcacatacatttccggaaagtctttgatcagactgctgacttctgaaaccagccaactgacagcaaagtagcccagcgtccccatcaacgccaggactccgataataatcaatgcggagcctaatttttttctgatcttcaaacgtttttctaaccagttaacaaccggtgtggcgatggatgcaatgatccatccaaccacaaacggcatgagaaatccaagtaatttccatccgatcagtacaaatccaactgttgctgctatgctgaaaagcaagcttacggcaacttgccagtatgggcgcttatttgtcatcctctgccccctcgtcatttccatatccgagatattctgtctcaatcaattcccaaatctcatctcttccctgttttgtctgggatgagaatggaattacttttgttccaggaacaagctgcagacctgtcttcagcattttaatatgcttctgtacctgactgcgtttaatcttatcaagctttgttgcgataatgatcggctgatatccctgatccaggatccactgatacatcattttatcattcgcagatggatcatgacggatatcgatcaaaaggaatactgccttaagctgttttgatgtatgcagataacgctcgatcagttttccccactgaatcttttcctgctcagaaacctttgcgtatccataccctgggagatcgaccagatacatttcctcattaatcgtatagaaattgattgtctgtgtctttcccggtgttgctgaaattcttgcataagacttacggttcatcagtgcattaatcagtgatgattttcctacatttgattttcccgcaaatgcgatctcaggcttatcgttttccggaagaacgcttgtgattccacaaactgtttccaaatttatatttttaatgaccatgtcgtttactcctcctttcattctattttattgcaatctgctgtcagaagcaatctttttatcttgtcagtgctttctttaagacttcttccattgtctcaaccggaatgatttccagaccttttgtaatttcagatgaaagttcttccacatctgctgtgttctcttttggaataagtacggtctgtattccggcattcttagcagcaagaagtttttctttcaatcctccgatcggaagcacacgacctctcaaggtgatttctcctgtcattgcgagatctgcgcggactttcttgcctgtcacagcagaaagcattgctgttgccattgtgattccggctgatggtccgtctttcggaactgcgccttccggaatatgcacatgaatatcatgcttctcgaagaaatcttctgcgattgcatattttttgcttacagatcgaatataactgattccggcacgggcggactctttcattacatctccaagctgtcctgtcagcatgatctctcccttgcccggcattacattcacctcaatctgaagcgtatctcctccgacacttgtccatgcaagtccacgtacgataccgacctccggtgctgcatttgccatctgataagaatatttctcttttccaaggaatttatgaagatttctatctgtcacagtaatcttctctttctcggttgtaagaagctcttttgccgctttacggcaaatatttccgatttcacgttctaactgacgaacacctgcttctttcgtatagttatgtgcgatcttccagattgctttcttactaaagcttaactgttcattcgtaattccatgtttctccagctgctttggaatcagatgttccattgcaatatgaagtttctcgttttctgtataacttgtgatctcgatgatctccattctgtccaggagtggtcttggaatcgtctgtaaggtattcgctgttgtgataaatgtaacctctgacagatccagtggcacttccagataatgatcgcggaacttgctgttctgctcactatccagtacttccaaaagtgcggagaacgtatcccctttatagtctgtacttactttgtcaatctcatccagaaggagtaccggattcttcacacctgctgtacggattccatttgcaattcttccaggcattgcccctacataagtcttgcggtgaccgcgaatctcagcttcgtcacgtactcctcctaaagaaatgcgcacaaacggtttcttaagagaacgtgccagagacttggcaatagaagttttacctgtacccggaggtcccaccagacaaaggataggactttcccccttctgtgtcagtgttctgacagccaggaattccaggattctttctttcacctgttccaatccataatgatctgcctctaaaacttctttcgcatagttaatatctgtattatcttctgcacgtttattccacggcatctccaggattgtctcaatataagtacggattactccattttctgcctgagaaccgatcgtgttcttaaaccgtccaatttccttatggagcttttcttttacttcttccggtgcatctaatttgccacatgcttcttcgaactcatctgcatctgaaaatgtagtatcttcacctaattcctcgcgaatcaccttcagctgttctcttaaaagatattctttttgatgcttatctactttgctctttacttttctctgaagttcttctttgatttccatgatctgcatctcattcacaagcttcaatgataatttctcatatctactccagaaatccagctcttccagaagttcctgttgatccttgtacttcaatggaatattcgcagccacttcatttaccagacgttttaaatcagtaatatcaagaatttctgcaacagattctttggaaatctttccattctttgctgcatattctgtaataatttccttcaatccgcgcatcattgcttccgcattcagatcatccggaatcgtgatctcctgttcttccagaacttctacttctgcacgaagataaggatctgtctcttcaattttcttaagaaccgcacggttctttccttccacgagaacccttacaactttctttgacagcttgatcagctgcttcacagatgcaactgttccagtctcatagacatcatcctgtccggggttctctgtctctattgatttctgggcaaccagaaatatctcctgctcttcaaccattgcctgttgaattgcagcgatggagcgttctctgctcacatcaaaatgaacgatcatctccggcatgattgttaatcctcttaaggcaaccatagggagacttcttgtctcgttgtccaattcaattcctcctcgttagaaaaggcgggtaggatggtactcccatcactcccgcctcgttttatactccgcaactgtttgcaggattcctgtatccagttactatttgctctcagatgtcaggaatgattttctttcctcactatcacgagtatacttcggttcttccactccaagaaccgcttccttcgtaatgcggcattccttgattgtcttatctgacggtactgtaaacatcgtatccatcatgatattctccatgatcgcacggagacctctcgcacctgtcttacgcttcaatgttgtctctgctatttctaacagagcatctttatcaaattcaagcttcacgccatccaactccagaagcttctgatactgttttacgatcgcactttttggctctgtaagaatgcgtatcaatgcatccttatccagaagatccaatgatactgtcaccggaagtcttccgaccagctcagggatcaaaccaaactttacaagatcctgtggaagtgcttcctgaagaagtacatccatatcgtactcatgttttgatgcgatctctgcattgaatccgattgattttctatcgattcttgtctcaatgatcttatcaattccttcaaaagcaccaccacagataaacaagatgttcgttgtatcaatctggatcaattcctgatgtggatgctttcttccgccctgcggtggaacagacgcaactgttccttcgatgattttcaaaagtgcctgctgaacaccttctccggaaacatctcgtgtgatggatggattttctgattttcttgtgatcttatcaatctcatcaatgtaaatgattccgtgttctgcacgctcgatgtctccgtctgctgcctgaatcaccttaaggagaatattttcaacgtcctctcctacatatccggcctctgtcagtgctgtagcatctgcgattgcaaatggaacattcagcactttcgcaagtgtctgtgccagaagtgtcttaccacatcctgttggtccaagcatcaggatattactcttctgaagttctactccaagatcctgttctgccagaattctcttataatgattgtaaactgcaacagaaagaactttcttcgcctcatcctgtccaatcacatattcgtccagaaaagctttcatctcttccggtgtcaggagattaatatcgtcaagtgcagctctgtcattaaaatctaattcttcctcaataatctcggtacaaatagcaacacagtcatcacagatataggttccgctcggtcctgcgatcatcttacgaacctgggactgtgtcttattacaaaacgagcatcttacgatatcctcagtcttttttcctgccatattctgtcacctcaataaccaattaatggtttactattacttcgtcgatcagaccgtactctttcgcctcttctgcagacatgaaattgtcacgctctgtatcctgctggatcacttccagcggctttcctgtatttgctgccaggatctcattcaatttcttctttgtacgaagaatatgttctgctgcaatctgaatctctgttgcctgtccctgtgcaccaccggatggctgatgaatcatgatttcagcgttcggaagggcaaatctctttcctttctttccaccggaaagcaggaatgcgcccatgctggctgccataccgatacatactgttgaaacatcacacttgatgtactgcattgtatcgtagattgccagacctgctgttacagatcctcccgggctgttaatatacagctggatatccttatccggatcgtctgcctccaagaacagaagctgtgcaacgatcacgcttgctgacacatcatttacttcttctccgaggaaaatgatacgctcctttaaaagtcttgaataaatatcataggaacgctctccacggcttgtctgctcaatgacataaggtactaaactcatatgctatccttccttttctatatgattgtcgctatttgcaatagttattaccagcaacgcataattattgttctgatccttactcccgaatcagtcctcatcctctcacttcttatagaaagagaaaaggcacacctgatatacaggcgcaccctctcaagaaatctaataaatgattagccttctacagatgcatcaacgatcagagtaactgcatcctgtactgcaatatcctctttcatctgcttcttctcgttctcacccatgaactctttcagcttctcaacttccatcttgtaagactcagccatcttagctaactcttcatcaagacgctcatcagatacttcaatattctctgctgctacgattgcttcaagaacaagtcttgttctgattctcttctcagcctgtggcttaagctcttccatcatcttctcttctgagagacctgtgaactggaagtactgctctacgctgagtccctgctgcataatgcggcgtgcaaagtcatcagccatctgcttagcctgaaggtcaaccattggttccggaagatcgatctctgcattagcaactgcctgctctacagcctgatcttctttcttagcctttccttcgttctctttacgctctttaatctgagcctttacttctgctctgtaagcatcaagtgtctcagccttctcggaaacgtcagatgcgaactcgtcatctacttccggaagctcttttgctctgattgcatgtactgtgcatttgaatacagcttctttacccttcagatcttctgaatgataatcttctggaaatgtaaccttaacttctacttctttgtcgatctcagctccgatcagctgctcctcgaatcccggaatgaaagaaccagatccgattgtcagtggatagttctcaccttttccaccttcgaatgcaacaccgtcaacgaatccttcgaaatcaagtgtaacatcatctttatctgctacagctctgtctgtaacctcaacgattcttgcatgctgctcacgaaccttctcgatctcctcgtcaacttccttctgtgttactcttgtagagtatttgtcaactttaagtcctttgtactctccaagtttaacttccggtttaactgcaacttctgctgtgaagatgaatgattttcccttctcaagctgaacgatatcaattttcggctgggaagcaatctcaagttcactctcatcatatgcttttgcatatgcctcagaaatcatgcggtttgctgcctcatcataaaatacttccggtccgtacatcttctcgatcatctgacgcggaacttttcctttacggaatcccgggaggctgattttgctgcgctcttttaagtaagctgcctgcagtgccttctctacttcttcagctgaaacttcgattgtcagctttgccatattatgctctaatttttctacctgtaaactcattttcttcctccttgtttataagcaaattctttacttatcgaacgaattaatttcttaaaagtatacattcgcagtcattgaaacagtatagcatataaagtctcatatttccagtgttttttccactttcctatatcttttacatgtttttttacatttttctgactactttttctaattttattcctcatatacaatagattctgctatttcagaagctttttcattgccaaaaagctgacggatcagttccagtgcgaatggtatcgctgttcccacaccacggcttgttgtgatatttccatctgtgacaaaggaacagaactttgcttctttacaattcagctgttcttccatccccggataacagcatgctgctttctctttcaacaatccaagtgctccgaatacagtcggagctgcacagattgctgcgattctctttcccttttcattgaacttgcaaagtaagtctgccagacctttatgctcttttagatgcagtgttcccggcatacctcccggaagtacaagaagttctgcgtcatcaaaaaatgctttctcaaacaattcatccgcttccacctgtattccatgtgctccgtcaatctgcagttttcccataacagaaactgtctctacaaccgctcctgctcttctcaaaagatccactacagttaaaccttctacttcttcaaaaccgtctgctaaaaatacaactactttcttcatccaatacttcctcgctttccgatgatatctcaacaatgatttcattttactgcgtggataagtcgttcgtcaagtcaagatagtactcttctcaccattgcctttttgtatttcacgtattattatagtataaacaatcaacatccaggaggaatatttagttatggaaatagaacgcaaatttttaatacaaaaacttgaggagcttccattttctcctttcaatcatccgcacaaagaactggaacaaggctatttgtgcactgctcctgtcgtaaggatacgcagagaggatgacgattatgttctcacctacaaatccaaagggcttatgacccgtgaagaatataaccttcctcttaccaaagaaagttatgagcatctaaaagaaaaagtcgacggacgcatcattcataaaacacgctatgtcattcctatgagttgtgtctgcccggaaaacgcagacttctgttccactccgctttttcttgaattagatatcttccatgatgaccttgctccactgattctcgccgaaattgaattcccggacgaagaaacagctaacacctatcccgcaccagaatggctggataaagatgtaacttttagttccgcataccataatagtacattgagtcgtatgtaaaacaagagccagacaggcacctcacacggtaactgttctggctcttactaaattactaattttcacaatcgaaagtaactgaatcttaatctgccatacggatcatcttcacaacttccggcatctcttctgccttctgtgcatactccgcctcggtcatctcgcctgtgataacagcgaattctccctcgacatcatctgctttgacaaattcaacttgtccgaacacttcgtccacacgggatttgagtacagattcttctccatgaattctgacgaagaatcttctcttcgcatccgcattcggaacaagttcgagtgtgttactctcccatcttgttacaacagttctgtgaaggtgctttgcagcatctacaacatctgcaactacagcacttgctgtcggaagcttacccgctccacttccgtagaacattgcatcaccaagcatatttccacgaacaaaaattgcattaaatacatcattcacattacacagcggatgattcttggaaagaagcatcggtgcaacgattgcagagaaagattccccttctcttttactggatgcaagcagcttgattgccatatccatcgtcttggcatacttcatatcttctgttgtgatctttgtgattccttctgtatggattgtctcaaaatccacatgttgtcctgcgatcagagatgtcagaatcgcaatctttctacacgcatcatgtccctcgacatctgcttccggattacgctccgcgtatcctttctcctgcgcctctttgagcacctcatcataatcagcactctcaaagaacatctttgtcagcatatagtttgttgttccattcagaattcctgtcacttcatcaattctgtctgctgtcagagaggaattcagtgcacgaatgatcgggatacccccaccaacacttgcttcaaacataaaattgatacttctatcacgagcaatcgcaagaagttctgctccatgttttgctaccagagctttgttggatgtcgcaacgttcttacctgcttccagacaacgttttacaaatgtataagcaggctctacacctcccattgtctcaacaacaatatctacttctgcatcatttacgattgtctcgaaatcatgtatcagaatctcttctaccggatctcccgggaaatctctgagatccagaacgtattttacatttatcacatcctgagctctttcattgatgagttcaccattggttctgaggacctctacaactcctgatcctactgtaccgtatcccattactgctacatttatcattctgctttctttcctttctgtgcttctgcatccatgctcaaatatgcgttaataaaaggatcaatatttccatccattactgcacctacattgctgatttctgcgtttgttctgtgatccttgacaagtgtatatggctgcatgacataagaacggatctgatttccgaaattaatatctctaacctctccgcggatgtctgacatcttctctgcctgttcctgctgtttgagtacatacagtttggatttcaacatctgcatcgccttatctttattcatgtgctgggaacgttcattctgacactgaaccacaattcctgtcggaagatgtgtgattcggattgcagatgacgtcttattgatatgctgtccgccggcaccactggaacgataagtatcgacacggatatcatcgtcgttgatctcgatatcgatatcttcttcaatatccggaattacatcacaggatgcaaatgatgtctgtcgttttccatttgcattaaatggagaaatacgtaccagacgatgtacacctttctcggaacggagatagccataagcattttctcccttaacctcaaaagtaactcccttgatacctgctacatctccttccagatagtccagcacctcgacttcatatcctctcttttcagcccagcggctgtacatacgatagagcatacttgtccagtccattgcctctgtaccgcccgcacctgcgtgaagtgtcacgattgcattatctgcatcatacggtccgatcagaagtgtgctgattcgcagtttctcaaagacttcctcaaatgttccaagttcctcttcaatctcttctgcggcttcctgctcctcgtcttctcctgcactcatttcaatcagaagaagcatgtcttcataatctgtaaataatttttcaatctcttttacagaatcctgaagacctttcaattctttcattacatgctgggaaacctccgggtcatcccagaatcctggttcctccagtctcttttctaattcttcgatcctaagcttctttgaagcgaggtcaaagtgaatccctcaaatctttcagcggttcttcatatgcagtcagtcttgacttcagttcatccagtaaaaccaccttaatcacctctttcatatatataactttaaattattgtaactgttcagagccaacctccaaaatgctacgcattttacatctttttttgaaattttgcttggctctgaacagttacagattatttaatctttcttccacagcattgtttgtacttctttccacttccgcatgggcatggatcgtttggataaatcttcttctcctcgcgctttttcggtgcacggactgcgctgttatctttgtttgttccagttacttttgcaacctcttctctctccactttctgctcaaccttaatgtggaataatgtacggatcgtgttttcagcgattgcatttgtcatttcaccgaacatctcatatcctgtcatcttgtactctaccagtggatctctctgcccataagcctgaagaccgattccctgacgcagctgatccatatcatcgatatgatccatccatcttgcatcaatcactttcagaagtacaacacgctcaacttcacgaagctgctctgcctccgggaactctgcttctttgttctcataagccttcactccacgttctttcagaagatgctttaactccttctgactcatactctggcattccttctcagatgggagctgaagctgtggaatcacattgtgaagattcacatccaatcctttgatatcccactcttccggatctgcctctgtagaagcgaaacgatctgtcatattttccacatattctgtaatcatgctgtagattgtatcacgcatgctttctccatcaagaacacggcgtctctcttcgtaaataatctctctctgctcgttcattacctgatcgtactccaacagattcttacgaataccaaagttattgctctcaatcttcttctgtgctttctcaattgcacttgaaagcatcttatgttcaatctgctcaccgtcttctacaccaagtgtattgaaaattcccatcagtctttctgaaccgaacagtcgcatcagatcatcttccagagaaatgtagaatctggactctcctggatctccctgacgtccggaacgtccacgcagctgattgtcaatacgacgggattcatgtctctctgtaccgataattttcaggccacctgccgcacgcgcatcatcatccagcttgatatcagtaccacggccagccatattggttgcgatcgttaccgctccatgaagtccggcatcggctacgattgcagcctcctgctcatgatactttgcattcagtacattatgcttgattccctctttcttcagcatcttgctgagaagttcggatacttcaattgtaattgtacctaccagcaccggctgtcctgttgcatgcgcttctttaacagcttctacaactgcttcgtatttttctttctttgtcttataaacagcatcctcaagatccactctctgtaccggcctgtttgtcggaatttcaacaacgtccattccataaatatcacggaactctttctcctctgtgatcgcagtacctgtcataccactcttcttgtcatacttattaaacaggttctggaatgtgattgttgccagagtcttactctctcttcttaccttcacatgttccttcgcctcgattgcctgatgcagaccatcagagtaacgacgtcccggcatgatacgtcctgtaaactcatcgacgatcataacttcaccatccggagttacaacataatcctgatcacggaacatcagattgtgtgctctgagtgcaaggataatattatgctggatttccaggttctccggatcagcaaggttttcgatgtggaagaatttctctactttcttcacaccatcttctgtcaggttaactgtcttctctttctcatcaacgatgaaatcacctgtctcttcaatttcttctcccatgatggcattcatcttggaaaactcaccgcttgcctcaccgcgttccagctgttttgcaagaacatcacaggcttcatacagagctgtagactttccactctgtccggaaatgatcaaaggtgttctggcctcatcgatcaaaacggaatcgacctcatcgataactgcataatgcaatcctctctgaaccagctgttctttatagataaccatgttatctctcagataatcaaatccaagttcattattcgttacataagtaatatcgcaattataagcctctcgtctctcgtcattgttcatctcattgagaacaacaccgactttgagtcctaaaaactcatgtacttttcccatccactcagcatcacgctttgccagataatcattaactgtgacgatgtgaacaccttttccgtccaaggcattcaaatatgccggaagtgtggacacaagtgtcttaccttcaccagttctcatctctgcgatacgtccctgatgcaggataataccaccaatcaactgtactctataatgacgcattccaagacttctgtaagcaccttctcttactacagcatatgcttccggaaggatatcatccagagtctctccctctttcagtcgttctttaaattcttttgtctttcctcgaagttcttcgtctgaaagcgcctccatctccggccccagtgcctcgatgcggtctacgatcggataaattcgttttagctcgttctcactgtgagttccgaaaatcttttctataatattcatatttccgcaattactccttctttgaattttgattttggtctgaaattccactctgttctacattctatcactatccgctcttgaattcaacaacttcatagagtgttaacattctgcggatttacaagcggagtgattaacacgggagtgaacagtaactacaaacttctgcatatggaattttcccgccaaacagatcaagagcgcttccgattgtaaagtctacttttccgccgctctcttttcgaaatctctccagatcttccattgatccgattccaccggcataagtgattgggattccgtcccagctcccaagcatccttactaattctgtttccattccggcacctttcccctccacatctacaccatggatcaggaattcatcacaatattttgaaagctcatttaacacctcgtgagataatgcaagttctgtgaacttctgccagcggtctgtaaccacgtaaaatttaccatcttttcttctgcagctaagatctaaaaccacatgttctttcccaactgcagccaccagtttctgaagcctctcttcatgaaagattccgtctttaaacacataagaagtcacgatcacatggcttgctcctgaatctagatattcctgtgcattatctgctgtaattccaccaccgatctgcattccacccgggtatgccgccagagctcccatcgcctgctttttcgtcgcctcgtagtattctgatccaactggatttaaaagaattatatggccgcctttcaggtgatctttctgatactgtcttgcataccatgctgcatccagttctgacgtaaagtttgtgctgacctgatttccttcatctttcaggcttccgcccacaatctgtttcacttttccattatgtatatcaatacatggtctgaatctcatcctgtctctccttcttttagaaaaatgccgcagttccgtttccggcctacggcatattgatcactcgttattctgcatcttgttctgcacgccattctcctgcgtcagatcatcggctgcatcatcgacaccatttgtgatatcgtctgtaacatcatccactccatccgttacatcgtcaaccgcgtcatctaggatactatctccattctggtctcccgcattatttccggtattattaccattttctccacttccatcatagttttcaccggatgtcgcatcattgagattgtcattcgctgttcctgtgttgtttccacaaccagcgagactgcaaagcatcagtacgcacatcacacagacaagcaattttcttattctcctcatttttcgtcttcctttcaaataaatattgtgtctttactatctgcaatttttcaatatttattcaaaagaaattttttacagttttgtcgctttgctgcgaagtttctccatcgctctggcttcaatctggcgtacgcgttctcttgtcacattcagttcatcaccgatttcttccaacgtatgtgtttttccatcttccagaccaaatctcaaacggatcacctgacgttctctatcattaagggactctaacaattcctgtacttcttctttttgcacaagctgattcatagcatcttccggcgttgttgcatccttatcttcaaccatatcaccaagattattctccccatcttctcctaccggagtttccagtgaaaccggattctgaagatatgacaaaatctcttttacaaattccggtgatttatccttcatctctgctgctatctcttccggtgtagcctctcttccaaatttctgctgaagatcttttgaaattttctgtactttcttcatattctctgcaacatgaaccggcacacggatttctcgtgactgctgatcgattgcccgctgcattgcttctttgatccaccatgatgcatatgtggaaaatcgattttcctttgtataatcatatttctctgctgcatgcatgagaccaatatttccctcctggatcagatccatgagtgtaatccctcttccagtataatgttttgcgagagataccaccaggcgtagattcccctcttccagctttcttcttgcatcctcatctcctgaagcacttttacacccaaggtccctttcctcttcttctgacagcaaagggatctgtccaatctcattcagatagattttcagcggttctgttacttctgttccttccggaagatttaagtctttttccattctagtaatcctttctatcttcagtcctaattcaagaatgcctcggcattcttgctgcgaggtgcgcgtcatgcaattgcatgaccacaagggaaacaataagggaaagctcacctgcgacaaatccagtgttttcaagggtttacagagaatttctttaaaaatataacagttattaaatctcttaaaacaggtgaaatctcaatcggaagttgtggaaataaaaaatatggaattaagactattgcgctattttctgacggtggcaaaagaacagagctttacaaaagcagcagaacaattgcatattacccagccaacgctatccagacaaatggcggcatttgaagaggagcttggagtaacattatttattcgaagcgggaagaaaatttcgcttactgaagaggggattttattaaaaaggcgtgctctggagatccttaatcttgaggaaaaaacacttgaggaactgaaaggaaaagaagatgttgtagagggaaatataaccattggatgcggtgaatttgcagcggtggagacattggcggagatatgtaaaacatataaagaaaaatacccgctggttcagattgtattgcatactgcaacagcagatgcagtgtatgagatgatgaacaaaggacttgtagatattgcattattcatggagccggtggacaccgaagggctggattatatccggatcacagattgcgatcactggtgtgttggaatgcggccggatgatccgctggcagaaaaagagtttataagaaaagaagatcttattggaaaaccattgatcctgccggaaagagtaaatgttcaaagtgaacttgccaattggtttggaaaagatttttcgaaactgcagattgcttttacaagtaatcttggaacgaatgccggagttatggcagcaaatggactgggctatccggtatccatcgaaggtgctgcaaagtattggcgggaggatattcttgtacagcgaagaatttctcctgaaatcacaacaagtactgtgattgcctggagacgaaacattccatattctctggcggtcagtaaaatgatagaagaaataaatgcttttcaggcatagaatggaattcaatataagcattagacataataaaaatatcaggtataatatagatgtataagagaaattcaaatcttatacatctatttttatacgaaaaattcgcaaagaaaggggatttttattatgagtaaaaatttagtcgcatttttcagtgcaagcgggacaacaaaaaaagtagcagaaatgattgcagaggaagcaaaagcggatttatttgagattgagccaaaagttccatatacaaaggctgatcttgactggatgaataaaaaatcccgcagcagtgtggaaatgagtgataagaaatacagaccggagattatgaagaaaaagatggatatgagttcttatgacgagatccttctgggattcccaatctggtggtatgtagctccgacaattgtcaatacatttttggaagcctatgatttcagtggcaaaaagattgtgctctttgcaacatccggtggaagtggattcggtaatactgtaaaggaattacagccatctgcaccggatgcggttatcacagaaggcagcctgttaaaccgtggaacaaaacaggaaatcagtgagtgggtaaaatctttataaataacagtgctatggaggtatacagaaaatgggaaaaatagtacagacagcaggaagaaatacacttggtgaattcgcaccggaatttgcacattttaacgatgatgtacttttcggcgaaaactggaataatcaggacatcgacgtaaaaacaagaagtatcatcacagtggttgctctgatggcttccggaattacagattcttctttaaaatatcatcttcaaaatgcaaaaaatcatggtgtaacacaaaaagagattgccgcagtaatcacacatgtcgcattttatgcaggatggccaaaagcatgggctgttttcaatcttgcaaaggaagtgtgggaggcaggtgaaggagatttaccatacgaagaggaagcaatgcgggtgcatgcaaaagagatggtatttccaattggtgcaccaaatgatggctttgcacagtatttttctggcagaagttttcttgcaccgatttccacttctcaggtttgcattttcaacgtgacatttgaacccggatgcaggaataattggcatattcatcatgcaaaaagcggtggcgggcagatcttagtatgtgtagccggacgagggttttatcaggaagaaggcagggatgcgatagaaatgaaaccgggtgactgtattaacattccggtagatgtaaagcactggcatggggccgctccggatgaatggttttcccatctggcaattgaggtgccgggagtggattgttccaatgagtggtgtgaggcggtatcagagaaagagtacgctggattaagataaggagagcactatggaatacggtaaactcggaaatacagatatagaagtgtcaaaattatgtgtgggctgcatgagttttgggaaagctggaaccatgcatgactggacgctggatgaagctgaaagtgagaatgttatcaagcatgcacttgatttgggatataacttttttgatacagcaaatggatattcagcaggaacaagtgaggaatatttaggtaaagcattgaagaaaaatgtagcgagaaatcaggttgtgattgcatccaaggtatattttaatgaaggtcgtttatcaagacaggcaatcatgagggaaatagatggaactctgtcacgtcttggaaccgactatcttgatttatatatcatccatagatttgactatgatacaccaattgaagaaactatggaggcactgcacgatctggtaaaagcaggaaaggtcagggcacttggtgcatctgccatgtatggatatcagttttataatatgcagttagccgcaagagacaatggatggacaccattttctgcgatggagaatcattataatttgctttacagagaggatgagagagaattgctaccaatttgtaagcaaatgaaagtttcgttaatgccgtatagccctcttgcagccggacatctggcaagaccacagtggaaatcagagtctcttcgtggaaccacggatagggttgccatgggaaaatatgataagactgaagcggaagacatgcagatagttaaacgtgtagcggagcttgctgaaaagtataactgcaaaatgtcccagatagccattgcatggcagtgggcaaagggaattctatcgcctattattggggcaaccaaaacgcagtatctggatgattcagccggagcatttgacattaaattaactgccgaagaccttgcatatcttgaagagccatatgttccacatgagatagttggtgcaattgataaaaatccggcgcaaggtgttattttgcttgatgaaaagaaataataaatgaaattactgtttttctatacgaagagctcgacagattttagataattgcgttctgtgaaggatttgcaattttaggaatgatatttttgattatcagttgatagtcaacttcaagtttgccaacttgccctttgagagaggagaaatccctttctcaaagggctttttctatttatacggatattcgcaaactacaagataaagccaaaacttcatatactctaagcacaaggaggttgaggtttggctatgtcctgctggtcttttgtcagactggcgaaaaaggcagaagccaattatccgattcgaaagacagctattgtggatctgaatattctggatgatttttaagagtctttcgatatgttagatgagtgctataagagatatctgttattaagggcagagggacaaaaagcctctctgcccttaatgaacaaagcatgttcttttagaaaaatttagtcgttgacagataacatatcttgcattataatacatttaacaattaggttaaatgttaaatgaggagcgtgatgaattcttgggtatacaagatacattaaaagcactggcagatccaatacgacgtgagattttaaatttattgaagaatggacggctttctgctggagagatatgtgaacatttttcagtaacgggagcttctatatccagacatctggcaatattgaaggaggctgatttaattcgaaataaaagagagggaaaatttatttattatgaattaaacacttccgtattggaagatgtcatgttgtggattatagatttgaaaggagtatcggacgatgaaggaaatgataaaaaaatatagaggttcattaatttgttctgttctggtaatgctcatcggggttttagtaggattcactagtacacagagcatgtgggcaaatgtgttttttgtagtgacggattgtgcgctggtggcaataatattttatgataaccggaacagacagcagagccgcaagattataggaatgacgatgtggattataccaattataacattactctataatggtattacaagactggtcaatatgggtgcagatatggaaaatctgtttatggcagtaatttactatggaactggactgctgtttatggttattggaaattatttgccaaaagtgaaacagaataataccataggaataagagttgtatggtctttaatggatgaagaaaactggaatgcaacacatagattcagcggcaaattatggatggcatcaggtattttatgtatgttttgtggactttttggggaaagcatggctgcactggttgtgtatattataagcattatggcagctgcaatcattagcattctctactcctaccttttttataagaaaaagctggcaaccggagaaggcttaaaaattcagtataatacaaaaaaaagtgtgatatatctgatcatcgcaatttccactattgtgtttactatatggactttgttttgtggaagcattcaggttcgttgtaatgatcgtgattttaacattgaagcaaaaggatggaatgattatacagtggagtattcgcaaattgacagcatttcttatgaagaaaatgtattgcagaacaataatggttacagaactaatggtcttggaaacctgaagtatgctatgggaaacttcaaaaacgatatcttcggagattatatccgctacactcatgcctcctgccattcatatgttgtcatgaacatagatggaaaaatattagttgtaaatggggaaaatgacgcagagacaaaggaaatctatcagagaataagtgagaaggtgtcaaaggaaagaaaatagttgtcggaaacgctgagaaaaaattattctcagcgttcaatgctcctccatccaaattcggatagattaatgctttgtttgtgtgatcgataagcatggatagaaaagcgatgtatttaagctgcgctcctgaaaatattttgattctctcttttacattgttcataaaaattagtcctttttttcaatttttttatcaaatttcctacacttgaaaagtgcgaacataataatcgtttcatgcagatgctcctttatcaattccgattgttattcatatgatatcatactatttctttaattacatctacttactgggtcatctttgtcttttaaagatccctataatgttgtacttgctacttgtttgctgaatttttctcaaataaagaaatattattctggcatcttccggcttctgtattttttgggggtgatcccctggtattctttgaacttacgaatgaaatagctgatgttgtcaaatccacagttaatggcaatatcagaaacagacagtgagctgtcatccaaaaggatagcagcttttttgatgcggtattcattcaggaaggcgaacggtgtttttcccatctcctgatggaaatatctgcagaaataggtcgggctcatgcaggcaatgtcagcaagttcttttaatgtaatttcttcggcgtaatgtgaccggataaaatcaagcacttccttcagctgattcatggaggagagctgttttccggtagtctggttctgtataagaatttctgtgcggaaacagagttccaaaatctgtagaagacagatcttaattttgagaagtgcacattgtttcgggtagtggtaattatagatcaattcaagaaaaagctgtcggagactttcttgttcttcctgactgagagcactggagatattgtttgggaagagcaatttcttctgtgtgattggctggatgaaattgtgctgacaggcatcatacaaatcaaaattaagtaattgaggatcgaaaacgattgcatgatgcagggaatgggtgtgtgcgcttagttcatgcagttcaccagagttgatgaaatagaactcaccggttttcatttcataaggggttccagaaatgattccgtgcatagttccttcctcaatatagagaaattccagttcctcatgccagtgggcagtaacggaatagaaaccgttcttatctttatgagaataaatctgtaaggggaacataggggttccgtgaaaatttgtctcttttaaggaacgtgacatgagtgagctcctttcttgtagtgaaacagttcagccatgcagctcgaattcgacactgcgtgacgaatcctcgcttaggggcgtctgccctatgtctgcataagaacagactattttatataagcgagcttataacgatagtctgtccttatacagccgcatggctgaactggtgcataatattgtgttattttttgataaaataatgaaagtatcttcttattttttgtattatacttggttcaaataaaaaaagcaagaagggggcataagatggagaagaaatggtggcaaagcagtgttgtttatcagatctatccacggagttttgcggacagcaatggagatggaatgggcgatattccaggaattatagggaaaattgaatatctgaaaaaactgggagtcaatgtactctggatctgtccaatctatcagtcgccgcaggatgacaatggatatgatatctctgattatcgtacggtttacccggagtttggaacaatggaagatatgaagatattgatacaaaaatgtcaagataatgatatcaaaatcattatggatctggtagtgaaccatacatcagatgaacatccatggttcatagaagcaaagaaaagcttggataatccatatcgggactattacatctggaggaaaggtgaagatggacagccaccgaatgatctgatgtcaaatttcggtggaagtgcatgggagtattctccggagacggatgagtattatctgcatttttacagtaagaaacagccagatctgaactgggagaatccgaagttgcgacagaaaatttatgacatgatgaactggtggctggatcaggggattgcaggtttccgtatggatgtgattgatctgattggaaagataccggatcagaagatcaaagagaatgggccgatgcttcataaatacctgcaagagatgaacgaagcgacctttggtcacagggacagcatgacggttggtgagtgctggggggcgaccccggagatcggaagattatatactgatccggcaagaaaagaacttagtatgatcttccagtttgaacagattcagctggataagaaaccgggcggacaaagatgggatttgaaaccactttatctgccggatctgaagtatgttttcagcaaatggcagacagagttagaaggtcatggatggaacagtttattttggaataatcatgatctcccaagaatcgtttcccgttggggaaatgacggagactatcgtgttctgtctgcaaaaatgcttgcgacactgcttcatggaatgaaggggacaccgtatatctatcagggggaagagattggaatgacgaatgttccatttcagacgattgatgaattccctgatattgagacacagaacatttatcaagaacgtctgaaagcgggattcacagaggaagagaccatgtatgcaatccgggcgaaggcgagggataatgcaaggacaccgatgcagtggaatgccgaaaagaatgcaggatttacagaaggaattccatggtacagagtcaatccaaattataaggaaatcaatgtagaacaggcattagcggatccagagtccgttttctatcattatcagaaattgattcagcttcggaaagaacatgaagttatggtatacggaacttatcaactgctgttcccggaggatgaagacctttatatctatacaagaacgctggaggaggaaaaatggctgattgtctgtaactttcatgagaagacaagaaagttacagtgtaagagagccgggcaggtcatgcttagtaattatgcagatacgcctgccgcggaaaaaattacagaactcagaccatatgaggcgattatttatcagatggaatcctgggatgcgaatcatggagaacgcggacaagatcatagttctgattttgaagccgatattgagttggtgtagttccgaaagcttttcgaaagaccttacaaaaataattatcatttgaaaatccgaccatggaggcgatttcggcaattgtgtgctggcggctctgtaaaagaagcgcacaggatttctgaagacgcagattcgccagatattttccgggcgagattccatagagatggttgaattctctgcaaagatgatacttggacagcccgacggcatcagcgacttcgtcaaggttcagatccgtgttgtaataattggaatccagataattcttggccagtgtaacacgaggtgaagaaagtgccgggtgttccaatgcataatctgccagatctaaaagaaaagcgtaggccgctttggaattatcaaataccgatgctaactgattggaaatcgcatcagcatagagctgtttcatctgttcaggtaaagtactggatgcttccaggtggaaagcaggtccacaggattgatgaatgtggtagagaagagggagacactcggaggaaaattctagataaagaacatcccaacattccgaatcatcgggtaatgagtattggctgtctccgggtacttgaacaaggaagagatcacccgcctgttgaggataggtatggtctggtgtctggaaacttccttttcccgaaatcgtgtactgaagtaatacataagagtttttgcggactcggttatcccaatgatagtcatgggaagtgatgtgatgcatgccgattccacgaagtgtctggaggggaagcgcagaggttatatgaaaaccgacggaatcaaaaggcggttgggcagatgattttgtgtttgtcataaaaagtactcctttcaaaataaatgaagattgcggggcgcaacacgaaacaatctgtagaaatcttagttttgggtttttatatccgatattataatatagcaatcaataaaaaatagcaagaaattaccattcactaatctgcattaccattgaaagtgaaaagagatggaagttataatgcatttagtcaagcgatgaaatgaagcagaatgagagagtggaggaatagaatgcagatcagttttgaggaagaacagcaggtttttcatctatacaacgataagatcagttatgtgattcaagtagaaaaacaacgatatttaaagcattgttactacgggaaaagaataaagagatggcacagcagcatcaaggattattattacgaccgtggattctgtgcgaatccgatagcggaagacaggacattttctctggatacacagttgagggaatttccggagtccggacagggggacttccgaagtccagcttacgaactagaagatagaaatggagataaaaacgcaagatttttctataacggctatcgcattctgagtggaaagatcgctccggatggcctgccacatgtctatactgatgcggacaccgaggcaatgacactggagattacgcttcaggataaggtgagaaatcagagaattctgttatattacaccatctatgaagatgcagtggtcacacgattcgcaaaatggatcaatgacggaacagaaccgatagaaatctgtcgattcttaagcatgaacatggatcttccaacacaggaatatgatgtactgacattatccggtgcacatacagaagagaaaaacgtgtatcgacgtccattgtgtgcggattcagtcacgattgaaagcagtcgtggaacgagcagtccacaggcaaccccatttatcggattgttaagtcccgggactacggaagagcaaggggaagtgcttggagtaaacttgatttacagtggaaacttctatggatgtgttcagtgtggacagtatggaacaatcagggtacagcttggaattaatccgtatcagtttggatggcagcttgcaccgggaacaagcttctgcacaccagaggctgtactggtctatagtgtaaatggacttgccggaatgtcgaatatatttcaccggttatacagaacgcgcgtctgccggggatggtacagagaccgggaacggccagttctattgaatagctgggaaggtatgtattttgagatcaatgaagagaaaatgctgacgctagcggaagaagcagcggaacttggaatcgaacttctggtgatggatgatggctggttcaagggaagaaatacagatacgacttccttgggggactggacggaagataagaagaaatttccggatggcctgcagagtcttgccgaaaaggtgaaacagaaggggattgatttcggaatctggtttgaaccggagatgatttcaagggaaagtgacctttacagggagcatccagactgggtgatccgaagtccgctttacgaaccaatactcagccgacatcagctagtactggatctgtcgaatccggcagtttgcgaatatctgatcgaagcagtcagtaaggtgttggtaccgggaaatatcagttatgtgaaatgggatatgaaccggcatctgacagatcttggaagtgcttatcttgacaggaaaaatcagaatgaactttcacaccgctacgtgcttggactttatcaggtaatggagacattgacagaacgttttccacaggtgttgtttgaaagctgttccagtggaggtggcagattcgatgcaggaatgctttattacatgccacagacatggaccagcgataatacagatgcggtctgcaggctgaaaatccagcatggaacaagctttctgtttcctacagttacaatgggagcgcatgtgtcagcatgtccgaatcatcaggtcggacggaccacaccgcttgctacaagatttgccgtggcggcagcaggcaatcttggatatgaactggatttgaagaagcttttaaaagaagagaagaaagaagtcagagagcagattgcagaatataaaatgagacgaagaaccgtacagttcggaacttattaccggctggcggattcatttcaggagaatcaaagtgcctggaatattgtttcagaagatggaatggaagtcatcttcactcacgtgcagatccttgcacgctcagcctacagggttccggtaattcgcttaaaaggactggatccggatgcagtttacacagattgtgagaccgggcaggagtatggcggggatgaactgatgtatgcaggaatccgaataccaagaatcagacaggacttttcaagtacaacgatggtactaagaaaatcctgattgagatagaaaagaaatgaagttacaggaggagttagaatgagtaaagagcagagttaccagaatgcagcaagtgaacttctgcgtctggtaggcggaaaagaaaatgtaatcagcgcggctcactgcgcaaccagattacgtctggtattaaaagatgagagcaaagcagatgtagatggaattctcaagacagagcttgtaaaaggacagttttccacaggcggtcagttccagatcatcattggaagtggtacagtagatgaagtatacaaatattttattcagtatgcagacatcaaagaaagtacaaaaaatgaagtgaaaaaggctgctgaccagaagatgaatccgttacagaaactggtaaagatgctggcggatgtattcgtaccgattattccggcactggttgccagcggtcttctgatgggtctgaacaatgttctgacagcagaaggactttttgtctcaggaaagtcacttgttgaagtatatccgaatattgcagatcttgcatctatgatcaacacatttgcaagtgcagcatatgcattcctgccaatccttgtagggttctcagcaacaaagatgttcggtggcaatccttatcttggagcagttatgggaatgatcatggtatccggtgatcttctgaatgcatattcttatggtacagccattacagagggaacggttccggtatggcatatcggagcgctgacaattgagaaggttggatatcagggaactgtacttccggtacttgcagcggcagcaatccttgcatttatcgagaagaaacttcacaaagtagttccggaatatctggacaacctcctgacacctgcactttccgtactcgtaacagcattccttacatttacagtggtaggtggagtgatgcgtacagccggagactggattacaaatggtattctgtggctccatgatacattaggtgttgtcggtggatttattttcggatttatctatgcgccattaacaatgacgggaatgcaccacagtcttcttccggttgatatccagttgattgcagcaggcggatctttcctctttgcaatcgcagcatgcaacaatgtggctcagggtggagcaacactggcagcaatgttctgtgcaaaggataagaagatgaagagtatcgcagtttcttccggtatctcagcactgcttggtattacagaaccagcaatgttcggagtcaacttgaagatgaaatatccattctatgcagcaatgttcggttctgctgtaggatgtgcttatgtgacactgacaaatgttcagaatatctccccgggagcagcaggaatcatcggattcgtatgcatcaagtccggcggaatgctgaattatatgatcggaattctgatctcacttgttgttggatttgcagtgacaatggcattgtccaagcattcgaaatttaaagaagtgtaagtcattggggacggggaaaacggatttttccccgtccttattggctttgagaataagatataatacaagcaaatccatccagacaatatattcgggatctggtgaaagaaatgattgtacattgcagaagccggaaaagtgcttccatttacagcaacgacattgacaagagcagtaaagtagttggaagacctattgtggagtcattatccacgataggtctttcatagttggcacttttttaagacggaatcaacacacatgcacaatatcccggagctggttgaaaacagtagatggttagagtcttgtcgatttccggactataatcatgcaggatatgtttattgccgtttaacgctacatccgcataagtgacaagccattttttatctccattttcaaagacttcataaaatgaacgattcaacatttctgaaacgggaacgccttcaacaacagccatttcatcattgcagtaacggaatacaaagtctacaccatgtccattcgcatcaaatacaagctcaataatacaaaaagcaagtggcatatcattgagaaagctacagttatcaaataattgaagtgagctgtcttctgaaacatccgaaaggttctgcgtatttaaaccaagttccttacggatctgtttgtgctgacttagattacgttttcttccttgaaagacagcaccatcagtcattgtataaagtccttcatcggatatatgaacaatttgattttttcgaagaacaacgccctttgagatatttagaaaatcttcttccggcaagtagagcataagttcttttatcgggattgtagtcgtaatgctttctcccgaggaaagcgtaatgattgtgtgaggattctgtctggtaaggtaaaaaatatctgaaattttgatattctttcgttcgaaatatagtggaacattataacgcatatgagaccttcctttattgtgataattctatattactatagttgttttgaaaagacaataagaacaattaaaacgcaataattaacacaaataaaatgcattttaattaaattttacagcgatttatcgaaaaacatcaaataaagatacatatttgagtaaaaagattgctgattaactgcgtgagtgatattataaaaagtataaataatgatacaaaaggaatcatcaggcagagacaggaataaggaaggggtgggaagcggatgaaaagaagaatttcaaaaaggattattgcaattggaatgagcctttgcgtagcattttcgattatgcctttaccggtaagtgcagaagcagagactgctgcaccggcagttaaacaaaataatctatgggtgagtaccggaaaaacatttgtcaatcgtatttacacagtaggggtgactacttgtggatcagcacttgtcagaattgccggagcgacagagagtgaaggatttcagaaagtaacttcatttgttaataaatggatttgtggaggcaataacactggacagacactggcagaaattcaggctctttgtaatgagatacttaatgaagttaagatcgttgatcaacatcttaaagagtatgatgcagaaatagagaatacacttcagaaaatacagtacacagaagcgaaaaatgagctgaatcagcaatggtctaaagatatagatgtatatgaaactgccggaaatgtaggaaatacattgagcgcctatgaagattatatgaaagccgcgcaactgtatatggatggtaagacggatataaatgctgtcgaaaagagtaagcaaaagctttatgacaattttattgaggtttataaagcggctggaaatagctttgaaaatccaaccgatgagaaaaaaaggacgctatattttgtaatgacacgatagatggtgtattcaaaagatcgatttggagtatgatcaatgcgttgaataagccgagtgatgagaaaaattatgcggatgctgcggcacaatttgcatatagggcttatggattttctggtgatcaatataattacatagtttcaagtattgataaacaatttatggaaatcattaagatggagatgatgtatcaggaatttattgcacagcgtggtgattattttgaagagaaatatccagatgatgaaagtaaatgggagagctatgctgcatggacgaatgatttaaataagttgaatgaagatgttgccaaagctatggatactatgcttgacagagaaatattagtttcggattcaacggttggttcgattcggatgaaattggatgaatttgtaaagccagaagacatggtatctgtacgtatgaaaaatgaaaattaccatgagaaattaacaggcgagttctatgagaatgagcaaccgattatcgatgcgtttaacgaaggttatctttaccttattgaggagtatggttggaaatccaatgctgatgtaattacgccgtttattaattttcacagaattgctgtgccgacacctaaaacggaggagaatccatcgggaatagatatttattatattttcgatacatcacagccacacgatgcggaagaggattgggcttggaattcagacgattctgttcctgaaaatttgcggttttatcaatttgaagagaaaatagatcttactttggcgagagatcaacatattccatcttgtgattttattaatttaacaaaagaaaattatagcgatgggcagaatcaatttagttgcgcgaaaagtacggcggaatttcagagcttattcgctacaggactattcagtgcattatcaagtatacctggtgattatctgagtgaatacctgcttacaaaaaaagatacaaaaacatatattgctttatcggattatgattttgattatcatgatgcatgggcgacaagctatacgattttccatgtggttgatacaacaggacagtatccgggaagcagtcttgaaagttctactttaagtgcagaaaaaattcaaccggataaatcagcgggggcatattcggcatataccgttatattaaagaaccgcccacaagaagatggttattataagacgaaagttgatgttgctacgaatggagtcggagatacagagttagaaatggttcaggaagatgggacaatatgtcaggaaaatattgttccttcaggaaaagaggtaacacttcggtttaaggcggaaggtacaactgttctggaatccattacattacagagacataacaatacagaaaatccatcagaagtaacttcggaagaaacgttgttgacaaaagaccagatcgcgacattgagtccggatgaagaaggatattatacatatacatacagtgcaccatattcaaatgcaacatttgttttaaacggagcagtaggacataaggtatatgtgaaaggtacgaatcagtcatttgaagatgcaattcaattggattcctatgtagattactttgaagaaggagaaaatgttgaattttatgtatcagataatgtaaagagtgtcggatattatgagggaaatacttataaagagcttgcattaacagaaaattatgagggtgacagaaaaggaagtttcgtaatgccggcgaaggatattacattatattataatgcagtctgcaaggaacattcctatgacaatggattctgtacgaaatgtggtggatatcagccggcagactataatgaatctacaggcagttatgagattgggaatggtggacagatgttttggtttgccgctcttgtaaatggggacggtgaacatacacagattcaggaagcaaagccagatgcacatggagtgctggtgtctgacatttcacttaagaatccggcggatgaaaactatgaatggaaaccaatcggagaattcaaaggaattttcgacggacagaatcatacgatttctgatttcagtatgacgaaagtaaatgatcagtcaataggctttttccagaaccttatgagtgacccgaacgagacagacgaggcaaagaaagcgacgcttaagaactttacactgaatggaacaatcgttacaacagcagaggcggcaagtgcagtaggtggtgttgtaggaacaacttccgacagtgtgatcaggcgggtgaattcaaatgtaaatattggaagtggattgatatactatatcggcggaattgtcggagagatcaatgcagcaacttctatagaggagagtacatattcaggtaagatcgtactggattatagtttctacggagtcggtggaattgtaggttttgtaactgatgatgatacatatgcaggcagcacaaaaatcaaggattgtgcaaattacggattgatcacatattataaagtggaaaatcacggaggacgtggttacagcggtggaatcaccggacaggttgcattgggtgaagaggatttcattctttctgattgttacaattatggcagtgtgcttgctgaagagtggaaggaaatctatggtgcaatttccggatactgtgcggcgaagaaagatggaatcaagaataattattatctcgatacacttccggtaaaaggtttcctaggagaagctgagattgcgaatgatgaagaactggcaaaggcaaagacagcagaacagttcaagagtggtgaagaggcatatcttttaaataacgaggtgacagacggctctcaagtatggtatcagaatattgataatggagaaactccggatgcttatccggttctggatgatacacatggcacagtctatcgttgggaagatggaacctattcgaattatgagaaagaacctgtagaagaaacttacgagattcgtacatttaaagaatttaaagaaattccggaaattgttaagaagaacaatcgtgcaaacttcaaactgatgaacacaattttcggagacggtgaaacaatgacagaatcaatcggttcagcagacaatccgtataatggtacatttgacggacaaggatattatgtctaccgattcgatatcaaatcatccgatggaaatgcagcactttttgatacgatcggtgcacggggaagtgtaaagaatttcggagctttttatcaaaacattgaaggagagaaagcagcaggtcttgcgattgtcaattatggattgattgatgagtgtatcagtggatcaaatctcagcggttcatttactgatcaacttacgaaggagcctaaaaatttgacggagacaactacatttgttaagggcacatcaatggcaggaggcgttgtagttgagaataaaggtgtgattcgaaatactgcgaactatgcaaaggcaacagcaagtgcatcagatggaattgttggaggaattgcagtagtaaacagcggaacgattgagaactgtatgagtataggcactctgtcaacaaaggaaaatggaattgccggaggaattgttggaaagctggataaaaatggttccattcaaattgcatatagtgcacaaactgcgatagaaggtgggacaaccggagcagtatttggcgcaaaagaagaaacagcaggagctgtaaataacacatattaccaggataccttatcaggaaacgaagaacagggaacagcgaaaacagcggctgagatgaagagcaatgcttttaaagaggaattgaatactctggtagcaggcaatgaagaattgtgtagttggacatggaattcaacaaagaatcaggggtatccaagaatcttatcttcgcttattacggaagttgaattagtgaacgcatcaagaggacttaccgtaaaaggtatgatgcataaagatacgaaacttcagttgaacgagcttgacaagaagaatgacatttatcaggcatttaagaaatatgcacagaagacagataagcaggttctttattcagcagaaccgacgttggtatatgaagatggacagccgtctgcatacgaaggaaatctgaatgtaaaactggatttgtcaaagtatcgaggaaaaggatataaggttcttgtttatcgaaataatcagatcgaagagcttgaaattgataaacagatgatcgcctcaaaagatgtagaagagatggttccgtttgctgtactggctgaaaagagtgagatctccaaagcagttgatcatattaaggatacagtaaaaacaggagataacagcagtgtgattcttttgttttgtattgttgttgtggcaggtagtgtagcaggtggagttatttactggagaaaaaagaaagcaaaaaaataagatgaaaaaaaagacaaagattataatcggaattctgattgcggctgtgatagcagccgcaggaattacctggtatgttatgaaccaaaagaatcagaaaaccggaaattcgtctgcagaagtagtagcctgggatgtggatatcgaggaggaagaaccttccgaggaaaaaggaatcctgattccgggatatacaagtatggtaatgaaggcgaatacaaaggagcagacagtaagcattggtaatccggcagataatgattgcatttttgtaattgtattgaaactggaagacggaacaaaactgttcgaatcacaagagttaaaaccgggagaaggtctggagaatattacgcttgaccaggagctggaagccggagagtatcaggcagttatagaatataagtgttattcattagaagataaaagtccgttaaacggcggaagcgcagagtttaaattatatgtaaaagaataaaacgtggaggtagaatgatgaaaaagaaagtagtagcaggatttatggcagcaacgatgatggtatctgttatgtcaacaggcgtttttgcaaaagatcttgacccgtccagtgagactcaaagaacgggagatacaacagtgactgcaacagtggaggaaaatttaaataaagcagattatattataagcattccggagaccgttgattttggaaaaatacagcagcctgagacagaaggaaatgcatattcttataaagatatcactgtatcttgtataaaagcagataatctcggggcaggaaatggaatcgctgttttagtaaaagatgcgacagcagctgaaagttctgatccgtttctcctgacacataatacacattcagattgtgctctgacttatgagattatgaataacaacgatgagagtattcaaaatgggacatggtatgcaaatggatttttatttaatctatttacgggagcagatcagtcagcaactgacaaattaagactgaaccgtaatcagttatataataaagatctttctgtctggggtggacagtacaccggtacacttaatttctatacaaagattgtagatgtacatgcacaataaaaaagagtggaataatacaagaaaaagcttgcttagactcttttttatgtcgctcgttcttgtatgtatttgtactttatcagttccaaagaaatctctggctcaggagacaacagattctgcaacttatgcaggaagtaccagcgtaaaagcatatgtgacaggaaattccgtgaatgagcaggagaaccatcccgaagatgaggagaaacatttacaagacgaaagcacaacaaatgcgaaaacaggagatgagagcaaagcaacaatttggattacgatattgatattctcaatgcttgtatttggctgtggagtaaaatataaaaaaggtaacaagtaaataaaaatttgtgttatcatagaaaaaacaaaagaaatgcagaaatgaaaggggcagcaaaaatgaaggagaataaaacaattaaaattatcacaatgatcacgggaattctgacagtgctgttaggtttttatgcagtagttcgacctatgagaacttttttagcaatcggatggattcttggaatgcttctctttgtaaatggtattgaacttgtggtactttcattgtccaaagaaaagaaggatatcggaggatgtattcttggagtcctggaaggacttggcggtatcattttattgttcagcggcgtacagagattcctgacagatatcatggcaacttatctggttggtgccagtgtcctgatttatggtatcttccagattgtagccggagtgaagaagtttcaagattctaagggaaaagcaattttagcaattgtttgtggtgtgttatccattattgtaagtattatagcctttactcatccggtattgactatgttctcagttggatatatgatcgcatttgctgttttaatgcagggaatcaatatgatcgtacttgctgtgaattttggaaaagagagtgagtaaatcaaagaaaaatagtaaatgactaaaagaagagaactccagtaaaatgagagttctcttctttttttgttatggcaacagaaatacaaatcacaggacaacaagtaaaactgagtttatctgtatgaaaaatatgcttgacgcaatatattgtctgaatttataataaaaaagtataaatcatacgaaaatatggttgagaggaaggaagaaacggcgatgaaaaaggaatatttggacaagattgcagaatatggacagttaattgttgtttcgggaccgtctggtgtggggaataagacggttttgagagagtatttgcaggatcatgaacaggcgtgtgtcagtgtatctgtgacaacgagaagacagagaaagcatgaaatagacggaaaagactattggtttgtgtctgtaccggaatttgagcgaatggttcgtatgggtgagatgttggaatatacatatgtgaatggtaatgcttacggaacaacaaagaaaagtgtagaggaagcgcgtgcaagagggaaaaatgtaattctggacgtggatacaatcggagcaatgaagattcgtgcactttgtccggatgctacactgatttacattttgccgccatcttgggatgaattaaagagccggctgtctagcactggaatttataccgaagaagaagtgaatgctttaatggaaatagcagaagaagagatttcatgtgccaatagttatgattacattttggtcaatgatacaatttcaaatactttgagtcgttttgcacagattattcatagtaatcgctatagccgtaactgtatgaaagaatttcttgatagttacatagacggagaagtgaagcctcatgttcagtcatacaaagaggcattactgtaaattttttgattattggaaatattctttgaaagatggcacatattttgcgaaagaatattcggatgaaaaacagaggagagtcgtttcgcctaccttgcttttaaagaaaacttacagcgtatgctcacggacagtgagttcactgtaaaagaacatatatatagggaaaataaaagctttacattataaaaagtattatgataaactgaatatcaaactgaaaatttgcggtgtaggagatttcttacaccgcatctgtgttttagaaagtagagggatgaatatgccaataggagttattatcaatgccctgtcggttgcagccggcggtgtgatcggggcattattcgggcacaagctgtctgcaaaaatcaattcggaacttaccaagatatttggtgtctgctcaatgggaatgggagttagttccattggacttatgaaaaatatgcctgctgttatttttgcagtgataattggaactgcctttggtctggcagtcaatctgggcggaattattaatagcggagcgacctgcatggagaaaccagtgggaaaactcttcccaaataagaacaaatccatgtccagagaagagtatatgtcaatgcttgtgacgattatcgtattgttttgtgccagtgggacagggatttatggttcactggattccggaatgagcggtgatcatacaattttgatttcgaagtcgattctggatttctttactgcgatgatttttggaggaacattaggtatggtggttgctgcagttgcaattccgcagtgtgtgatcttccttattatattcgcagcagcaaaatttattttcccactgaccacgccggatatgattgccgatttcaaggcatgtggaggcttcctgcttcttgcaactggtttccggatcgcaaagattcacgattttccagtcgcagacatgatcccagccatggtgcttgtgatgccggtgagctggttctgggtaaatatgatcgtaccgatgctgtaaagcagaagaaatgtatcattctatatttcagcatgttccaatatataattcttaaaattcgtaacaacaggtgcctgataaacattcttcaaagttgccatgtagaagagtctttcccaggacggagttgcaatctctatgattgaaaccggtaaagaggaaagaatcggcattcgcggcacaactgcgatgccgaatccggcactgactaatccggcaacaccctgatcttcttccattgagtaagcaatctgagggtatccgccacatttttcaaataacttgtcaattacatgtcttaaaccgcttcgcttagagaaaacgatgtgcggatacgtaagcgcttcttttagatcaatcgaagttttcccgtccaaaggatgtccttccggtacgatcagtacaagctcttgttttgcgaccggaacaaactcaacgagcggttcattgtccatcttggaacaaaatgcgatgtcgtattttcgctcttttaatccctggatcatgtcggatgtgagtccggtcgaactgtgaaaataaaaatcgatttttttgttaggcgtggaatccaaaaaaccttttacaaagttcggaacaactgcactgctgagcgtacggagttcaacaatatcgatgcggccttctccaaatccggtcatctgcagtttattgatgcttgaatccagcatatccaaagcctgttccacatcggcaagaaaagcctgtccacattttgtgaggacaacgttacgtccatctttttcaaagagttttactccgagctcactttccagagatgagattgcatgacttaagcttggttgagtgatagaaagaatctccgcagcctttgtgtagtgttctagatgagcgagagtaacaaaatatctaagatgatagagattcataaagtctggtaccttccttataaaaatttgtatcttcccatttaatcaggttcattttatatctatttggtaactgttcagagccaagcaaaatttcataaaacagatgtaaaatgcttgcacgaacaaaaaacacattgaaaattcaagtgcatcaaattattctatatctacttctggccgggagtaaaaaacagaaggagaagcactatcggatatctttttccaggggagcgtagtgcatgttattcggctgatatgttattaagacagtataaaagagtaagaagagaattaggaaaaaagtttcattatcgagacataaaaaaagtatatacgatagttctatttgaaaaaagtaatagtgttttcaagagtttttcaaaggacatttatattcatcggtttcagcaacaaagtgattcaggaatagaactgaaccttttacaggagtacacgtttatttgccttgacatttttgatgacatcattcacaatgaaggcagaaatgcaggagacgaaagcggagaaagaatcgctggagacagagatgcagagaacaaaagatgagatggaagctgaaagaaaacgtgctgaggaggcggaaaaggaactgatccggttgagggcagaactggaaaaactgagaaaatagatgaaatacatagtgatatcagttgtttcttatttactctgcgctcctggagtgttataataactgttaagactgccgggaggcatctgtttgaagattttgataatagaaaaagatagaagaattatttgaaggagtaaatggtatggaactgacaacaattcgtgagttatttaagaacagagaggcatatctggacaaagaggtaacagttgggggctggattcgaagcattcgagattctaagacattcggatttatcgtattgaatgatggatcttattttgatacattacagattgtatatcatgataagatggagaacttcgctgaagtttccaagctgaatgtaggggcagcaatcattgttaagggtacactggtagcaacaccacaggctaagcagccatttgagatccaggcagaagaggttgtgatcgaaggagcatccgcaccggattatccactgcagaagaagcgtcacagctttgagtatcttagaacaatttctcatctccgtccgagaacaaacacattccaggctgtattcagagttcgttctctggcagcatatgcgattcaccagttcttccaggacagaggatttgtatatgtgcacactccgctgatcacaggaagtgactgtgagggtgcaggagagatgttccgtgttacaacactggatatggataatgttccaaagaatgaggatggaactgtagattatacacaggatttctttggaaaagagacaagccttacagtaagtggtcagcttaacggagagacttatgcacaggcattccgtaatatttatacatttggaccgacattccgcgcagagaactctaacacaacaagacatgcagcagagttctggatgatcgagccggagatcgcatttgcagatcttgaagatgatatggaactggctgaggctatgttgaagtatgtgatcaactatgtacttgagaatgcaccggaagagatgaacttcttcaactctttcgttgataaaggacttcttgacagacttcataatgtagtgaactctgactttgcgcgtgtaacatatacagaggcagtagagatccttgagaagaacaatgataagtttgattataaagtatcctggggatgcgaccttcagacagagcatgagcgctatctgacagagcaggtatacaaacgtcctgtattcgttacagattatccgaaggaaatcaaagctttctatatgaagatgaacgaagatggtaagacagtagcagctgtagactgtcttgtaccgggaatcggagaaatcatcggaggaagccagagagaggatgattatgacaagcttcttggaagaatgaaagaacttggacttaaggaagaagattatggattctaccttgatctgagaaaatatggttctacaagacatgcaggattcggacttggattcgagagatgcgtaatgtatctgacaggaatgtccaatatccgtgacgtcattccattcccaagaacagtaaacaactgtgaactgtaataatataaagaagttttagagtgttattcacacatgaacagtaaagtgtgtggataacactctttttttctatatcgaatgtggaaaaccagttcggtttatcgtttgaagtgaaagactgcaaagaataagaaagttatagataactaacctggttttaacattatttaaaagggattttaataaaattttcgctatttaacatagatttaacataacttcacagagttttttataaagccatgataatctcggatatgtaaagaagaaaaaagcactgcgtttgaaaaacagatgcaagacagtgatttgtaattgaaaacagacatgagagaggatctggaggaagaaaaatgaaggaaaacatacagattgttttcgggctgcttggtggcctggcggtttttatctatggaatgaatatgatgagtgaatgtcttcagaaagcggcaggagaaaaaatgaagaaaatcctgtcacttttaacgagaaatcctgtaatgggagcacttgcgggaatgcttgttacagccgtactgcaaagttcaagtgcaacgacggttatggcgattggttttgtaagtgcaggactgatgacactgccacaggcaatttctattatttttggtgccaatatcggtacaacaatgacagcgcagctgattgcatttaagttaagtgactacatttatgcaatcatttttattggatttatcgtatattttatctctaaatcagaacgtgtgaagaatattggtatgacgatttttgcgttcggtttactgttccttggaattgagacgatgggaacagttatgaaaccattagcatcaagccctgttttcacagaactgatcggcaaagtggcagacattccaatccttggagttgctgttggtgcattaatgactcttgtagtacagagttccagtgctacaatcgcagtgctccagaattttgcggctcagccgggagctgatggagtgacaagtatcatcggtctggcaggtgcaattccgattcttttcggtgataacatcggaacgacgatcacagcacttctggcaagtattggtcagccgaaggatgcgaagagaacagcacttgcacactgtatctttaatatttcaggatgcttcttgtttatctggttcgtaaaaccactggcagcgtttatccagtatatttcccctaagggaccggagattgaagtgatttcgagacagattgcgaatacgcatacatttttcaaccttgtgatgacgctgatctgggtaccgcttgttggagttatggtgaaaatcgtaatgcgtctgatcccggacggagaagtgaaagaagtcaatgcagtgcagccaaaatttcttgataacaaactgatcagtcagcctacagttgcattacagcttgcagtaagagaattgatgaattgcggagagcaggtaggcgcgatgctgaaaaaggcagcagaaaagattgatagtggagatggtgcttctgttgaagaatttgtaaagagcagagaagtgacagctgagcttacaggaaagatcacagattatctggctgagatggcagccgccggagttatgacagagcagcaggcagcaagagccgcagagcttcagtatgtattgatcgatattgacagaatcagtgaacttacgaaaaatgtcgctgtttccatgcagacagaaaagcttgtgaaaaaggacaagaagagtgcaaaagaagaaagagtacagttctcacaagaagcatcaaaggatatacagaagagcatggaacttgtcagtgaaatgtacaatatggtcatgaaaatggttaataacgaagaggcaaatgaggctgaaaatcttgtcaagatgaaagaaaagatccgcaagatggacggagatatcagaaaaggacatattaaacgtgtacacaaaggaaaatgtaaggcaggacttacggctgcattcaatgagattctacataatgtggaaagaatcggaaacagctgtgtgaatctggcagatgcggcagaggacggagtgagattcagcacatttttaaaagagacggagtagagaactttattatgagcaggcaaactttcaatagaagagagtttgcctgtttcctattcatggaaatccttttgattttatgctgataaaagaagaaaaactgtgctaaaatagttgagacaacaagaaagaacagttataatattaatctgttaatagagagaaaaaagaaacttttactaatataggaaggaagtagtaaatgaagatagaattaccaaagaaggtattatttatcattaataatctgcaacttgcaggatatgatgcatttgcagtaggtggctgcgtgagagattctattttggcgagaaaaccgcaggactgggatatcacaacgtcggcaaaaccagaagcaatcaaggaaatatttcgccggacggttgatacaggaatagaacacggaacagttacagtaatgattggcaaagacagttatgaggtgacgacttacagaattgacggtgcatatgaggatagccgtcatccgaaggaagtccgctttaccaattgtctggaagaagatcttcgcagaagagattttacgatcaatgcgatggcatataatgatgatgtccggctggtagacgtgtttggtggaatgcaggatttgaatcatcatctgatccgctgcgttggagatccgagggaaagattttcagaagatgcacttcgtatccttcgtgcggtacgcttctcagcacagctggatttcccgattgaacctgatactgccaaagcagtgaaggagcttgcaccaaaccttaagaatattagtgcagaacgtattcagacagagcttgtgaaacttctgacgtctccacatccggagcgcattcaggatgcctgtgaacttggaattacaaaggtggtccttccagaatgggacgccatggtaggagtaaaacagaatacaatacatcataagtacgatgtggcagagcatacacttcatacattgaagcatgtgaagagagataaataccttcgtcttacaatgttgttccatgatatgggaaaaccggcaatgaagacaacagatgagaaaggaaacgatcatttcaaaggacatgctctggaaagcgagaaaattgcccgtacagttttgaagcggttaaaatttgacaatgagacgattcgcattgtaacgaagctggtctgctatcatgattaccggatggaagcaacaccggcgaatgtacgtcgtgcaatgaatcggatcggtgtcgaattattcccatactatctcgcagtgcgtcttgcagatgcaaaatcacagagcacttacatgagaagggaaaagattgaaaatatcgtagagataagaaatctttacaaacagatcctgatggagaatcagtgcgtgactcttcgacagcttgcagtgagcggaagagaattgatggaactggggatgaagccggggcgcgaacttggtgcaatgctcagtgaactgctggaatatgtgctggatgatccggaacggaatacgaaagagaatctctgcaagtacgtgaaagaaaaaatggaaaaagaaaagtagaaaataccggaagaaaaagagaatactcaggttgtccctttcatacattagaaagaaatcgttgtcggttgctgttaaaaccgacagtaaaaagtctggtaattggaaaagaataacaatccaggtcaatgggacagggggcagccatgagagaatatgagatggaagtactggaaaagtacgaacttgaagtgaatagcacccggcggatcagaggtgcattttattgcgatacaaaagaagggacgatgcttctgaaagagacaaagatctcggagaggcgcgtccctttattgtatcttattttaaaccgattagaaaagcagggatatctggtggatacacctgtgttcagtaaagaagggaatctggtgcagaattccagagatggaacaagatatttgatgaaaaaatggtatccgggggaagagtgcaatttgaagagagaggaagatattttccgggcagcaagaaaactgggagagcttcatctgggatttcagtggtatgagccggacttgcaggagaaagaaatatttcagaaattccagaaagaagaggtgcaggaaatcccacagaatacacagcagtcagtttgtgaagaaaagaaaattgactggacaaagttgtcaccattgttaagtaaaaatccattggaagaaatgaaacgtcgtaacagggaaatgaaaaaagtgcggtcatttatcagaaaacgggttgcaaaaaatgaattcgaatcctattatctgaagcattatgaagaaattgcatggcaggcagaaaaggtgacagagcagatagagcggtctggttgccagaatctatatgaaagaagtatacgggaaaggaaaatgcttcatggagattataattatcataatgtcatgatccttccggaaaatgaggtgataacaaactttgagcggatgcgaatcggaatacaagtagatgatttatattaccttttgagaaaagtaatggaaaaataccattggaaacaaaaaacaggacaaaatatattagaagcatatgaaagcgtacggcaattaaaaccagatgaaagagagtatctttgccttcgactggcctatccggaaaagttctggaagacagcaagtgcttattccagatcaaataaagcatggcttccggaaaagagtgtagagaagctgcagacagcagtagaacagacgaaggagaaagaagtatttttgagagaggtcttcgaataaaaaagctccgcaaaccgcggaaaatgtggatttatcttgacaaacaacagggaaaccgttataacagtacataagggtttgaggcaagttatcgtgcagacttgtaacctgaataaataaaattaggaatagaattgtatttgagtacaataaaggaggacataatccatgaacaaaacagaatttattgcagcagtagctgaaaaggcagagatttccaagaaagattccgagaaagcattaaaggcatttgttgatgttgtaacagagcagctgaaagccggagataaagtacagcttgttggatttggtacatttgaagtgagcgagagagcagcaagagaaggaagaaacccacagacaggaaaaactatgacaatcgcagcttgcaaggctcctaaattcaaagctggaaaagcattaaaggacgcaatcaactagttcaggggattttgtagaagaatatatgagactggataagtttttaaaagtctcccgtctgatcaagcgaagaactgtagcaaacgaggcctgtgatgcaggacgtgtgctggtgaatggaaagacggcgaaagcatctgtgaaggtaacgccgggtgatgtgatcgagattcagtttggaacgagaaccgttaaggttgaggttcttgaactgcaggagacaacaaaaaaagaagaagcaaaggacttattcaaatacctgtaaagtctgtcagacaacaggaatttataagtcgatcaatggttattgttttcagtaatcttagaaaggcagggaatattttacaaagtgagatattccctgcctttctgcatattgtacgataaagcagtttttgagacacatctataaaaccttatctgtcaggaataagtagaaaagctctgacatatatatagaaaagtacagggaactgttatctggttccagtaatatactgtggggtatgccagagaagagggaggtgcagcggatggaggaacagcaaaagactgtaaaggctcataagctggtggtcaataaccgaaagacaagtatggtgacaggtgttctggatgtattgtcttttgatctgaatgagattcttctggaaacagagcagggaatgctgttagtaaaaggaacagacttgcatgtgaaccgtctcagtgtggaaaagggagaagtagatttgtctggaacaatagacagtgtttcatattctaatatttcacaggcaaagaaacaggaagaaagcttttggacaaagatgttcaagtgaggaagaaagaagatgctaaatataaaaaaagaactgcttgtcttcttctgtgcctgtcttacaggtgtgaatgtccgggctgggtatgagattctgattttcttaaggaaaatgataatacataataatctggtgaaaggaatcgaggatctgttctactggatatttatgagtgcatatattttctcacagatatatgcaactatgtatggtagtatcagatggtattttctactaggtcttgtatttggcgttgccgttattcagaaactgatttcgtctggagaaaaaatacacaaaaaaacaaggaaaaaccttgaaattattagaaaaaacagatagaatattgataattgggaagtttatagggggactccgtcagtgaaggcaggattgatttcccggtaacgttaagagtgtattattttagggtgaattttagatggcaaagaaaagaagagtgactggacggcgcagctatacaaagcagagacgtccgagtccgtacaaaagaagcgttcttatgattttgtcagtattgtgtcttctttccggtgtgctgggggtgaatgcagtaaagcttcatgcaaagaatacagcgtatagacagcaggaagcagaactgaagacacagatcaaaagtgagcaggcaagagcagaagagatcaaagaatacgagcagtatgtacagacagatgattacatgaaagagattgcagaagataagctgaatcttgttgatccgaatgaaatcgtatttaaaccaatcaagtgaatagtaaccgaatctgcaaagtcagtgaaagacggatacagaattttacgaaagataactccgggagagaaagtactcctggagtttttcttttttacgcgaacaacgagccaaaatccgtgcttgtatgagaccttggcgactgtcgcgataacttgagaaactcgcggagtgtgtttctcacagttgagtaacgaggggggatggaaatggaaaatggacaggtattacatagtagtctatatgtggaacagattgataagtttgcagtttcattaaaacagttagcgaaaacatttttgaaattagaagaaaaaaagcagacattttcagaagaagagattgatgaaatgtttgcctgcgtaagagaagaagtgtgtgaaaaatgtgagaaaaacagttggtgctggggcgaaaactatattcagatgtatcagatgggatacgagattcttgcagcagtggatcagtatggaaatgaactggatgcagagacaaaaagaaaactgatgcagcgctgcattatggctccgcggttttatcgggggatgcttgatagttttcacgaagcaagacaaaatatgatctggatcaatcgtatcgcaagaagccgggaagggtgtgcagcccagcttgatctatttgcagatatgctgcaaaatgtggcgaaaaatctggaagacagcatatttacagatgaaaggttggggaaacggatcttgtctcaattaaaaagaaaaggaatacgtgtactttccatgcattttcttgtgaatggagagggaaaatatgaattgcatctgacgatgcgcacctggaaagtggaaaagattccggtaaaaagtctggcagggactctgagtaatctgacaggaagaagattgattccgggaaaagaaggggcgcagttgatcggagcggattatacaacagtggtcttccgagaaggaccatcctattacacaatgtccggaatagcaagaatcggaaaaggctgcagtaatatttcaggggacagtttcacgatgatggatcttccgggtggtaaaaggggagttgcattgtcagatggcatgggatgtgggcaggctgcctgtcgggaaagcacacttgtgatagaacttctcgaagaacttctggaagcgggatttccggaaaagactgcgatccagatgatcaatacaacactggtctgcggaagagaagaaatccattactctacgatcgaccttacagtgtttgatctgtatacaggagaatgtgaattgatcaaggcaggcgcatcctcaacttttatccgaagaaaggatcagattgagcatctgacatcgacaagccttccgatcggagtgatgaattcacttgaaatagattcagtgaaacggcagttgacggatggaacgtatgtaatcatgctgacagatggagtgctggatgcacttccggtaggagagcaggacttccttcttgaaacaatcataaaaggaacggaaatacgaaacccaaaggaactggccagacacattttacagcaggtacttaactggacaggaaaagaaccggaggatgatatgtcagttttggttgcagctttgtggaaatgcagaaagtagtcattgacatagaagtaaccgttaacgtatagttgaggtatgatggataaaagattagaaaagattgaaaactatatcagacaatatcatatgatagaaaaaggggacaggattgtcataggtgtatcgggtggcgcagactctgtatgtctgctgatggcactttgttcattgcaggaaaagctgggatttcaggtgcttgtctgccatgtgaatcatgaactgcgcggggaggaggctgcacaggatgaggcatatgtggaaatgctttgtcataaaatgcaggttcctttttttgcatttcatgaaaatgtggaattaattgcaaaaaagcggaaagaatcattggaggaagcaggcagatatgtgcgaagacaggcatttgaacaactctgtaaagaacagggcgggacaaagattgcaacagcgcatcatagtaatgacaatgcagaaacaatgcttcttaacatggcaagaggaaccgggcttcgcggattgtgtgggataagaccagtgtatggaaaatggattcgcccacttctggaattgtccagggaagagattgaacagtggttgaaagattgtgatatcagatattgtgttgacgaaacgaatcaggaagatgaatacacaaggaaccggattcgtcatcatgtaattccgacattagaagaacaggttaatacaaggacggtagaacattttgtgaagctcagtgaacaggcagaagaaatctatgaatatctggaaaaacagacagatcaggcatggaatatctgtgtaaaacagacagacggacttcaaagcaggaaagaaatatttctcaaggcagaggaaatgaaacaccttgatcctgtgataaagaaattactgatccaaagatcagtaagtgaagtggcaggggcacagaaagatattgaaagcaggcatatcctggcggtactgcaactgtttgaacggcagacaggacggcagatcgatcttccgtatagtgttacagccaaaagaatgtatgagggagttctgcttgcaaaaggtgataaaaaagttacatctgtacatcagaaagagaaaagaaaagaagagagtaattttgttctacagcttcagattccgggagaaacaaagatcccgggaacaaatttgaaaatctgctgtacaatcagcggtgaaaatgagaagaattcagcaaaagcgataccacaaaaaagctacacgaaatgctttgattatgatataataaaaagcagtctctgtgtgagatacagacgacccggagattattttacaattgatggggaaggaaagaaaaagaagctgaagagttactttattgatgagaagattccgcaagaagaacgggacagacagcttctgatcgcagaggaaagccacatcgtatggattccgggcagaaggatgagttcgtactaccaggtgggagaccagacgaaaaagattcttaagataaagattatggaggaatagaacaatggctgagaagattaaagtgttaatttcagaggaagaagtagatgcaagaatccgtgaactcggagaaaagatcagtaaagagtatgaaggaaagcagatccatctgatctgtgttctgaaaggtggagtattctttatgtgcgaacttgcaaagagaattacagttccggtatctatggactttatgtgtgttggaagctatggcgacggaacaaagtccagtggtgttgtaagacttgcgaaagatctggatgagtctattgagaataaggaagtattgatcgtggaagatatcattgattccggtaatacactgtattatctgatggacgtacttcgtcagagaaagccggcaagtctccgtctttgcacattgcttgataaaccagaccgccgtgtgaaagatgtgcacgtagactggacaggatttgagattccggatgagttcgtagttggatacggactggattatgcacagaagtatagaaatcttccatacatcggagtagtagaagtcgcagaatagaaaggaagcaataaaaaattgaataatgacagaaaaagcagaggtctgagtggggcaacgatcatcagttttgttgtgatccttgttgtggttctgtggatggcgaaccagcttcagatgcatcagcaggagatgacatatacctcctttgtctctgcagtacaggaaaaaaatgtttctgatgtctacatcaatcagaacagtgcagttccgacaggaaccgtctctgttacattgaaagatgatggtaatacaaggaaagtgaatgtgtcagatgttgagcaggtagagaagcttctgacagagaatcaggtggagtacaggctttcggatgtaccgaaggattctatgttgacaacagttgtagttccgatgctgattacacttggaggagtatttctgatctttttcctgatgagccgtcagaacggcgggggaaattctaaggcgatgaactttggaaagagccgcgcaaagatgagtacgaagaatgagatcaaggttacatttcgtgatgttgcaggattgagagaagagaaggaagaactggaggagatcgtagattttctgaaagatccgaagaaatacatccaggttggagcacgtatcccgaaaggtgttcttttagaaggacctccgggaaccggtaagacacttcttgcaaaggctgtagccggtgaggcaggagtaccatttttcagcatttcgggctcagatttcgttgagatgtttgttggtgtgggtgcttcccgtgtccgtgatctgttccaggatgcgaagaagaacgcaccatgtatcatatttattgatgagattgatgcagtcgcaagacgccgcggaagcggtcttggcggtggtcatgatgagcgtgagcagaccctgaaccagctccttgtagagatggatggatttggtgtaaatgaaggcattatcgtaatggcagcgacaaaccgtaaggatattctggatcctgcaatcttaagaccgggaagatttgaccgtgatgtccttgtcggacgtccggatgtagggggcagagaagagatcctgaaagttcatgcgagaaataagccgcttggagatgatgtggatctaaagcagattgcccagacaacggcaggattttcaggagcagatcttgagaatcttctcaacgaggctgcaattctggcagcgaaggagaaccgggtgtacattcagcagtctgatatccgtcatgcatttgtgaaggtcggaatcggtccggagaagaagagccgtatcgtttctgagaaagaacgcaggattacagcttatcatgaagccggacacgcgatcttgttccatctgcttccggatgtaggaccggtttacagcgtatctatcattccgacaggcggagccggcggatatacgatgccgcttccggagaaggatgatatgttcaatacaaaggggcatatgcttcaggaaattacagtttcccttggcggacgtgttgcagaagaagagatttttgatgatatcacaacgggagcttcccaggatatcaagcaggcaacagcaattgcaaaatcaatgatcacgaagttcggtatgtctgaaagactggggctgattaattatgataatgacagcgatgaagtattcattggacgtgatttcggtcatacatcaagagggtatggcgaaaaagtggccggaacgattgatgaagaagtgaaacgtattattgatgagtgttatttgaaagcgcgtgcacttattcaggagtatcatccggtactcgagaagtgtgcacaactgcttcttgagaaggaaaagataacaagaagtgaattcgaagcactgtttgcagacagtgaggttgaaggatagtagttattatatgtatttaggataagataccctctgccggcgggcgatcccgtgttggccgggggtattttggttctattttagaatagttttaagaattgagttaaaggaggctaaacaggtgaatagagaagcactgttttgtgacggtacaggtgattatgtctgtccggcagagcctgagataaatgaaaaagtagtgttgcgatttcgtacggcacacaatgatgttgacgaagtgaaacttcacatcggagaacaggagtatcctatgtggaagacacgtacgaacggtgaatttgacttttacgagattgagtatcagcttggtgaggatatcttaagatattgttttgaaatcaagcagggagcagaaatctgtttttatagtaggtatggaataacagggaaaaaagaaaactattatgattttattatttcgccgggatttaagacacccgagtgggcgaaaggtgctgtgatgtaccagatctttgttgatcgtttttataatggagatccgacaaatgatgtggaggataacgaatatatttatattggggcaccgagccgcaaggtgaaggactggaatcaggcaccggaagcaatggatatccgtaatttttacggcggggatttacagggtgttttagataagctggattatctgcaggatcttggagttgaagttatttacttcaatccgctgtttgtttctccgtcgaatcataagtatgatattcaggattatgattacatagatccgcattatggaaagattgttgtggatgacggagaagtacttccggcaggtgcaaaggataatatccatgcgacaaagtatcagcaacgtacaggagatatccgcaatcttgaggcaagtaatcagttgtttatcaaactggtagaagagatgcataagcgtggaatgcgtgtaattctggatggtgtattcaatcattgtggctcttttaacaaatggatggacagagaacgtatctatgagccgcagccggactatccgaagggagcatatgtaagtaaagaaagtccatataacagctttttcctgttccatgatgcgagaaatgaactctggccttataacggaacatatgatggctggtggggacatgatacattgccaaagctcgattatgaggattcaccacagcttgagcagtacattatggatatcggaagaaaatgggtatcaccgccgtataacgtagacggatggcgtcttgatgttgcagcggaccttggattcagtaatgaatacaaccatatcttctggaagagattccgaaaggaagttaaggatgcgaatccggatgcaattatattagcagaacattatggagatccgcaggattggcttcagggagatgagtgggacagcgttatgaattatgacgcatttatggaaccgctgacctggtttttgactggtatggagaagcatagtgatgaatatcgtccggatctgtgtggaaatgctgacaactttgtcggagcgatgcgtcattttatggcaagtatgctgacaccatctcttcaggtggcaatgaatgaactttcaaaccatgaccattctcgtttcctgacacgtacgaaccacaaggcaggacgcgtggcacagcttggaacagaagcagctgaaaaggatgtgaataaggcaatcttacgagaagcggttattatgcagatgacctggatcggtgcgccgacgatttattatggtgatgaggcaggactttgtggattcaccgatccggataaccggagaactttcccatgggggaacgaagacaaagaacttcaggcattccacaaagaagtgatccgtatccacaaggaagagaaaccgctgaaaaaaggttctatcaagttactggcgtcagatgaaaatctgctggcctatggaagatttgaagcagatgaacagattgtcgttgttgtgaataacagtgatgaacttcgtacagtgaccgtaccggtatggtatgcgggtatagagatggaaggacggatgaaacgactgatctactcttatgaaaacggttatacgacggaatatgacgagtatatcgtacaagatggagagattgtcctgaatatgggatctcattcagcaatcgtattaaagccggcagaagcattgagattgatgccgtaagaagtggaacggtattttgcagataaagaaagagcattatacaagaataataaaaatacgggatgagcagttttaatatctgctcatcccgtatttgttactattattattttgtcagaacctctgccccattctctgtgatgagtaccatgtactcaatctgggcagaaagaccatcatccattgtataaatagtccagtcattgtcctcatctacgaagaagtcagggctgccttcgttgatcataggctcaatcgtgaacatcatacctggaacgagaagcatctcacttccctttggtgtcacatagctgacaaaaggatcttcatggaattccagaccgacaccgtgtccgccgatatcctctacaacagagtatccgtttgcacgggcatgtgtattgatcgcatctgcgatatcacctaaatgtccccaaggcttcgcagcctcaagtccaagcttcacacactcttctgtgacgcggacgatgcgctctgcacgttcagatacttttcccatcttgaacatacgggatgcatcagaaaaatatccgtcaagaatagtggatacatcaacattgatgatatctccctcttccagaatgatattctcatccggaatgccgtgacaaatctcattattaatagaagtacacacgctcttagggaatccctgataattgagcggagccgggataccaccgtgttcttttgtgaaacgatatacgatgtcatcaatctcctgtgtgctcattccaatgtggatctgtcttgctacttcatccaggatcgctgtattaagctcagcacttttcctgatcttttcaatctggaatggagtttttaaaatcttacgtgtcggaacaatctcaccacgttcagcatgcatcattatcttttcttcaatcggcatatggcatttcttatacttcttgccgctgccgcaccagcacaattcatttctttccatgatattacctcttctaaaaatcacttattttctcagtttctatttattttatcacaaaattcgacaaaaagatacatgttatgcttgccgagaacgtaaaaatatagtacgattaagattcagataggagtgataatgcatatgtggtattgggcgattatggtactgctgattttaggaagtatcgcacttctttgcagtacatttataagtgtaaaaaagaataaggcacaggacgcagagcggagaaagcagtccaggaacggaaagcgttacaaggcagatcagggatatgatccagaagaggatcagccgcagggaaagaagagacgcagttcagggcagaacggttctatggattcagcgaagcgttcttctaaaaaaagaagacagtggaagattatcctggaagatctggatacatggcagaaatatagcttcatattctatgatgaagtgggaatcggaagagcaaagaggaatgacaattatgagaagtatcttccactgcatgaggatggaagagtatccaagcagcactgtgtgatcatacagagaggtgactgtttgtatctgatggatgatggttccaagaatggaacatacctgaacggaatcctggtagatcgtccgacagaggttcagagagaagatgtgattggtgttggggagaccagactggagattctcagaattttaagagaaagtgaataatgaaattacaggcaaggaagtccggcggaaaagccaggacttctttttctttagatcgtaaaatgaagaatctgtgtgaaagtaacagttgagtaaggaaaatcatatagtagttatatagttactgttcactcccgtgtcaatcactttgctgattgacacggaggatgcgtgtaggattgcactccatccaactctccgacttctttttcaatttttgcggaacaatttggacagtccaacccttttaatagaaatatgcgtttcatgctaatctccttataatttgtttaattgttcaattactcaactataatgttaaaaaatattatttctgccaaagatgctcaaatcccttgtcaataatctctttcacatgatcatctgccagcgagtagtaaactatctgtgcttctttacggaattttaccagattcgcaaggcgtaatgcctttaactgatgcgaaattgcagattttgttacccccagtagcactgcaagatcacatacacacatctcactctgttctagagcgtgtaagatttgtactctagttccatctccaaatagcttaaacaaagaagccaactggatataatcatcttttggctgcatcttggatttcacatcattcacaatatcctcatgaattacatcgcaattacaaatataagacgtttttggcatatattcacctccaaataataatagttgaacaattactcaactattattatacttatttttaaattcatgtcaataagctgatgttagttccccataaattttacaattaaaaccagctctttattcttttcttaatcttttttcccagtataccgttttggctttcttgtcacacttcctgtaaatttcaaatttgtaacgctgagtttatatgtaattgtcatggtttccatattttttagaacacataccatttcattcgttaattccggcaagcgttttaagcacggaagtttccttttggcatttgcatatacatgtcttgcgtcaaaatagaactgattatttgtaagaatagatttttttgcattcttataaaaatccttggtcgaaagtcttgtctccactcctgttaaatgtagaaagtgatctcaaaatattcatctccacaaacatacagaaatgttttacctgccaaattttggcagtatacgatttccgcctctgtaataccttgtcgtattgcgtttttcttatctaccattgttgccacttatacctcacatgcaaaggagagtgtggcattaaaccacactcttgtgagaattacttttgtaaaagagttttctgctagttgtcagcctcggtacccagttaagacatctaatgagatggaagtttaccctgctccatctgcaacccaacttttaacgatgctcttacatcgagaacgtttctgttcttgcttttattatactcaatcataaaaaaaatcaacacagattagcaaattatattattccgatccgatcttccaaaggtgtaaataaggtgtaaattctacactttctcccaagaaacccaataaactcaaggctttcgtcccatcccttaaacactgccgtggcatacgaaaagtacttttatcatagttttgtttctccttgttttgccctgaagtgccctgttttgcaagggtttcttgggattttgtgaaatgctctgaaattacagattgtggtgaatcagagcagaattaggcaagttattactacctgttagtagtaaaattggtagtaaaaggggaaagggttactactaagaattttttagctttttatcttgctttgtttttcgataagataatttataaaagctgaacacgaaactaacatatactttgcgtcctcagcaggtgcatttgtaaaatctattccaccgtgtcgaattccatctgaatctgaagtatatccatataatttttcaaacgcagttttcatagctccatgaatcactactccaccgtctttttccaatttcttcaatgtactccctaaagttgcttgcgaacctgtggctcctgtaataatgcaacatagtgactctacagcactaattgactctttaattgaattttcataatctggtttctttctatctgaataaagagcgagagctttattaatatgaattttaactgcttgatatggggagtctattattttatttatttcctgtaattcctcatcactaattatgttaacaaatttatcatttaataatctatatccagatttttcttgttctaacataatattaatatcagttgttacatttctcaaccactctgtgtaaccacaatactcacagttatcatcgcttctatattcacattctttacaatgaagcctttttgcttcaaaaaatatctcaattacttcatatggcatgtaccaaggaatagatgagtcttcgccctctaaaactgtattaataatataccaatttctgtttgtagttgattttacttgatatccaagcctatcaacaacatattctaattcttcgtgtatcattggagaactctctgaaaatctatgtaccatattatacaagcgatttctcaagcttctatctatttcatctacctgaacagtcttctctttcacaaaaccatttctttctgcaaaacccataatgtccacctcctatcccatagcagcattctttactatcggcaataattcttcgcaagaagaatacctattttcaatgctacttgataaacatttcattattatgtcaatatttgttggtgtaatttgtgaatttgacttttccaaatactccctcatatcactcccacttggagctctcccgcataacaaaaaataccaaattgcaccaactgaataaatatcacttctcacatctcgaattttaggtttttgttgtaatattggatcgataaagcttccacctgcgatgtgttcacctgtttttgtcaattgtgtatgattttctgtatctaaaaatgcacttacaccaaaatcaataatcttaaacattctttcattttctgaaaaaatcacatttcttggtctcaagtccctatgaatcacaccatgttcatgtgcatgctttaatccaactaaaatatgtaaaattacaattgcacttctagaaaaagacatattcccttctcggtttctaagctcctctactgtatatcctttaatatattccattctaatatatggtttaccatccatacgacctgcatcataaattctagcaatatgagtattatttagcgaaaataacattttagcttctctgaaaaatctcttttctccttcaagttgctcttctgcggaaacaaacaccggatcatatatcttaacggcaaaatccatatctaaacaattattatgatatttgtatacagttccaaaaccaccacgtcccaattcttcttgctttgtgtattctttcatctgcatgaactgatcgctatcttcatttagataagaagccaaactatccatttcggtatgtatcagtgaacgtctatctgtataatgttggttatatgcttgcatataacgacgaaaatcgtttgccgaatgattacttttaataaatgcaggtatatgtgattttagttctggaacttgcatcaaaatatccctacatcgcttataatccttctctgacatatccccatttgttgcttttgctattaatccgcttttaaattcatcaatcaaatctcttattgcatttttatccattttatctgccacatccactccataaaatctataatcatacacttctctgcctgatatgtattcctttatatataattcatacccgtcttcttttatcaaattgtttactttttctaaaaataatccccactgttttttttcatctctaaccaaaggatggaatatctcacaaatgaacctcaaaaacatttcatccgatccatttgctaatccaaatctatcatcttcaaaaacccaacaatacggataatcatcattatttattgtatggcgaataatatccccctttgcattttcatgccttgaatcaatgcttttcatattatctaaatcatatagtctctcaagaaaatcaatttcttctaatcttccataataaggatattgaacattctctgtatgaaacaaatcttctacagtgcatccatcacgaaataattcatatatgtctctcttagttatttcagttaatctattcaagaatatcgcccctttttgcaatattaatccaaaatatattatatcagtagcttcgcggtttttccatagaaaaaacgccccagcctaagcacggagcgtcatccctcttcaatattatatatactaccttaaacatcttctgtaacaccggtttctttttcttctgctcaacctccgcctgtgctttcctaaactcttccatccgtttcaattcttcctcggcatcatcgaatccgatatgcgtgtatacattcattgtgaccgatatatccgaatgccccatgaggtactgtaatgtctttggattcattcccgattttgccatattggagcaataggtatgtcggcatacatgtggatgtgtcaagtataggacaaaaaaaattttatttttttctgctgaagactatctgacgcttccatcaggtagtcccagcacctttattatcttctgataagtcattcttgtcctgctcaagttatctctgttccgaaaaaatatcgtcaaaattccattcgatttcaatttcatcctgactatgaacacggattaccttgataatctcacgcagcttctctgtatcgaacttctgaattcccaagaaatcttttagttttattttatcagaaagttcattttgttcaagaagctttttgctattctccgcatcttctatctttcgttttatttcatccagctgtacacttatctttccagctctctgcttatacgaatcacgatctatacgaccatctttgtaatcatcatagagtttcatcttttccgaggtcaactgtcggctctgtttttgcaattctgcagtattaatctctttgtattcgcattgccttttggaagatattttcttttctttttccaacattgacgctgcatactgatggacaagcccaaggatattttcctccagcagttcccgctggagcaccaggcttcgacacacaggatctccattggttcgagcatctgagcattttagcagatgctccgtttcttttagcaaagaatgcccacagttggcacataacagcaatgctggttgctttttacgtctttccagagtaaaattggtgcgtgattccgcaacacttctcttctttttcggatgcatttcatttgctttttcaaacaatgccctgtctataattgccgtatgatgattttccaggcgaacccattctgtttcatcattcagaactgctttatgaccggtatgcatactgcaacgtgttttgccccagattctggttccaatataaatctcatcccggacaattgccgctactgtcgtagggctccagtgtttctttttgatcgtgtcaaacctctgaaactgcacctgatcccctcttgataatttctgctcatcacaagtggcaatcgcctgtctgttcaattcccttgtaatatctgcaaaacttgttccttccgctgccatccgaaaaatcattttcacgacttttgcagcctccggatcaacttccagtcttccgtcttttccttttttatagccatatctggaatttactggaaggcgtgtaccatttctcgttcttgtctgcaatgctgatgaaattttcttggacaaatccaggctatacatattgtataccagattctgcaatgctacattcattccaccagtcattccgctgcttgctgcactgtcatagctgtcattaatcgaaataaatcgaatctgtagaagtgggaaaatatattcaatataaaatccaacttccagatagtctcttccgaatctggaaaagtcttttacaactacacagccgatttctccacttttcatgtcatcctgcagctgttgaaatccctgccttttaaaatgagtaccgctgacaccgtcatcgacatattccaggatatctgcctcagcaacacccaactgatcaatcacaaatgattttaacagaattctctgagaagttacactgtcgctctcttttttggctctgccatctacattgtcatcttctgcggataaacggatgtaaacagctgtttttctatgatctgtcatcttgactgcgcctccttctctttctttaatttctgtaaatctgcaaactgatcgtcatataccagcttgatctcataatcatacttaccatggataataattgaatccacaaaggcatctgccatttcttttgtcagcttacgctttgacatataagtatgtatcacatttccccagccttcttcaatgtggtaatcctgggaataccgaacctgtgccgccaatactgtgtccagacggctcttgatattctcaatttcattggaatagatccgagaaaactgtatgtattcttcttctgtaatcaaacgttcggaatagtcttcatataaatccgatttacgcttactgatacggcttagttcccgtcgaagtttccccacctctttatccaaaagcaggtactgtgtctgatttttggaagctgcattcatttcctgaatcattttttctgtatccaatacggttttcatatgcatttgaatcaggcgaagaacatcgtcatccacatattcttttctgactctgtgccctttgcattgctttcctccggatttatggttagtattggctccgcagatataaaagaatgtgccatttctttctctggacaacgtcatgcggttgccacagcctccgcaccatatctttcctgtatagaaattatggtttctaatagccccattgttctgctgatgtttcttcttataagcttccgtatattcctggattttagattgtacctgttgaaacaactctctatctataatcccttcatgcgtgttcttcacatgcacccattcactctctggtcgatttctctgtttatttccctggaaaacactttgctgatattttccaaatacagaatcacctgtgcaatgaacatcctgaagaactcgtttcacttcataattgttccagggttttgactccggaagcggcttttcaccggttttataaaattttctctgtaaagtcggtgataaaactccatctttattgagctgtcttgcaatatcactatagttcctgccatccatatacatagaaaatatacttttcagatgttctgcagcttcttcatcaacaatcagctgatgatggtcttcttctgactttctgtaaccatacggttcccaggcacttgtaaattttccttttttccaaagagctttttttgcactgctactctttttggcaaggtctttcgaatagaactcattgataatattcttcagtggaactgtaagatccacaccctctctgaaggaatcgaaatcatctgtcacagccaggaatcttacatggaaaaacgggaatactcgttctatataattactggtttcgacataatttcttccaagtctggacaaatcttttacaataacacagttgatttttccatgcttgatatcttccatcatctgtacgaatccaggacggtcaaaatttgtacctgaatagtctgagtccttataaacttccgcaaccgaaatatcttccgtatctgctacaaagtttttcatcaattccacctgggtttctattgttcctctttccaatgtttcttctgtttccattgaaattctggcatacaatcctgcccggaacggtctgctcacctctgtctggacggttgcactgctgactacttccggaatgtttttcctgctctttcgtgccattttatacaacctcctttaccttgacctgaagattattatcatcatctattaccgtatcaactcccatagccggtaattgattcagcaatgtctgataacaatcatcaaaatcaaaagtgatctctatattctttttatcatatactctgattttcctgatcagttctaccaccacagtgcgggacagttcttcaatatcctgatacttcacaaaataatccagccaggtattggcattgtcggctttttccagctcactatccatttctttctggatcgcacggatactctcttccgcatttctaagcctctttccataggctgcatgaagctcaacatagtcttcttttgatacaatgccctctttcatatccgaatagagcatcatccgtaactccttacagcgttctgtctcctgttttttcttctccagcctgtcctgcagcttcttcatattgatctcctgaaatggcacagtaccaacaaattccaggactcttttcaggtgcagaatgttctggatatgctgtttcagcatcaccagtacggcatcttccagatccttttccggtattctatgactggaacagcgttttgtttctttatttgtggaacatagataataagcatatttttttcctgccacagtggaaacctttcttgtcataggtgcaccacaatccgcacatacagcaattccggataacagatatacctgcttttggtcaggtgaagtacgtgtatccatgccaagaagtctctgaacaatttcaaaatcacggtcactcaccaatggctcatgatttttctcaatccggatccagtcatcttccggtttcacataagtctgctttactttatggttcggtgttgtcctttttccctgcacaagatttccaatataaacctcgttttccagtatcctacggactgtaacggaactccaaagtgcctgttctttctgtcggaagccagtttcataacgactgccgctgcttattttatattcaaatggggaaagaatacccagttcatttaaacgattagcaatcgcatcctgactcattccccgcagcttcatcttaaaaatatcctgtactacgctgcctgcagatgggtcaatctctaatttatgcttatctgtcattgtcttcctgtatccaaatgctacaaacggagtcacgcactcgccttttttcctcttaatctcaagattactcctgatcttaatagaaatgtcacgacaataagcatcattgattaaattcttaaatgggataatgatttcgtctgcctgattctttcccttgagactgtcataattgtcatttatggcaatgaagcgcacgccaagagccgggaataatctctcgatatacttcccggaatcaatatattcccttccaaatcgtgataagtctttaaccactacacagtctacaatcccacgccggatatcctccagcattgcctggaacgctgggcgctcaaaattagagcctgagtaaccatcatcaactcggactgaaacaacttcaatatcttttttgtctttcaggaaatccagaatcaaagctttctggttagaaatgctgttactttccagttttactgaactggaaatatcgccatcttctttagataatctgacatagatggcggcatgatagattttattgatattctgatacatatcttacctccttttattacgtcagaaaatccatgcaataaaaggggctgcataatttgtccttaccaacattctaacacagtcccctccatcttgccagtactttttcagacactcagaagcatattctcgaatgcctgctccatagatataccgttattggcaaatctgacttttactttcatattaccgatccggaccagataaggatttcctactttattcagaaaaatatctctccgttcctgaagcggcttatttctgtctgcttttatcatccgtagatccgtcatttcattgatatctacatcactgaaatcctgatccagataatttctatattcctctgctgtcatgcccttctccttccattcccatctggatccgtactgctttcagtacccgatccaggctccacttatttactcttccgcatttctcaataatacattttgtagaaatgctcataacctgttcagccaatgcaaggcttccttttcggatccctgtcatatcgtatttactgataaatacatgtgttggtaaataccgcttcttatatattcttgacgtcagcggaactactgtaatgactgaactgtatgtattagctttgttgttacttactacgatcaccggtcttactccaccctgaaccgaagttgtcgggaacataccgagatccgcccataagatatctcctcttcgaatcgtcacttgtcatctctctccaatctttttaatttgtaaagcattcatagcgctatattggctccacaggaatacggcagagttcccttccaagacggaaagctctgccgcataacctctatagccaatttgattattaaacagtgctcgctcgattctatttatccccgataccccgaatcgttactcccgcatatgcaggaagggaataataacctgcccggatgcacgctccggaccacaacccagaaactctcgtttccaggctccagcagttcataggtttaccagttacagacttttcagggtctgcaagtgtatcgcatctcatacacgtcatcgcatcaccagcctgccagctggcttcggtcagtgctttttcgcagcattacggactgaactaaaatctttgttttgtcttataatcctatagcggcatcttcctcgtgctcactgtatgaaatgtcacatcagttattattgaatattcagttatcatggttcattttaggaagtcctttaacttcctctaattactaaagtcaaatgactttggcagatgcaaaagattttgaaaaattttttaaaaaaatttattcatatacatttcacgcatcttattaagagtggatttcagcttgtatgacagcatctgtctggaaatccccataatctccgccatctgtgtctgtgtcttattttcaaagaaaatgccataaataatcatgcgttcctctgagttcagctgattgatcactttgtgaatatcctgctgttccatttttgtcagtacacagtgctccacatcacagttcagatctggaaaatcctcaatcatgaatccttctccatcaatggactgaccgctgtaaggtacttctctcagcatcttatccacaacctcacccagttcgttcttaatctcaactttttttgccttgctgcttctgtaaaaattattcatcgcatacgcaacttcttttgtaatctcgatcatttctccatcaatatttgcgtaatactttccttcataaaaatatggatgttcaatatacatatccgttcctcctgaatttgaaatcttgttgctcgtttcaaatccagaaggcggacctctgtttaggatcatgcctgctccgcctttatcctgccgggatacgcccgcagttattggctgagaaattcaggcacgaaaaaaagccccagtagttttttcttaactactgaggctttcgtctctttcttgtattcagttatctatgccttctttcatcagcataatcattgtatcaggataaagttcacaaagtatccgcaatacgttcccataagttcatgtcattattagaatcgtacatatttcagtgtaaaaagttcactattcaacttctgattatttgtagttaatatggtctatcaaaatgactattttctgtttcattatttaatttaacaaaacaattcctatgccaaaaggcggagttcactttacattttccccactaaagctgaacaagtcgaactctgtatatgatattatcgtatacaggaatatgttttgtttggtgtatcgaagaaaataaaagtaacgatattgtatgttacgaaagtgatatacagtgtcgttatttttatgctataatgcggatatgaatttaacaaatcggaatttgtggagagatttcctgaactttccttatttttcaaggcttacagcctcttagatagtgaaatgatatgtattttcccttatttttgcccttatgcggaatccgcaagggaaataagggaaatttttagttaagcattgctcgctactttatcaagaagtcttgcggaatcccgttttgcttttcttgttgagtgagcgtaaatattcattgtggtactgacatcagagtgtcctaacagttcctgtacatctttcggtgcagctccattggaaagcagattgctggtataagtgtgacgcaactggtgaaaatggaaatcttcaaatccttccagcttctttgccactgatctgcatacaatgctgagtgtactcggcagttccaaagagccatctggtcgcaggcagacaaaggagatttctttgtaatctgtcgggatttcctgtgttccgtcaagatgatagtattcataatataccctgtttttcacatgcacttctttgtagtaattgcggtgatataattcgccatactgcatccggtttttgagctgttcttttctggcagctttcagtacttcagtcagcgtatctccaaaatcaacaatccttacttttttccgtttcgttggtccgataatatttttgtgtttcatgccgtcgtagcggatactgcgttttatggtcaggcattgttcctcaaggttaatgtcctgccatgtaagaccacaggtttccccgatacggagcccggcataatacgcaatttgaatcggcagaatagcaggtggatttttcttttccagatattggataagccgttcataatcctcatgtgaaatcggctgtgtaccttcttccacttcatcatcggaaaagaggtcaacttcctctgcctgctttttcagcttaatatactgcatcggattgaaactgattaactgttttggaaatactgcaaaacggaatgactgctgtaacactgcggaaaaagaatggatataatctttgctgtatccttttcttactttcccgtctggaaactcaccaccgaatgtaagcagatcaagaaatgcctgtaaatgttcggcagtaactgttttcagtttgcggtctgcaatcgggtgttttttgatatagcggattacaccaagataattttctactgtaccgttgctgagtgtcccagtttttagttcttcttctgcccacatgtccagaagttctcctacggtaagattatctgcctttgcgacaaacttcttattttcgtaatcttccagtgccttgcggagaagcttttccgtctcacttttactctcggttccggcgtattctttctgaaccattttaccgcttgcatcttctacatagaagcgatagtaccatttttttcctttttttctaacagatccttttgccataatcgtatgtctcctttcgatatcagacaatcggaactgttgaaatgcttcttgcgtgtaagtatatcacaactccggttgtcttactataccgattcagaatcctcatacataacttcggataaaagattggcaagcctttgttctgctgcttccggtttctttgaatagagccttatcacatctgccatatcgttaaatgcgttgacagtatgcgtgatctccctgagaaacataatctcattatattcatctttcgattcaaatcccattactttggcaatgtccgcatctttggtactgcctttgtaatttttgcaggcgaactgaaacgaatccagaaacaattcatattgctttaacagtaacagcagtaagtctttagaaaaagcgtcttctgttttattgaggtcaagaggtaactgtttgagaatgttgcccatcgcatcacgaatctgcaattctttcttatccgtaatatcagtttcatattcatcggtttcccctttgagccatttgattgatacatgaagtgcttccgagagaccttccagtaccatctttttggtattgtcaatcgaaccgttctcataacgcaggattgtggaagcggtaactcccatcttctctgcgacataaggctgtgtcagatttaattccagacggcgctgttttgccctgctgccgatcagcttgcgtagttctttatctttcatgctgatgtgcctcctttttcggtatgtcattactataccacgtaacagcatatattgcaatatgcaatttaaagaaaagaaatataatttcataatgcttgacaacaagatgcaaacacgctatactgacagcacaaacgaaattgcataatgcaatcaataaggaggtggtcatatgacgcaaagaaagatcgccttatctattgaggaagctgctgattatacgggaattggcaggaacaccctgcgaaagttggtagagtggaagaaacttccggtattgaaggttgggagaaaagtcctgatcaaaacagatatgctggaactctttatggaagccaacgagggcagggacttgagggataagggaaatgtgaaagcagtcacaagaaacggttcaacttaaaaaagcggttcccgaagaaaccgccaaaggttctatcagaccggagccatgatatacctacacgcaagcagattataccatgtacttcgtctgacagacaacaggaaacttatgtttggaagaaaaatgaaaggacgatgatatttatggcaagatcaacaaagagttatgaggagcgtatgctccagttggaaaagaaagaacaggaaagccttgagaaggcaaaacagtatgcagcacagaaacgggaactgaagaaacgtcagaaagatgtggaaaccaaaaagcggacacacaggctctgccagattggcggtgcggtggaatcggtgctgggttctgcgattgaggaagaagatatcccgaagctgatcggcttcttaaaaaggcaggaagcaaacggaaagtttttctcaaaggcaatgcagaaagagccagttgcaaatacggaggaagtgtaatgccggagggagtgggttttccattcccttcattgcttttttatgaagggcgcacttatggacaaccagaggtcgtccgtataagtttgccacagatggcaaccggtctgcgcttacgcttgccgggctcgttccgtcggcggggctttcattgtaattgatggtgaaggttcaaaggttatttgcaaagactaatttgaaaattccagttgatatttcacatattttaggaaatttaataactgttatatttgattatcaaattcttcgcaaacccttgaaaatactaagtttgtagcaagtgaactttcccttactctttcccttgtgttacattttcccattgcttttcatgaaccttaatatgggaaaaattaagggaaagaaaatttcataacacaatataacatataacaataacgacatggtgaactgattgaaatgttttcgatatttaactctgtaactgattatcaaaagaaaatggagataagatacgatgagaacaatttatgcagaatataatataaaccacgatagtattgatgtttacacaagtgctggatatatgcttcgcattgattgctgggaagctgaaaaaaatttaaaaaccacatatggatcagaatgtgcgcttacttcattggctgtggatgagcctttggaatatgcaagattatatcttgatggcaatttacagatgtgggtggatacagaagattcattagaactttattaagcaagaagtgagatagtgttgtagggagtttcctgtagttaaagataccacacccgatatgatgaacccacgcttatacactaccagctatgataaaagaaaggacagcaatttgacactgctgtcctttcttttataaaattgcagtacacagaaaaaagctgtaaaatgaaaaatatatttgtccttgtaacaattctcggacatttgcctgttatactatctgcaaaaagaaaaggaagtgataatatgaagcatattttaattgtcgaagatgataatcttttgaataaaacgcttacttataatttggaattggacggttacacaataacttctgttctgaatgcaaggacagccgctgaatcattaaaaacaaacatttttgatttggtattgctggatataaatttaccagacggaaatggttatgacctatgccgtcttatcaagccagagcatcctgatacagtagttatatttctaactgccaacgatcaggaaagcaatcagatacggggatatgaagctggtgcagtggattatatcacgaaacctttttcgattagtgctttgcagcgaaaaatcaaagccatgttcgctatgttggagcatcacaaaccagctaaggatatttacgaggatggtagcttgtttctggatttttcggaacaatttgcaagtttgaacgggaaaccattagcactttctgcgatggaatataaaatgttgaacctatttcttaaaaatccgaagcaggtacttactcgccaacaatttttagaaaaactgtgggatgttgatgaaaaatatgtagatgaacatacccttactacttctatcagccgtattcgcagtaagattgaagcggatggcgacacatatatcaaaacggtttatggtatggggtatcaatggacaggaggcgaaaagaaatgaatctgaataacctttctgctaagaaaatttgtagactggttagtgctggcatggttttctctatgctggtaattaccggtattttcggcggtataatgcaggatatacgaatttttatagtgggtggaacattgacactctgtgcgtttttctggatttggctattggtgctgatttttggaaaacgcctttctcattttacttctaatttgtgccggacgctggacaacatgattgatggaaacgaggaattacaaaagtcaaatgatagtgaaactctttttgcccgtatcaaccaccgcttaattcggttgtatgagattatgcagaaaaaccggcacaaggtagacatggaacgacaggagcttcaaatgctgatttctgatatttcacatcaagttaaaacgcctgtcagcaatttgcaaatggtaacggacacacttttaacaaagcctgtttcagaagaagaacagatggactttttacaaggcatacgtagtcagactgataaactggattttctgttccaagcactggttaaaacgtcccggttggaaaccggagcaatacgattagaaaagaaagacagcagcttattccatacgcttgcacaagccatgagcagtattgtatatgccgcagagaaaaaagaaattgctgtatccgtggattgcccggaaaatttgataatctcccatgacagcaagtggacaagcgaagcccttttcaatctgctggacaatgcagtaaaatacactccgtcaggtggaaagatttctgtatcagtggttcagtgggaaatgtacgtagaggtcaaagtgaccgacaccggcaagggcatttcagaaagcaatcaggctgccatcttccggcgcttctatcgtgaggaagaagtacacgatcaacagggtgtgggaataggtttgtatttggctcgtgagattgtaacaaggcaagggggctatatcaaggttgtttcagagctgaggcaaggctcagaattttctattatgcttcctgtaaggtaagatataaccactttttttgaaatgtccgagcgttgtaacatttcactctgattttcgataaaaattttttctatctcggacatttgtgtaacatttgtggtttacaatggctttatcaacagatagaaagccttgaaaggagcatttgaatatgagcattttacaaacaatcgacttaaagaagtattacggcacagaaccaaatattactcgtgcccttaatggtgtaaattttactgtggaacagggagaatttgttgccgtagttggaacttccggcagcggtaagtctacattgcttcacatgatgggaggacttgatacccccacttccggcagcgtgattgtacggggagaagaactcgcaaaaaagaatgatgatgaattgacaattttccgccgtcgtaacatcggatttatcttccaaaattataatctggttccgattttgaatgtatatgaaaatatcgtcctgcctgtggaactggatggcgatacagtagaccagaaatttatggacgaagttgtgtatatgttggctttagaagataaactggaaaatatgccgaacaatctttcaggcggtcaacagcaacgtgtagcgattgcacgagctttaattacgaagcctgcgattatccttgctgatgaaccgaccggaaatcttgatagcaagaccagtgcagatgtgttagggcttttgaagcataccagcggagaatttaatcagaccattgtaatgattactcacaacaacgagatcgctcaactcgcagaccgcattgtacggattgaagatggtaaaattgttggctaaaggaggtgggaattatgaattatccttttgaaaatgataccagtgcagtaattaaaaaattagcacgaaaaagtgtgcgttttgataagaagaaaaacttattttgcctttcggcaattattgtagccgttgctatgataatgatgtcgttgctcacagtgcaaaatatcatttatcaaaatcagaaagaaatcgaaggattacatcaagggattttctttgacattacgcaggacagtaaagaaaagttgttagcaaacgaagaagtaaaaagtgtaggactttcctgtaatatcaaaacagtgaaagaaaattctaaagaactgtctctgatttattatgatgatgacatgcttagtttgattcctgcctttgacggaaaatatccagagaaagcaagtgaaattgctgttacagatgccttttttgccagtgaaaataagtctccggaaatcaacgccatagttcagttgaatctggatggtactttgaagaattatactattgttggtatttatcatgataaaacttctaccgcttatcctgtttttgtttcacttgaaaaatgccgggaattacgtggaaataacctgcttaatggatatgtttggcttgaaaatgcagatacccttacaaaagacgaagcaacagaaatattatctcaaatttcagaggagactggactgaataattggacagtcagcagttactatgattatgtaaatacaactttgtccttcagtaattatgcggtatatggtgtagttgctgccattttgtttttagctgccgcacttgtaatttacagcattttctatatttcggttggacaaaaagttgctgagttcggacagcttcggacaataggggcaagtaaaaagcaaatttataaaatagttcttaaacagggttatatgcttgcagttccggggattttaattggtagtatcatgggaacgatcatcagctattgtctgcaatcaaaaggctggtcagtatttgcatttattgtttctctatgtggcgcatgcctttttggaatactgcttgtttatattagtgttcgtaaaccagcaaaaattgcagcgaatacttctccaatttccgccctgaaaaatccagtgggaattgtaaattaccgcactcacaaaagacatcgtattacgcctgtatatttagcgaaaatcagcttttccagaaacagaaaaaaatctctattgaccattttatcattgggactgtgcggagttatatttttccttgcagcaagttatcagagttcttttaatgccgagagtatggctcgttattgggatatgaagtacggagatttcaaaatcagcattgatttagaaaacgaaagtgaaaatttggatgctctcttgcagaaagaatatttttctgattatgtaaagcgtgttggagatatagagggagttagcaatatatttacttatgctaccgtaccagttgatttctcaacagacaatgatatttcagatagcaccttgatgctcggctataatgaaaaggatttggcgtcgctaaatgcagcggttttgtctggaaatattactgatgatacagaattagttgtaagtgatcccgaacgtatttatgatgtttaccattggaaacctcaaattggggatactgtgacctttaatttcaaaaatcatagtggtaaaacaataacaaaagcattcaaaattggtgcaatcacttccagcaatgatggaatgggtggctatattttcagaatgccggaaaatatgctcaaagaacttgcaggttatgactgtacatacgcaatcgaaatacaagcagaagctgaatatcaggagataatcgagcaagaactcaaattactcgtttctgacaatagggatgttcgcttacaaacccttcaagattttattgtagaacaccaatcagacaatcgtgcaggttttacattagcttatgcgattgcagccatcttgtggatatttgcggtcatcaatcaaatcaatcttactgtgacaaatcttttatcacagaaacaggaaatgggcacactaaaatctattggtatgacaaataagcagttgaagcaagcatttatgatggaaggtctttttactactttgattgcattgcttataactgctgttgttggaatccccggcggatatgcaatcggtatatttttgaaaaatgcaggcatgtctacgggatttgtatttccggttgttgcttttactctttttgctgttgctatgtttatgcttgaaagtttgatgacaatattgcttattcattcatggaagaagcaatctgttattgcaataatgcgaaattgatgatagaaagcttttcatatctcggtcagctccacaattacattactctgctgatacagccagtccgtaaattctttcgggctggctgttcctgtttttacagccttttttctctgtaatacttcttttcatacagtaaattttcactaggctggtatggagtaattttactgtctatacagtaagttgaaaatactaatatggtcttttttctaaccaaactttaagataacatctaattccaacatatgcgccctgcgaaagtacgaaaagcaatagaagatttactgacagtacttttttgattgattctccaaaataaatgacaatagcaacacttgtcagtatcattagtagagtaataacatcccaacagtttttcttatataattctataacctttatttctatcagtatcgccagcatccctgttcctgccatacatattcctacaatcaatattagcaataaccaatataccattccggctataaaagcatttggaatttttgtactaatctgtgccgcagaatgcccggcatcaatcgtccatccgacaaaggtttgtatgaatgatgctaaatcattgaagaatgatttacaatcgacaaggaacatatctgactgtactgcctgaaaaagagtggttgtcaacgaataccatgcaagaaggaacaaggttgtttggaacattaccgtttttgctttatactgtcctgcaagtcgctctttttgtgtttcgtattttgcttttgcattctgataggctgtccggttacaggcttcacatttttcatagagtaccggcttttctaccggtatttctacgattttctgatgtgtccgggcataatcccgttcctgtgttaaatagcatattttatcttgacattcctctatcatgacgtttgcgcttcgcaacttctctttctcgatccgcaatgctctgtctgccagcttcaagtcgttctttaatgcttgaatattcccggctctgttctctttgtttaatttctcgttcaaggtcagagattcgctgagctgcgtcttcagttccacgataagctgttctttctgttctagttcttcttgtatctcctcggtcaagagcagaagttcttccaactgttctgcgttctttgattctctggattcgttcatctatatcacgtcctttccttatttgctgttccagttcagcaattcggtgttctgtttcagtaataaactgttttcgctgttcagattttgtgccaatttctgccattgctgattttcgttttccaaaagttctatctttgttttctgttcttccatcttggaaagcagttcctcggtatttggcaaaatgttgagcagctcggataactcgctgtttaatttttgcaatttctgattctgttcctgcataagagagagctggatgtcccggttctgcatttccagaatcatttctgccattagattctgctgttcttcgatttgaccaatcatggattccattaagggtataatttcccggctttcttctaatgtcatttaatcgctccttccataatgataatgcacccgatacttttccaaaggtgtccagtatcctttgcaataacgtgttttgttgttttatgatttgattttccgctactttccacgagccttttatttcctgcccggcaagaaacttttgttcaatctttcttgcgtcagctccttcatggatggtaggaatctggagttttccctgcttttcataagaacggtgatcaacctgattatgcaaaggcagatgttcgttacacacctttgcccattcactccgccacagttcacagttttttggattgttccatccagtagcatcggtcagcacccgtttccattgcaggcggtttcttgctccaatcttctgaattccgttttcgtctaatacagggatacggattccatgacggtcagggtttttcttatcctgccaccagttcggatgggattcatcaatcacgatatttccgtttttatctctgacaaaatcccaatccttgacttctttctttccccaagaatgatccgggttaaaagggcgcatagtcagaagcagatggacatgggggttgccatcccctttatcgtggatactccaatcagcacacattcccttatccacaaatgttttttggatatagtcggctgtgtattgaatctgttcctgtctgctccattcttttgggagggcaaattcaaatgacctaccaagttgggcatctgcacttttttcaatcttcaatacctcattccataacctttgtttctgaaatgtgattttgaaattttttaaggcagcttctttatcttctgaccttttgtatcggacagatttttgaaagcgttttatattttcttctggtactatctgccattcaggaggtgcgttttcgcacatcatcagtcgggtgtagaccacttcttttttagatgtgtaataactgattcgcccggtttcctcatttttcatcacatccccattgagatatgcggaagcggagataatagatttccctttacttcgtccgactattttgactgtgtaatgaaaaatcgccatgtctggattcctcctttctgcacatccggcatagatttccggcaacattgctttcagttttagaaaaagcagcattgacggaacgccctctgcgtaagagtgccctgcgcataacagcctgcatggaatgcgcccctctggcgaagagtgcctcctgcggcatgagcaggtctggctgaaagccccgccgacggaacgcgcatcctccgtgtcaatcagcggagtgattgacacgggagtgaacagtaacatttatcttcctctactttttctgcttctttcttgaacgccggattgatagatccactacaagaaaactaatgattaaaagcggaattgcaacacataccgcaactgtcaaactgcttacctcagccgcatccgatgtcactctggagtcatctcccgaacgattttcaatccgatgtccacgcaccagaatcctctgcgtattgattccatatggtgtacatgtaagaagtgtacacagatcttttccatcttcaatctcaagcaagccataatcttccggctcaacaatactgatctggtcaatctcatatgtcaataccttatcataaatgtgcagaagaaagatatctcccttttccaatttatcaaggtctgtgaacagcttcgcactcggcagtcctctgtgcccggataatacacagtgcgtgccccttcctccaaccggaagagacgaaccttcaatatgtccaataccaacctgcagaacagaatcctctacaccgtgatagattggaagcttacagcgaatctccgggattgtgatatatcccatcattccggttccatttgcatccagaagactatcatataaagtatcttcctcttctgatggtgtaaagcgtccgccattcgtaatcaacgtctggttgtactcctctgccgctgccagcgcctgctccttctcctgatcatccatcttctctatctgcttcgaataatccgcaactgcctgcgtctgatgcttcgaattccagaaattactgattgtcggatacagcagtaaggacaagcctgtaagaaagatgattcccgcaattattgttgaaatatgctttctcatgttacaatcctctccttgctgctgtatggggaatgatgaaacacattccccgtacagcaaaattacttctttcttatctcacttacatacctataatcgagcaacaattatttcattctcttctttgtaatcagtacaactccggatccaattacaaggattgcaccgaaaatgtagaacagggttgttcccattccacctgtggatgggaggagggagccggtgttgttctcgactttgacttcgtctactttttttgcatcaactttaatatctccatttccctcaatcacaatctctatcgggtctttcagcttattgtatccagctggctgttgtgtctcagtgaggtagtatctacctgcgtcaagaccttggattgtgaatttaccggtattccctgtaatcacagtgctatttcctgtctcacccgttactgcaacacgatagaaatcgccctgttttcccgccggagtttctatcgatataagacttacagcctctgaactaccctctttttttagcgtgaagttggctccggcaagtggtgtatctgtacctgtgtatttgaacactgggatttcaaatgtataagtagttgttgtactatctgttgtttttttattatcaccatattccaagtttgttgtattagtatttcctgttgttgtaccaattactgctttgtcattcaattttgcagaataggtaacaataatttgcgtatcagttgtaatcgaattacagaaatcttctgtaaatttaatgtggaatgtacagttatcacctttagtatcatttgtaactaattcataatctttaggcacactaagaggtgttgtatctccagcttttttcactacaacagaatcattaaaagtcaacccagcactcattgtatcatgcaacacatagttctttgcacctttctttgcttcgattgttgtttggaaatacactatatctccaatactagctgtacttgttcttccatatgttccgttaacagtcttacttacctttttatccacggtaggtgcaacatttttatcgtcaattgtccatgttggatttgttgtattaagagcaagtactgttcccacacttgtttcaacaagatagtaacccaatggaagatctgtgaatgttactgatttctctgagtcgtttaacgtctccgtcttatccgggtttatttttgttgttgaatcttttgcatatgccagtgctgcttttgcaaagttctcaacacttgctccatccttccaagttacataatctccatcaagagttacatatgtattctctatcccagtacttttaataaagtcactccaactctttattgatccattcacttgatctgttcttaacttataagcataattctcatcactataactctccaaatctaaaatacgataaatattatatgttccccctggtgccgcattattaatcgtaatacttcctgttgtagctgacattccactcgtagtcccctcagctcctaccacactacacattcccaataccatcataactgagagcattatggcggcaatcttcttgattattttcattttcttcctccttgtttttgttactgccccccccgaattttccgggggtggcagcacaccctcttttgttagtttcttgtttttgtttctttatatttcatcagcataagcactactgcgaagagtattaatatcgcccctgccaatctgtaaataagaaccccacaactgcctgtggaaggcagtttattcacacggctttgatttgtaacggttaccgtgtcactgttttttgcactgtttgaccctgttgtcgcactatcagcctttgttgtcgtatatgacgtaaagtattccattccgttcacaatagcaactgtagacgaatcttttattggctgatccttatcatcaagttcaaagacataataggtcttttttgtatctaagttaacaaatttatttgtttttatggttgtgtcttccggataatatgtgatagaaatttcttgaagtggctgtgtagttccatccatatttgttccattcgccttatcataaagaccaaaccaataggttccactcactggattcgaatcaagaccacctgggttcttaaactcttttcctacggtaatctcacctttatggtttgtaactgtcaattcgtagactcccttatattgcgtcttaatctgtggatcgtttatgcacgcttctacatcagatgaatattttccatcagtacctttctttggaatcataatataatatggtgtattatcctcaacatatccatcaggagcttttgtttctatcactttgtagatagtgttatatttcattgccttgtctgtagcatcaccttttccaaaactaatctctccattttcatccgtcgttcctgtccatattggagaaccgtccagttccgtaatttccccctctgcgcttcccgaaatatccgttcttgtacatttcaccattttgaattgcgcacctgataaattgcgtgataaatcgttttggtctttcttgatgattttcaatttgatgttttctccgcctgatatcattccgcctgctgaatatgaatacccatttactttcacacctgaaccgcttgccggagcataattttcccaatatgcattgttagaaaacgaaacggcttgtcccggcggtgcatttaccgtcgcagtataagtgattgtaactggttgattacatggaatctgtatctccagtgtattatcagctcctagtgaagctgtaaacgttacattttcacttgtattttttgaattaacgaccttaatagttgatgtgtccaaaatcaacgtagaactcaatttatcaattaattttaaagtcgtaccatcttttgtcggcaatgtctgtccaagttcatttgctttaattgtaaaatgaactttttcatccttcttaggctcagtattttttaccgttttttcaagattttttgtttctatagttgccgaagagaatgctgaacgaatatcttgtccatcccgtgtctgaagtgtaacataattggtaaatttctttatttctcctccaagtagtacctttggatctaccactttacatacaacctgaacatctactgaataactatctgttgcttttcccggataaaaatctccaagtgcaatcagtgcctgatttcctttaacataataagttgttgtcctatcaccatcaacgtcatcatctgttcctgctgtcgttcgtttttccgcccatccttcatcaagacctgcaatttcttttgactctacaaaacctttctttttctgatctggtcctacccatttgatacgaatatatgcaagttccattccatccggaattgtctccaacactcgataagtgcctgataattcgccggcataattcagcttaaatacccaggatgcatactgtcctgaacctgtgagcgctttctgtataatcttttcactatgtccgtcatccttaccatctttttcacttgttactttctccccatcataagtaaatgtctgaccgagttcttttaagatatctgcaccaccgcacagagttttatctgccgtactttgtggaatccaattcgtaccatcatcacttgtgctgacttgatttctataagtaaatgaatcacgatattttgtcggtaatgtttgtggttctgtctgtacaacaaagtacagtttattctctccaagtgtaattttttctcttgccgttatagtaaactcactaaagacatcctctccggtaaaaccagcactattttcaaattgaggagatgtaaacttatccgtgactgttttaagtttttcacttgcctgtaattcttctaacgtcttataatctgtaattgtcttgccatcttctagctttcctatatagattccaacaagcgaatctgaatgtaaataagaatttatcaagcttgaggttgtcgtattcgatacaatttcatctttaaaagccgtatcttttaaaattgccgttccatcaacttcaatcacccagtatagctttccatttttccatttcgtcgcatctgctttcgctttctcataatgccaggcttcttttctaatattcatactgtaatttccagaaatattcaccgatgtttgagaatatatttcagaaatattaaacttattttttcctcttccaacttctcccttcaactcaaatcgattgtttgcagttgcttgaccaaaggattccttgttcacaggtgttacatagtatgtgaatctatatgcataactttcatcattccatccaagatctgacggtttcaaagtgaatgtttttaatccatcaatcttcacccacttcgtttctttcacctcgtacttatctgaatttgtactgttctcattatacttacatgcttcaaccttcgcatatcctacatactgtactttatcagctggggtcaacgtatccgtcattgatacctctgttgcatcccaatcgttctttgtttcattaacttttacagtataaggatagcttccggcgggaacgctaaaaacagattctgtggaagaatccttttccacttttccctttgtcagatcatatcgactatcacttccggtaagattaattgtccgatttgtttctgtttctcttccaaccgctttctgattccatgtatagccatcaatagttttatctaatctgaccgcttcaaatccaggtgcaaaccttgcattatatgcattcgacgcagctacaatccacctgttctttacttgcacagaatttgcctgcattaccgccaaaacttctggttgcacagtaacactatatgttaaacgataagaatctcccggattcactgtgaaaggatatgtttcggttcccgaaagactaaaacaattagcgccagcaaagtatgtctctacatattctgttgatctatccgttgaccattttattttataattttcaacagtctgatatgaatcagaaccatcatcctttctttctaatttgaacgaatctgacttataactgatatatggaagtatttttgtatctgttgcattatcactatggttcaaataatcccaaaatacaaaatttttcaatggataattacttgaatctttttttaacgtaaatataagctgatattcaatcgtatacattccatcttgattccgcacagcccctttgtctgatgtctttttcatgtcatattttatctgcggttcaaaagacgcacccccatatcccttgtaatacttctttgagtatacatttgctttattgtcaattgatttaatatctttcatattgagtccatcttttaactttacataataagttaatttccggacttccccggctttcatttctccaatcttccagaccatactaccaagtttatcgtcacttgctgtattttctgtcggaattggattctctgtatccgtagttgttttcccaacatagacttcaccatgctcagatgtcttgtcagcatcaatttcctcataaggataaggttcgctcacttcattcttatttctgagctttgatttcgttttttctattcctgcatagttacttacgtaatttgctccattcacaactgtatccactactgaaacatccggacatctatcctctcccgctgtaacagtaatcgtatactgaatgtaatctccatcttttttggaaatcaccttattagcacattcctttttaacatccactttaccatactgtgcaacaggatcttctccaaagtttaacctgaatgtttttcctgcagttatcaccgtagttgttccattttctttcagctcacttagatttacctctcctgttataaagaagtttcctttaattgttgtatgctcaagtctttcaagataagattgatcaaattgtacaacaatcttttttccctgaacggtaagcgttccaacttgcttatttccgtccataatcttcccatctgttttttcattacgtaaaagctctggaagatcatatgtcagtgtacagttatagttgtcaatcagattttgtctctgtatatccttatactcaacttccaatttgatgtttgcatcacctggaatttcttcgcttccgttttcttcaatttttttccagtttccatttttatcttgataagacagtgaaactgattccactttgttttctggcgtatttacactcgcactcagatcaaaccctgccgtcgtagtacttcccgttccatcttcgccctctgctgccggcgctggtgtactccctgccacgacactttcttcatcattgccagatgtctcatccgctgtggttcctgctgtatctccactttctccgttctgagctacatttccatcatccgatgtctgaacctgatcctgactctgatcttggttctgttcctgactttgtcccgaattctgctcctgtccttctgtctggttctgctccggtgtctgctgtgagtcttcccctgattgatctttcgatgtcttatcatctgcataacacaattcggtatgcgtatgttctgtttttccgcaagtcagctgtccgtcactcgaatagcattcttctgtatggctatgctcttcctgaccacagactgtctttctctccagcgtgattgccgggagaatcagcgcatagaccgtacagaaaacaactacacaggacagacacagaatcatctttctccaccgttttaaccgggttttgtcttttaataatcttctgatataatccgttcctttattctgcacaaatccaccttcttttttctggtgtgtatctgctgccttcctgtgttagtcttcccttcgataccttataaactaaactaattacttattatctcactgtatgcttcctattttattcaacggccagatccggaatatgatctgtccctctatctggtcttttgaaatatcaccgattgcggtgcttcttgaatcaaccgatgtatctctgttatctcccatcagaaaccaatgtgcttctgatacctgatgtgggagatcaatgtcgcaatttccaagtgttttttctgtcagatacggttcgtccagtttctgtccatcaaccgtcacatttccgtccatatcaatatcaacccactgtcccggacctgcgatcacgcgcttgatcaggagcttattcccctgccagaatgcaacgacttctcctgtcttcagctgattggtcttcaccgatactacaatctgcccggcttccaaagtcggtgacatggaagaaccgtagatctgcagaaccggcatccacaaggttgccacaagaacagagattgccgcaactacaagcagcactgcgatcgtaccgcggagtgttctttgatacaccgcccggtgtctcagcctcttctgttcgttctcaacttcttctattgtagggatattaactgaatgttctttcttcttcactactctaatctcgcatattcttcttggcctgctttgtcaggcgtgccaattctttttcctttgcttttatcgatttaagataactatcagcagcttcctgtgccgcctggaatacgccacttagctgcactgccgcatcagcgatcgatcccgccttctctatcgtgatctctctggcctgaagctttgcctctgcctcatccagcctggtctgaagctctatctcccgcttcttcatttcataaatcagatcgatcaattcgcttcttcttaggtgcttcaaatcgttcttcatacatcattgactcctttgtcttgatttcctgtttctcttcatgaaacggttcgttcaaatctaagactttagccttcttttttacgtcaagcagattatagtacacagatattctatctgtcaattgcattttagcaattttcacatattttctcgagttttttatcatttttgcgtattttagacgcattattatgttttgtctagaaatagattatgtattttgtattattttttcttttatttgccttattctgtatttctattcagctatcagcactgccattctgagttatattataaattttctacttttgcaaaggcgaaacgtttcgtctttacaaaaaagaaagaccaccgagaacggttttaaaactctgctccattctcagcggtcaatcttcataaagtcaatattaaaattcagcgatcactgtctcgccctgtactgcgtccattcctgtatgcagcttcatatccggataatcgtctccgtttgtaactacgagaatacatgttttctcatatccatgtgctttgatcttctccggatcaaatgaaagcagcttgtctcctgcgtttaccttatctccttcttttacgaagtactcgaatccgtcaccttccatgtttacagtgtcgattccttcatggatcaaaatctctactccgttcgcaagtgtaagtccaactgcatgtctggaaccttccatcagcacagatactgttgcgtcacatggtgccacgatcacattctcttccggctcgattgcaagtccgtcacctaatgctttagatgagaacacctcgtcttttacttcctcgattggtactacttttcctgacagataagcctttacaacgaatggcttattctcttctacaggagcctgttttttcttgaaaaatgaaaacatacctacttctcgcctctttcttttaaacattgtccattggtttcaattacggtcttataccagtcaaatgatttcttctttgtacgtctcagcgtgccttttccattatcatctttgtcaacatagataaagccataacgctttttcatttcaccggttgaagcactaactaaatcaatgcatccccatgaagtataacccataatttccacaccgtcaatctctacggcatccatcatagccaaaatgtgtgctttcaaatattctatacgataatcatcttctacatagccgttctcatccggctggtctaccgctccgagtccattttctacgatgaagagcggcttctgatatctgtcatacagtgcattcattgtaatacgaagtcccaacggatcaatctgccatccccactcgcttgctttcaggtatggatttttgactgttgcgaatacatttccatctgttgtatcaacgctcgcatccgcacttgcgcatctggaagagtagtaagaaaatgaaacaaaatcaactgtattttctttcaggagcttttcatcttcttctgtgatatcgagctggattccttctctttcgaaaaatttctttgcataagccggatactcacctcttgcctgtacatcgatgaagaagtagttttcgcgatcttttcccatcgctttccatacatcttccggcgcacaggagtatggatacgtctgaccagctgccagcatacatccgaccttattctccggatcgatctcatgagcgattcttgttgcttctgcagacgctaccagctcatgatgtgccgcaagatatttcgcctgtgtctcattttctccttctttgaagacaagtcctgcccccataaatgggatgtgaaggatcatgttgatctcattaaatgtcagccagtattttacaagacctttatagcgtgtaaaaagtacggttacgagtttcttatagaactcgatcagttttcggttcttccagcctccgtactctttcgttagatgaatcgggcaatcaaagtgtgtgatcgtaacaagcggctcaattccgtatttgtggcattctttaaatacattttcatagaattgaagtcctgcttcgtttggttctgcgtcatcaccgtttggaaagattcttgaccaggcaatcgacagacggaaggtcttgaatcccatttcaccaagaagtgcgatatcttctttgtaatgatgatagaagtcgattccttccattgccggatagatatgttctgtatccggctctagtgtctctccatgtccaagcaataccttgaatcggtcttttcctgccggacatatatcgacatttgccagtcctcttccatccacattatatgcaccctcgcactgatttgctgctgttgcgccgccccacaaaaaattttccggtaaactcattttttcttcctcctgttgaatttctctgatttttctgatttattttcccatatatttttctatatatagatgcaccattccttctacaccaaacggttcaattggcagataatgactgattgcatctctcatctgtgtgccaagtgtatttgttacctcaattgccagccgggggaatataggggataggtaaaaaacttacaccctttattttacctcttcctaagttcaaaaagtgtctatatcaaaaccttttatcgtttcttgatatagacactcttttttaacaatcatcctgtcaactaattgatattttcaccgttggttgaaataacttctttataccactcgaaagaatctttctttcttctggacaagtctcctgttccatcgttatgtttatccacatagatgaatccatatctcttatccatctcaccgcttcctgcactgacaaggtcgatgcatccccatggtgtataacccatcagatctacaccatcttcctctaccgcctttttcatttctgaaatgtggtgctgcagatattccacacggtatggatcgtgaatgcttccatcctcttctaaagtatcatatgctccaaatccattttctacaataaacaatggtactttgtagcgatctgtaaaccagttcaatgaatagcgcagtccaatcggatcaatctgccatccccattcacttgcctttacatactggttctttatacgatccttttctccacggtagtcatattccggattgtctggttttgcttttgtacagaaagacatataataactgaaaccgatgtaatcgacacagccctgttttaacactgcaagatcttcttctgttacgtcaatcttaaggtcttttctttcccagtatttcaaaatatttacagggtattctccttttacatgcacatctgtataataatatcttttctgcatggctttttcagcctgcagtatatcttccggacggcaggtagccggataaatcgggcacattgcgatcatgcagccaatctgaaatttgggattgatcttatgtcctgcttttatcgcttcggcactggcaaccagttcgtagtgagatgcctgatacatcaattcttctacattttcttctggtttaactacaatcccggaattagcgtaaagcatgaatccgtcaccgatatctgcctggttgttaatctcattaaatgtcatccaatattttactttgtctttgtatcgctcaaagcatgttactgcaaatttcacgaagaaatcaatcagttttctgtttctccatccaccgtactcttgtacaagatgcagaggcatctcaaagtgactcagtgtgatcactggttcgattccatatttcagacattcatcaaacatgtcatcatagaattttaatccggcttcattcggctgctcttcatcaccatttgggaagatacgtgtccatgcaatacttgtacggaaacacttgaatcccatttccgcaaataagcggatatcttctttatagtaatcataaaaatcgattgcttcatgattcggataattctcgccttttagtatttcacctgttattcttcttcttgtatttacatctccgctggttacaacgtccataatgctcaagccttttccatctcgatcataggcaccctccagctgatgagcagcaactgcgccgccccagagaaaatcttttcgaaatcccattgttatttccttcctgttgtcttaattgctttgtataatagtgttgggggcttttgcccccaacttttctgtttctatatccaattacatcttgatgattatttctcatcaattctcttatacagtgcaatgaattcatctgcgagaatacggaaactctctgcactcataagctgatcttctgcatgcatcagaagcatgtatccattagaaatctctccgtttgcatccattgtcagaaggtctgcatgagcgttatgcccaagtgaaaaggcttcatctccttgtttaatcagctctgctgcctcatcatattttccttctttcgcacaatggattgcattgataaaatgtgttcttgctgtacctacatatgtaataatctgaaaacatgccaattcaaatttttcgtccatttctgtctcctgtcctgcttttattatttttaaattctgattttaccagtcttcatcctcatcttctaccggctgattcttctcctgaaccagattcatcttgtcaaccttcttaatgaatggcagataaacaaagaatgaaacacaaaggattactaactgaagcaaagcacttttccatcctgctaaaaggaatcctgagatgatcggtggacaagtccatgggatctgtgttgctccatataatgggcagattcctgtatacagtgcaaaatactggattaaacatgcaatcacaggcattccaataaacggaattgcaagcattgggttcataacgatcggagtaccaaacagaactggctcattgattccaaatattgccggaataattcccactttaccaagtgctttcaactgttttgattttgcaaagaagaacatatacattacaagtccgattgtgatacctgcacctgttatattgataaactgatcataaaactgctgtgttacaatatggcctccgtttgctattgtaagttctacaccactgtcaataatagcctggtttgcaagactgtttgcctgtaaaagtcctgtcatgattccaccaactactgttgaaccatgaactccgaagaaccacaggaatggtcccataaagcacatcagaactgctccaccaagggagtctgtcattttctgaagtggtgtctgaacaactttgtaaataatttccatacctgttgtgttgaatccaatagaacagataccgtgaattactgcagtccctgtcaggattacgaatgccgggattaatgctgagaatgcatttgttacaccttccggaactccggccggcattttaatacgtatatttttcttcaaaaaccaacagtaaacaagcggtacgatcaatccgacaatgattgctccaatcattccctgtcctgctgtccatgtcttatcaatgattccaccaacaacttctccactttctgttgttttggacgaaggcatcagaatcaagaatgatgccaatgaaataattgcacagttgagtggttcctgattttccagtttcgcatagctatagctgataccgataactgcgatcatcgcactgatggagaatgttgcaccacatgcctgatctaatactgctttgattcctgtagactctaatacatcgacaactgcctttaccggaaagtttgacaggatcaggaagattgatccgatgatcagaggagacatggaagtcaccataccattttttattgactgtattccctttgtattaataaacttaaggatcacagggattactttttcgttaaatttctctttcatttgctactaccctttactttaaattgtgtatctttgttttctcttatttatttttcgcaagcttatatgcaaatttcaaaacattcattccattgcacattccataatcctgcattgggatcacatctaccggaaccccttttggatcacaaatctcttttgctctggcaagctgatatcctacctgtggtccgagcagtgctacatccgcgccttcaatcatgcgttccatatctgtaaatggatatgctgcgatatcagcatcttttcctttttcctttgctgcctcttccatcttttttaccagaagacttgttgacattcctgctgcacaaaataatcgaattaccatgattgtttcctccttaattttttcccatttgttttgatgttgctagtataacaggcattttccattttgtcagtactttttcctgtttctggtttccgttccatatagacggaatttgttacataaaaaaaacaggacattctactttattgtgtaaaatgcactgttttcattttccttttttgtatattatgacactttttcgtgtatcctgttttttttgttacttatctggttactattcgtaccattacattctacaaccttaatgaaataagtcttccatatcattttgaaacagatcatctgtatcgttatggacgccctccaattctcttccaattaattccaaaataaaaacgactgccatttgggatgtcagatcataattttcgtcttttttatactctgaaacataataatttatattgcagtcactcatcttcgccaaagaacagtttgccttatttgtaatagatatcaggctgctccctcttcttttcaacttttctgccaacatcagtgtctgctctgtctctcctgatacagacaatgcaaccgtagctgtcctctcaccttttccgcgaaataccggagtaaatggatcatcaattgcaaaagaaaaccaacctacattattaaaatatcttgccccatactttcctataatagaagaattccccacacctacaaatataattgacgatgcctttgtaagcaacttcacagcttcctggatattctcagcaaatgcctgtgtctgcaccctctcaaagaaatctttaaccgcagtaagatccatattgattttcttctgttctttgctgttgacttcctgttttaatttcaaacggaattcagaatatccctcgcatcctacctttttacaaaagcgaaggatcgttgttgtcgaaacatgaacctcctctgccagttcacgtactttcatatatactactttctcttcattgctgatgatgtaattatatacatccatctctaactgattaaaagactttatcatctcatgcgtaaacatatgaattcagttcctttctattttttctctctattccattcttctgattattcactcaacagctgacttgcttccttccagcactgccgtcctgctgccaggatggaacacggctgatccaacgtgatcattccgccctctgctgttgagataaaccctccggcttccatcacgatcagtgatgctgccgcataatcccacggatacagcatcagttcaagataaactccatttgcgccggatgccacacggcagatatcaagtgctgcagaaccacctgcacgaattccaaggctgttcagatacagcttcttcgcatagtcaaagattctgtctgtatcttctgtctgataccgtgcagttccgaatgcaaccagattgtctgcaagtcctttatccgaacagtgaatctcttttccgttcagcttcgctccttcgcctttcacagcggaatacatttctcttgtgtaagggttgtaaacacatccaaacagcattcttccaaactttgttaatccgactgaaatgcaactatgcttgtaatcaaagataaagttcgtcgttccgtcaatcggatctataatgaagcaatatccatctccaagttcctgctgcatcccgtcttcctctgcaagaaatgtcgcttccggtatgagttgacgcaggttctgaatcagataaaactgaatctccttgtcatgctttgtcacaaagtttgcagttccttctttatcaaaaactgtcagttcctcgtcctgtgcctgaagcatcagttcccctgccagtgttactatcttcatgatttcatcgtataacatgttggttgtagtcctttcctgtttattcatccaatcttacagattccatttttctatactgctgattctgctaatacttctttgtctttctatcttatcatgattttctacattaatctatatagaacaaagaatgtgctcggcacattcttgcgcctgcggcggtcgcttgcgacgcctaccttgtacgccgcagtgcgcatcctaagcggagcgtttttttatatgttaggaaagaactttcctaacatataaaaaacatctgcaaccggccaattcaggctgtgcagatgctttttcgtattttcatcctctatttcatcgcgtctttaatcgctgtcagaagctcatcataagtctcatatgccggaagttccggatgatctgctttgatctgctctgtgctgcggaacaagaatcctgccttacttgcctggatcatgccaaggtcattgtaggaatctccacttgcgatcgtgtcgaatccgatagactgcagtgctttcacagtactcagtttagactgctctacgcgcatcttgaatcctgtgatctcgccgtcctcagctacttccagactgttgcagaacagtgtcggccatccgagtttctccatcagcggtgtcgcaaactgtgtaaatgtatcactgatcaggattacctggctaaatgtgcggagctcatctaagaactctctcgctcccggaagcggatcgatctttgcgattgtctcctggatctctttcagtccgagaccatgctctttcagaattccaagtctccaattcatcagtttatcatagtcaggttcgtctcttgttgtcttcttgagttccggaattccactcgcctctgcgaatgcaatccagatctccggtacaagtactccctctacatcaagacatgttatatacatcgtaatattcctccatctgtttcattctctaatcactttattactttactgtaatgtattgattttaacatatatgctacatatttactacttattttttgcgacagtgaaaaaggagaccagatatctgatcccctttcccatcttctattactccataataggtttcagtgcttctgcaagcttctctttctcagcttctgcctctgcaagatctttaccaagtgttgtgtagtagatcttgatcttcggctctgttccggatggacgaacgattactgtctcgttgttctccagtttgtaaacaagtacgttagccttcggaagtcctgtttcttctgtcttctcgtaatcgatcacgctggctactttgtatcctgcgatctcttccagaggattcttacgaagattttccatgattcctgacatcttatccattccgctcagtcccgggaattcaaagctatcgatcttgttgagataacgtccgtactgtgcgtagatctcttccagtctctgtttcagtgagcttccgatgcttctgtagtaagcggccatctcacagatcagcatagatccgatgattgcatctttatcacgtacataaggtcctgcaaggtatccgtagctctcttcaaatccgaagataaaacggtcaacttctcctgctgcctcgaggttcgcaatctgatctccgatccatttgaatcctgtcagtacgttacgaagctctactccgtaatgctctgcaactgcatctgcaagtggtgtagatacgagagatttcactgctaccggtttctcaggcattgtgcctttctcgatacgtcctgctgcaatgtagtcaagaagaagaactccgacttcatttcctgaaacgagctcgtaagatccgtccgggcacttcatagcgattcctacacggtctgcatctgggtctgttgcaagcatgaggtctgcgcctgtctctttcgcaagattcagtcccagctcaagtgctgcaaagatctctgggttcgggtagctgcatgttgtgaaatatccattcggatactcctgctccggtacgattgttacatctgtgattccgatgtctttaagtacacgtgttaccggtactaatccagatccattcagtgggctgtatacaagcttaagtcctgcactcttacacagacccggacgaacctgacgggactcgattgcctcatacagtgcatccttacagtcatctcctacgaaacggatcagaccttcttcaactccctgagcgaaagacatatacttcgcacctgtaagtacatctgtcttctggatctcttcgtatacgattgctgctgcatcatctgtcatctggcatccatccggtccgtatgccttatatccgttatacttcgccgggttgtgggatgctgttaccataacacctgcgttacagttataataacgtgttgcaaatgaaagtgccggtaccggcatcagagcatcgtaaattcttactttaattccgttcgctgcaagaactcctgctgctgtcttcgcaaacacatcactcttgagacggctgtcgtagctgattgctactgtctgtgtaccgccctgtgtctttacccagttagcgagtccctgtgtagcctgacgaacaacatagatattcattctgtttgttcctgctccaagaacaccacgaagtccggctgttccaaacttcagcgcaactgcgaaacgctccttgatctcatcatcatttccctcgattttagttaactccggcatcagatctgcgtcttccaggtctgctgccatccagcgcttatactcttcctgatacatcttaatcactcctattattttcttaaaatgtaaaattattgcaattcagccatacaacgtaagaccgtcagtttatgaccacttcgttgtatggctgaactgtttctaaactttacaagtctagtcatattataccatgcaggtagatttacagcaagattacttgtctattttaacaagcattttccattacatagaaataattcccaatacatttgcaatagaacttaataatataataatcaggcagatcggtgccagatatttcataaagaacatgtataatttctttctcttaaatgcagatgactgctcaatctcccttgcaatcttgtcaaatccaacggtacgaacgatcaagaagcatgttgcaagtgctgcaagtggcatcatcactgaatttgtcaggaagtcaaagaagtccagacatgccattccgaaaatctgaataaagctcagtactccatatcccatagaagataaggttccgattataagcataacagcaaccataaggatacagcatttcggtctgctccagtgaagttcatcctggaatgtagatacgcttgtctccagaagtgagattgcacttgtcactgctgcaagaagtaccaatatgaagaacaggataccagccagccttccaacgcccatacttgcgaataccttcggaagtgtgatgaacatcagagatggtcctgcctgcagattgtccgggtttccaccagagaatgcaaatacagccggaatgatcataagtcctgcgagcattgcgattgctgtatcgaaaatctcaacctgtgttgtactcttctcaagatcaacgtctttacctatataagaaccatatgtatacaaaattcccatcgcgattgacagggagtagaacatctgtcccattgccgcaacaaccgtcattgctgagaagtgcttcggattcggaatcaggaagtacttcacaccttcaattgctcccggtcttgttacagaataaattgctacgataaccgcaaggataacgaggattggcatcataatcttagatactcgctctacaccattctcaactcctgccaggataacgcagaatacaagaatagaaaacacgatgaaccatgcttctacctgaaaagaatctgaaataaattctgtaaaatatccgtcctgtgcaacagtctgcacatttcctttcaaatactctgcaaggtacttgataacccagccaccgatcgaactataatacggcacgatcagcatagggattattgcattgagccatccgccgatcttaaatgattttgtcttaccaaatgtctgaaaagctccaaccggactttttcttgtcattcttccaagtgctgtctctgacatgatcagaacatatccaaaagatacggtcagaatcagataaacgagaaggaagattccccctccatatttcgcagccagatacgggaatctccagatatttcccaggccgactgctgagcctgcaacagcaagcacatatccgattttacccgagaaacttgctctctttgctgattgtccattgttactcataaattgcctcccatcacataacagtctgtactgctattttcccatcttttttatagcctatactgttctattctaccattcacaatcatgaatagcaacaaaaaagagcgttgacagcgctttttaaacacatttaaaatgctatctcggctcatttttatacgtttttataatttcccttctatttctgctctttcaagcaatctctcaatccctatattccatgttccgatcttcactccggcattgatcacacgcttacatttccctattgtctcaaatgctttctgaagcgtttcttcccgaatctcctcaaacggttcttccgtgatcacttctgctgccagtaatcttgccagccggtaatccatatcattttcatataaaatacctgccgcaaacgggatgtgctccttctgaagtcttcgataaaccgggattccagttccgccggaagagatcacgaacacttccggctcaccctccggcgcaggaagttcaatacttccaaaaagcgggtcaaaatatccattattgattccatacaattcgcgaatgatttcttctgtaaatacttcttccgggcttccgtaatgtgaaatcgtctcgcctttgacacagatgatcttatctgaaatcttctgtgccagatcgatttcatgaagagacataatcaccgtaatcttcttctgccttgccatccgctcaaggatagacaacagctccaacttatattttacatccaggaatgaagtcggctcatctaaaacgatcacatccgggtcctgacagattgctctcgccagcagaacgcgctgcttctgtccgtcactaatcgcattaaaatcacggttgccgagttcctgcgcatgcaccgcctgcatcgcctcttccaccagacattcatcttcctgcgtcagaatcccaagtcgtcctgtgtaaggataacgtccagtcgccacaatatcatgacaagtcatcaactctgtcttgatccgatccgtcaacacgaccgccatcttagacgcaagctctttgtacggcagtttcaaaagagaagtatcgtcaaaaaatacattccctccaacgactttcaactgtcttgtaatacttttcaaaatcgttgactttcctgaaccattcggcccgattaaagtcacgatctcccccttgttgatcccgatattaatatcacggatcagggagtttccattataacctaccgacaggtctttcatttgaaaataataatctaccatcttattttcttcctcccttcggtatcatcatatagataacgatcggtgcacccagaatagaagtcaccgtactgatattcaattccaccggtgccagtgccattcgtgcgatcaaatcacagatcatacagaacacagctcccataaagaacgttcccggtatgaccacgatcggttttgacgttccaaatgctttccttgcaagaaacggaactgcgattcccacgaaagaaatcggtcccgcaaatgctgtcacacacgctgacagaatactggaaagcaaaatcaaaatcacgcgaaatgtcttgatgttgactcccatactctgcgcatatgcttctcccaattgatatgcactgattggtttggacaggaaaaatgtaaacagcaccgcaagtccgacaaccactgctgccacacgaatattgctccagctcattccggaaaaacttccctgtgaccatccgtgcagattcacaatatcagaatcatccgcaaatgtcacaacaaaatccgtgatagccgaacagatatatccgatcatgatccccccgacaagaagagacgccatatgctgcacttttttcgacatcagaaggataaatcccgtcgagatcagcgacccgataaatgctgcaagaatcagtgtatacgaagaaaatcttccgatatatttcaaatacacgatcattgtaagtgccacgaccattttcgctccggaagaaattccgagaacgaaaggtccggcaataggattggaaaaaaatgtctgcagcaaaaaacctgaaagagacaatgcaccaccaaggagcgctgccatcagaattctcggaagacggatcttccatataatattgtactctgtcgccgctccttctttcagaaagagaatgcgcagaatcttaggtaccggaatatgaacatttccggtattgatatttagcactgtcacaacacaaaatactgctgcaagaatcagaaataccgctgtgtatcttgtacgccgtctgaaattttcctgatgaaaacttgtctgctccattcttctactccatcttttcaagaaatgtcatctgagatgcatcaccgtctgtcagcatcagatgcatatctttgatcagctctccgactgtatctgttgcctgatataagttctttccggtataccagacatttccgtctttcaccgccttgaattcagagaacaattcattctttgcttccaactcactgatactatttacctgtccgtcgatcgtcccgttgtagatcagataatctgcatcgacagcagtcgcatagaattcctccatcgtcagtttaacagatggtgcgttgctgtccggattcttcagatctttgaacgcatatcttccacctgcgatttcgatcattgacggaatataatcgtcagattttctcacaacgattgaaccatctgtactcacatagaaataagcaaccgtcttttccgtgttctcaaatcctttcagttcctcgatcacgtgagcctgctggtcaaaaaatgtatccgcttcttcctctttattcagaagcgccccataaagcttgatccactcggttcttccaagcggatgtgactcataactggagtagtctacaaataccggaatcccaagatcttcgatcatttcctgtaccttcggtgtatgaaggatcatcgttgattcgattgccagatcacagtctccgtcaacgagagtctcataatccggttcgctgtattttcccgcaaatgtcatcgctccggattccattgcttcctttgcactctctacataccagccggaagcctcaagcccggagaatttcaccttgtcaattccgccgattgcatcaaacagagacatggatgctgtcgccgccatataaatattctctgtcggctgctggatcacaacaatatcatccgccagattttccggttcttcttcaccttccggaacgatcagatattgcttatcttcatggacatcgatcaacttatatccatccttataataatatacatcgaattctgtcgcgtaagtcagatccattgtagattcataggtaagcccttcgatctccggtgctttttttgtcttgtcggctgtatctttggtcttatcctttgttacatctgtacctgctgaattattaccgctgtttccaccggaggctgcggtagaaccgcagcctccgagcagaagtgcagctgaaagcattaacgctgtgattctgcatcttcttatcttcattctatttttctctcctatttctctgccgctgctactgccgcatcaaacttctcgttcgtcagctcttcacatccgtagagaacaccgtaaaccttgatccactcctgctttccaagttctgtcttttcctcggaagaacgatcaacgagtaccggaattccaagcattgcaagcttttctgtcagctcttcgaactgttccgccttctcttctactgtcagagtctcttttgtatctttactgtctttatctgctattttgtcagtatctttcgctgcattttcctcagaatcttctcttggaagaatatctcctgtaaacaatgcaagattcacttcactcttcacaaaattcttcagtttcaacttgtccgctgttcctgcatatgcaacttcagcattcttctctccgtcttttgctttcatcttatcagcaatctcagatactgtacagtctttgctcttcattccaactgccgcaatattattaagaagatcgagatctttcatcgtattcagaatctcatcagactctgcataagtatgatccacaggtttcttcacaatgatcatatcctgctcaagaccaaccggaacttccacatcctccggaacgatcagatatttcacaacatttcccttgtaaagctctgctgccagttcctgttcgcttgtgccgttgttatccgaagctgcggattcctcggcagaagcatctactttgctttctgcatctgagttcttagaatcttctgatctattgatcgtaacagaagctactttcttcttggaagacttctctttatcttctgcagacttctcattttcagactttgtttcctctgctttttccgggtctcttgctgtgtccttcgtcatatcaatttcaagaagtacaatcccctgatcataatgataaatcttgaaatattctgcatagtccagctttgtttctgactgatattccaaacctataatttcaggtgcttgttcatccagcttctggttactgcttgtcgaagcatctgttccgtttgcagatgttcctccatttgccgctgcaagataaatgaaaatcgtatattctatctcatgtgcgacagacattttatctgtcattccaataatcttattgttctgattcaatgcaaccgggataacagctgtcgctgatccgccgccctttgttgtgtaatacttatttccattcgctttcacatactgataatgatcactgctgaacacgagtgttgcataagcctgtccattctggatcgtcactttattacaagtaatctgaaccttacctgttccacctgaccaggtaaaacggtccggagtatatacaccatctttcagtgttgttccactgtctacatgagaagtagagccgcttgtgtcggattcgtattttgatacattatctgcttttccgtcatttccatctgtttttcctgaattagttccagatacagaaccgcctgggaaagcagaattgttcgttcctgtattaccagtattattggaaccaccagtagttccggaatttcctgtgtttccgttgtttcctgtatttccggaatcacctttattctctgagtctgtggaattaagatcggcaatcttcttcattgtctctgactggaaagtcagcattctgtcataccagattccttttttaatggaatatgctgctactgcgatttccttatccaacgcttctaccggaacagtataagtatattttccttcttcattcacctgatatggaatccaggatgactgatctgcgcttgcagcctcttcctttgttcccatatacagatagccgtaaccggttccgcttaatgtaagcacggcactcatttttccgtcttttgctgtcaggatacaatccactactttaaacatggaagaactggaagttacgtccatactgtagattccgtttgctactgttgcttccggtgtcggtgttggcgttggtgccggatccggtgttgaggtttctcccggattcggaatgtacatccataagtactgtttgtcataccaagtctgatcttttgactttctcaaagataccggaattgtctgacctgctttttctttcggaacattgaaatgaaatgtccatgcaccttcttcatcctttgttccttctataacagatgctttcaacaagtcatcttttgaaccaagatatagcgcatcaaatcccgtgttgtttgtcttgatcgtaatatcaagttcgccatccttttcaacaactgttgattcactgaccttgaacatcttgaactcttcagcgtcttcttttactactttcacagattctcctgttacagaaggagcctcctgcagtggcgaaagttccggttccggagtattcatagaatcgttcgaatctgtagaaggttctgacttgcctgtttcatcttttatctgtgtatccttgttatcagtttttttgtccgcaacctgatctgagacagttatgcctggatttttcccggtggtttctgtatctttctcttctgagttattttctgaattattttctgagttattctctaaatttggttttgtttctgcttcgattgaattctgattatctgatttatccgaagaattatcaactttatcagattcctctgtctgatcttcttttgttaaatcgtcatttcttttatcttctttaacatttcctgcgtcttctgtctgactctcatcttgtttcttatctagatcagcttcttccacctctacagtttcctgtaaatttgtctcacactgctgctcattttctgccgcatatgttcttgtataagacaatggtgaaatcaccatagaacctgtcagcataagcgcaagccatctgctcttatttttcatttcttttttgtctcctcttaagttgtgaattataaaatacggaaaatggatagaattatcttgaatcaaatgaatgattgctggtcacacgtaatgcgaacagtaagaatggttctttcggtacaatcaattactcgtgatctggaattcgtatattccccgcaccaacggccggcaggtttcctgacttacagatcttctatacagaacaccttcccggtctcccagtggatgtgcggactctccacacttgtctgtataggagcggtcttctgaaatctaatttctaagaagaccgcatctctgctcacagtgacgagttcgtacaggtcttacacctgtttcccttttacctgtttcaatcaggatatggaaatatattctctgatcaaacagcaccgaacgctattatttctgactaactataacatttcattatattgaagtcaactattctgccttcacggcccagcgcatcttcgtagatcttgctcttccgttctgtgcacattcctgcgctgacggacgtacaacgtcccttgcatattcggaataaattccttctttgtatcctgctttgagtgctttttttacaagcttgtcctctccggaatggaatgtaagaattgctactcttccgcccggttttagtgctcccgggagtttctccatgaattcatacagcacttcgaactcattattgacatcaatacgaagtgcctggaatgttctctggcaagtctttttgataatgtccttcttttctttattatttggaaggaaatctaaagtcttctcgatgacatttctaagctttgttgttgtatcaatgcgattgcccttgcggatctctgttgtgatcgctttcgccagctcttcgcagtatggctcatctgaattctcgtaaagcattccggcaagctcttcctcggaaatgttatcaaggcgctctgctgcgctgattcccttctcctggttcagtcgcagatccagcggtccgtcaactttgaaagaaaatcctctcttcggattgtcgatctgcatagaggaaactccaagatccgcaaggataaaatcaaatcctccaacttcttttgcaatctcatcgatcgtgcagaaattctgcagacggatacttaaaatgtcttctccgaatccctgatctgccagacgttttcttgtctttgcagactcttccgggtcaacatctgttgcatagatgtgcccctcacctttcagacattccagcattgctttcgtatgtccaccgtatccgagtgtcgcgtcaaatcctgtctcccccggctgaatcttcaagaaatcaagaatctcatttaccatgatggaaatgtgcattccggcaggagtgtttcccttctggattacatgcgcaattgtatccttgtatttctccggctgtaactctttatatttctcctcgaatttcttcgggtattttcctttatatctcacacgacgcttgtgcggtgtctgtgattcctgtgtgttctgattgttctgttcgctcatttcgctctcctgttcttatctttacaacgtatgtacagtataccatgaaagttattcacaatataccatgaactttgaaatgttttccacataagtctgcatatttttcacctattcacatttctttaccggaacctgcatggattcgctattttatccggctgcatatcttactgccacgttcatcactccggcaagcatcatcacaaccaccggattcagttttgtcttacgaagcaataacagacagattccaaagatcaccaccatagaccattttgtcgccgcaaactgcacaattccatctgtccaaaatgcagtgtgcagaattgcgatacctgcggaggcgatcagtgcgacaactgccggtcttaaggattccagcacgctctggaacattttcattttcttatatcttaaataaaaccatgcgatcaaagttacgataatacaagacggcagaatgcacccacaggtcgccgcaacagatcccggaactcccgcaatcttgctgccgacaaatgttgccgcattgattgcaatcggcccaggtgtcatctgggaaatcgtgatcaaatctgtgaattctgtcatcgtaagccaaccatgctgtgtcacaacctgttcttggatcagaggcatcgccgcataaccgccaccaaagctgaacagtccaatctgaagaaagcttaaaaataatttcaaataaatcatttctcttcacttcctttcctcgtgatctttttctcaattaatgcgcggagtactccgacaattccacagatcagaatcacatagactacatttacctcaaatatgcaggaagctataaatgccccgaccataagtacgtatgacaaagcatctttcttcttcacgattccagcacccatgtcatatgtcacagatgcgatcacggcgcccactccggcctgcattccttcgagcattaagctgatgatctggttacttcgaaatgcctgataaccggcagaaagtatcgatataataagaaatggtgggattactgtcccggcaattgctgtcagaatccccgcaattccagccagtttatatccgatcacgattgctccgttcactgcgattgctcccggtgccgactgcgcgatcgccacaagatccaacatttcttcttcctcaatccaatgatattcatctacgaactttttcttcatcaggctgacgatcacataacctccaccaaacgtgaacgcacttaagtaaaaggttgaccagaaaatcttccacaattttttatcttgtttttttccttgcattttttcttgttgttcttccatatatattgtcctcgtatattatgattatgcgaattgcgtagcactagaactcccgccacactatatgctattggcagacaaaattccctaactatgatattctttctcttgtagtctatcgcaatcaaaatgattatgcaatcgccttgaattttttacattatattttcctttttgaaaccttaattttatctgaattttccctatttggaaaatgattatgatacaatgagaacagtaatatttatcataaaggagattgaacttgaaaaacccatttttgcgattatcttgtgccgttctcctgtgttgctgcctgagcggatgcggtagcatacagcacaaatcccgtacggacacggcgcaggcgcagggtactaaggcaccacccaagacagcagatgatttttctatctcatcagattctgaaaatgaaactgtagatgaaacttcttctgctgatgccgccaccccatctgcttctgaatctgaatccgtaactcagcaggaactgctgaccggcgcagcggctctttacagcaatggacaggagatcagctttgacccttcctggcaatacgcagacttttctgcaatcaattctggaacagctactatttatcttgcagattctgaccgcaaggatatcgtcgttggcgtgaatgccggacatggaacttccggtggtgcttctgtaaagacacagtgtcacccggatggttctccaaagacaaccggcggaagcactgctcagggtgcaacttatgcgactgcagtttccgggggaatgacatttaacgatggaactgctgaaagcactgttacacttcagatggctcagattctgaaagataagctacttgctcaaggatatgatgtccttatggtgagaactggcgacgatgtccagcttgataacgttgcccgcaccgtactctgtaacaatgtagctgactgtcacatctcactccactgggatggagatggattgggatatgacaaaggctgtttctacatttctgtgccggatggtctgaaaagtatggaacctgtcgcttcccactggcaggaacatgatgcacttggggtctctcttgtagaaggacttcgtacagaaggaatgaccatttaccaaaatggttctatgaatattgatctgacacagacttcttatagtacaattccgtctgttgatatggaacttggaaatgcaagctctgaccacagtgattccacactaaatagtctggctgatggtctggttcttggactcaatgcttattttggaaattaaaattcttattgagttatttattttattttttaaggaggttattatggagccactcattcgtgttaaaaatatgtacaagatctacaatcctggagaaaatgaagtccgcgcgctggatgatgtttctcttgagatcaaccagggagaatttattgccattgtcggacattccggctctggtaaatctacatttatgaatatgctcggctgtcttgacacacctgattccggggaatattttctggacggaaaagatgttgccaatctctcagacaatgaactgtctgatatccgcaatcacaagatcggcttcatctttcagggatttaatttgattccaaatttggatgcacttggaaatgtagaacttccactgatttaccgcggacttggaaagcagcagagaaaagagattgccggggaagcactgtcgaaagttggactggaaaaccgtatggatcacagaccgaaccagctttccggtggacagcaacagcgtgtcgctgtagccagagcaattgccgcacagccgccgatcatccttgccgatgagccgaccggtaacctggacagtaagtcgactatcgagatcatgaatattctgaaagatcttcatgagtctggaagaacagttattatcattacacatgatgatgaaattgctaatcaggttgatcgtgttgtccgcattatggatggaaagattgtgagtgatagtgtaaattcgtagcaatttaaatctttacctgcaattacagagagagggcagtactttacgatttctcaatcgttgaagcactgccctctctttatgtttcttattagatatttcttagtagaatttctaattacttctattcactttttattctactgatacaagctcaatcttgaagttcagttcttttcctgccatctcatggtttgcatcgaaagtgattgttgtctcttccttagctgttacctttaccggaaatggctgtccatactgattggacaggtaaacctgctgtcccacttcaaggtcttcagatcccgggagttctgcaatctctactgtgaagatagcttccggattcggcattccataagcttcttccggcatcaggtggatgtctactacctgaccaacttccatatcagctactgctgcgtcaaatcctttgatcatctgtcctgcaccgcatacgaactcaagcggctctccacgatcataagaagaatcaaactgagttccgtcattgaatgttcctttgtaatgtgtacggcatttctttccaacattctttccttccattgtagtatgtgatccgcatccgccaccgcagctgcttccacaagaatgtccctcttcatgatctccacaagaatgtccttcctcatggtgatgatgatcacatgtagctcctctggatacaagctcgcctttcaggtatgcctctactgcctgatccgcatctccctgagcgcctgaacacaattcaacgccggcctctgcaagtgctgtctgagctccgccaccgattccaccacaaatcagaacatctacgttctgtcctgcaagcagtcctgccagtgctccgtgtccttccccattagaaccgatcacttcactggaaaccaccttattatcttccacttcatacactttgaaagtctctgtctttccaaaatgctggaaaatatttccgttgtcataagttactgcaattttcattgtaaaatcctccgtttcaaaattccctgtcagactagtataatccattacgcaggtaaaagcaacctttgtgtggatgcgaagttgctccttgtagcagttactgttcacacggtgtgcgaccagcaacgcaaacagtatcattgacacaatcttctcaagacactatacttgttataaaacttactctagaccatcagaaagtgagcacaaccttggaatatgaacacattacccattcctttgaaccaatatataatgaagactccgagattctgattcttggaactcttccttctgtaaaatcacgggaaaataatttctactacggacataaacaaaatcgattctggaaattgttggcgaaactttgtgaggaggaaactccgcagacagttgaagagaaaacggccatgttactccgccaccatatcgccatctgggatgttattcaaagctgtgacatcaaaggctccagtgacagcagtatcaagaatgtgacaccaactgatttaaaacaaatcttagatcattgtcagattcgacaaatctatgcaaacggaaataaagccggagctctttataagaaatatcagcagccgctgaccgaaagagacatccttgtgcttccttccaccagcccggccaatgccgcctggtcactggatcgtttgtacgaaaaatggagtgagatactgaggtaaattatattgcctcagttctcactccatttttattcgaataaattactatttcaaacaacttagattattcgctaacctgcgctcttctctgctcaaacactgctgccagtctcggcagaatcttattgcatgccatcgtgtatgccgcgccaaatacatttgccccaatacgaagcgctaccgcatacggcatcccaaacaagccagatgcaatcgacaatgcaccaaatgtattaaatgctgtctgccatgcataccctgcagaatatccgactccaattcctccgatcattccgatgtatggatacattgactccggaagcaccaaatacaggataacaaataacagacatcctactatattaaatgcagctctctttcctgctcgttctttacagtcatccgggaatggaagacaaacagacatgcttgcgatccccgcccacattgctctcggaagtccaagcaatgacatgaataacattgcactggaaacaactaatgaaagacgaatgtaccatctgtttcttgcggagttaatattgaactcgcggaacaaatcaagaaatgatcttctatacggtctgttcttctgattcttatagaagattgccatacacaataccattccaaccaaaaggccagccacgcgatacaagtactcctgtccggtcacatcatatccctggagaagaagatatccaagaacaaatgtagaatgattgtacatgattacattgtgacatcccaaaatcataagaagcaaaatacatactatattaataaagaatgccggaaccggtgacaccatattcgaaagcttcggtcctgcaatcaatattccaaagattccgacgatggaggccaatccgtgcgttgtacgaattccaaaatctgcctgtcgaagaacaagcaccgcaagaagcactgtaacgcctactacactgttgttattccctgtgaaatgactgtataaagaaactaccgccacacaaaatgccattacaagatagactttaaaattataaataagaatgtggcgatacctttccttcttgtcttctgtcgctttgatcagctgcttagatgcaactgaactgagctgtaactcctgataaaatgtcatatatctcttcctcccactgttatttttcttcaaaatatcaacgagaaactataatacaaatccatcacggagtcaataaaaactttattaaaattttctgataaatctgaattattcaaacaatatatagaatttaatttttaggctttacaaactgttcgctctatgataagataatttgtgtcgagcggaagtggcggaatggcagacgcgctagattcaggttctagtgggagttttatcctgtgggagttcaagtctcctcttccgcattgatagaatgtaagagaaatccttagttcaaggatttctcttatttttttgttatctgaaattttcctatttttcgttttctcaactagctttatggcagaatctcaagccagtatccatctggatctttgataaaatcatcagtagtctttcttctcacttcgtgcagatcaagggcctcgttgtaaaatttaatagattgcttcaggtctgatacattgtagttttcgtgaatcatcttaaacttcataattcttctccttttgtacattctgtgtctttaatacgtgacttatattgcggatattcagtaataaaccgcttaattacattggcatcattccagtaatgcattggaaaaatgacattgcaatctacatttttaaggaaatacaggatcccgtcggcatagtgatcttcctgcctcggatctaaaggaacaaatgcagcatcaaaatgcatacccttaattttcctgatttctgcacgatatgctgaagtaagtctctggttgtcagctttcggttcaccatcccaataccagtcatttaagtcgccggcatgataaatggtaccttcctttgttttgacaataaatgctacaccactatcgttagacagcaatgtatcaactttggtatcattatccagattataagtctgatcatgataaacatatgtaatcttcatatctgtcaaatgatttctttttcgtatatcattcgccagaactgcctgataagtcatccccatgtcatcaagaatctcaaaaatttgagggttaaaatgatccttatggaagtgactacaaaaaacgattacttctttttccttatcaaggtgcggtaattcacccttataataatcaaaaatatagtagcaatctttggtttcaagtaaaaatccactgtggttaatgtaagtaattttcataatatctcctgtataaattaatattgaaaacttcataagaaaattctgatttctatgttgtttaaattcctaataaagaatcaatctatgattgatttataataattcccaaaatcggccagtgcatctataattggcagcatttcttttccaagttccgttaatccatattctacttttggcggcatctcctgataatcgtgccgataagcaagcccgtcatcaatcatttgcctgagactatctgtcagtaccttctgtgaaatgccttcaatatctctctgcagttcattaaaacgccagggacgttcttttaaattacgtatgatcaaaagtttccattttccacctataagggacacggccgttgctaccggacaaacaggaagttcatcttttgtcttcatttcacattcacctccaattttataataacacatacattttagagtgtatagttataaaaaggtacgtacttgtttttgcatgtgtaaaacgttaaagtatagatgagcaatcgaaaattgcaaataatcaagtgttgtaaacacagacaggctcacaatctccccattaacggagattatgagcctgaatttttatgaatttctcacttcttcatatttccattttgtacttttgagataatctgtcaccccaacgccacatccagaaccatcatcaaactgaacccaaccgcaaagaaaactgtaccgatattagagtgctccccttgcgacatttccggaatcagttcttcaaccacaacataaagcattgctcctgctgcaaagctcagtaaatatggtaatgccggaattatcaactgcgcagcaatgattgtaagtactgctccaactggttcaaccacacctgaaagcacacctccaagaaatgccttccccttactttctccttcggctctaagcggcagagatataattgctccttctgggaaattctgaattgcaattccaagtgataaagcaagcgcactcgctgctgtaatctttgtatttcctgcaagaagacctgcatacattacaccaactgccatcccctcaggaatattatgcagtgtaaccgccagtaccatcatcgttgtacgcccaagcttacttttaggtccttctgactgttcacttcctacatgaaggtgtggaatcaaatgatccagcgcaagcaaaaacaacacgccaatccaaaaaccgactaccgccgggaaaaatgataaagccttcatattttcagattgttcaattgccggaatcaaaagactccagatggatgctgcaaccattacccctgcggcaaatcctgcaagtgcacgctgcacctgttttctaagtgtttttttcataaaaagcacgcatgctgcaccgagcgttgttccaatgaacggaatcagtatcccaagaaaaatttccatttacgcatctcctttcttggttagttttaactaactactcattttctaaaaatccgtgtaaaaccgaaactgtaattccacacggattattttttctctagttcagtatatcacttaaggaattgtgtagcaagaagcaacttttctgcctgatcacttccccatccaattttcctgtttttttcacagttttcactcaacctttcgatttctgtgctataatatggcattgcgaaaatatacgatgcttaaacagaggtgaattacttgaagaagaaaacgcttgtgcctcttatcgtttttttactgggcatgtgccttgttggtttgattgtatacaaaacagatgccattgaaaaagaacagaaacgcacgaccgcacaattaaatgcaacaacttacggtgaacgtataaagaatgagattactaatgggattgagatcactgatacgttacaacaaatcttgatcagtgaaaatggagagatcaattattttgataccatttccaaaaatattatgtccgactctattgaaagtatacagctcgccccaaatggtgttgtgacagatatttatcctgctgaaggaaatgaagcgggcaagattgatctgctccatgataaagatcgtggagaaatttcctgttatgcgagggataaccatactttgatcacacaaggtccctttgaattaaagcaaggaggctatggaattgcagttcgcaatccggtctacttaaatgatgaaaatgggcaggaatatttctggggatttacgattgttattttgcgtgttcctgatattttttcagactcaatcaacgcactttcggattttggttataaatataagctttcgaaaacatcctctccctggagtgacacatatgaagttgtttatcagtcagatggaactttaacaaatccggtttcttatgattttacaataggtgaagagaactggaaatttgaggtaatgcctgtaagtggatggagaaatgcgaaacttatagctatagttatcggattttttacttctatcgtatttgttctgtcagttcttatctgggtctggctaacatcaaaagaaaataaaaacaaattccagaaactggcacatatggattcacttaccaatatttataatcgttacggatttgatgaattagcagaagaaatgattgctaaaaatccgaacgctcattatgtagttgcactcttcgatatagatgattttaagtttattaatgatatctatggacatgtttacggtgacagagctttaaagaatcttgctgacagtatgaaaaaatcttttccatcggatgcattattggggcgaaacggcggtgacgaattctgtattcttctccctaatcgcacatatgatgatgcaaaagaacagttacaacaattcactatgcttccaaagatattctcatacaagggaaatgactacccattttatatttctcttggatatgctgaataccctaccgctgcatcaaaccgtgcgcagctcatgcgctgtgctgatgccgcactttatgaagtaaaactacatggaaagaatggatgtatggcttacaaggaaggacttcaatccggtgtccgcaaacaacttggatttgcactcaaggatatctctgaacatcttcctggtgcgtttattatctacagagcggataaggaaaatgatgaactcttttatgcaaaccatgagtttctccacatggccggatacaaagatatagatgagctgtttaagcttacaaagaagagctttcgaaaccttatccgggaagatgagcaacagcagattgagacaagtatctggcagcaaatcgacagcggcaatgaaaatgactatatttattttcatcttcgaaaagctgatggaacttacctttctgtacttgaccatggaagaattgtagaaaaccagcaatatggaagagtattttatgtgttgtttatggactgggctgacatgcatatccgttacagtgataaattctctgaataaataacagatggtgtgggatcatatcaaaatcccacaccatctgttatttctttcaagaatgcctttttataaatcttcctgtattttgacgtcactgttatctgccagacactgttttaacacagtgatcattttttccccatccaatggttttgcaatatgaccgttcattcctgcattttttgccatctgtatatcttccgcaaaagcattcgcagtcatggcaataatcggtatggcggcttttttccggttttccatctgccgtatctttgcagtcgcttcatatccatttaacctcggcatctgaatatccatgagaatcaacgcataatatccatcctctgcttgtcccagcatatcacagcattcctgaccatcttttgcccagtcagtcaaaatcccctcttctttcaacagttctatcgcaatttcagcatttaattcattatcttccgcaagaagaattcgctttccaatactcttatcagatataacagactgttccgactctttctttttatatacatcctcttctgatgcaatctccagtggaatttccactgtgaattttgttcctttcccctgttcactttctacataaatctttccgcccatcagttcaacaaaagatttcacaatagaaagtccaagaccagtaccgaccactttattctctgtcgctgtatgttctcttgaaaattcatcaaaaatatgtggaaggtattcctgcttcatccctattccggtatcttcacagatgaatacataccatgcttttttatcatctgatgctgtttccgtaatatttacatgaatcgcctgaccgtttggagtatatttgattgcattactcactatatttaaatatatttcctgaagttttgtcttatcacagactgcatatttatgctgtatatttgtatctatcgaatattgaatttccttcgattggatatcagattcaaatactgtatttacagaataaaacatttcgctcaaattctctgcctgcatttttaacacagctgttccactttcaatgcgagccttttccagcacctgatcaataatcgtcatcagaaaattgcccgaggacttgatctttcctaaatactcccttgctttttcctcgttcttaagattctttccgagaagatctgaaaatccaataattgcattcatcggggttcggatgtcatgactcatattaaacagaaatcgtgtttttgcctcacttgcttcttttgcctgttctgccgattttttcaattcagctgcatactgcttctctcgacgttttttgctgcagatctgatcaaaaatagtagcacccatcatggcaattatgagggctgatacaataacagcaatccattgataaattgaaatccatccctcctttggtacgatatccacataccatgtgtaattaggaatctcacactctaccgtaaggctattctcaggcatatgttcctgattttgagtcagaacaatccgatcatcggcattctcatcattcgtccatatctcataacaataggatgcttcacttagccgttccatgccaatttcatctataaatttatcccagtcgataactatgatcacaaacccccaaaaggtgtcatttcctgtaatattattctgataaaccggatggaacagcaaagctcctgttcctccctgttttaattgatatggacctccaagagtatattttcctgtttctttggcacgctttgcgtctccactgcgttcatgctctgtcagcatattcattccaaaagcctgatcatttccctgctttgggaaaatatcagtaataaccccattcggtgcgagttcgaatgcttttacaacacctgcttcattcggaagcatttctgccaattctgagaatgtagtctgattcagatcatatcctgcaagaatcacgttttcaagaaattctgaaagttcaacatactgatctaattgtgcattgatccgctttactgtactttgtgcagtataagcagctgctgtctttttttctttctctatgttctttacaataatacagcccaaaagaagtgctgttataaaaataaacaagccaatgatccaactgtatctttttgtctgtttagaactggtacttcccttttccatttactgttgcctcttcatcttcaatgttttctgttgtttttaattatatcatgtcatgttttttcatgtctatttttttctacagtaaacggataacaagttctttcattgtctgctgctttccttcgcattatccttaagctatttcctttttcattgccctgtaaccgatcagcactgtccatacatatgcacatgttttcggaatcatcagcattccgatcatcggaacaacatcagcccacagtacaaccgggatatagaaagcaaagcttaagacgatcgtcatccacatccagcggaaagactggtcgtttctttcttttgcacttttgtaaaataaaacgatgataagtaatcccatcagtgcaaacggaatattacggtaaatgccccaggaatgcggtgcttctgcactgagccattcattctgcggcatcatacacagaacaattcttaatcctgcgagtacatagatcgctgctgtagttgcattgtgtcctttgatctgataacgttcacgccaaatatagtaaagaataacataaaagattgtcattgtaacagatgtgatccatttacctaatcctaactgtacagtgaaattctcaagacctgttgtacaaagtgcaaatgcacgtggaaccaggtggaatgcatctccacttcctaaaagaactgccatgattccaaacatggtgaactgacggtttcctttgctcttacggatcatcaagattccgattgtaattaccgagattaaatacacggcgtcaaataaagtttctacaattgcctgcataataaatatccttctttcttttgattatattgaattatgttgttctgataaagcagacctgcacaattacaatcacacataactatgcgtacatgaacattgttcattttcgttcaaaaaatttcccacagcaattgtgggagaattttaatacaacgttttctttacaagcatcaatacagatgatggatcataatcctgccggatcatcgacaccagaatcagagaaaacagtatgtctgcaaactttttctctgtaaattcctggtcaaatacatctgcacggacctttggatcattttctaagacctcacataatccattcagaatatgtccccatgtcttcatcattcttttcttcccacttgttttttcatctctcataaaaccaaatgaatgtaatgagaagaaccctggaaactgacgattaccgtattctaatcgttcatagatccatgaaatacaagattcgacatcgtgaaagacctgttcatcctccgggtgaaaaaagatttcataccaaatactctctattgtatcactgagcaaatctgccttggattcataataattataaatagtacctgctgatacagaacatcgggacgcaacagcccgtatacttacggcagcccatccattctcctttatcagatctctgctggcagctaatatgtcttcttttgaagtagcaagatgattcacgatctcacctccgatatctcatttctgtattctaaatttataatgaacactgttcattttgataatatacagcacttaggtaggtttgtcaagactgttttaacctatttcttttttcttatgtcaaatagatcttttcagcattaccagcattgtaataaagcacaaacttccaccaatcacattagatataggctctgctaagaacacccctctcgtccccatgtgaaatgcatatgggaacaaatacgtcagtggcacaacgataaatacttttctaagtaatgaaaagaaaattgcctgcttcttcttgttcaatgatttgaaaaccgtctgcccaacatactgcagatccataaatataaatgctgcgaaataaagtttcagtgcatctacgcaatcagcaagcagttctctatctgtgctgaaaattccgattagaaattccggttcgaaaataatcacgctccacgtaattgctgtatagatcaatatcatgcaagtcagtacgcggatggctttcttcactttcattgggcgccgggctccataattatagctcaagatcggagaagttccttcattgatagcatagatcggagtttccaccatctgacgaacacttgatacgatcgtcataacagagatatatacatcaccgccaattcctgataagacgctgttacaacatattgttaccagactattggtcagctgcatgataaaccctgcacttccaaggctcacaatattcttcgcatcatctctacatgctttccattctccttttgacagcacccgcactttcaattccgctttctttctcaagaaataaaatacatatgctgccgataaagtctgggaaatgattgttgcgatcgccgctccttttatgcctaaattcaatccaaatataaacaatggatccagaatcagattagcaacggctccaattgtaaccgataacattcctgaagttgcatatccctgcgcattaataaatgggttcatccctgttgcaatcatagatgggactgttccgatcaaataaatcatcatgtatggatatgcgtaagacagcccttcttccgacgccccgaacaacaccagaatcgaacttgcgaacagcattccgatcaccatcaatgccactccacaaatgcacagcattgaaaatgatgtattcatgatcacttctgctttttttatgtttcctttgcctcggttaattgaaaataacggggcaccgccacttccaaataaattgctgaatgcagtgatgatcacaataatcggaaagcacaagcccactgctccaagcgctgttgttcctactgatgggatcctggcaatataaatccgatccacaatgttgtacaaaagactcagtatctgagccacaagcatcggtaacgctgctcccaaaatatttcctgtaactgttccgtggtcgaaatcaatctgtttcatctttataatattatcttaaaccaatctttctcttcaaattcaacaaccgtacaatcatttgcataagtacattccggaagtacgatcattgcatgaagtacctcattattcgccggaagtggacacagatgccagatcgctgcattgatctttaccatgcatccctttggtacaaggaaagccttcgcaagttccggaaccggtgttccgccggaagcaggtgcaacatggataagcatgtcgtcatcaagagcaacaatcccttcccatgtagttgtatgatattccgccatcttgacaattctttcgtccttgcgaacttcaatcggtgaaaatgccattgttccaacacaggttcctgagatacggtccggatagaatttatgaatctctccctccagtggatatccctctggttctgtcatactgcaaaatgttccgtacggtgcaaaatctgctgcattaatctttactgcttttacttctctcatcgagtaagtcctcctttgttttaatataatcgtatcgctgatggaaagcagatcagcttgctccactctcactaccaactcatcacgtctagtatatcataattaattccgaccagcaaaatctcaccgcaaaactctttgattgccgccgggtagttccgtttcttaatctgtgctgctactgcatccacattcatatttgcccagcaacatctatcttttcacatatctctgatttctgctgcgtggcttgtcaggaactgtcatctgtatcaattgaagttctattgccggattcagataattcttgcgaaatgattcctttgactttagacccaacaactccatcaaagtaactgcggtgtacggaacttcgtattccataacatctaataatcgttttacatattctgatatattttccctttgtccttccgactgtaacagaacttcttttaaaatctgatcaatctggcgcaacataaattcgataaatagatttgaatcaccatttacatggcattgtgcgatcacattgtaatattcttcctggaatctttcaatctgactttctattggaatgtattgaaagaatggcttccaatttgctaaaagacaagtatgccacaaccttgccatgcgtccattcccatctgcgaatggatgaataaatacgaattcataatgaaatacgcaggacaggatcaatggatgaacttcttctttttctcgttccatccaatcaaacagttcttccataagatgtgggacgaatcttgccggcggtgccatgaagatgcattcctctccattgaaaacaccctcttcgccatgtctgaaacatcctgattcatctatcagatacttcgtcataatcccatgtatgtgctttaattcttcaatatcataaggatcgatctcatttattttctcatatgcttcgtatgcgttctttacttcttgtatttccttttgttctccaagcacaagctttccatctatgacatctcttacctgtccgattgtcaatgaatttgcctcgattttcaaagaagaatagattgatttaactctgttattttttctcaaatgtggctttgactccagattttttccagtagtgattcttcctactttttcagaaattgatgcgactaaatccagcattgtatttgtaagtttgaatggtggtgcataagtattcatatcatttcccctcgtataacttacttattatcttgtacgttttcttactatattatactagttttttatttattttactataacttgcttgttatcttatacgttttcttgtcttttattaatttgcgaacatatcaagacttctctccacattttcctcaaattatcatcacaatcaacattttctcttgacaattcctcaaacctccatataattatctatggtaattaaccttggtaactatataggagttttattatgacaaatgaaaaaatcaaacgcatgctcgatgcatgttatcaggcaaagcgaattcgtgagatgctccctccgcttccggaaggtatcatgtcatctcacatccgctatatggatatgatccaggagcttcagaaacagaaagtccatgtaagagtttctgatttaagtgacgttctgaatatcccgcgaccgggtgtcacaaggacaataaaagaaatggagaagaaaggattggtacaaaagacagcctccccagatgatggacgtgtcacatacttgtctttgacagaacatgggacggaaatctctgaaaaatataatgagaattattttaatgagctgacgccttatcttgatgatatctccgatgcggacgctgactgcatggttcaaacaatccagaaattttacgacatcatgtgtgaaaggagcattcaaaatgacagataaaactgctgattttacgcaaggaagcattctaaagaaactggtagcatttatgatgcctgtgcttggcgcactaatccttcaggcagcgtatggagcggttgaccttctggtcgttggaagatttggttctacctccggactttctgcagtttctaccggaagtcaggttctgaatctggtcactttcgtagtcgtccagtttgctatgggtatcacggttctgatcgcgcgttatctcggcgaaaagaaaccggaacagattggctccgtcattggcggtgctgcaattgtatttacagcgatttcagttggattgttcatcgttatggtttgttttgcacacccgatcgcaatcctgatgcaggcacctgctgaagctgtcgaattgactactgtttacatccgtatctgcggtggcggaatcttcttcatcgtcgcctacaacctgctttctgcgattttccgtggactcggagacagcaagtctcctctgctttttgtacttgtcgcatgcatcataaatgttttcggtgacttgatacttgttgcaggtttccacatgaacgcagtcggtgccgcaattgcaactgttttcgcccaggcagtcagtgttgtcttcgcagtagttcttcttatcaaaaagaatttgccgtttaagattatgaaaaaagacttctgcctgaatccacagtgcaagaaattcctcattattggactccctcttgcgctccaggaattcctgacacagatgtcattcctcgcactctgcgcttttgtaaaccggctcggactggaggcttcttctggttacggcgttgcctgtaaaatcgtaaactttgcaatgctggtacctagcgcactcatgcaatctatggcttctttcgtctctcagaatgtcggtgccggaaaatcaaagcgtgcaaagaaatctatgttcaccggaatcgaagtcggcctggttgtcggatgtttcgtcttcgctcttgtatttcttaagggagatgtcctgtccggattcttctctacggatgccgacgttattcagaatggctttgcttacttgaaaggattcgcaccggaaacgattttaacagccgtcctcttcagcatgatcggttattttaatggaaatgataagacgctctgggttatgacacagggactcatccagacacttctggtccgtctgccaatggcatacatcatgagtatccagccgaatgccagcctgacaaagatcggtcttgctgcaccggtttctacagcagttggaattatgttaaacgttggattttatgtttatttaaatcggaaaaaatagccccctgcaaccgctgccaccggcattacaaccacgcaggcgattgctccgaagatcattgaggcgcaattttcaaacatgattttagaattcaacagtagttcaaacgaatatccctgcatccgcagataggaaaaaagcagaagtgattctcctaaatatgcaaacagaagtgtattcaccgttgttccggtcacttcttttcctatctgcattccgctgtgaatcagttctttaaaagtcatatcttctttatggcttttcacttcataaacagatgtggtaactgtcagtgccatatcaagaacagctccaagagtactgagaagtataacagagacagcaacatttctcatactgatattcaggttcatattataataaaatacatcttctccaacctgttgtatctcgttaagacctcccgcctcacttctccatacaacgatatatatgaagaaaaacagcaacagcattgtgatcatagttgccagaaatgcactccatgtctttccatttctaccattttgatagaacaacgtaatacaggaaatgacaacgccgacacaaaccgtaacgagaagaacaggaactcctgatgccataagccagattgcaagacttaagatcaacagatttccacacaaagcaataagcgaaacgacacctctgtctccaccgacgaccataattaaaatcagtaaaatcaatccaagtgttatcagcattttccttctccctgcacctttcttgctttcttctgtctatgaaacattcctgggacctttatcatcacagaagtaaccaaaatagaaatcggtattgccagaacaattcctatactttccaccagaaatctgcacaattcacatggaatgtgcaattttataatagtaattaaactcacatcattattcattcgaatcagacacattgggatcagtccacagccaaagacaaacaacagcacatttatcatcgttcccataatgtcatatccaatttctcttcctgatttaaataattccaaaaatgtcacttccggcttcttttcaacgatttcgcttaaggatgcagcgatggcgaccgccacatccatgattgctcccagtcctgagatcaggatttctgcatggaaaatttcatccggattttcaatacttccaagatactccatggtcgaataatcaagatcttctgcatgatggattacaacatcaaagattcccatgatcattacaagaacaatcaatgttgtaaaaagtgctgcccatgtctttttatgaatcccgtttaatccaaccaatgtaataaccgcaaaaagaatcaccagcccgctgcacatttccagcacatttgatgtatctcccgctttccaaaaaacaattgcaaaaacagcaacattaaaaataacggtcaatatcgtaagcgcaccctgtcttcctgcaatggtaattaatacaaacattaagaatcctacaagtatcataagctctgtatctcgtttcagtccacgaattccagaacccattctcttgcttgttccattgagcagtaccttatctcccttatgatatggctgtttcgtcattccggtatacgtgtactcattcgtaaaacttattgtctttcccttgttttccccatttaggattactccctggatgttctgcttatattttttctccttcgtccctctggttcctgtctcttctcctgagacactggtttcgacctttgtcagttttgcaatgggtgtgctatacaaccatgcatcatttgcaacaaagataatacacagcagatacaatatgccaaggatacaatataactttcttttcttgctctgttttataaattccaacattactttacttccatctcgaatctatcaaaaatcatttttttattttaacgcaaaaaattttattgtcaagatgaatttgaaaatgattttcatgttaaaagaacaggacagcacgctaacgcgcactgctctgttcttctgttcttcttttctctattctactttgcttctccctccgggaaaataatcttattcacgaagaagaataccaccatcgacactcctccgttcagcacggttgttccgatattgtaaagccatcccggtacaaacattccggcaactgcaacccagatacaattgattgagtttacaatacatgtaacaatacagaatgcgatcagataccagaacgcctgataccagatctttcctttgctgcggaacacaaagcttctctggattgggaagttgatacactcaccaacgagcattgcgatcatgtatgcacagaaatacggaagacctccatgtgccgcatcatatccgataatattccacttaaatgtctcaccgaataatgtaatgtcgattcccgggaaaccgaaatcaatattcggaagtcctgcgaatgccagtggcaaaaacagcaacattacatatttaagtacagtgatcagattacttacgattacgaacaatccgccttctttgcaagttctactgctgcctttgtcaacttttgattcggttttctgttacggatatatccctgctcatatgcaacaacatccagatctgttgatccaatcacatcaaggattgcttccggctgttttgtcaggttatgatgcgcttccacatcaaatgtttttccctttgcgtcttctgttgcctgatgtgttgagaagattacatttaaaagctcatccagtctctgatccaataccgcttcatcaagatcaccattctcaactgcatgaataatatcatacatacctgattttcctgttcccggcatttccaaatggcttccgttcttcacaccaagtgcatgatcattacttccgccccagtcagatacaacaaaaccatcaaagccccactcatctaccaggatttcctgcagcatatgactgttttcatttgcatagactccatttacttcattataggaagacatgatggactttgatttaccttccttaattgcaatctcgaatccggttgtataaatctcacggaacgttctttcatccacaacggaatcatttgccatgcggcgcagctcctgactgtttgctgcaaaatgctttggacaagctgcaatacccttgctctggattccacgaacatatgccgccgccatttttcctgcatgatatggatcctctgaaaaatactcgaagtttcttccgcacagaggacttctcttaatattaagtcccggtccaaggatcacattgacacccatcgtcactgcttcctctgcaagtgcttctccaatttcttctccaagtgcttcgtcccagctgtttgccactcctgctgctgtcggaaaacaagttgccggaagactggcattcaatcccaaatggtctcctgctcctgcctgtcttctcagcccatgcggtccatcggacattaccatagacggaatcccatatttttctaaatcaactgtctcccatgtgttctttcctgacatcataattgctttctctgccagtgtcatttttctgatcaacttttcatatttcagactcattttgaaacctaccttttattgtgtactatgttactttgttacccttcgcagtacctgtgatcagttttcttgcattttccatatcacaagtgtcttttttactgaacttatcataacacaaaaagcagaccgttaaggtctgctttcataaatggtcgttttttctacatgaactgttttaataacattttttattttgattttttcaataatttcttatacgagaaatcgatcgcaaatgcgcccagcggagctgtcaacacaatcgctaaaacagccacggtaagaacggtatctccgcatgcaaatcccatcgcaagagggattccaccgattgcggcttgaactgttgctttcggtgtataagccatcatggcaaataatcgttctgtcttcttgagacttgttccaagaagacagacggatacaccaagcatacgaaacaccagtgcacctacgataacaactaacgctttcacaccgatttttccaagatatccgacattcactgttgctcctacaagcacaaacagaaatacttctgctgccacccacagctttccatatttcacagaaatcctcttcgcaacaacttctctcttcttctgcaaaccgatcccaatgaacatgatcgcgatcaatgctgaaaatgtaatcgccgtattcaaactgtcttccataacaacaagcaacagagaaatactcaaaatgatcaacactttcgaggtatctcttatatgcactttcttaaagtaatacgcaagacatgtccctattaataatccaatcccaattccaaggaaaatagaaaccggaatattgataaaactgagtatagatgtactttgtccctgcatcattcctgtaaatgttgaaaacagcacgatgacatagacgtcatccacagatgcgcccgcaagaatcagctgcggaatcccctgtttcacgccatagccttcctccatcagcttcaccattctcggtactacaacagccggtgaaactgctgcaagcacagctcccatgattgcagcttcaagtatagataatcccatcagcttcggagccaacagtacaattccaacaatctcaaacgttgccggaacaaaacacatcatcacagccggtcttccgatctttttaagtcctgaaagatccagaccaagaccggctcttgtaaggatgataatcagcgcgatctttcgaagctcggctgagattccaagaatactgtcatccaacagattcagtacatatgggccgagtatcatccccgtgatcatcattccaagcaagcttggcagtttgattttcttacagatccagcccatagacattcctacaagcaagattaaagcaatacttagtaacatctattaaattgcaagcaagttcttaattgcttccatgtaaatctgtactgcttcttcaacttcagatacgagtgtgtactcgtctgcaccatggatgcggtaatctacgcccggtttctccggtccgaatgcgatgatattttttaaggacttcgcatatgttccaccaccgattactaacggtttgttctctgtatctcctgttacatctgtataagctttgtacagtgcctctacaagtggagactctttcgggaagaacaatggttttgtagttgtgtggatctcaatgcgtccgttctcgtcttcgagctttccttcgcacatcttgagcatatcttctacagaatatgttaccgggaatctgatatcgattgtagcggagatcacaccgtcttctttcttaacgattccgttacagaatgtaagctctccaaactcatctgcgcatttcagtccgattcctgatccgtcacatgctgtaccaatgtgtgagttatagaattctacgaaatcatcttcaaatccggcttttgcaagacagtcaaagataacacctgcagcattaactccaaatgccggtgtacttgcatgtgcagatactccctttgcataaatagtgatctttccatcttcctctgttactttgtattcctgaagttttgtccctgcgaaagcagcttccagtctgtctttcagtccttcttctgccggaatctctgctgtacatgcatcacatacggcattgaatacaaatccaccattgatagaaataatctttgtattcttagaagttgccagcatgccaagcatacctttctctccgtgaatacatgggtaatttgcatccggtgtaaatccacaagataactcttctgccacttcattataatgctccatacatctggaaccattttcctcattacatcccatgatcagacgaactctcttgttgagcttcacacctgaatcacgaagaagcttcattgcataaagcgcttccataacaggtcctttatcatctgttgttccacgtccgtaaacgtaatctccttctcttgtcagcttgaatggatcatatgtccagtcaccgcccgccggtacgatatccagatgtcctgcgataccaacgatctcttcgccttctcccatctctgcatatccacagtagttatccaggttcactgtcttgaatccgagctcatctgcaatctgcagtgcttcgtgaagaacctttgccggtccctctccaaatggcattccttctgccggtgttccaagctgtgaatctatcgctacaagtctttccatattgcttaacaattcttctgttgttgcatgaatcttttctttgatatccattattttcatccttccttttttacgttactgttcacacgacgtgcgaccagcaacgcatctcgccattttaaatcgcctttggcgatggggcgagaatgcattcaagtcaaaacgcgcatcctccgtgtcaatcagcggagtgattgacacaggagtgaacagtaacctgcattgttccgtaccttttggttactgttttggggtttgacatatattgtatgctatggtagaatacaacggtaactttaccgtagtacagtgactcattggtagagaataaaagccaaactcaatgatggagggtgttattatgaaaagaaaagtattaagtgtgttattatgtgcaggacttgcagtttctatgttagcaggatgtggttcagactcttctaatgcgaataagaaagcggaatcaacaggaagtgatcttgaatatgtgaaagacaaagggacactcgtggtcggtgttactgactttgaaccaatggattataaagatgataatggtgagtgggtcggatttgatgcagacatggcgaaagcatttgcagagagtatcggagttgaggcagaatttgtagagattgactgggataataaagagcttgagcttgatggaaagtcaatcgactgcgtatggaatggtatgacactgacagatgaagtggaaagctctatggaatgcacagatgcttatatgaataatgcacaggttgtagttgtaccggctgacaaagctgataagtatcaggatgaggatagtgtgaaagagttaacttttgcagtagaagcaggaagtgcaggagaagagcaggtaaacagaatcggtgctcagtatacagctgtttcatcacaggcagatgcattgatggaagttgcttcaggaaattcagatgcagctgcaattgatgctttgatggcagcagctatgatcggagaaggaacaggttatgcagatcttacttacacaataagtctgaataatgaggagtatggtgttggattccgtaaaggatctgatcttgcagcagctctgaatgattactttaaaaagagtatggaagatggatcaatgaagaaatgtgctgagacttataaagtacaggctgcattgatcgaaaaataaatttaggatggagctttaataaaatggaacttattatggaacaatttccaatcgttattcactcactgaatgtgggatttttacagacgctgaagctgttttttgcaacgcttcttggagctattccgttgggactggtcattgcatttggatcaatgtcacattttaaaccgttgagttatattacgaatatcattgtctggatcgtgcgaggcacaccgcttatgatccagatgctgatcatttattatttcccgggactggtcttaggaaacccaatttggggtggcggtgaaagcggaagatttcttgcagcttcggttgcatttatctttaactacgcatgctatttctcggtaatttaccgcggaggaatccagggtatcccacagggacagacggaggccggacttgttcttggaatgacaaagcatcagatcttctttaaggttaagctgcttcagatggtgaagagaattgttccaccgatgtcaaatgagatcatcacacttgtaaaagatacttctcttgcacgaatcattgcactgcaggagattatctgggcaggacaggcgttcctgaaaggttctcagggaatctcaggtgcgatctggccgatgttctttacagctttttattatctgatcttcaatggtattctgacagtccttcttggaaagcttgagaagaagctggaatattttaattaaatggggaggaagagataaatggcaatacttgaagtagaacatattaataaaacatttggacggacagaagtattgaaagatatcagcttttcgttggaacgtggacaggtactttccttgatcggttcctcgggaagtggaaagacgacacttctgcgctgcctgaattttctggagacaccggataaaggtgtgatccgtgtaaatgatgaattattgtttgatgctgcaaatcctgtaacaaaacaggaaagtgagatccgtaagaaaagattacattttggacttgtattccagtcttttaatctgttcccgcagtatacagcacttgggaatgtaatgctggcgaaggaactacttgcaaaaagtcagcctgattataaggcgcgcaagaaagagatacacacagagattgaagcagaagcaaagcgcctcttagatcagatgggactttcagagcgtatgaataactatccgcatcaactttccggaggacagtgtcagcgtgtggcgattgcccgtgcacttgcactcagtccggatattctatgctttgacgagccgacttcggcgcttgatccggagcttacaggtgaagtactgaaagttatcaaaggacttgcggatcagaatactacgatgatcatcgtaacgcatgagatggcatttgcaagagacgtatcggacaaagttctgtttatggatgacggtaagatacttgagcagggaactcctgaggaagtgtttgagaatccaaaagaagagcgtacccgtcaatttttgtctcgttatacaaatggatagtgattttgtaaatactggacaaaaatgaaggcggtaataagatacgaagaataaaaacgacgaatatattagaaatgctaatatatcaagcgcgaataaaataatgagcaggaagaaatacaaggcggagggaatgttgattttcactctgccttatattataatcggttttgtatgatacagaaatcatgataaaaactagcaggaactaggtaaggagcataaactgacatgagtgaatttgaaaaagcagtgacgggacttggggaagaatgcggtgtttttggtgcttatgatgtggatggacaggatgtggctgcatcagtctattatggcttgtttgctctgcagcatagaggtcaggagagctgcggtattgcagtgacagacacttatgggaagagaaacgttctttcaaagaaaggacttggccatgtagatgacgtgtttaacgaagagggactttcagaattgaaaggaaatcttggagtaggacatgtgagatattcaacagcaggcggaacacgtgtagagaatgcaatgccacttgttataaactatgtaaagggaacacttgcgattgcacataacggaaatttagtaaatgcaatcgagctgagagaagaactcagccagacaggtgctattttccagacaacaatagattctgaagtaatcgcatatcttattgcgagagagcgtcttcatacaccgacagcagaagaagcagtgaagcgtgcgatgcagaagatcaagggtgcatacgcacttgttgttagcagcccgagaaaaatgattggtgcaagagatccatttggactcaagccactgtgcatcggaaaacgtgacaatacatatttccttgcttctgagagctgtgcaatcgcagctgtagacggtgagtttgtaagagatgttcttccgggagaaatcgtaacaattacaagaaaacatggaatccagtcagatacgagtatggtgattgattcggaaaaacaggcaagatgtatttttgagtatatttattttgcaagaacagacagtacaatcgatggtgtaggtgtataccattccagaattctggcaggaaaagcacttgcggaatcttatccggtagacgctgatcttgttgtaggagttccggactccggtctggtagcagcgaaaggatattctgagcagtcaggaattccgtatggaatggcatttcacaagaatagctatgtgggaagaacatttatcaaaccgaaacaaagcgaacgtgtttccagtgtaaaaatcaaactgaatgtgattccggaagttgtaaaaggaaaacgaatcgtaatggtagatgattccatcgtgcgtggaacaacttgtgcaaatatcattaagatgctgaaaaaagccggagcaaaagaggtacatgtacgtatcagttctccaccgttcttacatccatgcttctttggaacggatgttccgtcaaatgagcagctgatcgcacatactcacacacaggaggagatccgtcagctgattggagcagactctcttggatacatggagattgagaaactgaaagacatggttggagatcttaagtattgcgatgcctgctttacaggaaagtatccgatggaagttccgaaagaggatatcagtcaggcatttgaacaaaattgattttgaagactcagtttatgtgttataatagatgaacagttacgataaagatatgaaacaaggagaaaagaattatgagtaatgatcgttatgtaagcccgctttcagagcgttatgcaagccgcgagatgcagtatatcttctcaccggacaaaaagttcagaacatggagaagactttggatcgcactggcagagactgagaaggagcttggactcaacatcacggatgagcagattgaagagatgaagagccatgcagatgatattaactttgaggtggcaaaggaacgtgagaaggttgtacgtcatgatgttatgtctcatgtttatgcatatggtgttcagtgtccgaaagcaaaaggaatcatccatcttggagctacatcctgttatgtaggagataatacagatattattattatgtcagaagcactgaaactggttcgcacaaagcttgtgaatgtaattgcagagcttgcgaagtttgcagaggagcagaagaaccagcctacacttgcttttacacatttccagccggcacagccgacaactgttggaaagagagcaactctctggatgcaggagtttgaaatggatcttgaggatctggaatatgtacttggaagcctgaaactgcttggatctaaaggaacaacaggaacacaggcaagtttccttgaactgtttgacggagatcaggagacaattgacaagatcgatccaatgatcgctgagaagatgggatttgaggcatgttatccggtatccggacagacttattcaagaaaagtagacacaagagtactgaatgtactggcaggaattgctgcaagtgctcacaaattctctaatgatatccgtctgctccagcatttgaaagaaattgaagaaccatttgagaagacacagatcggatcttcagcaatggcttataagagaaacccgatgagaagtgagagaattgcttccctttcaagatatgtgatgatcgatgcacttaatccggcaatcacatctgcaacacagtggtttgagagaacacttgatgattccgctaacaagcgtctgagtgttccggaaggattccttgcaatcgacggaatacttgatctttgtctgaacgttgtagacggattggttgtatacccgaaagtaatcgagaagcgtctgatgtccgaacttccattcatggcaacagagaatattatgatggatgctgttaaagccggtggagaccgtcaggagctgcacgaaagaatccgtgagctttctatggaagcaggaagaaatgtaaaagagaagggacttgacaataaccttcttgaactgatcgcagcagatccggcattcaacctgactttagaggatcttcagaagacaatgaaaccggagaaatatgttggacgtgcaagtgagcaggtagatgcttatcttaagaatgtgatccgtccactgcttgaaaagaataaagagatccttggcgtgaaggctgaaattaacgtatagaatccttggaatctatcaggacaaagcggaaaaatcaaagggatgttgcatttggttgcagcatccctttttctttgataaactaaaattatttcgtatattaaaatgtgggggaaagagaaaggaataagagaacatggatataggactgaattggaatgaatggcatcaggaagcggcgagaaaaccatatgccagagtgggcgtgactttattaagtggtgcgctgattctgatgtctgcacaggaaattgtttcattatatttggaaaagaatctgatttccaaaatagaggtctgtgcgacaacagaggatataaatgtgtcaggaaatgatctgccggaaaaagtaacaataacaaaacagataaaagaaccggaaaaaatggatgagcattctttcttatcagcagaaactatccagacagatgttaatcaagcagatgttatccaggtagcagctgttccggcagaaattttagtggaagaacctatggtagaagaaattgcggtggaagaaccagtagtagaagagattgtggcagaaaaaccaggcgtgaaaagagatacaactataaatgttgcaagtgaaccggtaattacaaatcctgattcaatggaaaatgtaaaaaatgaaaatgaggatgaagaagggtcgatagcagtgggaaatacagataccggatatcttattaatgcggaaggtatgatctgtggactttcaggagacaaagaagtgataaaggatggagtattgtactttcctgaagaaggatgttccggaattgcgagaggagcactgtcgggtcttggttctgctgtagaagagattgaaattcctgctaatataacaaatattcagccaggagcgtttgttgggctgagtaatctgggatggatagaagcagatgcagcaaatccagcctatgttacggtagatggtgtactttacacggcagatggcacagttcttcttgcatttccggcagcgtggacaggaacctttcaggtgccggaaagtgtgaaaagttttgcggaaagtgcatttgatggaacaaatctggaatgtattgatgcaagatcctgtacacttgaacaggcgggaagtattcctgaaacggtgaaacttttggagtaaaagaaaaacattgattttgtttgttgaagaatctggggacttgcgctataatatgacgagattgaacaataacaaacaagaattggagaagatagaatgagtaagaaagtaagaacaagatttgcaccaagcccgacaggaagaatgcatgtgggtaacttaagaacagcactatacgcgtatctgatcgcaaagcatgaagggggagatttcctccttcgtgtagaggatacagaccaggaacgttttgtggaaggtgcacttgatatcatttacagaacaatggagaaaacaggtctcatccatgatgagggaccggataaagatggcggatatggaccgtatgtacagagtgagcgtaatgcgtcaggactttatcttaaatatgcaaagcagcttgtagagcagggagatgcttattactgtttctgtgacaaagagcgtcttgagtctttaaagacacaggtttccgaaggtggagtagagatttctgtttatgataagcactgcttaagtctgagcaaggaagaagtagaggcgaatctggcagcaggtaagccatgggttatccgtctgaatgtaccgaatgaaggtgagacaacattccatgatgagatctacggagatatcacagttccgaatgcagagcttgacgatatgatcctgatcaaatctgatggattcccgacatataattttgcaaacgtaattgacgatcatctgatggagatttcacatgttgttcgtggaaatgagtacttatcttcagcaccgaagtataaccgcctttatgaggcgtttggctgggaagtaccggtttatgtacactgtccgctgatcacagatgagaatcataagaaattgagcaagagatgtggacattcttcttatgaagatctgatcgagcagggatatgtttcagaggcagttgtgaattatgttgcactgctcggatggtgcccgacagacaacagagagatcttctcattggaagagcttgttgaggcatttgattatcatcatatgagtaaatctccggctgtatttgatacagtgaaattgaaatggatgaacggagaatatctcaaggcaatggattttgataagttctatgcacttgcggagccttatctgaaagaggcagtaacaaaggactatgatctgaagaagattgcaacacttgtgaagacaagaattgagattcttccggagatcaaagagcaggttgatttctttgaagaacttccagattacgatattgcactgtatacacacaagaagatgaaaacagatcctgagaagtcactcgcacttctgaacgaggttcttccggttctcgaggcgcaggaggactttagtaatgatgcattgtttgagacattgaaagcatttgcaacagaaaaaggatacaaagtaggttatgtaatgtggccgcttcgtacagcagtttccggaaagcagagcactccgggtggagcaacagaactgatggaagtactcggaaaagaggagtctcttagaagaatccgtcttggaatcgagaaacttcagtaaggacagcgaaaagaggtacaatgggatttaatgaagcacagacgcaggcaatccagcacacagacggcccatgtcttgtactggcaggcccgggatcggggaagacgcttacgattgtaaacagagtaaaataccttatagagaaacagaaagtaagaccagaagaaattctggtcgttacttttacaagatttgcagcggcggagatgaaatcccgcctctgtttggttatgggcaaaagagatcttccggttacagtgggtacatttcatggaatctattatggaatcctgaaatgggcttaccggatgaatcaggaaaatattctttcggagacagaaaaatatcagattttacgtggcgtgattaacaaggaaagaatggagatctttgatgaagaagattttattcaggatattgcggcagaaattggaaaagtgaagaataatcggattccgctggaagaatttgtatcagaaaagtgtagtgcggatgcttttcgcaatatttaccgtaattatgaacagtatagaaaagaactgaaaaagattgattttgatgatatgctggtactttgttatgaattgttccggtcaagaccagatgtacttgcacagtggcagaagaaattcagatacgttttgattgatgaatttcaggatattaatcgaattcagtatgatgtgattcgcatgctggcacagccggaaaataatttgttcgtagtaggggatgacgatcaggcaatctacggatttcgtggagctgattcagaattgatgcttggatttggaaaagatttccctaatgcaaaacaaattctgttgggaatgaattaccgttcgacagcaaatatcgtacagaattctttgaaactgattgaaaataatgtggagagatacagtaaaaaattggaagcaaaccgtgaaggcggttcctgccttcatattcaggaagtgaaagatccggtggaagaggcagaatatgttcttgaagagatacagaaatgtaaggagaatggcataaaagaagaggagattgcgattctgttcagggttcatacagatgcgagagcagtggtagaagcaatggtggagcggaagatcccgtttcagatgaaagaacatcttccaaatatatatgaacactttatcgcaaaggacatcatggcatatttccgactggcaacaggagctcggcacagacaagattttttacagataatgaaccgaccaaagcgatatcttggaagagacagtgtagcaggagcgaaggtttcttttgaagacatgcggaagttctattgtgataaagactggatgatcgaccggattgatcagtttgagtgggatgttaagatgcttatgaagatggctccatatgcggcaatccagtatatcagaaaaaggattggttatgacgattttctgaaagagtatgcatttacacatcagataaacagatctgatctgaatgaagtactggcagagatcgaagaggcggcgaaagcattttcaagtgttgaagaatggtttgcacatgtagaagaatatacggagactttgaaagtgaaggaaaaggaaagaaacagaccacgtccgggtgtccggctgatgacgatacatgcttctaaaggactggaattcaagcaggtatttctgattgcggcgaatgaaggaaggattccgtatcagaaggcaaagacagacaaggagatcgaagaagagagaagattattctatgtggcaatgacaagggcaaaagattttctgaagatctgttatgtgaaaataaaaaacgggaaagaagttactccttcccgttttgtagacgaactattgaaaagctgaccggatgtcagtcactttgctgacatcctcaagacttagtcctccaggtcatctaatgcatcaagatcgatatcgccgaaatcctgtgtatccagccattcgttgaatatagcggaaacacggtcgaattcttcatcttcttcgatgttctcaagtccaggttcttcctcttctccgttatcaatgaaacgatacagatagatctgaccgtctgtgttatcaccgttttcatccagtggaagaagtgcgatatactccttttcatctgcttcaaaaatattgagaacagcgcattcaagttcctcattattctccagtgtcaaagtgactgtgagggattcgttttcgttcataatcttctcctttgaatctgtgttgtatttcattccgtattgaccagccaggtgctcaaaacgagaatgatcagctatcttgatggtaacaaaaaggggagaaaaaagcaagataagattgactttcgggttaaacaaggtagaataaaagtgttactgatagaagtgaaaggataatagacaatatgaagaaaagatggatactgtgtacagtggcagttttgtgtatagcggcagcactgcttggatgtggaaagaaaaatgtcggaacaccggaagataatgcagtagtagaagaggatgataagaaaaatgataatacaggggaaggtggcagactgtttggatttagtgggattgatatgtcgaatcctttttatgacacattgaaaaattctgtccagacagcattagaggctcaaggtgaccgtctgatggttcgtgatccggcatcagatgctgatttgcagaatgaacagattcgggagttgatcaacgaaggggtacaggcagtatttctttgtccggtagattgggagaaaatcactcccgcacttgaagccttaaaagaggcagatattccggtgatcaatcttgatacagaagtaaaagagacaagccttgtatctgcatttgtagggtcagataatgagaatgcgggatatgtgtgcgggcaggatcttctggtccagaaaccagatggcggcaaaattgtgattgtggaaagccctggggtgaactcagtgaatgagagaattaccggatttgaagaggctataacaaacagtgggtttgaagtggtaaagagaattgaagcattgggagacagtagcaatgtgaaggacgagatgacacaggttctgagcgaaaacagtgagattgatgctgtaatgtgtggtagtgatcctatggcagaacaggtgatggcagcaatcacagaagcgcagagaacgaatatctgcgtgtatagtgtggatggttccccggcgacaaaaacagcactggtgaatggcactggaggaatgaccgggattggagcacagtccccgatcaatatgggaaagacagcagtaaaggtggcgacagcattactggcagacaaggattacgagaaggataattatgaggaaactttctttataaatcgtgataatgttgaaatgtacggaacagatggatggcagtaatttattgattgctcaagaaaggggttaactatgaggaagataaaggggagtccgcagccatttggagtggatatcaaaggcaaaaatataaattttgccgttcaggtagcaaaagggaagacatgtgaacttttactgtataagagaggaaaagaagttccggaatatcagtttgctatgccggaggaagaaggcgttggagaagtacgtttcttatctgttgaaggtctgaaagcagatcgatatgaatacaattttctgatcgatgggaaagtatgtgtggatccatatgtaaaagaacttgcaggaaaagagaagtttggtgtagaacgaaaacttcaggaacatcagattcgtgggaaaattgtttcaatggaggactatgactggcaggaggatcagcgcctacatcttccatgggaagatgtagtggcttatggtttgcatgtgcgtggatttacaaaacattcttcttcgaaagtggtgcataagggaacattccagggggttgttgaaaaactggattatttaaaagaacttggagtcaaccagattcagtgtatgccggtctatgaatttgaagagtgcggaaaaacaaaagtgaactattggggatatggtaaaggtttttattttgcccctaaaaaagcctatgcatatgggaaaagtgcagttcgtgagttgaaagatatggtgcgtgcatgtcatagtcagggcatagaagttgtactggagatgccatttgttccgggaatatcagcaaattatgtaacggaatgtctacgcttttatatgctggagtatcatgtggatggatttgttctgaatccttataacgtaccgtgggagcagctgatagaagatccgtttttgaaagatatcaagttgatgcagaaagatgatggtttccagaatgtgatgcgtcgcttcttaaaaggtgacgagaatatggtcaatgatgtcatctgggcattgaaaaatcgttcatcggaaaatggaaaatgcaattatattacaacacagacaggatttacgttatgggatttagtgtcttatgattgcaaacataatgaagaaaacggtgagaagaacctggatggaccagattataattacagttggaactgcggagctgaaggaccgagcagaaaacgcgcagttgtcaatctcagaaagaatcaggtgaagaatgcattagaactcctgttgacggctcagggaactccatgcctccttgcaggagatgaattctgtaattcgcagagaggaaataacaatgcatattgtcaggataacgagacaggatgggtgaactggacacagttgaagaaagatgactggctgtttcagtatacaaagaaactgatcgggctgagaaaagaacatcgttgtctccaccagagtacagcactatccggaatggataccacgagatgtggcataccggacgtatcctaccatggagaaaatgcatggcaggtaaaagcagaagtttccagccgtcagttaggtgtcttatattcgggaacgaaagaaggggagttcccttgttttacagcatataatatgcattggctgccgcatcacttcgcaataccatcgattggaaagaacgtagaatggtatcttgttatgactacaaaagatggcgtgctttgtgaagcgaaaaagctggaaaatcagaaagaagtattactggaagaacgtagcgtagcaattctggttggacgtaggatagaagaaaagaagagtcgttcagaaaagaaaccgattcatacagctaagacgcagaatgtaaataaaatagaaaaacggcagggaacagaagaactttgtaaagaagaacagccggccagagagggaaaagtatgaaggcatttgcacatttttgtaccataacaaaacacaaaaaactggtattgaaagagtgttttcgtgttgggttgtacaaacagggactgctccatgatatgtcaaaatacagttggacagaattccgtgtgggatgcagatactatcaggggacaagaagccctaataatgccgaacgggaagaaaaggggtattcttccgcatggctccaccacaaaggcaggaacaaacaccattatgaatactggattgattatagtctggagggaccgaaccttctggcgggaatgaagatgccggtgagatatgtagtagagatgtttcttgaccgcattgcagcaagtaaagtgtatctcggggatgcatatacctctgatgcaccgcttgcttattatgaaaacggacgtgcagatgagctgatgcataaagatacaagagaattattagaaaaactgcttcatatgcttgcggaagaaggcgaggaaactacttacagatatatcaggagagaagtattaaaaagataagaagagggagtgtaggcagcagtgaggctatatattgtgcgtcatggagagacggattggaacaagaaaaaactggtacagggacgaaaggatattcccttaaatgaatatgggcgtcatcttgcccgggaaacttcttatgggatgagacaataccagattgatctggcttatacaagtcccttacagcgtgcaaaagaaacggcagagattcttcttgaaggacgcaacattccgctttatgaagatcagagaatccaggaaatttcttttggctcgtatgagggaatgtcttgtgtagataagacgaaagaagagaatcttgcattccagaaattctttcaggatacgggaaattatattccgccggaagatgctgaaagtgtagaacaactttatgaaagaaccggagagtttttaaagagtcttgaagagagtaagaagttgaaggataagaatcttttgatttctactcatggtgctgcgatgacagcaatgctgaacaggatgagaggcagtctttcagtagaacatttctggaaaaatgaagtaccgccaaattgttctgttacgattgcggaacttgaaggcagtggattcaaaattatccaggaaggaattatcttttacaaagaagaagtgaaacactggaaagcagtgtagtataaaaggcagaatgtaagtgctgtggtacttgcattctgcctttccttatgctattctttagttgtctggccggcagatccttaagccggcaatgattcacatgaacttcaattcttctgtttcaggaagaggattccatggtatatcgtattattgcaacaaaattaaggggaagaattattgttgacattttgaaagaagtataataaaatctattcatagacgaacaactgttcgaaaaagagagaatgggttttatacactaagagagatagagaaggagaaaattatggcaggcaaagagagcgttacaaagctggcgaataacgaagagaagaagaaagcactggatgcagcgatcgcaaagctggagaaagattttggtaagggtgcagtgatgcggctgggagaatcaggggcgcatgtagctgtagagacagttcctaccggatgtctgagtcttgatctggcacttggacttggcggtgtgccaaagggacgtgtgatcgaggtttatggtcctgaatcaagtggtaagacaactgtcgcacttcatatgatttctgaggttcagaagagaggcggaattgccggatttatcgatgcagagcatgcactggatcctgtatacgcaaagaatatcggagtagatatcgatgaactctatatttcacagcctgacagtggagatcaggcccttgagattgcagagacaatggtacgttcaggggcgattgatattattgtcattgactctgtagctgcacttgttccaaagcaggagatcgaaggggatatgggagacagtcatgttggtctgcaggcaagattgatgtcacaggcattgagaaaactgacaccggttatcagcaagtcaaactgtattgtgatctttattaaccagctgcgtgagaaagttggagtaatgtttggaaatccagagacaacgacaggaggacgtgcgctgaaattctatgcatctgtgcgtatggatgtcagaagaatcgagactttaaagcagagtggagagatggtaggaaaccgtacaagaatccgtattgtgaagaataagattgctccgccgttcaaagaagcggaatttgatattatgtttggaaaaggtatttcccgtgcaggagatattcttgatctcgcaaccaatattgatcttgtgaagaagagcggtgcgtggtatgcatatgagggagagaagattggccagggaagagagaatgcaaaggcatatctggaatcacatccggaagtgatggagacactggatcagaaggtgagagcacattatgcattatccggatcagaagaagcagagaatgagcttccagatgctgagaagaagaccggggcatcaagtgatctgaagctgacaccggcttctaaagtggctgatgaggcagaaaagaaagaatgattgttactgggatagaagagcagacaaagacaaagtttaaagtatatctggatggaacatttgcatttgtgctttataaaggtgagttgaagcgttttggtataaagcagggagaagatctcgcgcaggaaaattatgaaaagattcagaatgaggtattgttgaaacgcgcaaagaagagagcaatgcatttgctggaggatatggatcgtactgagtctgcattaagggaaaaactgaaggcgggacaatatccggagaatgcaatcagcggagcaattgaatatgtgagatcttttggatatctggatgatgcaagatatgcggaaaattttgttatgagccgcaaagatactaaaagcaaacgggaaatcaaggcactgctgtcgcagaagggagtttctgatgatttgatctgcctggcttttgaacagtgctatagtgaagattctgaggaagaggcaatccgaaggatactgcgaaaaaagaaggttgatccggaaagaatggaagagcaggaatatcaaaagatattaggatatcttgcgcgaaaaggatttcgttatgaggtgatccgccatgttatatcagattatgataaacagagtaactgtacactcccgtgtcaatcactccgctgattgacacggaggatgcgtgttttgacttgggcgatttaaaatggcgagatgcgttgctggtcgcacattgtgtgaacagtaacggaaaagatcttgtatcagatggagagaaaacggttgacatctatcagacaagcttttatactaatcatgtgaagaaaacacggggagcttgtgtaccaggctgagaggaagttgagaacttcgacccataacctgatttggataatgccaacgtaggaatgtataaagcagtactttagagagatacatttgttggtatctctcttttttactaatcaggcaaaattgaagattggagtaagttgagattgagcgagagttcatgaaggggtgcaccaccacgggtacatttctttcgtgaactcttttttcaattatccggaaaggagtagttatgattacagtaaatggaaagcagatccagctgacatctgaaatgagtgttgcggattatctggagcagaacaattaccagattaatagaatcgcagttgaaatgaatgaagaaattcttccgaaatacagctattcggagacaatgctcaaagacggtgaccgtctggaggttgtgacatttgtaggaggaggctgatatcagatggcatcagaaagaatattaagcaaagaagaaatcgaaacagcgctgaatgaacgccattcgccggaaaaacagaagcttttatcagccggtcaggtgacgattgccggacttggtggactaggttccaatgtagcgtattcacttgcacgaattggagtagggcatctgcatctgattgattttgatgtggtggatattaccaatttgaatcggcagcagtatttcatggagcatatcggaatgtataagaccgatgcgctaaagtcactgcttttaaagatcaatccatatctggatattcgtacagattgtgtgaaggtgacagaagagaatttgaaagaactgtttgcggatgctcagattgtctgtgaagcatttgataatccggtagcaaaagcaatgctggtgaatggaattctggagcattttccggagaaaaagcttgtgtctgcaacaggtatggcaggctatgaaagcagcaatataatcagtactaagagaatgatgaagaacttttatttatgtggagatcgtgtaacagagccgacttatgggaatggattaatggctccacgagttgcaatctgtgcagggcatgaagcaaatatgatcacgcgtttgcttcttggagaagaggatgtatagaaagacatctaaatgaataaaaaagaaagaaggatttaagttatgaatcagaaagatacatttacacttggaggaaaagaatttagttcacgttttattctgggatcaggaaaattttcgcttgatcttgtgaaagcatgtatagaaaaagcaggagcgcagatcattacacttgcgcttcgtcgtgcaaatgaaggaggacttgcgaatattttggattatattccggaaaatgtaacacttcttccgaatacatcaggagcaagaaatgcagaggaagcagttcgtattgcaagactttccagagaagttggttgtggtaactttgtaaaaatcgaagttgtcagagattccaaatatcttctcccagacaactatgagacaatcaaggcaacagaaattcttgcaaaagaaggctttgtagttatgccatatatgtatccggatctgaatgcggcaagagatctggtgaatgcaggggctgcctgtgtaatgccacttggggcaccgattggttctaacaaaggactttgtacaaaagacttcatccagattttgattgatgagattgatctgccgattattgtagatgcaggaatcggacgtccatctcaggcatgcgaggcaatggaaatgggagcgacagctgttatggcgaatacagcaatcgcaacagcaggaaatgtcgaggagatggctgaggcattcaagaaagcaattgaagcaggaagaagtgcttatctttcaggtcttggaagaacaattgaacgaggtgcaagtgcatcttcaccattgacaggatttctggaagactaggaggcagttgagatgaatgatacacatgttaatgaaagtattttaagtgaagaaatactggaagatcagaagaaaaacagaatcgatcatatgacttatcttccgggaatggaggatatcggatcagaaatcatggatcaggtgatcgaggcaatggaagcctatgattatagtaaatatacggcagcagatgtgaaaaatgcacttgcacattcggaacgtactccggaggatttccgtgcgctgttatcaccggcagcccttccatttttggaagaaattgcccaggcagcccagacagagacaagaaaacattttggaaacagtgtttatatgttcacaccgatttatattgcaaactattgtgaaaactattgtatttattgtggatttaactgtcacaataagatcaaccgtgcgcaattgaatgcagaagagattgagaaagaaatggcagcaatcgcagagacaggattacaggaaatcctgatcctgacaggggaaagccgcaacaaatctacagtagagtatattggagaggcatgcaagattgcaagaaagcatttcaaagtgatcggtctggaaatctatccggtcaattcagatgagtatgcgtatctgcatgaatgtggagctgactatgtgacagtattccaggaaacatataattcagataagtacgagacacttcatctggcaggacataaaagaatcttcccataccgtgtcaatgcacaggagagagcagtgaaaggtggtatgcgaggagtcggattcggtgcgcttttaggactggatgattttagaaaagatgcttttgcaacaggatatcacgcatatctgttacagagaaaatatccacatgcggaaatcgcattttcctgcccaagacttcgcccaatcatcaataatgacagaatcaatccgatggatgttcatgagccacagcttctgcaggttgtctgtgcatatcgtttgtttatgccatttgcaagcattacagtttcaacaagagagtgtgcacgtgtcagagataatcttgtaaatatcgcagcaactaagatttcagcaggggtaagtacaggaattggaagccatgtggatgatatcgaggataagggcgatgaccagtttgagatttcagatgaacgttcggtagatgaggtttatgatgcattattgaaaaataatctccagccggttatgagtgattatatttatgtgtaagatgaaatgtgatttatcggagatagatttgaaaattatagctgtcagtaatagaaaactgtgcgaaagaccatttttggagcagattgaacgggtttgtcagatgaaaccgcaggcaattattttgcgtgaaaaagatctgtcagaagaggaatatcggattctgtcagaagaagttctgtctgtttgcaagaagtatgagattccgtgtattttacataagttctggaaaacagcactggaattggaatgtacatctgtacatctgccattgccggaattaaggaaacttccggaagatgtgaaagaacaatttcaaagaatcggtacttccgttcattcagtggaagatgcaaaggaagcagaaagacttggtgtgtcttacatgacagcaggacatatttatgttacagattgcaagaaaggtctggcaccgagagggcttggattcttaaaagatgtctgcagtactgtgaatgttcctgtatatgcgattggtggaatcaagtttgatgaaaaacagtgggaagaattgaaacaaaatggtgcttccggaggatgcattatgtccggaatgatggaactataaaccatgagatctcatgaaatagaattaatgaagcaatacaaattaacttgacctgaaccgggctttacatagtataataaatgcacttgattacgaggatttatgaaattgtaattaggtgcatttttttgtatgaaaaagcgttacaattaataggataaaaaagcagaacagcaagaaggtaaagacagggttactgttcactcccgtgtcaatcactccgctgattgacacggaggatgcgtgggcgatttaaaatggcgagatgcgttgctggtcgcacattgtgtgaacagtaacgttatatagccgccggatttataaactgcaatcaacaggaatgcggacagcagggacggcacaacttattgtcagtgggagtgagcaacatgtaccagaaattgccttattatatggcctatccgatacagacagaatatgatgagagagcggaaaggacagacctggagtatatgaaaagcctgtatccggatcttccaaagagaatactgccttatgtcgaagaagagtgtgacaggatggaatacacggggagtgtgatatttgatgtttatccggataaattgcagttacgcatcatgtgcagcagaatttgcgaaaatgtaaaaaaacaggagaaaatgtttgccggggaagagcggatgttaagagacctggcggaagttttgttatatcaggaaatctaccgacgcaggggagaacagagaaaaaggaaacaaaaaatttacagttattgttcattgccaggaaaatctatgatataatcattcagattacaacgaaagaaacggattcagaagaagggaacagatacagatgaaaagtaatcttatatttatcggtatgccggctgtcggaaaaagtacagttggtattgtagtagcaaaaagacttggaaaaggtttcatagattcagatcttctgattcaggaacaagaaggaaagcttctgcgtgaaattatagcagaagtcggtgatgatgggtttttaaaaatcgaaaatcaggtaaatcgtgatataaaagcagaaaatgcggttatttctccgggcggaagtgttgtctattgcgaggaagcaatgaaacatttcaaagaaatcggaattgttgtatatcttcatgcttcttatcagacaataaagaggagaatcaggaatcctcaaaaaagaggagttgttttgaaggacggtcagacattaaaagacctgtatgacgagcgaaaagtcctttttgagaagtatgcagatgtgacaatcagtgaagagggctgtcagattgaagaaacaatagaaaatgtacttgatactattgagaattactctcaaaataaagcgtgaatattaccgtcatagaaaaaggggattccacaatgaaagattttgtgttatagttatgtatggattatattgtaattaagatagatagttcttttcgtatagataaagacacaagaataaatcgttactgaacacaggatctgtgggaagtaatacagaatcggacaattgaggtgcaaaatggagcaatatattattaagggtggtaatccgctggttggggaagttgaaatcggcggagctaagaatgcggcacttggaattcttgcagctgcaatcatggcagatgaaccggttttgattgagaatcttccggatgtgaatgacattaatgtcatgctggaggcaatcgagggaatcggtgcaatggtacagagaattgacagacatacagtaaagatcaatggaaatacaatcggagatttcagtattgattatgactatattaagaagatcagagcgtcttattatttgttaggtgcacttcttggaaaatacaagagagcagaagtagcacttccgggaggatgcaatatcggaagcagaccgatcgatcagcatctgaaaggattccgtgcacttggagcagatgtagacattgagtatggtaagattgttgcagaggcggaagagctgaagggaacacatctttatttcgatgttgtgactgtaggtgcaacgatcaacgtaatgatggcagcagctatggctgacggtcttacgatcatggagaacgtagcgaaagagccacatgttgtagatgtagcgaacttcctgaacagcatgggagcaaatatccgtggtgcaggaacagacgtgattaagatccgtggagtgaagtccctgcataaggcagagtactccatcattccggatcagatcgaagcaggaacatttatgtttgccgctgcagcaacacgcggagatgtgacagtgctcaatgtgattccgaagcatttagatgcaacgatctccaagctggtagatatcggatgtgaagtggaagaatttgacgatgcagtccgtgtagtggctaagagacgtctgaaaagtacacaggtgaagacattaccatatccgggatatccgacagatatgcagccacagatcggggttgtgcttgcactcgcgaagggaacaagtacgatcacagaaagtatcttcgagaatcgttttaaatatttagatgagctggcacgtatgggtgcgaatatcaaagttgaaggtaattcagcaacgatcgagggtgttgagaaatttacggcagcaagagtcagcgcgccggatcttcgtgcaggagctgcgctttgcatcgcaggacttgcaacagaaggaattacgatcgtagatgatattgtttatatccagagaggatacgaacgctttgaagagaaactcagaagtctgggtggaatcatcgagaaagtgtccagtgaaaaagagattcagaaattcaaattaaaagttggctaaaccgaggttactgtttacaacaagctgcggccggcagcgagccgatacagacagaatccgaagaaatatgatgtgagaacgtgtgcaggtgtcggaacgaaagttctgatacctgttttcagtttatatgtcaggagttatggcgtaataggcgatcaggcaggtcgaatgaaacagtgacgggatattaataagaaaacagcaggagcaacgaacgatgaatgaatttgaacaggcagaagaacggagaaaaagacagagagaagaaatcaaacaaaagaggatcagacagctcagacgaagaatgactatttccggctgtattttgttgtgcataatcatagcgctggcagcctttgcagtcaatgtggctaagaaaaagaaactggcagcagaacagaaaaagcagctggagcaggaaattgcacagatgaatgaatcgctgaatgactgctacaacactttcctgacggataatggagtgtcagcggaaaagtctgatgttacagcatttacgaaatggctggaaaagaactattctgaagagatggatgatttatttccagtctatcagaagaataaaaagataacagcgcaggatatttatgattcctttggagcaactttgcatgttctgtcagatacatacgagggaaaattaaaggatgaagctaccgctgcgaagaatcatatctatgagaagaaggcagcagagaacggaaccgtgcagatcacagcagcaggtgacctctgtctggaggaagatggatatgttctcgattattatgatacggtaaatgacctatccaaatgcatttccaagacaattctggatcagacaaatgcagcagatattttcttcctgaaccatgaatattgtatcagtgaccgtggaaccccgctggaggataagtattatgtattccgtgcaaaaccagaacgcatgaagttgctggaacagatgggaacagatattgtttcaattgcgaataatcacatttacgattatggtgcagatgcgatggatgatacgatcgatctgttagatcaggcgaagatcactcatgttggaggcggaacgaatctggatgaggcaaagcagccgacttattatatcattaacggaatcaagatcggatttgtggcagcttccgagggagaacagtataaatttacaccggaagcaacagattcaacgacaggtattcttacatcctacgacacaacagagtataatcaggtgatcgcggatgcatcaaaggaatgtgattatctgatcgcatatgttcattggggaacagaagatgaggatatgtataattcaacacagacagagcatggaaaagaattcctgaagtcaggagcagatatcgtgatcggaggtcatccgcatgtacttcagggaattgaatatacagaagatggacctattgtatacagtctgggcgatttctggtttaatgatgagacaaaatacacaggacttctgaatcttgagattacatcagaaggattgaaacagatgtcctttacaccgtgtgagcagaaagacagccagacacagtatctgaataatgcagagtcccagagagcactttttgatcacttgcaggagatttcaccgaatattacgattgatgatacaggtgtgatcacggagttgaaagatgttgatgcagaatcatagaaatataaaagttttatcaacttcaggaaacggtattgacataatcaacaaggtgttgtatagtctgatacgaaacaaaattaaatagatgatactttctcttattcagagcagtggagatacaaaggatctaagaagctgcggcaacccctcgtaataggaaggtgccaacctgagcgagttatttcgaacaataagaggattgttaagataaactgacagtccgcttgatgcgggctgttttcattattggcaatgtaagcaaatgaagacagcacaagcgagagaaagtgagatattgctgtggggacagcaaccggaaaggagaacagatatggaaagagaaaagattttatttacatcagaatcagtaactgagggacacccggataagatgtgtgaccagatttcagatgcgatccttgatgaactgatgagacaggacccgatgagccgtgtggcatgtgagacatgctgtacaacaggtcttgtaatggttatgggagagattacaacacaggcttatgtagatatccagaagatcgttcgtgacactgttcgtgagatcggatacacaagaggaaaatatggatttgatgcggatacatgtggcgtgatcacaacactggatgagcagtcagcagatatcgcactcggagtagataaagcacttgaggcgaaagagaataagatgtcagatgaagacatcgaggcgatcggagcaggagaccagggtatgatgttcggttatgcttctgatgagacagaagagtatatgccttacccggttgcaatggctcataagcttgcacgtcagctgacaaaggttcgtaaagacggaacacttacttaccttcgtccggatggaaagacacaggttacagtagagtacaacgaagacggttctgtaaagcgtctggatgcagttgttctttctacacagcatgacccggatgtgactcaggagcagattcatgaggatattaagaaatatgtattcgatgagattattccggcagaactcgtagacgaagagacaaagttcttcgtaaacccgacaggacgtttcgtgatcggtggaccacacggagacagcggactgacaggacgtaagatcatcgttgatacttacggcggaatggctcgtcacggtggcggtgctttctcaggaaaggactgtacaaaggtagaccgttctgcagcttatgcagcacgttatgcagcaaagaatgttgtagcagcaggacttgctaagaaatgtgagattcagctttcttatgcaatcggtgttgcacagccgacatctatcgcagttgatacattcggaacaggaaaactttctgatacaaaactggttgagatccttcgtgagaactttgatttccgtccggcaggaatcatcaagatgctggatctgagaagaccgatctacaaacagacagcagcttacggacattttggacgcaacgacctggatcttccatgggagaagctggacaaggttgacgatttaaagaaatatctgtaagatagaaatatctgatacaagcaccggaaggtgcctgacacccgtcataaagtgtcaggcacctttttcaatacggaaaggagatgcttctatgaaattacgtaccaaactgattattgcttttgtagtcgttatgatctttcctgtaacatttgcactgatcgcaatgcatgcatttgttccgggaagaggggcagagatacagcagctgtatctgatcgcagttgtccttacgacagcatttctaatcttgtggatctacagatcggtatcggtcccgctggagaaacttcagagagctgcacgcaatatcaaagagggtaatcttgactttgagattaaggcagaatcaaatgacgagatcggacaactctgtcaggactttgaagagatgcgtctcagactgaaagcacaggcggaagagaaggtcgcatttgacagagagaataaagagctgatcagtaacatttcacatgacctgaagactccgatcacagcgatcaaaggttatgtggaaggaattatggatggggtagcagatacgccggaaaagatggacagatacatcagaaccatttataataaagctaatgagatgaatcttctgatcaatgaactgacgctttattcaaagatcgatacgaatcgaattccgtataatttcacaacaatctctgcgaagggatattttgcagattgtgcggaggatttaagtgtagaactggaatcaaagggagctgaatttacttacaggaactttatggaagaggacagcaaggtgatcgtagatccggagcagcttcgaagagtcatcaataacatcgtatcaaattctatcaaatatacagataagccgaaggtgaagattacgatggatgtaaaggacgtgggagactttattcaggtagaactgggagataacggaaagggcattgcggcaaaggatctgccgaatatctttgaccgtttctaccggacagatgcttcaaggaattcttccaagggaggaagcggcatcggtctttctatcgtgaagaagattgtggaagagcacggaggaaagatctgggcaaccagcgaagagggcgttggaaccacgatgtattttgtaataagaaaatatcaggaggtacccgtagaagatgagtaaacgtattttaatcgtagaagacgaggaaagcattgcagatcttgagaaagactatctggagctgagtggttttgaagtcgaggttgcgaatgatggtgagataggacttaagaaaggacttgaaggagaatttgatctgatcattctggatctgatgcttccgggagtagatggatttgagatctgtcgtcagatccgcagccagaagaatacaccgatcattatggtttcagcgaagaaagatgatattgataagattcgtgggcttggacttggcgcagatgattatatgacaaaaccgttcagtccaagtgaacttgtagcgcgtgtgaaagcacatcttgcaagatatgagagactgatcggaagtaatgtagagcagaatgaagtgatcgagatccgtggattgaagattgacaagacagcacgtcgtgtctgggtgaatggagaagagaagtctttcacaacgaaagaatttgaccttttaactttccttgcaggacatccgaatcatgtgtacagcaaggaagagcttttccgtgagatctgggatatggagtcgatcggagacattgcaactgttacagtacatattaagaagatccgtgagaagattgagtatgatacttcacatcctcaatatattgagacaatctggggtgtgggatatagatttaaagtataagaagaaagagaggactctgccagtgaatggtggggttcttttttatatattaggaaagtgctttcctaatatataaaaaacgctccgttaaggatgcgcactgcggcgtacaatgtagatgtcgcaagcgaccgccgcaggcgtgagcggcagcgagtttgtcaatcctttctttgcttttagcagtctgttgtttttcctagtatgaacagtatgcgtaaccctgaatcagcgttcttgcctccatcttctaacaagtaattatgcttaacatcatagtcgctgttttcgtccgcatattcgaaaaaaacaatctctacgtcaaatttctatttctccaaattcttaaacgctgtcgacagcatcagtttaatacgattcaactgatttacttcacttgcgcctggatcgaagtcgattgctacgatgttggattcagggtgtctgcggcggagttctttgataactcccttacctacaacatggtttggcaggcaggcgaatggctgggtgcagacaatatttccggcaccgctgtgaatgagttcgagcatctcaccggtcaggaaccatccttcaccggtctgatttccgagagatacgatctctgaagccatttttgcaagatcttcaatgtgagccggcggatcaaagtgtttactttctgcaaatgctttggaagccggagcacggaaccattccagagctttgattccaagatttcctgctgttgctttggacttcttcattcccagatgagaaactttgaagttctgattgtagaagcagtagagcaggaagtcgagaagatccggaacaactgcttcggcgccttcactttccaaaagctctgccagatgattgttggcagccggaaggaatttaacaaggatttctccaacgattccaacacgaggtttcttaatgtcgagtgtttctatattatcaaaatcattgatgatatctttacaaagcttcttaaatctcttacgggacggatatccttcggacacaaacttcttaacaacttcaacccatttgcggtgaatcttatctgtagttcccggtacggcctcataaggacgcatacggtaaacgcatttcataaagatatctccgaatactgctgcgtagattccgcggagaaccagtgcaggagaaagtttgaatccaggattatcttccagtccacttaagttaagtgagataaccggaatatgctccatgccggctttcttaagtgcacgacggataaatccgatatagttcgaagcacggcagccaccaccagtttgtgtgatgataacagctgtatgattcaagtcatattttccggataacagtgcatccatgatctgaccgacaacgatcagagaagggtagcaagcatcgttatttacatattttaatcccatatcgacagcctgtttgttatcgttaggaagaacatcgatgttgtatccggcagcgcggaaagcaggctcaagcagttcaaaatgaatcggagacatctgcggacagagaattgtataatccttacgcatttcttttgtaaatgtaaccttttcgatagaagccggacgaatggtacgtttttcctgtttcttttcacgcacacggattgcggcgagaagagagcgtacacggattcttgcagctccaagattatttacttcatcaatcttcaaagttgtgtagatcttatctgaatttgtaaggatctcagcaacctgatctgttgtaacagcatccagtccacatccgaaggagttgagctgaatcagatcaagattctccgttgtctttacataattcgcggcagcatacagtctggagtggtacatccactgatccataacattcagagggtgctctgccggattcaaatgagagacagagtcttctgtaagtactgcaatattgtaggatgtaatcaattcaggaagaccatgatttacctccggatcgatatggtatggacgaccggcaagtacgataccgcggtttcctgtttcatttaagaaacggattgtttcttcccctttatttctcatatcctgacgacaggcagcaagttcattccatgcgtcatggactgctgacttgatttcgctttcggaaagagagaacttcttacttaattcttctacaagacgataagaaatcgtctcttcactttcaaaattcaagaatggatggataaaatcaacttctccgttgacgatcgggtccatgttattcttgatgttttccggataagaagtaacgatcggacagttgtagtgattatcagaatcagcaaattctttccgctcatacgggattgacggatagaaaatgtgtttcactccctgattgatcagccactgtacatgtccgtgcgccagtttcgccggataacactcggattcacttggaatagattcaataccaagttcataaacctttcttgtggaagctggtgacagaacaacacggaatccaagttttgtaaaaaatgtgaaccagaacggatagttctcatacatattcaatacgcgaggaataccgattaatccgtgttttgcctcttcttcggaaagcggttcataatcaaaatagcgatgcaatttatattcaaataaattcggcatctgattttttgatttctcttttccaagtccgcgctcacagcgatttcctgtgatgaatttacgtccaccactgaaatggttgatcgtcagacggcagttgtttgtacatccacgacattttgtcattgttgtggagtattcaagggaacggatgtcatcaatggaaagcatggttgtgccttcgcagtcaacataacgttctcgggcaatcagagctgcaccgaatgcacccatgattccggcaatgtccgggcggatcgcttcgcagtttgcgattttctcaaagcttcgaagaactgcattattatagaaggtacctccctgaacaacaatatgatttccaagttcggatgcatcagatactttgattaccttgaacagggcattcttgataacagaataagcaagtccggctgagatatcagcaacagacgccccctctttctgtgcctgttttactttggagttcataaatacagtacagcgtgttccgagatcgatcgggttctgtgcataaagtgcttcgtgagcaaaatcctctaccgaataattcagagattttgcaaatgtctcaatgaaagaaccgcatccggaagagcaggcttcgttcagctgaacactgtcgacagtctgatttttgattttgatacatttcatatcctgaccgccaatgtccagaatacagtctacatccggttcaaagaaggatgctgcataataatgagaaacagtctcaacttctccttcatcaagcatcagagcagctttgatcagtgcttcgccgtatcctgtggaacaggaatgaacaatctctacaccctcagggagttgatcgtaaatatctttgatcgctgtgatcgttgtaccaagcggatccccgtcgttgttgtgatagaaggaataaagaagtgttccgtcttcaccaacgagagctgcttttgtagttgttgaaccggcatcgattccaagaaatgcttttcctttgtatgaggcaagatcttttaccggcacctgatgctttgcatggcgggaaatgaattcctcgtaatcagcagttgttgcaaacagtggatccagacgttccacttcaaaatccatttggattttattctcgagacgattctgcatatcacgcagttccatcggagtatcttttttggaattcagtgcggaaccaatcgcagcaaacaaatgtgagtgatttggtgcgataatatgttcatcatccagttttaatgtgcggatgaatgcttctcttaattctgagaggaaatgaagtggacctcctaaaaatgcaacatgaccacggatcggttttccacaggcaagaccactgatggtctgattcacaacagcctggaaaatggatgcggcaaggtcttccttagcagcaccgtcattgatcagtggctggatatctgtcttggcaaatacaccgcagcgcgcagcgatagagtataatgctttgtaatttttagcgtattcattcagaccggaagcatctgtctgaagaagagatgccatctggtcaatgaaagaacctgtaccaccggcacagacaccattcatacgctgttctacatttccaccctcaaaataaatgatcttcgcatcttctccaccaagctcaattgctacatctgtctgaggagcgtaatcctgtagtgcagtggagactgcaattacctcctggacaaatggaacaccgagatgtttggcaagtgtcagaccaccgcttcctgtgatgacaggagaaacctggattggtccaagcttataaagcgcacggccgagcagatcggaaagcgtctcctggatattagcgaaatggcgttcataatcagagaagaggacttcattttcatcattaagaattgcaatttttactgttgtggaaccaatgtcgattcctaaagtatgtagattttttgcgttcataattaatatccccaatcttttgtaattcagttaatttgtcaaatttatatgagttactacctattaaatgcgtttgttagctcgcaataaataacattatacgacaagattctcaaaaagacaatggttattgtagtgtagtaagtgtgaagaaatgagctgcaatatggcaaaatgtctaagtagaaaggaaaggaaaatatcatattcttgttaaaagtgtattaatataaaaacaatcgtttgacaaaacaagtcttcccttgtacaattactgctatacgaagatgtgagtgctgaccacatgtagtggacagtaatataaaatgaaaatagaaggagaatacaagttgaactggcttgacaaattagaaaaaaaattaggtcgttttgcaataccgaatcttacggtgtatctgctggccgggtatgtgataggtttcgctatttattatttagcaccgggacttttaggatggcttacactggaaccggcatatattttaagaggacagatctggaggattatttcctgggtattgatcccaccaacaggaagtttgatttctttactgtttctagtattattgtactattctcttggttctgcacttgagagaacctggggaacattccgttataatgtatacattttttcaggaatactttttacagtgatcgcagtattcatactgtatggtgtgttttatcttatctatggaattgaacttccactttcaagtatcggattgatcagcacgaactacattacaatgtctatctttttggcatttgcttccatctatccggatatggaagttttactctattttattttaccgattaagatgaaatggatggctttcgtatatgtagcaatggcactgtattatttctttacaggaagtctcgcaacgaaagttgcgattgcggcatccttattgaactttgttatctttttcctgtccagcaggaatatgaagcgtttcagtccgaaagagcaggcgagaaaagcaaagtttaaacagcagacgagaccacatatgacttatgcgaatggggcaagacaccgttgtgcagtctgcggacgtacagaacttgatgatccgacattggagttccgtttctgttcaaaatgtaatggaaactatgagtattgccaggatcatttatttacacatgaacatgtgaagtagaaaatgagaattgtgtaacgcatatttctcatagtttaccggagatgaggtatggcagtgcagtgtatcagatcagagttgcagccgaaagtgatacggtgtagcttcgctccaggtgtataggaactttatggttatattttttaaaggagagattgacttagtatgaaaaaaacaaaagtagtatgtacgatgggaccaaacacaaatgatagagaactgatgagaaaactcatccagaatggcatggatgtagctcgtttcaacttctctcatggtgatcatgaagagcagaagggtcgtatggatatgctcaaagagcttcgcgaggaagagcatgcaacgacagctattcttctggatacaaagggaccagagatccgtacaggtgttctgaaagacggaaagaagattaagcttgaaacagggaagacctttacacttactacagaagatattgttggtgatgagaataaagtatctatcacatataagggacttgcagaagatgtaagtgaaggaaagattattttgatcgatgatggtctgatcggactgaaagtaatcggaaaaacagacaaagaaattcattgtgagatcatcaacggtggtgaactcggagagaaaaagggcgttaatgtaccgggagtaccggtaagacttccggcaatcactgagaaagataaagaagatattaaatttggagcagagcaggggattgattttatcgctgcatctttcgtaagaaatgcagagtgtattcttgagatcaaggcatatctgaagtctctcggagctccttacattccgattattgcaaagattgagaatgaagaaggaatcagcaatatcgatgagatcattcgtgcagcagatggtatcatggttgcccgtggagacctcggagttgagattccggcagaggaacttccatatcttcagaagatgatgatccagaaatgtaacgatcagttcaagacagttatcacagcaacacagatgctcgattctatgatgcgtaatccacgtccgacaagagctgaggtaacagacgttgcgaacgctgtatatgatggaacagatgctgtaatgctctcaggagagacagcacagggtaaatacccactcgaggcgcttcagatgatggttcatatcattgagcagacagagaaacaccttgattatgatagcatgcttgagaaagagcacggtcatttaagaggcggagtatccagtgcaatcggatattcatccgtactggcagcagcaaacctgaatgcaaaatgtatcattacaccatctgtatcaggagcaacttcaagagttgtatccaacttaagaccaagacaggaaatccttggtgtaactccgaacgagagaacactgagaagaatgtctatttactggggcgtaagaccgctgaagtctcttgaagttgatacaacagaagatatctgtgaaaatgcgatcgaactggcacaggtaaaacagtatgttgagccgggagatgttgtagttatcacagctggaattccttcaacaaatgtaagcaaagagagaagctttacaagtaatatgatgagaattgtgacagtagattaaattagaaaaacttttaataagagccagaacagttaccgtgcgaggtgcctgttctggctcttattaaatacaatcaatatattgacatccaacaatcaatgctgtatagtgttcctgtaaagaactactaatcagagggatggtgctatggacgaaagtaaagcaattgaatatctgatgcattttggaatgtcccggcaggaagcaactgtttatcttcggctgatcgaagcaggaaagcagacggggtatgagattgcgagagatacaggaatctcaagatcgaatgtgtatgcatcactggcagctctggttgagaaaggggctgcatatctggtggaagaggatgccaagcgatatattccggttcatgttcaggagttctgtggtaacagaatccgcagaatggaagaagaacagaagtggttggatatgaatcttacgggagaacagaaagaagaagaaggatatgttacgatcgatggtcaggaacatatttcagataagatccataatcttctggctaatgtggaagaaagagtgtattgttcctgttccggtgtctgtctggaacagttgaaaggacagttaaaggaactgacagaaaaaggaaaaaaggtggttcttgtgacagatcatccatttgaactttcaggggcgatcatttatgtgacgaaagaaaaaggaaatcagattggtctgatcacagattctaaatatgtactttcgggtgagtatggacaggagagcagaaacacttgtgtctattccggacagagaaatttcgttacgctgtttaaaacagcacttgcgaatgagatagaattaatcaaaatacgcgaaggagaaaatgaaaatgagtaagaaaccatttgtgacaaaagaacaggttgaagagattgtaaaaacatatccgacaccgttccatctttatgatgagaaagggatccgcgagaatgcaaaagcattaaaggaagcatttgcatggaatccgggatataaagagtattttgctgtaaaggcaactccgaatccgttccttttacagatcttgaaagagtatggatgcggttgtgactgctcctcttatacagaactgcttatgtcagatgcagttggaattgatggtcatgatattatgttttcctctaatgatacaccagaggaagattttaaacttgctgataaacttggagcaatcatcaatctggatgatattacacatattgacttccttgagaagacaatcggacatattccggagacaatcagctgccgttataatccgggcggaatattcaagatcagcaatgatattatggataatccgggagattcaaagtatggaatgacaacagagcagatcacagaagcatttaagacactgaaggcaaaaggtgcaaaagaatttggtattcatgcattccttgccagcaatacagtgacaaatgattattatccaatgcttgcaaaagttctttttgaacaggcagtacgtcttcagaaagaaacaggagtacatattaagtttattaatctttctggtggtattggaattccttacacaccggatcaggagccgaatgatatccgtgtgatcggagagggcgtccgcaaggtttatgaagaagtacttgttccggcaggaatgggagatgttgcaatctacacagagcttggccgttttatgatgggaccttatggctgccttgtaacaaaagcaatccatgagaagaatacttataagaactacatcggagtagatgcatgtgctgttaacctgatgcgcccggcaatgtacggagcatatcatcacattactgttcttggaaaagaagacgcaccgtgcgaccacaaatatgatgtaacaggttctctgtgtgaaaataatgataagtttgcaattgacagaatgcttccggaagttgatatgggagattatcttgtgattcatgatacaggagcacatggtttctctatgggatataactacaatggtaaattgaaatcagcagaacttcttttaaaagaagatggaagtgtacagatgattcgccgtgcagagacaccgaaagactattttgcaacatttgattgttttgaggttggaaagaaactttgcaaataaaaaacaaataaaatcataaaaaaatagttgaaaaatgtgaccggatatggtaacataaaaaagctgattcggacaggaaagttttcttgtccgacagaataagccgctgtggcggaattggcagacgcacttgactcaaaatcaagcggttagtagccgtgccggttcgagtccggccagcggcatcgaacttaatctctgaatatcttacaaattcaatgtttgcaagatatccagagattttttatatattaggaaagtgttttcctaatatataaaaaacgctccgctaaggatgcgcactgcggcgtacaatgttcattgcttttgcctggagttcacgatattctgagtgattctttttcaaatacttagtcacccatttctccaccgattcccataatgtactttgctcccacatgatatcctgcttttttctcatattgcatttctcccttctaagtgttttcttttcagttacatgactataccagaagtcggggaaatagcaattcatcagatgtactgaaaatacgtgaaggaaattggggatagtaaatataagaaaaaatgggtaaaaaaatttcccagacgccacaaccgtctgggaaattttagaaaatattactgagcacttccagcacagaacccaagagttgccgtaatcttgtttgtagtacctgtaatttcatttacagtactgttattacaatcataatcacagccttccatccagatatatgctttaattttaacaacttcattattttcagtgaagctatagagttcatcagcctgaccaactgtagcagaaagtccatttgccggatctggagttgctaaagccctattctcaccagtaagtgctttacttgcagctgatacaatgttgtttgcgcttggggttccaaaagtatctgtagtttctgctttgttcataccagaaactgctttattaataccatccgcacttaaagctgcaagagtagtattgtatgatcctgtagtattagttactggatcaatttgataaaatactgttttcttccatgttccttcactgtttgaaacaacaagagcaagacgcagaactttgttcatagtattgttagtgccagttacattaaaagcagtttctgtgtcaagatacagtttacaagcctgagaagccttaatttcaaaatcttttgtccaatattcacttccagtagcagcagataccttatttaccgtaattttattatcggtatcttttgcccaatcattctggataaagaagtcaaatgcctctgttgaattttttccaattgtagaaactggaacaaaattcttgttctcatctttgaaggtataagttgttgcccactcattgttttcatttttgataagcaatgtgtttgctgtcgttgcagatatttctaccgtgcctgctttaaccttcgtattcgttacaaaccaagcatacgtacttgatcccagcgctacagcggcaacgcataccatggcaacgttacttactgaacgatgatacttttaagacgtataatccaaacaaaacaaccgtttaacgattttgtggcttgctttcataaggctttcggaacgtataaccttatgtcagcatgcattatcaggaattagaaataattttggttattttgcacgttgatttttttatctgttatacatataataatattaacaggactccccgcacctctcaacgatgtgccccaggggagacatttttttatacggagatattttatgaatgaagtaaaaccgcacctgtcctacgagggacaaataaataagttgcgtgaaaagggatgtattatagacgatgattccctttgcagagatgttttagtcaacatcggttattaccgattgtctgcctattttttaccatttaaaaattttgatggaacctatatggacaatctttcatttgaaagagtatatcgaatttatgaatttgaccgaaaactccgcaatttattattctctgctattgaagttattgaagtgagccttcgcacgagacttgcacattttcactcagaaaaatatggtcctcttggatatttggatgcttcttcattcaattcaaaacataatgctgataaatttaagcagaatattgaccgtgaaattgaaaacaacaagaaagttctgtttgtaaagcaccatatagataattacgatggtcagtttccgttatgggtaatatctgaattatttacatttggtatgctttcgtatttttataatgacctgataaccgcagataagaaagcatttacaggtgccgattataaaaatatgattagttggatgcgctgttgcaccgatttaaggaatatatgtgcacattatggcagactttattttagaatcttctctgcaatgccttccggatttcaaatctccgaagcagcaaaacgaagactctggggtgcaatactttctgtgaaagcattatatccatctgctgaaaaatggaattctgaatttatgccaaaattggaagctctttttgaagaatacaaagaggacattgatctatatcatttagcttttccaagagactgggcaatacaattgaagaaataatataaagtagaattacgacgaagaactggaacgtttaccacgagctgactatggtctttgcctcaccctcatttcaatgattctccgagaaaatcattttaataacggaatctttgcaaaacgctacaaaaatagagagaaacttttgattttggattgaatgctactatatccaataataaatgggttcgttgtatgaggctgctccaattgcagcctcattttatgcaactttgccttttgtgtaaccctcaaccagagtttgccccggcaaaagttcaattccataggctgctgcttttgccagtttttctggtgaagctttccacccctcatgaagatttcgaatatggaaactcacatcaaaaggcgctttatactccctgtgcatcggaatcacaacaccttcaatattacttacctgttctgtgattcttggagtctcggtctttatcagtattttgggatcagtattctttaatgcattccagaaaacttccattacctctttatttttgatacctaagacaagtctcaccattgcagtgatacttattcctgcaatggcaatttccattttatgctccctgatccagtgaataagcgttttctgctctttttgggtttctccactcatttccatttttttagtttcattcatgattctatcctccttgtgttttctatctaaaccataacacatttcggaatctctgacattcgcgcttcgcgtacctgcactcaagcttcaaatactgtagctataaactgaatcgcatacagatttcctaattctgcatatgccactagcatctggtttccaattgctatgttgaattctgaggataactcagtatcaaccatatcgaaaagaaatgtgagagccaaataataatcacccagttctgcccattctgtatccgattttagcgcctttattgcctccgtaatcatttccttaaaattctgaagaaaggcttgtttcttctcactcacttcggccgttctctgagtatcctgatattcctgtatgaaccctttcatatcaatccgattagactgtagcttattctgtaaagctaacatttgctgtatatcgttgatctgtgaccaccaaagaaatatagaccacacgagattagctacagcttccagtgcttctgtttcatctactgcatgcaaaaagcaatcccaaatatcaactacaatatgtccactcaaattttcacctttggcgaatgcttccagaaccttctcacaaagacaatatgcactcctgaacctgctatttctcatggtctcctccgatgaaaataatggaaatatttttctgtagatttctatgatatctaaaacagatttctcattgatgtcacttgcttgtatccctgttaagtccgtatgtaaaagttcatcaacagttttcccaaagtgctttgctataacaaccagtttttcaaaatcaggttttcttcttccagtctcatatccactgatagtcgttttactcaaaaacactttacttccaagttcttctaatgtttctccatttatttctctaagatgccttatattttttcccagctgattctccattatacagccctcctgactacgattctttagttattaccagtttatcacattcatattgaatctgcacgtggcttccaggttcaaaatcacattcttgtaaccattttccctgcaaacggatctgcgagatgggaacactttttcctacaatatcaaaaaacatctggattattaatctggtagtgcgtagatacctcagaatcctcattcagcatctctttctttaactgtgctaacattcttccataagagtacgccacaccgacgaaatgcgtagcattttggaggttggctctgaacagttacacttattttatttctgtcacagtatagcatgatatcagttcacattttgtagaacgatgtcgcatggtatatagcgcttttcagatagatggaacgataccgccttgtatgcagcgcttttcagatagatgaaacgatgtcgcctgcatgcagcacgtttcaaatagcaagaaagagatacgcaaccgtatctctttcttcttgcaggcttgtttcttttgtctgctttctctttcatttacagatcaaatctgatcttgatatatgctttgatctcttccacgcatttctggaatccaagctttccactgttcaggcacaaatcataatttcttgcatctgcccactcgtgtcctgtatggtaacgatagaaatcaccgcgaaatttatccgtcttctcaatgtattttttcatttctttttctgtcatactgttacgctccatcgcacgatcaagacagaatttctcgtctgcatgaacaaacacactgacaacatttggattgtctttcagaacataatctgcacatcttccaacgattacacaggattctttctcagccagatctttgatgatctttgcctgatagttaaagatattttcttctgaaacgaagtctttatcttccggcggaagaagttctccgtcgtatggacgactgaggatcttgaaccagccggctcccttcatcttctcatcactcataccgaagagtctctcgttaattccgctttcctcggatgccatacgcaggatttctctgctataacagttgattccaagctcttttgcaagcatagctccgattgtcttaccaccgcttccatactgtctcgccattgtaattacaatattgctgctcacctgaatcgcctcctattctcctaaatacgctttcttaactgcttcatcttccagcaggtcttttgcatttcctgacattgtgatcttaccagtctcaagaacataggcgcgatccgcgatagaaagagctttctttgcattctgttctacaagaagtactgttgttccactctcacttactgcctggataatatcaaaaatctcatttacaaagattggagaaagtcccatagaaggctcatccatcagaatgatcttcggtttagacatcagtgcacgtcccatggcaagcatctgctgctctccaccactgagcgttccggccatctgatttcttctctcttccagacgtgggaatctcttataaacatttgcaagactctcttcgatctcttttttatcttttcttgtataggcgcccattttcaggttttcgtaaacactcagttcagcgaaaactcttcgtccttccggaacgtgagccattcccatagacacgatcttatgcgccgggatctttgtgatatcagttccttcaaacataacagaacctttctttggagaaagaagtcctgtaattgtatgaagtgttgttgtctttccggctccgtttgcgccgatcagtgcaataacctctccctgatttacctcaaaggaaatgcctttgattgcctggatcattccataatatacttctaagtctttgacttcaagcattgccattgttatcttccccctattctcccagatatgccttgattacctgaggatcattcagtacatctgttgtcttgccctgtgcaagtacttcaccgaagttgagtactgtcagctcctcgcagataccacttaccagtttcatatcatgttcgatcagaaggatcgtcatatggaactcatctctcacgaaacggatcatatccatcaattctcctgtctcattcgggttcattcctgctgccggctcatccagaagaagaagctttggatctgtcgcaagtgctctggcgatctccagttttctctgctgtccgtaaggaaggtttgcagccttatatgacgcaaacttctcaagatcgaataccttcagaagctccatcgccttttcattcatctctttttctaccttacgataattcggaagtcttaagattccttcgattgtagagtaatgatgatggttgtgaagtcctactttaacattatcaagaacagtcagttctttgaaaagacggatgttctggaatgttcttgcaattccggccttactgatctcaatatttttctttcctgtaagatcctttccgtccaaaagaacctttcctgaatccggtttatatactcctgtcagaaggttgaatacggttgtcttaccggcaccgtttggtccaatcaatccgtaaagttcttctttctgtatcttgaggtcaaagtcatttaccgcacggagacctccgaaagaaattccaagattttttacatctaataatgtactcattcttacttaagcctcctttttctttccaaaatgaagatacttctctctccactcgattgcctttggtgcccagttaaagagcatcatgatgatcagaacgatcgcatagatcaacatacggtaatcagacagtccacggagaagctccggaaggagtgtcaggataactgctgcaataatagatccacggatatttccgattccaccaagtactacaaagacaagaatcgtgatggacatattgtatccaaagttgtttgtatttgctgtcagtgttgacaggttgtgtgcatacagaacacctgctgcaccggccatagctgctgaaattgtaaatgccatgagtttatattttgtaacattgattccgatagactcagctgcaattacattatcacggatcgccatgattgcacgtccgtctctggaattgatcaggttgagtacgataaataatgtcaccatgatcaggataaatccgatcaggaaagttgaatccttcggagttcctgtgattccctgcggaccgttcaggataactgttccgtctggatccatgtcaagtgccataacgtcctttgttgcaaaatgaaatcctttggaatcctttccaatataaaggacatttacaaggttcttaatgatctcaccgaatgcaagtgtaacgattgcaaggtaatcgcctttcaaacgaagtaccgggattccgatgataacaccgaagattgctgctactacaacaccgatcaaaagtgcaagcagaaatcgtacaatcgaattctcgatcacatctctcatacattttgagaaaaatgcactggaaaatgctcccacacacataaatcctgcatggccaaggctaagttctccgagaatacctactacaaggttcagagaaaccgccaggataatatatgtacaaagcggaacaagaagtcctgtcaaaagactggaaatacttcctgtgctgcttaaagtctgcatcactacgaaagctacaatcacaatagcataagtgatgagattgcttctctttgttttattcatattcttcaacataattccatccacctacactttctcctgaatcttcttgcccagaagtcctgtaggcttcacaagcaacacaacgatcagaactgcgaacacgatcgcatctgcaagctgggaagaaatgtatgccttactgagtatctcgatgattcccaaaagaattcctccgataaatgcacccggaatggaaccgattcctccaaatacagctgcaacgaatgctttgatacccggcatcgcacctgtgtatggtgtcaggctcgggtaggtagaacacagaagcacaccggctactgctgcaagtccggaaccaatcgcaaatgtaagagcaattgttgcatttacattgatacccattaattgcgctgcgcctctatcctctgatactgcacgcatcgcctgtcctggctttgtcttctgaacaaatgtgatcaatgcgatcataataaccacacaaactacgatcgtaacaattgtctctcctgaaatattcagcttgccatctgcaagtgaaagtccgctccacttgatcactgatgggaatgtctgtgcattcgcaccgaagatcagaagtgctacattctgaagcagataactgacaccaatcgctgtgatcagtacggcaagtgaagatgttgcattacgaagcggcttatacgctacacgctccatcagaaccccaagtactgtacaggcaatgattgaaatcaggattgccacccaggtaggaagtcctgcctgcttcattgtgatcaaagctacatatgcaccgatcatgatcacatcaccatgtgcaaagttcaacatcttggcgattccatataccattgtgtatccaagcgcgatcaacgcatagacactgccaagacttagtccatttactaaatatgaaataaagctcatatccgtccctctcatcctttttatatttttgtaaggtactactttaaccttttaaattgaattgattatagcataattattttctcgtatcaatacaaaaaacagaatccgctctgttttcctgtgttattttttaactttttgtaagaaaaaagacaacattttcctttttttctatctataccgaagaatagtgtctttttcttctttcgcggattcttatttacagacttttatgaagtaatccaagtactgttgtcagatcttcaatccccatctgtcccggtgcagatactttcccaactgctccaaatgtcagtgcagatccaaagacttctccacagagacgactgatcacacctgttcctgacatagacattgtaatgatcggacgatccgcatactcgcttgccatcttttctgttgctgcaagaagtgtaagaacatctttcttattctgtggcatcacagcgatcttcggaatatctgctccaagatcctgcatttttcttaaacgggatacgatttcctcttttgccggagttttgtggaagtcatggttcgaagcgatcacttttactccatttgcatgtgctgtctcaacaacagccttcacagcctcatctcctgtaaatgcctctacgtctacaaggtcaataagtcctgtctttgctgcattctgattcagttcaacataagcccctgtctcgattgctttttctccaccttctttggatgtgcggaatgtgaaaaggatcggcatctccccaatcacctcacgaagtgcctgcattgtcgcctctgtctttgcaaaatcaaagatatcttcataccagtcaacacgccactcaacaacatcagcctttgttgacttgatattctcggctgctgcaagaatctcttctcttgttacaccaacaataggtacgcagattttcgggattccagcgccaatttcaatatttcttacttttactgtattcatgattttttcctttcttaagcttcttccgaattcttcagaagcacaccatatcttacatttataaaaagtataatataaataatagcacaaagatagaacagcatgctatagaaaattcacaagcttgaaactatggccacaccaacggaaaaacatcttgtaaatcaaatgactaacactgctccaaaaagaagtcccccggcagaaacgatgtctgtcggggggatttctcctattcttttaatgtatctacaaagagcgttgctactctctgtatttatttttctaaacgaatctgatatatcaattattcagcagcatcttctgcctgaagtacctgatactctccactcttaacaacaactactgtaggatcttttgtaggctctccatcctctgaccatgtgatgctctttcctgtaagtccatcatatgtgatctctgtcataccttttttaagtgcgtcacagatatctgatacgctcttatccggtgtaacgtcttctttctcagctgctgctttgattacgtatacacagtcataagcatctgctgcgaactgaattggtgtgtctccgaatgcttctttgtaatcagcaacgaatttctgtgttgcttcgtctgtagcatttgctgtaaatggtgtaaggaacattaagtcttctgcaagacttgcgtcaaatccatcaagatcaaggataccgtccataccgtcacatccgaaccacttcggtgtaaatcctactttgtttgcctgagcaagaatcagagaagcttcctgatagtaaattggaaggaatacaagttcagcacctgcatcttttgctttctggatctgtacagagaagtctgtcttgttatctgctgtaaatgcttctgctgctacaacatcaagtccttttgcctttgcctctgtcgcaaatgtctgataaattcctgatgaatatgtgtcagagctgttataaatgattgctacttttgttgcaagcttgttctctgcaatgtaatctgctgatgcgctaccctggttaggatctgagaaacacatacggaatgcattgtcatactggatactgtctactgctgtagcagatggtgtcagctggaacatgttatctgaatgagtctcctcaacaactgctgtacaaggtgtagaagttgttgttccgatcagtgcctgcattccccagtctttcagagtattgtaagcgttcacagatttctctgaatcagcctgatcatcttcaaacttgtattcaatctgctttccgttaattccgcctgctgcgttgatctcatctactgcaagctgaataccattctttacagctgttccgtagattgctgcatctcctgttgtaggtccgataccaccaatcttaaaagtgtcagaatcggatgagcctccgctcttatttcctgaacttccacatgctgctaatgatactaccatagctgatgcaagcattacacttgctgcttttttccacatcttcataataataatctcctcctagaaattaaaataataaactttatgtgtcatatattagctcgtagaagtatgatttgtcaagcagaaatagagtgcaatctgttttttatctatattcgttaaatatggtcaagtgatgttaaaatagatcaagttggttgttgtatctattaatctgatatcttaatacatttcgttctatggaaaaattccaatttacactttggtttgctgtcaacaaagatactccgttttaattttgcaaaaaaaaaacagtgctttcgcactgcttctcattcctgtctatatatcatgtaccttcaaaactacatacagttaaaaccaacatcatcatccaaacctatctacttttcggtgttttgcgggtcaataagtcatgctttttcatgcaagcaagaaatgcatgaccttttgacccttgtatcatacataataataaagtataagaggtgcttacaaaatccgcaacctgaatttcgcaaaattgttgtaaagtattatggaaaagtgatattatgaaactaatatttggagggttatgtgatgagcatagaaagatgcaaagtagtagttgaggaaagcttctgatatgaattatgatctaatgaggaaacagcaggaagaattaagtgaggagcatttatgggatatgatcctcagttatcaaaatataatgtttaaaacatattccggtttgccgttcacctatgaagtgagaaaaggaagaaatggtgaatatacgaaagaattatggatcgatcgcagggaaaaaagtaaaagtctggcctggagttcggtgaggctggcatttcataatataaagcagacaggagaaatagttgaaagaccgaaggctcttggagatatcaggggcgttacctacatttatggaatgttttatcaatttggactgatcaatgtaccggataaagtgaaagaaaaaatgcatacataacactagtttatgtttaaaaatataaagttaataaacaaaaggaggatttttaatgagctcattttacgcagcagctattggaatattaagtataacagttttgacgttattcttaatattttcttatcaatatggtatgaatatatgtggtgaaaaacacaaaaattttttgtgggataagtggaatttacgaatatttttattggtttctgttttaggtttctttttttgcctatacatagttcttcaaaatcaatttgtgtactattgggattatggtggttattggactgctagttataatacgatgaatgaactttttcaaagccctatggaaactttaaaatcagtttattcgtcaattttggaaagtgattataataatattcttccgctcgtaatttcgatacctttgaaatgttttggatatacgttttcaaaatatgttatgataaattatcttttatttcttattccggtatgggggattacagtttctattatttggaaattagttctgaagtattatcctgatttaaaaaaaggaaaaaagaaacagggaatatttatatttacagtacttttagtggttctatttaatccgttttattatgcaatgttttatggatatatagatgttgcatgtttagtgccagctcttcttgcaatccttttatttatgaattatgattgtttatcgcttgataagaagcaagtgttaagagatttgctgatatctgcgcttcttcttttaacctttttgtttagacgatactttgcattttatgttgttggatatgggacagcattattagtttattctgcatataaagtaatacaagtgagagagagtaaagaatgggggaacaagattaagaatgcgtttttgaatctctttattgtaggtggagtagctacatgtattttgcttttgttttttcgacgtcttgtttttcggattctcgaaaataactatgcagatcaatacaaagcttacgatgccccttttattacaaagtctagactattgattgaaacattaggtccaattacgcttgtttttgtagtgttggcaattcttttatcagcaatttcgagaaaagctagaaaaatcacatttttttgtactactgcaatgattgtaacgataatagcattctttcgtgtgcagacaatgggggatcagcatatttatacgatagctggtgaagtttgtattcttatgatacttggaatttatcagattcttgatttaattcacagagattcttataaagtgattgtaagtgtttttctttcaattatttttgggattggatttttaaattgtttcttcccatcggtgagatcgttggttgctcctatagcaagaatatactctaaaaattattatccaatgaagaggggggatatggaatctcttcataatttagcagatgatcttaatagtttgacagatggaacaaataagtatgtctatatttgtgcaagtggatcagttttaaatgctagtgtgatggaatcacttgacaagccttatagtgatagtgcagttcataatatgtattggacagcggatgtggatttaagggatggtttttgctcaaattctctttgtgcagattatgtggtagttacaaatccagtggaacttcatctcccaaaaggaacacaagaggtagttagattcttatctgaagagataaaaaaatcagattcaccaattggcagacatttcgaaaagctagatcggagttatttacttgataacaatgttacagcttatatttataaaaaaataagtgattttgaaacctccgattatcaatacttagcaaattattatgatagttattatcctggtatggaagaaatgttttctgatagaatatgggaggcagctaagcagtgattattagtagaattctaaattttctgtatagtttaaatgcagagaacatgatggtataggtgtgtattatggaaacaaataaaaaagttatgaaaaaaccaattctatatattattatcccatgttacaatgaggaaaaggtacttcctattacgtcaaagctttttgaggatgaattaaaaaacttgattgaggaagaaaagataagtagcaatagcaaaatcctttttgtaaatgatgggagcagtgataaaacgtgggatattattgtgggcttatcaaaaaatagtgatagtttcttgggaattagccaaagtagaaatcgtggacatcagaatgcagtattagcaggattaatggattctaggaataagtgtgatattacaatatcgattgattgtgatggtcaggatgatattgctgcaatgggagaaatgataaacaaatatttagaaggctatgagattgtttatggggtaagaagtaaaagaaatacggatactttttttaaacgatttacggcagaacatttttataaacttttgaatataatgggtgcagaggttgtatttaatcatgcggattatcggttgatttcatcaagagttctggaagaattttctaaatttaatgaagtgaatttatttttaagaggtatgataccgcttgtgggttttaaaagtacaaaagtttattatgagagatcagagcgaattgcaggaaaaagtcattatccattgaggaaaatgctttcattggcttttgatggaattacaagtctcagtataaaacctttgagtttaattacctgtctgggactgacagtatctattatcagttttattggagttttatatgcattgattgcgtatttaagaggtgatgcactttcaggatggaccagtatgacttgtattatatgtacgcttggaggaatgcaattaatctgtctcggaataattggccaatatattggaaaaatatatatggaaacaaagcatcggccaagatatattattagtgaacgtacagaagatttaaaagtgaaagaaaaaatgaaggaagtatgaaacaacagaaattattaagtctgatccgtcaggcgatacaagattacaacatgatagaagacggagacaggattgcggtaggtgtttccggcggcaaggattccctgactctgctttatgcgatgaagctgctgcaggaattttacccgaagaggttcgaattatctgcgattacctgcaacgtaggatttgaagggatggattttacgggcgtagcagagttttgtaagcacctggagattccttatgagcaggtcgatacagagattgcccggatcgtatttcaggagaataaggatacaagaccgtgttctttgtgtgcaaagcttcggaagggtgcgatgtatcaacggttgggagcgcttggaatcaataagatggcatatgcacataataaggatgattttattgagacagcattgatgtcattgatctatgaaggccggttctatgcgttcccaccggtgacagaattgccggaagcgggagtgacggtgatccgtccaatgatgtatgttccggagcgaggtgtagcacactttgttgcagaccagggaatccgtgtggttaagaatacctgcccggtagacggttcaacaaaaagagcgtatgcaaaacagttgatggagcagatcaacagggagacgccaggggcgaaggacaggatcatgcatgcaatcgtgaacggaaggttccctgactggccactgtagtgatgggaaagtgattaagaaaatgcattttttacttccctatttcttttatctgtgttacactaacgaatgagttatttaacttttttgtaacaattacgaaagtgataggctcattgaaaagggaaaacaacatggaaatgcatataactatttgtagagagggatgcagatagttactgttcactcccgtgtcaatcacttcgctgattgacacggaggatgcatgttgcgcctgcggcggtcgcttgcgacacctaccttgtacgccgcagtgcgcatccttagcggagcgtttttaatatattaggaaagcactttcctaatatattaaaaagacaggtccgtccttcacctgcattcagctgtgtctgactccctgtcttttcttaagtaaacctgttcccggtacgtccggaaagcgatcttatatcttttatttatatcttacagatcgatttttcctgttgtatctccattaacaacataatatgctgctgactcttccggtttcagataaatcttaacatctttcatgtctccgactttattcttcaaatcctttgtccatacatctttgactttcttaagaatctctttctctgtatactctttaccagagaactgaaggaagaattctgtcttcagatcagctttctttgtagtcttagttgctgtcttcttagccgctgctttctttacagtctttacagccttttcagctgtatcttctgcttttgctgcaaccttcttagctgccttcttcactgtctctttcacttcttctgcctgaacttctggtgtatctaccagcactgctgcctttgtttcaagtttctttgttgtgtctttctttgtctcgattgctttcgcagctgctgtctctttcttctctgcctttactgttgctgtttcagcttttgttgttgaagatgtcttctttgttaccatacttgtttccctcctaaaatatacacccaagtatattggcactacctcattacaatgttattcttaacgcgaaataataacaagaacttttgtccgtaatgataaattattcacgatacagattattgtaactcatttttgacaaaacgtcaaattttccttgataattatcattttattcctctgaagaatatcccctgaaaaattctgaaagtccgtccaatgtcttcataagaaccggaatctctttttcatccagtctgttcagcacagcatttgtcatctccctgtgaaactcctcatgatgatagtaagccttctcccctttttctgtcagccagatatacaccactcttcgatcttcttcaccgcgggcacgcattacatacttcttgtttaccagcccattcaccgctgtggtcagagaccctgccgtaatcttcatcttttttgccactacagacatcgttgtctttcctgaaacaccgattgcttctattatatgcatatcgttgtttgtgatgtctttaaactcctctgtaatgattgcctttttctccagctcccagatttcattaaataaatgtaccagaatgtcattgatggtattatacgcatccatcttttttcctcctcgtcttctactgttctctgatctcttcaaacagctcttctctattcaatcttccgggatcactttcattctggtctgctatcttaattcagacaataccatgttttctatctcttacattcgacgaaatctgtcgtatcttctatctgtcagttgtttttctgaaagacttccatattgttcaaggaaatgttccatcttctcttccagttcacagagtacaggaaccatcgtatcttcccggtacacttcaggctcgcaaattatttcttcgatcaccttaagttccttaagatctgctgctgtcagacgcatcacccctgccgcctctgacgctctcttgctgtctttccacaaaatgcttgcaaacccttccggtgaaagtactgaatacactgcattctccatcatccacacttcatctgcaactgcaagtgcaagcgcaccgccgcttccaccttctccgattacaattgaaagaaccggcactttcaaagctgacatctcatacagattccgggcaattgcctcaccctgtccacgctcttctgcctccattccgcagaaagcccccggagtatctacaaaacagatgaccggacgctggaacttctctgcctgtttcatcagacgcagtgcttttctgtaaccttccggagacggcattgcaaaattccgttccagattctctttcgttgtctttcctttgcactgggcgatcacagtaactgcttttccatgaaaatacgcaattcctcctactactgccggatcatccttataatatctgtctccatgtaattctacaaaatctgtaaacaatctgtcaatataatccttaccgaccgggcgttctttttccctggatttcagaacacgctcccaggctgacacattttcttttactgcagatatgttttttctgttctcttttttcttttccggacattcttctttcttttcatctgtaaccgtatgcattttcagaatctgccccagtacttccttcatctcatccctggttacgatctgatcaacaaatccatgctcaagaaggaattcagctctctggaatccttccggcaatttctgtccgatcgtctgctcgatcacacgcggaccggcgaatccgatcagtgctcccggttctgcaagaatgatatctccaagcatagcaaagcttgctgtgacacctcccgtagttggatcagtcaataccggaatataaagaaggcctgcatcactgtggcgtttcagtgctgctgaagtctttgccatctgcatcagggaaatgattccctcctgcatacgtgcgcctccggaacaggtaaaaagaacaacaggaagcctctcctctgttgcacgctcgactgcacgggtaatcttttctcctaccgcatgtcccatactggccatcataaatcttccgtcacagaccccgatcacaaccggatatccacagattgttgcttttcctgtaacaaccgcttcatcaagtcctgtctttactcttaaagcttcgactttttctgtatacccccggaaatccaacggattctccggtctttccccttcatcgatctttgcatcccattcttcaaaagagcctgcgtctgtcacaagctcaattctcttatatgccggaatacgaaagtatccatgacatttaggacaaatatattttccgttgattacttcatctgtcaagattgccgcaccgcatttattacattttttcaagattccttccggtgcttccggctttcttctgtttcgtgaatgaatcgaagtgatcttctctccggtctttttaaacatattatgcagtctcattcatcattcctccgataaactccacatcaatatctccagatatgaattttttatgattcaaaatctcatactgataatcaatatttgtatccacaccttcaataataacttcgccaagtgcgcttctcattttacggatagcctcttctctatcgtcagcatgtacgatcagttttgcaagcatggaatcataataaggcggaacttcatatcctgtgtaaatcgcactgtctacacgtacgccttcaccacccgggaaatgtacatctgtgatttttccaggagacgggcggaaattcttttccgggttctctgcattgatcctacattcgatcgcgtgacctgtgatcttgatgtctttctgctgaagttttagtctctgtccgtctgcaatcttaatctgctctttgatcagatcgattcctgtcacccattctgtcaccggatgttctacctggattcttgtattcatttccataaagtaaaaggctccactcttttctaagagaaattcaatcgttccggcattcgtataatgagctgccttcgccgctttcacagccgcttctcccatcttctgtctcaattccggtgtcagtgcttctgacggagattcctcgatcatcttctgatgatttctctgaatggaacagtctctttctccaagatggaccacatttccatacttatctgcaagaatctgaaattctatatgacgcggatgttctacaaaatgttccagatacattgttccgtctccgaatgccatctgcgcttctttctgtgctgtctggaaacttgcctggaactcgtccggtgtctgtgcgacacgcattccttttcctccaccgccaagtgctgccttaacgatgattggataaccaatctcaccagcgatcttctcgccttcttctacggtatagacaggctccttgcttcccggaataaccggaacacctgcttccaccatcgtatttcttgcaacggatttatttccaagagcactgatcacctttgaatccggtccgatatatgtgatcttgcactgttcacacagttctgcaaatttgctgttttcagaaaggaatccaaatcccggatggattgcatctgcgccggacacaagtgttgcactgatgatattctgcatattcagataactttctgcggatggagcaggacctatacagactgcttcatctgcgagctgggtatgcagcgcatctttatctgcctcagagtaaacagcaaccgtacggattcccatttctctgcaggcgcggatcacccggactgcaatctcccctctgttcgcaattaaaatcttctctatcatttcttctgctcctgatttttttattctccaaccataaatgtaagttctgccgtaacaacgacctttccgttaactgttgccacagcttctcctacgcctaccggtccttttcttttaataatctttgtttctaatttcaactgatctcccggaaataccattcctttgaagcgacatttttgtacaccaccgaagaatgcaatctttccctgattctccggtacacttaagattgccacagctcctgtctgagcaagtgcctcaagaatcagaactccaggcattactgctttctgtgggaaatgtccacgaaagaaatcctcatgataagaaacacctttgtatccaattgcatattctcccggaacataatcttcaatcttatcaatcaaaagaaatggatgtctgtgcggaatgatttcctgaatctgttctacatttaaactattcatatctgaattcctttcttaaacaattctaaaaatcggctggccgtattctaccggttctccgttctctacaagaacttctgcaactgtaccggcacattcactctcaatctcattcataagtttcatcgcttctatgattccgacaacctgtccggcttcgaccttgtcaccaaccttaacaaaactcggtgcatcctctgccggtgctgcgtagaaagttccaaccagaggtgaaacgatcagttcaccttctgtttcttttatcacttcctgatgctcttcctgtgtgtgatccgcttcatttcctggattttgcagaatttctgctgtctgaagacctgctgtgacagttcctgtcaccggaactactcccggactctgtataatctccaccttctgctgttctttcttcagattcagctttgttccattttcttcatatttaaaatctgtaagctcagaagcagagactgcttcgatcagcttcaatatttcttccatcttcatcttcgcttctccttattcttcgaaacgttttacaagaagagacacattgtgcccaccaaacccaagagaattagaaattacacaattcacttctttctctaccggtgcgcctactgcataattcaatccacattccggatctacattctttgtaccaactgtctgatggatgaaattatccagaatactctttacgcagacaacaaattctactgctcctgctgctccaagaagatgaccgatcatagattttgttgaattgacaactacattttcggctgcatctcctaatgcataacagatcgcacgcgtctcaaagaggtcattgtgatgtgtacttgttccatgggcattgatataatccacttcttccggtgccacaccagcctctttcattgcaagtttcatcgccattccggctccttctccattttctgccggagatgtaatatgataagcatctcctgtagagccgtacccagcgagttctgcgtaaatcttcgcgcctctcgctttcgcgtgttcaagttcttccagaactacgattccggctccttctccgaggacaaatccatccctgtcctgatcaaacggacgggaagctgtcattggatcttcatttgtagacagtgctgtcaacgcagtaaatcctgcaattccggtcggacagatacagctctctgtcccccctgcaacacaaacatccaagtcaccatactgaatcgcacggagtgcatctccgatactgttagatcctgatgcacatgctgtcacgacatctgtacattttcctttcagtccaagctgaatggatacatttcctgctgccatattggagatcatcaaaggaaccatcaatggatttacacgcgctggtccttttgtctggatcttgtcgtaattctgctctacacagctgagacttccgatacctgaaccgatgattgttcccacacggtaaggatcttcctgctccatatcaagtcccgcatccgcaaatgcttcctttgctgctgcaaccgcatactgagagaacaattccattctctttgctgccttgaaatccattcgttcttttccaacgaaatctttcacttctgctgccagcttaaccttataatctgttgtatcaaattttgtgatcggaccaattccaactttacctgttttgattccgttccagaattcttctactgtatttccaatcggtgtcaccgcacccattccggttacaacaactcgtctcttcattttcctactccttctattcttacatcgccattccgccgtcgacatgcagcgtctggcctgtgatataacgtgcttcatcagaagcaagaaatgccgccgcattcgcaatatcttctgtctctccaaactttccaagagggatctgggctgttgctccttctttcaccttctctgaaagtacttctgtcatctctgtgttaataaatcccggagcaatcgcatttacggtaattcctctggaagccagttctcttgccgcactctttgtgagtccaatcactccagcctttgatgcagaataattagcctgtcctgcatttccaagaactcctgatacagaagacaggttaataattcttccggatctctgacgcagcatctgtcttgagactgcacggatacaatggaaagtccctttcagattcgtatcgatcacagcatcaaaatcctcttctgccatcttcataagcagtccgtctcttgtaattcccgcattgttcacaaggatatctattcttccgaattctttaatgattgtctgaaacatctcatcacaagatgctgcatctgccacatcacactgcatgatctgtgctgttccgcctgcagattcaatctctgttttcacttcctgcgcgcgctctttcgatccattataattgatcactactgctgcgccctcctgtgccagacgcagcgcgatcgctcttccgattcctctggaagcacctgtcactaccgcaactttccctgtcagtctgtctaacataattcatttaccaccttatctacgtcttcccaggttccgacgttatacactttcacctcacggtttatctttctcaagaaaccagccagtgttcttccaggcccgatctcgacaaatgtatctacaccgtccgcgatcagaagttccatactctgctgccatcgtacggaagatgctacctgacgtgcgagcagttcttttgtctttgtaatatcagttacatattctgctgtcacattcgtcacatatgggatctggagatcagaaaaatctacctgttccagttcttttccaagctcttctccggcctgctccagaagggaagaatggaacggtccactgacattaagcggaaggactctctttgctccggcttccttcagtgcatctgctgcctgttccacatcttccttccatcctgtaatcacaatctgtcccggacaattgtagttggcgatcattacaccacttcgatctgccagcactttctcaatctttccggcatccagtccgagaaccgctgccatggctccctgaccacccggtactgcattctgcatcagaataccgcgttttcttactgttgtgattgcattttctgtgctcattcctcctgctgaagcaatcgcacaatattcacccaggcttaagcctgctgtgacatccggggcgagtccccgttctcttaataccttctccattgccatacagacagtcacaagtgctgcctgtgtatattcggtctgatccagaagatcattttcttcaaaacagagtgctttcatatccagtccaagcagttcacttgcacggtcgatcacctctgctgccgtcttactgttttcatagaaatcttttcccattccggctttctgtgctccctgtcccgggaaaataaatgcgatcttactcatagaatccttttcctccgatcagttcatctgtctgtgagaccagcttctggatcacttcctgacaggtaagcttctccttgatcatacctgcaatctgccctgccatcacgcttccgctctgaacatctccatcaacaacagctctcctgagtcctcctagtgtcagatgttcaagttcttcgaatgttgctcctgcctgttctttctcaagatactctttcgtcattttattacgaagagcacgaaccggatgacctgtagatcttcctgtcacacgagaatcaatatcccttgctttcaaaatgcattctttataattctcatgcacctgtgcttcttctgtcacaacaaaacgtgttccgatctggacaccctctgctccgagcataaatgccgctgcaattcctcttccatctgcaattcctccggctgcgatcaccgggatttcaactgcatctacaacctgcggaacgagaaccatcgttgtattctcaccgatgtgtccgcctgcttctgttccttctgccaccagagcatctgctccacaacgttgcattctcttcgccatcgctacagaagcaactacagggatcactttgattccggcttccttccacatctttacatatttttccggagatcctgcacctgtcgtgacaactgcgacaccttcttcgacagccacctttgcaacttcatctgcataaggactgatcatcataatattgattccaaacggcttatctgtcagcttctttgcctcacggatctgttctctgacccactcggccggtgcacttgctgttccaatcagtccaagtccaccggcatttgaaactgctgccgccagatgatattctgcaacccatgccataccgccctgaatgatcgggtactcaattccaagtaattctgttattctcgttctcataagaactcccttcttgatcacttctctatcaacggttctctcggatcggctgccgaaaaggaaccgaaatgcttcgttttctactagttctatacttttacttgtgtgattcgatatattttacaacgtcacccactgttgtgatctgctccagatcttcagatgggatctctacttcaaaagcttcctcaaatgccattaccatctcaaaaagatccagggaatctgctccaagatcctctttgaaagatgttgtctcacttaatgtgctttcctctacgtttaatgactctgctacgatttcttttactttttctaacatgattttgttttcctttcttgaatttaccattccatcaggcatcctgcccatgtaagtcctgccccgaatccggcaagtataattttctgacctcttttcagctttccatcccgattcatttcatttaaaaggattggaactgacgccgccgacgtattcgcatattcaccaagattcattgggaacttctcaatttctacgccaaccctctttgcagccgcttcaatgattcttctgtttgcctgatgcaaaacaaagtaatccacatcttctcttgaaacatctgcttttttcaacatttcttcgatgatttccggtacttttctcacagcgaacttaaaaactgcctgtccatccatccgaattaccggcgtttcttctgttccatattgtaaggtcaatgcctctcctttgtctcctgccgaatgtgccatggccgcatagacggcttccacactttcactttcttctccccggagaaccactgcacctgcaccgtctccgaataaaatgcaagttcctcggtctttccagtctacaattctgctcatcttctctgcaccgatcaccagtgcagtcttaacaagacccgaacggatataagactgcgccgtattcaacgcaagaataaatcccgaacaggctgcattcagatcgtatccccatgcatgaactgcaccgattgctttttgcactttacaggaagtattcggaaatactgtttctgaagaagacgtcgctacaaggatcaggtcaatctcttctgctttcagcccactgtctgcaagagcttcttctgctgcttttgcagccataaaagataccgtctcctgttttgcgagatgtcggctttgaattcctgtgcgttcccggatccattcatcacttgtgtcgaccagagaggacaattccacgttgtccattcgatgggacggtatgtacgatcctgtcccgcatattcttcctatcatatctcttctccaactctgtcaaaataattgtcactcttcacagtatgattctttccagatctgaaccataattgttttgacctttaaatactttgactatcaaagtatatcataaataaaatagatgtcaagataatttttagacagattttctctttttgtctattagttactgttcgcacgatgttactgttcactcccgtgtgaacagcaatgcatattttatttgaatctgtcttttctgcgcagtataataaaataagcatctatagaaagggaatttgtcatgaaatacaagaatattgtttttgactttggaaatgtcatcggacgttttgatggaaaagcgatcctctcagaattctgcccatatgaagaagaactggattatttatccgaaatcgtttataaacgctgggcagaacttgacgccggcacacttgattatgatagttacataaatgaagtcatcgatcaggttccggaacatttgaaggactgcatccgccggtttgcaacagaatggccacgctgcactactttacttccggataccattacatttatccatgaattaaaagagcgcaatataccaatctatctgctgtctaatgctccaacctattttgcagaatactatgaaggaagtgaacttctttctcagtttgacggaatcttattttccggaccgatcagacttgcaaagccgtctcctgaaatctacagtcattttctcaggaaatttgatttaaaggcagaagaatgtttctttattgatgatcttgagccaaacatctatgcagcaaaagaagccggaatgggtggacttgtatttactggcgatatcaatgaagtaaaaaaagcaattggtttctgatccaattgctttttctattcgctcctgcttcaatcccttatcgattgaacgctttgaattctctctgcgcttcacgcttctgatctttctttgcgatcgtctcacgcttgtcatataatttcttacctttggcaagtccaatctcaatctttacaagacttccactgaaataaacctgcagcggaacaactgtaattccctgttctttcatcttaccaaatattttcagtatctccttcttatgaagaagcagctttctcacacgaagcggatctttgttaaagatattccccttctcataaggactgatatgcataccatagatatacatctccccgtcttccacacggataaatgcttctttgatactacactttcccatacgaagagactttacttctgtgccatgcagcacaagtcctgcttcgtatttctcaagaataaaataatcatgatatgcttttttattattcgcaataagttttttctctgtctttgccatctgattccaacctctaactcatctattttaaccgcactcctgcaagtattatgccagctcgaaattaatcgttcgtagcagcttatctgcatcacttacgcggacacgcaccttttcaccaagtttatatgtctttcctgtatgctctccgaccatttcatatgtctgctctataaaattataatgatcgtcccgcagatccacaacatgaacaagaccttctactgtattcggaagttctacatagattccccattttgtaacaccggaaatgacaccttcgtactcttctccaatatgcatgcgcatatactctgcttttttcatcttcacaacttcgcgttctgtctcttctgccagtcgttctctgtcactacactgcttcgctacttccgggaggatcttgtcataatgttctatacgattctcattcagtcgtccgcgcaggttctccttaatgattctgtgaatctggagatccggataacggcggatcggagaagtgaaatgtgtataatacttcgctgccaatccaaagtgtcctgtattatctgttgtgtattttgcctggcacatggagcgtaatgtaagtctgctgatcagagcttcttccggggttccttccacctgactaagaagtttctgaatctcctttggctttacttcatcatgcacatgaatatgataaccgaaattattgataaatgtactcagtttctttatcttctcttcgtctggaacttcatgcgttctgtagagaaatggaacctctctccaaaaatattcttctgccactgtctcattagcaagaagcataaaatcttcgatgatcttcgttgcactgtttctctcataaggtttgatattaattggtttccccttctcatccaattcaatctttgtctctggaaaatcaaaatcaatcgaacctctcttgccgcgtcgttctctgagaatcgttgaaagttcctgcatcttctgaatcatcggaacaaaatccttatcttcttccagtgcttccggttcttctgccagcaccttagatacacctgtataactcatacgcttgtctacccggatcacagtctccgcgatctgatgatcgatcacctcgcctttcggagacactgtcataatacaggataatgccagacggtcttcccctgcattcagagaacagatgccattcgacaacacatgcggtagcatcggtatgacacggtcagcaagataaacactcgtcccacgcttcagtgcttctcgatccagagcacttttctcctgtacataattggtaacatccgcaatatgaactcccagctgataattctcatccttcattgtcagagaaaccgcatcatccagatccttcgcatcttcaccgtcgatcgtaaccatctgccagtcacgtaaatccaatcttcctgcacaatctgcttctgatacatcttttccaacacgaaccgcttgattcaataccttctccggaaattctgtaggaagatcataatcctttacaatagataaaatatctgctcccggatcattcacatgaccgatgatctcaacaatctttccttccggcttagcatgttcctgtccataagatgtcagttctaccacaaccttatgaccgtccatggcacccatctcttttccggccggaatataaatatctttcagatatctctgattatccggacgtacaaatccaaaactcttactcttctcatacaatccgacaatcttcttcacctgatgcgacacgattcttacgatttttccttcttttctcttacctccaggcgcacctgtaataatacattccacttcatctccctggaatgcaccgttcacattctctcccggaataaagatatcctcatcttcaccctctagcataacaaatccaaatccacggatattcgcctggaaggttcctgtgatacgcttcgtctgccctttactgtattttcctcttttagaaagtgtaatcttcccttcctcaacaagagcgtccaacacttcctgaagctctcttctctgttctttcgatacctgaagaactgtcgcaatctctttgactttcattgggatataaaaatcatcacaaataaagtcataaatcactttttttctcttttcaaatgtctgatccattctgtttcctttcatcgttactgttcacacgatgtgcgaccagcaacgcatctcgccattttaaatcgcaaaaaacagccggaaaaagcttttatgaaaggcttcagactggtatcggcacttgcaatctttctgggagcaggaatggagatgtctcttttgtgggatctttccgatgtactgatgggggttatggcgctcattaacattccggttatcctgattttatcagggattgcgtttaaagcgatccaagattatgaagtgcagttaaagcagggaatcaacccggtttttaaaagtgcagacatcggtcttagacaaaaaacagatttctggagataaaacaggataatgggggagactgtccgaaccatcggataatctccccccaatttctacatcctctattttataactaagactttctgtgttttaatggatagctttttactttttgttactgtggtattttttatagaaataaatataggatattccacctggaatactgatccagataagcattgttacaacagacacaatctcaaaatcagaaattgttaatgcacaggctatatacagcaataccatcggaaatgaaataaatcctaaaattctatgtgcaatcttccaggtatcttcatcacgcacagtccatggcaaacgaaggccggtatgtctgttatatggcaacttcggcgatacaatacctataaaaaccattatgcaagacaataataccatagcaaatagtttctctccattttccgaaaaagtaatgacatcaactgcactcagaaaagcaaaaacaataccaatgattaaaatgctaatattgcaaagtgtggtaacacggaaaataccaattcttaaatcgtcagttgttagacttgtaaacaaagccaaattacgatacagtacgatagctgcaatcagcatacatattcctgccattagaattgatacgacttcatttttcacactcattgtaatcatcatagataaaaatgaaacaaacagaatcagacctcttttctggtttgcctgatacaacaacttttctttttgcttttttcttgccagctgttcatttagttccgccaattcttccgccaaattcccattactatggatactctcctcaattccaagcaattgactaaccgatacatcaagcaaatttgccatttcaatcaaaacatctgcatccggaatagataatcccttttcccattttgaaactgtctgccgaacaacatttaactttactgccatttcttcctgactcattccccttgtttttcggaaatgctttatattctcattaatcataatttcatatcccttctattcgatatgtacatgtacattataaattatacgaatatgctgtttccgatacaagcaatggaaattaacattggctattttttctttacacttaaaagttaatttgtgaatacccgataattctcttccttatcgtaatccttgtggattccatcatcctcatacatcgtataactgctgtttttatatccgataagctgcagatgttcggtatcaatatctttcacacactctgccacttctgcaaccgggatgcatttaccacttcgaatgaaaaacggtacttcatttagtgccacatctacataatgaataccttttgcgagaacctcttcagaaatgcttccgtccggcaggaacttgataaatttcatttcttccggcagataaacataacggcctcttgcgttctgctcgtagaccggagcgatcatgatctcgtttccaagcatcagctgatcctctatcctgattgctctcttgtcatccggataaacaaacccaagtggtttgaaatacatgtcatcattcagcacagctttcatgtactcactgtacaaatacggcacaagacgatatcttgtattaatgacagcgcggaaatcctcgattttttcaaattgataacattcctgctctcttgttcccgttgctgaatgattacgcatcagtggtgtgaatacaccaagtgcaagaaaacgaagcaacagttctcttgtcgtatcactgccaaatcctccaaggtcagcacctgtatacaggaaaccgcacatattcagagacggcagcatcttcaggttaagaaggatatgcgaccaccaggatttattatcgcctgtccagattccgccataacggtgcattccgatataagaagatctggaaaacatcagaaaacgtttttccgggtcaatgcgttcaaaagcttctccggccgctcttgtcatattgtagccaaaaagattatgtactttgtcatgacggatctttttgccatcgacattgtgataaaatcttttgtaatcttccggattatttgcaatactgagcatcttgtcctgcatttcccagggatgggtcttgccttcggtatcctttgcaaactctccggcaagttctcttgcctctgcaaggccttcggaagaataaaagatcgcaggctcattcatatcattccagaaaccttctattccctgttcaatcagaaaacgatatttgtccccgaaccattttctggcttccggattcagcatatccggaaaatgggtatctcccggccatacagctgcaacaaaatcacttccgtcttctctcttgcagaaatagttgtttttgacaccttcctcgtaaatctcatatcccggctcaaccttgacaccggcatcaatgatcggaatcaggcgaatatcctggtcatccatttcctgcacaaattctggaaaatccgggaaattttcttcattcactgtgaaatctttgaacgactgcatataatcaatatccatgtaaatcatatcgattgggatatgattctcccgatatccttttgcgacagtacggaaatcttctttcgtcgtatacccccagcggctctgtccgaaaccaaaagcaaactttggcggaatataactgcgtccaattacgtgacggaactgttttacgatatcataagcattctcaccttcaagcacatagatatccagattggcattttcgcaggataccctgagtgtatcctctctgtcatatccgatatcaaaggtcagtttcgacggatagtcaaaaaacaatccaaatgtagtctttccactcacgatgataaagttgtgtgctccgtacaaagaacgcttgtcctctgtatgtaccggatcatctgtgcaattactgatataacaataccctctcttgttgattccacgattggcttcacccagaccatagacaatgtcatcttcatccatgatataagtaaaaacaaatccttcctcctgactgacctctccatatgggagaacgccctcagttgtttcaattttttcagtcagtgcctccgtattaaacggagttccatatctatattttctaatcatttctctgtcacctgatgtttataatataatacgaatgcttcatatgggttcagaataatttttccgtcgaattcttttcttccaaggtttgtgatcagacactctgcgcctttgaattcttccggcacttctacttctgcattcttgtcactgaagttgcagacagtcagaagtttttcctgatcctgttttcttgtgtaagcaaaaatttgatcatcttcacgataaagcggttcaaattcgccataaacaataatgtctttctctttacgcaatcggatcagtttctgatagtagtggaaaacagaatccggatcttcaagctgctgtgctgcattgatcttcttgtagttcggattcactttgatccacggctcgccctctgtgaatccagcctgtttactgtcgtcccactgcatcggagttctcgcattgtcacggcttctcagcatcagacatttcatcatgtgttccggagtcataagacctgattccgtaaactcttcaaagtaattaatactttcaatatcacggtaatcttccagtttgtcaaaataaacatttgtcataccaagctcttccccctggtatacatatggcgttccctgcatcatgtgaatacaggtagccagcatttttgcggatgtttctctgtataccggattgtcatttccaaaacggctgacgcttctcggttgatcatgattacctaaaaacaaactgttccatgctttaccctggagtttctcctgccatttgatcatgatgtttttaaactctttaaaatcatatttttgagttgtccactttccataatctccgcatccactctccacatgctcaaattggaataccatattcagttcatttctgtcttcacccgcatatttctgtgcttcttcaattgtaactccagctgtttcaccaactgtcatgatatcatattttgaaaggacttcatgattcatttcctgaagaaattcatgaactcttggaccatgtacgctatatggtccaaaatcgccataaagtccgttattcatttctccatccggaaatctctgatctttggaaatcatactgataacatccatacggaaaccatcaattcctttttcacaccagaatttcatcatatcgtaaacttcctggcgtactttttcattttcccaattgagatccggctgtttttttgaaaacagatgcaggtaatacatctgtgtctgcggatcatattcccatgcagaaccgccgaatgctccgccccagttattaggttcttttccgtttaccgggtctttccagatataataatcacgatatggattatcttttgacttgcggctttcaataaaccagttatgttcatccgatgtatgattgactacaagatccatcagaatcctgatggatcttttgtgtgcttcacacaacaattcctcataatcctccatagttccatattcttcataaattctacggtaatcagaaatatcataaccattatcgtcctgaggtgattccagcatcggagaaatccataacacatttaccccaagttctttaaggtaatcgagtttctgtatgattcctctgatatctcccacgccatcaccgttactgtctttaaaactcttaggatatatctgatatactacactttctttccaccattttttctccatgccaagtctcctcatttctaattatttgaccgctcctgcaaccacaccattcattatactcacctcatccttgcagtatcaagaggtttctcgcgaaactacaaaaggtaacaaagtttatttcctgcttttatacagtttatacaaagaaaaacaggtcattgcacctgctcgcctatatatgcaaaaaaaggatcctgtcattctttgacagaatccctctttaccagatagactgggttttttatatttaattcgttcagcgtctctccctgaatcaatttcatcagacgttccaacgccacatgtgctttttgtggaatatcctgatgaactgttgtcagtttcggtcgaatcatgctcgcgtaaacactgtcatcatatcctgtaacagaaatctgctccggaaccatgattccttcgtcaaaaaagaaatttattgcttctatcgcattataatctgaagaaaaggccagcgcttttgcttcaagaaagcgtggaagaagttctccgtatttcctgagacgaagatttcttttacccggaataactatatatctggaacgactgcagaatcccccttgtttttccattgcctgtttgaatcccatccaccgatagtaatcgctgtcctgctctgtttctgcaacaaacaatgctttcttatatccacaggaatacaggtattctcctatctgatacccgcctgaataatcatctataccaacattctggaatgtataagtccccttcggataagcatcgatcaaaatcatttttttgtttaatctgtgcgaaaggttatgatactgctcttcattgtatcccaggataatcaatccctctacattccattttgaggcaatatccactacattctgaatgctttcaccgccaataagcataacataatatccattttcttccatttccatctgaatcgttccgatcagttctcccacgaatggatcctgaagtgactgcataccatgagcgtaagtaaatccgagtactacgcctataattttggaaccatgaccggaaagcatcatggaatccatattcggaacatagttctgttctttaagaatagccgtgattttatcgatcgttttctgggaaactcttttcgtattgccatttataacattggataccgtggtgcggctgacgcctgccatatctgcaatatcctgaagccgaatcataaaaccttcctcctgtattcttatttccttacaatactgtttcctgcttatttgtactcagatactttcgtttctgcaaaagtcattttcgcttatatcaaatttataatatcataggcagttaggtttgtcacataaaggtttgcaatttcaaactgcaagaccgctgtaattgcgactgataaaattaaccattgtctccatgaatatattagagatataatataaatactggtatctgatttttctgaatactaagtatctaaaaatggggaatgataaatgaacaaacaagagaaacagattttcacatcagacaatttgaaagaaacagccatcatgacgatagcagtgggcattatcgccgcggccgtatatttctttttgattccgagtatgacctcgatcagcagtatatccgcactggcaattgttatgtcgcattatataccgttgcatgtatcaacgatcacaatgatattgaacgttgtcctactgctgataggctttgtgacatgcggaaaggagttcggagcaaagacggtttacaccagcatcctgctgccggtgtatcttgcagtatttgaacacatatttccggattttacctcgctgacaaacagcagtgaactggatgtaatatgctatatcctggtcgtaagtatcggcctcagtattttatttaacatgaatgcatcttccggcggactggatatcgtagcgaagatcatgaataaatatctgcacatagaattgggaaaagcaatgtccatctcgggcatgtgtgtggcactttcttccgctctgatctatgacaaaaaagctgtagttttaagtgtgcttggaacttattttaatggtattgtgctggatcattttatctttggccagaatctgaaacggcgtgtatgtattattacaaaatacgaagaagaagtccgtcagtttatcttgcatgaactgcatagcggagcaacattctacgaggcgacaggcgcatacaatatgcagaaacacagagagatcattacgatcgtggacaagagtgaatatcagaaactgatgaattatattatcaagaaggatccggaagcattcgtgacagtgtatacagtatctgatatgagatatcgtccaaaggtaagatccttttaggcgggaagaagctctacagaacactttacgcagctgcttgaatatctgaacagaaaagagtcgcagcctgttccatcagggaataactgtgactctttttattttgtcttccaattttgtgacattacttcacaatatccaactgcccgacaattccgatatatccatctgttttcagtgatgaccataatgtgtgcagtttcagatcacacatctgcctttcacctcttacttttaacattactttcattgaaacttctttgtttttacttgatactgaatccagcgaatcttttacacgctgaatatcctcttcgcttatatcatatgctccatataaatcaaattccagattatctctctgatattctttctgcgattctccgtctgtcaaaaccagctttcctgagatcgcattatattccattgaaatcttaccgctattctccttaaagaactttatcttttcctgcatgatctcaataacacgctgggaatgatccttgcgtggcaatgcattttgcctcagtatttcttctgagatcctctgcgcttcataatactctctgttgtcatccttttctttcttaaatgttctggacaactgaggactgatctctttcaggcattccagaagaagcggattaaactgtccgcactgaccttccagaatcatctggattgccgtatcatgatcatatgcattcttatagcaccgtacacttgtaagcgcatcatacacatcagcaattgacacgatctgcgcagagattggtatttcttccccttttagtccatccggatatcctcttccgtcccatcgttcatggtgccaccggcagatttcccatgcagtgcgtaccaatggcttgtcctgtggaaaatccatattccggatcatagacgctccaatctcactgtggcttttcatgatcttgaattcttcatctgtcagtctgcctggtttattgaggatttcttccggaatgctgacctttccaatgtcatgaagggaagatgctgttatgatcagagcaatctccgcttctgtcagatgatacgcatctgttttcctgatcaattctctcaacagcatctccgttgcgacacggatgtgtaatatatgttcgctgctttcactgttatgagaacctaatacattgctcaggattccaatcataatcgtgttgttttcttctttctgatagacctgatctacaaccacattgatcagtcgtttctggtttgcataaagtcccaatgtattctggactcttttctttacgataactgcatcaaacggtcggctgatatagtctgtgatccccagatcatacgcttttcgcataatttcgacagattcttctgatgaaatcatgacaaccggaacttcatcaatccactgtaactccctcatatgttccaacacctggaatccattcatctgcggcatattgatatccagaagcatcaggtcgatctccggatgcacttccagaatctggatcgcctgagttccattttcagcttccatgtagtcatatctgcttccaagaatctcctttaatatatctctgttaagttctgaatcatctacaataagtagtttttgtttctcactcatcctttatcctcacgatttttatttttcctgctaattcagcaataatcttcactaatagtttcatatcgatcggttttgagacatgctcattcattcccgcttcttttgactttatccggtcctcaacaaaggcgttcgcagtcattgcgatgatcggaattttctttgcatcacttctgtccattgaacgaatcatctttgttgcctcatatccattcataaccggcatcatgacatccatgaggattgcgtcgaattcaccggaagcacttttctcaaaagcttccactgcctcctgaccgttccatgcctttaccacagaagctccttcgctttgaatgacgaattctgcgatctccatgttcagttcattgtcttctacgagcagaatgtttaatcctctgatggaagccgttacttcctcctgcttctcctcgtctcttgctacatcttcatttattttaaatggaattgtgatcacaaaagtagtacctacgccctgctcacttataaaggtgattgttccacccattttttccaaaagactctttgtgatcggcattcccagaccggtaccgccaaacttggatgctccgcctttttgctcctgcgcaaatggctcaaacagatgtttttggaattcctcactcataccaattcccgtatcctgacatatgaactccatcattacaactccatcctgatcggaagaaatctccctgctgctcaaataaatctttccataatctttattgtactttacggcattactcaggatattcatcagaagacgcttcagatggattgggctgcctataagatctttatgaatgatctctggtgttttgtgttccaccttgatttctctttcatcagccatctttccaactacatctatcacttcatttattatttgatagatattaaacggtttctcttccagataaatttctcctgactccagtttgctcatatcaaggacttcattaaccagttccttgagaatattggaagcctcacggatttttcctctacattcggtctgtctcgacagatcatcacgataataatcgcccacatcaagcattccgcagattccattgatcggtgtccggatatcatggctcatcctctgcaggaattctgtcttcgcccggttcgccgcatcagcctttttcgctgcttccagaaggcttttttgatacttctgttctttttccttttctattttgagaatatttttctgtaattttctgtaaatcatccagattagtgctacaacaatcagataaatgaacaggcacatgatcacattttgcagaagtgtctgaaatatgatcgaatccggaacgtaagcatagatgtaatggtcactctgcttcagcataacaccgtgacaccggactccattgatcgttaagcccatcatatgcttactgtctgcatgatcttttaacttctggattgcttcatagtctgttgtgctttgtccgatcagcccggtattgtttgaagcaatgatcacgccttcatctgctacgataattgtcccatcccggtccttccgatagccattcaacaaactttgtatcgtaagtgtataattcattgcatactctgcggaagtataatagtaagtcactacaactcccggtgcatcctttcttgtgcaggcagccatatcaatataagccccgtcattatgattgattctcttggcatacaccttttcatcataaattgctgtatccagtacgatttctttttttgcgcattcttttatttccggcaataagctttcatttgtactgtattcacatactatatttccatctatatccagaattgctattcccgtcagccataactgctctacactttctttcaacaactgattatccagtgttttttcattttctatttctgcggctatatttttgctgacctgccgggttccctcaatggcacgaagcagacttttggattctgatgattcattataatgtgtatatgtggaacattgtacttttacataatttaccgtgtctaaaagatcagcctctttcttttctttgtctgcattgctgaaaaaacatacagacagcacgacaagacatatcccaacagctatactgatgatccagaatttcttttctgttgggacagattttttattcttcttcaagctggtccacctccagatatttttctgggtcatcaagatattttcctatgattttttcagaagttccgtcctctctcatttcatccagagtctgctccagtttctccggcagatcccgagtttcattttttgagaaagcgactccgattccaactgtcataagtggttcatccagaattcggaatttcgcatcataatctttcatatactgtataaccgattcctcatgtgcacctattgcatctgcatatccctttccaaggaatgtatagatcagttccctgtgttccaggctgatcagattaccaagctttggaatcctgctgtctgttcttttcagaaaaattccttccggttttgttgtagattgtacggcaagtgtctttccttccagatcactcagggtatagatatcactgttctcattgactgcaaccacctggttactgaccatatacggaccgacccatttataatcatccaatcgtcctttcatggagaagcagcccataatacaatcaatatcaccgttctctaccagctcttgcttcttctcccagtcaatattgacaatttctacgtcataacccattcgtccaaatgcttccgttgccagttcaacatcgattcctgttggtacaccatcttcattcagataattatatgggggataactgtcgcttccaagctttataaccgagcgttccgctgtgtcagatacttgatctgtttttccacatccagaaagccctgttatcagacatgtcagcataagacatgcacttatcactttctttattgtcatatacttttttccttttgaaatcaaaaatgtggtaactgttcagagccaacctccaaaatgctacgcattttacacctgttttatgaaattttgcttggctctgaacagttgcaaaatatgattctattatatcttgatattattctgtacacaagaaaaacctgttactgttcacacgatgtgcgaccaacaacgcatattgcgcaaccatattgacattcctttcacagggtgtcataatacttgcggagatagtatttggaatactacaaaactatactctgactgaatcacaacaatttcatattgaacagttaccccgccggaaatggcggaaagcgagcttatatttatttaagacataaaataagactcagggaatacgaagaatagcaaaagcatttgcagggaccagtatgccttgacgaatgctttttttgtaaggagaccaataagaaatgacagttgagatgttaaaaggaaagattcatcgtgctacagtagtacaggccgaacttgactatgttggaagtattactgttgatgaagacctgctggaagcggcaggaattatggaatatgagaaagttcagatcgtggacgtaaataacggaagccggtttgaaacttatacgatctgcggcaagcgcggaagcggaatgatctgcttaaatggtgctgcggcaagatgcgtaagtactggtgacaagattattatcatgtgttatgcacattatgattctgaagaagccaaagaacataaaccacaggttgtttttgtagatgatgagaataagatcagccgtgttacaaactatgagaaacacggattactgaaagatatggcataactgcaaaagtgattgtaacctataaatgaaaatgaaatttgttgaattcagaacaagaggctatctcctaatttagttttaaaaggagaacaccatgaaggtaacaaaaacagtaaaggaaacaagagatttaattaaaaactggaaaagagaaggaaaaacaatcggtcttgtaccgacaatgggattcctgcacgaaggacacgcaagcctgatcaaaagatgccgcgaagaaaatgatatcgttgttgtatctgattttgtaaacccaacacagtttggaccgacagaagatctggaagcatatccgagagatttcaaacgtgacagcgaactctgcgaaagccttggagctgatgtcatctttcatccggaaccggaggatatgtaccatgatccacatgcctttgtaagtattgatactttatcagatacactgtgcggtaagacaagaccaatccattttaaaggtgtatgcaccgttgtttctaagttatttaacattgtaacaccggacagggcatatttcggtcagaaagatgcacaacaactggcaatcatccgcaaaatggtacaggatctgaattttgatatccagatcgtaggatgccctatcatccgtgaggaagacggacttgcgaaatcatccagaaatacatatttaagtgaagaagaaagaaaagccgcactttgtctttcaagagctgtaaaagccggtcagaatatgatctgcaagggaagcaaagctgaagaagtattaacaaagatgcgcgagattatcgaagctgaacctctggcaaagattgattatgtatctatggtagatgcactggatatgcaaccggtagaaatcgtagaaaaagatgttctggtcgctatggcagtttacatcggaaaaaccagactgatcgacaactttagctacgaggtatagcatatggaaaatgtgatgaaaaaagtaggaaaagccagttcttttcttacaaaatatattggaattattatcatctgcttctctgtgatcgcatttttctggcgcgacgggttcgcgtggacaaccaattatacatccatctttttaggtgttgccatgtttggcatggggcttacaatcaagatggacgattttaagagagttttttcaagaccaaaagaaatcgtgatcggatttgttgcacaatatacgatcatgcctgttgtggcatggggattatgccagctgatgcatcttccgacagatcttgcactcggcgttattctggtcggatgttgtcctgggggaacagcaagtaatgtgatcacatatattgccggaggtgatgtggcactctctgttggaatgacgatcacttccacgcttgcggccccactgatgacaccgttattagtgtatctgcttgccggtgcctgggtagaagtatctttccttgcaatggtaatttctgttgtaaaggttgtactgattccggtccttcttggtattttgataaactggatctttggaaagcagattcagaaaatatcagaagtacttccactgatttctgttgtatccatcgtaatgatcatcagtggaatcgtatctgtcaatgcagaaaaaatcttaagctgtggtctgctcgtacttggagttgtggcacttcacaatctctgcggaatgggcatcgggcttgaagcagcaaaacttttacatatcgaatatgataaagctactgcgattgcgatcgaagtcggaatgcagaacagcggccttgcgatttctcttgcaacagctaattttgcagccaatccactggcaacgcttccgggagcgatcttcagtgtatggcataatatatcaggctctttattcgccggaatccgccgtggcggaactggtacgaaagaagcttgcctggaagtaactgaatagataaaagaaaagcaaacgaggataggaaactactttctccatccccgtttgcttttctttaatttcctaatactactgctatcttaatctctttctctgtatcgctaagatccaatgatcctccatcttctactgtaacatgtacttcgtacaatgtatcttccgacaacttctctggtgtctttccatcttctgtctgaatcttccacagatcttctggaacctctgccagcttaccgtcttttccataagcatacagcttaaagtcatccgttttgcctgcaagccccttcattcgtatcgccacagtcgtactcggatgtacattttctaccgttatcgtattcagccatcctgcgacattacccttacctccgtcttccgtaaattcttcctgcgttaatatatttcgcattgccttgtccaaatctacttttcggtaaggcatttccggaagatatacgaaccgatcctgcagtctgaggagttcaagatatccggttggacagtataatgcatttccactgcttcctgcatacataccgattgccatattgttatatcccggtttgtctgacacgtccattgaaaatgcagtctcaccggtctcaaaatcgatcatgataaactgccacatgccactgtccaggtcctgaacataaccgtaaatgtatcctgtagcggttgaaagcttcatcatcgatgtatcccggatatcatctctgcaccagatactcttcatttcatatccgtcatctgtcttgatcgtgtcaacacgctcaactcccggcatgaccattttatttcctttctgcagccagtttacatcatagatattttcatatgtctgtacagatgaatcgttatctgcgtccgcaagcttcgcacttcctgctccaaaccagttacatacgattgtgctgactgtaccttcactgttatcatatacgattgctgaattttctacggatacctgcatttcttccggcagctcatcaataacaggtgtgcttgcaaccttttcaccggtcttcatatctaatgccagtagattcaccggattctgattatctgtaaacatgaccagattgctagttagtgacggcgaacatccacttccccacgccagacctcctccggtcgtttcatcaccttctttgctgtcttttgcccctgcactttcatacggagtacaccattctacctgtacaccgttatctgctttcagcagatagcagttctgatttgttaaaatgaccgcaccctctttcgaagaagctattccattttctgccccttctccaggagttaattcatatacaaatgtagatgctgtcagatcaacctcttctccattcagaattgcgttgattgcatctctggaaatgtatcccatcgcaccttgctgctgacgttccggatagattctgaatccgccggttgcaaaccagagattcccctcatagtcaaacactacggataataaattctgatccaatgtctttccggtaattgcctctgccgctgctttaatatcaatatccagcactttttcaaattccggcagcacatttccttcctcgtctgttgctttcaacataagtacatgattgttgcttgtcggacacaccagacgattattttcatcaacaaaggaataggaactttgtatcacatatcctccaccgtcatgctgttttggtgagaaatatcctatcgtctgtgtttcttctgcattgatatcacgaattgcaagtcctcccaacaacggaacaactgaatgtccataattgtcaaaaaataccgccggagatgcattcgaattcaccttttcataagaaacattaatttctgggtaaataccaacaggcaatacctcatctgttgaatctgaattataacaatcatggtggatattcgcatcattttttgccatataaggattctcatcgattgccttttgggtaagcggttttattgttactcctgagctcacgctttctgtttttgtctgttcctgtttcacctcatctgtctttggttcattcgctgaacagcctgatgtcattgcaactgctgatataataaatgctaaaagaattgctcgctttttcatattattcgtcctcctttttctcgtaatctgtaactgttcagagccaagcagaatttcataaaacaagtgtaaaatgcttgcatttttaagactgtttttgaaattttatttggcggatacgtgacatacttctactgcgcacctctgcaatcctgccggaggctatatcagctgggagatgactcccagctgatataaatatagagtattgaatccaccgcctgttttccctataataaacttatcaacaataaacgttattttttacgagattttcaacattttcatctcatcaaaacacactttgtgaagataacgcttacgaaacggagaatttattatggaatttcagaagatcagttccccttccctgagggatctgtttattgaacaattagaacatctgattctttccggcaagctacaggtcggagagaaacttccgccggaacgccagcttgctgaaatgatgcaggtcagccgtgcggttgtcaacagcgggatcagtgagctggagaagaaaggattcctcaccgtaaaaccccgcagtggaacttatgtagcagatttccgcagaaaagggactctggatacattgattgcgatcatgaattacaacggcggacgcatgcgtgatcaggagattcgttccatcttcgaagtccgcattgcgcttgatacacttgctgcacagctcgccatcgacacgatcagcgacaaaaacatccagcgtctcctcgaattcgttaatcagatccgtgatgcacaggatgtcaccactgccattgaagctgcttacgaattccaacacgagtttgccctgatttctggaaatacattgattccacttattttccagtctttccgagcaccgatttttaatatgtgggaacgttattgtgaactctatgggatagaagaattatatcgaagcaattataagacctggacctatatccgagaccgagacacccaaggagcgattgcatgggttcagaaatccatgcaggactgcattgatgggaagcatcagatttactattccaatgagtttgtataaatttgtatttgttgcacgtaaacgagaagatagactcaggttcagtcgatagcgttccttttgacatacttctactgcgcacctctgcaatcctgccggaggctatatcagctgggggattgactcccagctgatataaatctatattcacattctatctctcagcacatgatacaattccgcctctgtataatactgataaggattcacataaaaaatcatcagaattccaaacgtacatgcacccaacagattccagccaataaaggaaagatccaacacgaacgcatcccatttattccccatcatcattcgtttactttctgcaaaaatctcctgtctgctcatctcaggatgatcgagcagaaggtatggtaccatcgcatattcatatgctttaatcacgcctggaacaataaataatagtgaccacaatgcaagataaattgatttcaaaaacattgtcatacgaattgtcttattgcaatctcttaccattcggaaaatatccttcacatcctgtcttccacatcttccatttttgaaaaacttacagcacccaacagtcattggattccagagaaaataagcaattgccaaatatacaacaaaactgataaccacggctgctgctatagctgccgcaactccgaacattgcaatcggattgaaactttgtataaaagtttctgcttcatcactcttattgcttgccgccttaaaagaagatgtaattccatttcccaaaagaaacgtataaatcaatgctgcaagcacagaataccaataattctgtttcaacaggaatttcgctcttccttttaattcacttctcgtccacaacataaaaatccctcctgacatcactctgttgattgaaccgtttgctatgaaactattatagcacattccatcttccagaaatatctcaagagggataatatatttcttaatttttcttaatgttttcgtaactgttcaagttctatatgccttccggatattctactccctccggcaacggatcccagtcattcaatcccaatgactgtttatatctggcacgatccaatgtcagtatttctactggctcattcagataatccatgagctctttgataccttcccgcgtcttattatttacttcgaaaatgcgctcacatccggcattcttcatccaaagtctcaccatatcaacatttgcgtacggtgaatcaatctttgtaatgattccgatcaatggacgttggataaaacatctgcttccaggtccgaacagattgaacggttcatctgcagcctgcaccatagcaatcacgtctgcctcaaatgaaaaacaggcaagtccaacactgaaatgcttagactctgcatactctcccggagagtcgatcgtatcatcttctgtattcgtatactgtgtcttcacataatgcagttcttctcccttaagagcctgcgtcagtgaagtcttccccgcttcacttctccccatcaaaaatatctttttcatcctgttacgcctctgtcttcttaacttctatgaacctcgcacactgcaaagccaagtctctcattaaaaaatcgaactacttcttccaccgctgtctgtacctgtgtcaatccgccggtcagaatcagtgtcccgcagaatctgtccataaatccaatctcaacatctgcgctcttgaatgctacatctgcagcaaccacaactgcttcccacggtgtaaaacgcagaagtccgatagactctcctgtgtgatcctcaccttcatgagttccaatatgtaatcccagattctggtaaataacctcatctgatctactgataatatgcgccatgcagacttccttccccggcacgcgcacacgagtcatacgaagcttctttcctttcagattctcatagtcatcatgaaacagacgctccatgagctcttctctcgttatacgttcccgttccataagcgcacttcctatcgttttgtaatatcacagactacataaccaagagaatctctgaaataatccacaacttctgtcaatgcagatgtaacatcagaaatctctcctgtaataatcagtgtgcctgtaaaacggtctgcgaatccaagataaacattaccgcttttcactgcaatatcagatgcgataactgctgactccggtggagtcatattcataactccaattgcagaagaacgataatccagatgtggatttaatccgagtttctgataaataatcggagccggacctcccattacatgtgcaaatgtaatctccttacctgcaactgtttcctgtacaattctaatctgttctccgtgatcattcgccatctgtcagttcctctctttcacatagattctgtaattctcattcatacaattctgtatgttaatccactaacattctctgttcacagccagtctcgttactgttcacacgatgtgaccagcaacgcatctcgccattttaaatcgactttggcgatggggcgagatgcagattgattggatatttggaagcactcaaagaactttcataaaaaatttacctatataatacgcataaacgaagaaataatgaaataagtaaacgaaaagaatgaggtaagatagctgttatagcggagagggaatattcagatgcagagacaagacggctttgtcggaataggcgttaaataccttaccatgcagcgctttgtggtttatcttaactctaatattgcatcttaacttaaaaagagttaaaaatggaggtgaacacatggagtatctcaataaagtccttggaatcaaagtaacttatgaggatgtgaagttcaagcatttgcctaactttattgtcatgcggtatcgcctgcagatggcatctatgaatgggaaaaaggcgattttcctttatccgaaaactgagttggagcaaattggagtgctgaaaaagcacattgcccggatacagaaaaatgaaaatttgcctgttgttctagtgctgaaagagattatttctcggcagaaagaatatttgattcgtgagaaaattccatttgttgtagaaggaaggcagatttatttgccttttatggcgttgtatttgcaggaacggtgcaatgacgaaagggagcaacgagaagaaatgcgtccatcggcgcagatgcttctgttgcatttcatttatggaggcgcacaagaattgttcacaagtcaggctgcgaaagacttggaattaacacctacttctatatcgagagcatcgaaacagcttgaagaaatgggattgctgcatataaagaaaagaggtgtacagcggattttaaaatccgaggattctccgaaaatactgttccaaaaagcaggagataagttgctgaatccaataaaacgaacggtttatattccgaaagaatttatggggacagatttgctagaaagaggatattcggcattggcagagtgttccatgctgaatgcaccgaacgtcaaatactatgcaacagaaagaatctctcaatggaaagatgttatgacaaaccgtttgcaagattcacaggtgcaagtggctgtagaaatgtggagatataatccccgaaaattgtccacacgaaatactgtggacgaactttcgctggcattggcattgagagaagatgcggatgaacgggttgaagaagcagtagaagaaatgctgaatgaactgtggaggaagatagatggttacagggattgagagttttaaggaatggttcaagagcagtgaaggacaatataccatcattggaggaacggcgtgtgacattctgatgacggaagaaggtttggacttccgagcaacaaaggacattgaccttgttctcattatagaagcagttgatgcgaattttggaaagaaattctggatgccattcaacttccggaagatgcagtcttgacaccgctaccaatagacgaagatatttcaagtctgtctgctattcttttggacgatgattactacgaatttttgaaacaggggaaagtcactgttgatagagttactgtcttggatgcggcatatttgattccatttaaggcaaaagcgtggatggatttaatagatcgcaaggctgcaggtgaacatgttgacagcaaaaacatcaagaagcataagaacgatgttttccgcctgacagaattgattgatcccatggtcaagattacggctcctcaaggagtttatgcagatattcaagactttattcagaagatgcaaaacgaaagcattgacattaagcagttggggctggtagggagaatgaaagatcaggttttgaacgaactaaaagatttgtatatagcacagtgagaaaaccaataaaatcaaggacttgtggtgtttataaaatgcctaaaaaataagtttttaaaaggagataaatgaaatgaatagtgcattagataaagttggagtatatgatttttttggggtactgttatctggaatgatagtaattgttgtgagttgttgtcttgatttaccattgataaatttaatagcaaatgtagaaaatgacattgttaatgctatcttatttttggttgggagctttttcttgggattggttttacaagagattagttcagttcttgataaaaaggttttcaaatttcgtgaaaatgcaaggtgtaaatttttgaatgatgaaaataaaattattggtaatgagttggaattaaaatcttttagagagcttgcaaacaaaatattaaataaatcaaacgataatcaggtttatagcgaaactgaaaatgagtatgtattttatttatgtaagacttttttagaaacacatgagaaatgtgataaggctaataaaataaattcattatatgctatgagtcgtagtttaataatatcaatgccgttatgtttaagtacttattatagatacaacataaaatcattcagttttagtaggcaagatttagtggttatatttatcatggctatgttgactgttatcttttataaaagagcgaaaagatttgcagcatatagggtacgggtaattctgcgtcagtataaaatattaaatgagaaaaattagtaaagagacagaaatcggaatgctggtagaaacatatcaaaaattagatacaaatacgcagaaaagagtggattacaaaaatcggatatacaggtgagaattggacatattgggagtatatgaggaaagtttttcaagagattgtatgtcataatattcataaggcagtcaggattcaaaaggaagatacgaatgaaaatgatcttagaaagaaacttgaacagattgatttatctgagatactgaatgttcaaaataaagtcagcagaaattctgaaaaaggatttatatgggtgttgagtacatgtgtattattgattctggattataattttaaattgattacctacttacagtgcattccatgatacgaagacaggaatacataacattggtgtcaggcacttaaattattacgaaatattgtggacgaactttcgctgacattggcattgggagaagatgcggatgaacggcatgtgacaaggagcgtgagaaaaatgaatttatcaaaaatacatcatattgcaatcatcgtatctgactacgaagcagctaaggatttttatgtgaacaagctggggttctctgtcatcagggaaaactaccgcccggagcgtaaagactggaagctggatctgcgtgtcaatgagcaaacagagctggagattttcgcagaagaaaacccgccgaagcgtgtaaaccgaccggaggcctgtggtctgcatcatcttgcgttctgcgttgatagcgtggagcagacggtgaatgagttggcggaagtcggtattgaatgtgagccgattcggattgacgattataccggaaagaagatgactttcttccatgacccggacggactgccgctggaactgcatgagtaaagaggtaggcaaaatgatattccgtaaggcagaaaaagaaagaatgaaaacaatctactgtaagcagagaaatatgctatatagagcagctgttttgagattgcaaaaaaatatcagagcataaaaaattcagcttgcaataatagaattctaatgttaatctaataccacgcagttatcattctgatgaactgcaaaaagatctatgaaccaaatcggtaattattcaataagctcagaattccgggcagataatccgatgacaaacccaaaagatgaatattgtttgaagattatgtgattgaggaagtttgttttttcaaatatctgattttaagggatagttacttccatagaaaactatcttgtgttaattgctaaacaagcgccactggcgcttagcaacgccgcaggcgcaagaatgtgcaaggcacattctttattcgtatcgttaaaagtttttgtggataacaagtgaaaaagacggtctgaagtgtgggaaaagttattcccataattccagaccgtcttttttattcgttgtttaaattgtggataacttctgaattgcgtctgcggaaacaatgattttgcaatgctcctccagaaatgcaagaacagaagaatctcccttctcaggggaactgtactccgaaagcatattacatactttattaaattcctgatctgcgccatcagcaggtgccagcgcaaggataaaggtattattattctcctcgtccttatataatgtatttgcacctgtatagaacggagcaagcaggcgggaagcctcaattacggaatctaacgtgtcgaaagagaacaggcggactggaaatgtcggtactgtttctttaggttccggatcttttgcttcggaagccacttccttcactttgttaagcagatcaaagaattcatctgcgccctgaagcttttcaagaacattgctgttcagtgtatcagaatctccggcaggtgtaaacttggaaaaacgtgtatcaagttcttccggatcctccacctttgttatgatcaaggtgatagagtctgaagaagaaggaattgcttctatcatcagaggaaggtcatctgtctcaaatccaaagtcgaaagatgcctgctgcatcatatctcgaaatagtgattttgctttctcggtaccataagccagttcgctgatcttgagattgcgggctgcaagatcggcatgtgtcaaagtacaacgaatctgattgtcattgattttttcaattttcatatgatcacatccttatgtcttatgatattaagataatctgtggattaagaactgttcattatgttcataactagatatatcttttcatcgtttagtataaacaaaaaaagaaaagatgtaaaggaaaacgaaaattgtttataactattttaggttatcaacaaatcccacccacttatcaacaataaacacattgaaattccaaaaggctgctcatataatggcacttacagaagacacaccatttgataaaacagaatgttaagaaaggaggcactgaaagcatttctgattttcaaaaaaattcaattccctgaaatcaagggaaaattcacaataattatgagaaggagaccctccgaagatcagggttgtcttcttgtccgtcacttgttctacagtatgtcacagataccttttatggtcgaagatggcggacaacgttttatcaggatcccaggagagaaggagtacatacgatatgagaacggaagatggatataaggaattatatgcggaactaagaggttatgaagaaaaaggagtggacatagttatggatggatatccgatgagtccattgcagattgtgacagcatatatggccagagaagaaggtacttatatgagagattatgtgattgatccggaaggaaggatagaatcattggtttttacagatgtgaatcataacagacaggcagagattaccccttgaactgccggacagaagtatatttgtaagctgttataattgatagaagatggacagacatttaaggtgtaacaactttttgatatgtacaactgttgtagatgcaatttgttaatgacgcaagatgaaaatatgatataatgaattccagaatcattattttatccagagatgtggagatattagaaatacacacagcagagcgtaaggaactgtttgtgtaagaaagcgccagagatataaaaattgcaatcaggagggttggcatggacaaaagaaaaggcagtacccatgcgcgaagcaggggaagagtagaaggacaatctggacatccggggagttcccggagaaagggaagaccaatgacaacaggtagaggcagaaatggaaggtcaggaacacgacgtgcgaagaaagtgaatagagcgcggaaaagacgtaacaaaattcttttcgtaatgatcatcatattattgatcatgattttggcagcaggcgcagttttctttaagagatacggttcatcaaatgaggaagccgataaagaacaatattatggaatagaaaacagtgatgatctggcattgatcattaataatgaagtagtgaaaaaagaagagagttccgcggaatcttcttccgattcttctacagatagtgttataccgggtaaggtttttgatggacaatattatgtagcatatcaggttcttcgtgataagataaacagcagattttactgggatgcgaacgaacgggtgcttttatataccttgccggatggaaatatttctgtaagtgagaacagcagcgaatatacagcagtgaacgaaacaaaaagtgaagattatgtaattcttaagacggatggagatatcgcatatattgcacttccgttcatacaagagtatacgaatatggaatattctgtggaacaggaaccaaacagagcaattatcacatcaaagtggggcgagatcgagacagcagaagtgaagaaagacacacaggttcgttatcttggtggcgttaagagtccgatactgacagaagttaaaaaatcggacaaggtgacagtgcttgaagacgaagatgactggatgaaagttgccacagcggatggttatgtaggatatattaagaccaaatctttaaagaaccagaaaaaagaaaaaatatccagagattttacggaaccggtttattcagacatgacagaagatcattcgattaatatggcatggcataatgtgacgaatgcggcagcgaataatgcggttcagcaggttgctaaacaagcgccactggcgcttagcaacgccgcaggcgcaagaatgtgcaatgcacattctttgttttttgtaatttcacttttttccacgaccaacgagataatcaattgagactgtataataatcagcaagtttgatgaagacatcaataggaacgttgatttttccaagttcatatttagaatatgtagtctgtttgatgttgaggtatgcagcaacttctttctgcgttttatcattatcttctcgcaaatttcgtatgttttcgaatttcataatcccatcctcgtaccttaaagccggtgtgcgaacttaaccggaagcaagctatcgttcacagtatccagtgaacaataatctgatatcttttgtatttttggattattatataaaagtcctgacacgactattgaaatatagtcgtactacgactataattgataaaaacatgaagaaatgtgcgagaaatgagacagcataagaactaaggggaatgggagaaagtgatgaataaagaaaaaatagatgatatggattattatgaaaaatatctgttgaatgcgacgaaagaagaaagggattgctatataaaagaacatcccgattttatgaatgaatatccagtatcgtatgaacatcgggaactgcttcaggataagatttatcgaggattgatgcgtaagatccgggattatgaaaagagtcgtgagcaataaaaaactgacagatcacaacagaaacagaatgaaattcttaatggacagaaaatgtttcgtgtggtttgtcagtttgttttaaataaacagagatgttaatcaagctctcttaaaatgttttttaattctgaaaacgaatgtatcgtcggataatcttccttaacatctccaagtccatattcagcaaagataaaagggataccggcttttttgcaggaatcagcatcgccctgggtatctccgacatagacagggtttgtcaggttatttttctccattaatttcagaatcgtctggtctttggaagtctgcgtctggccaaaacaaaggaaatctttgatatatggctccatgcctgcgcctttcatcataacttcaatgtatccgcactggcaattgcttacaataaaaagaggatattccagagccagttccttgagtgtgtccataacgccttcgtagtaaacaccgggatgtgtttcaagatagcggttttcataatcaaaacagatatccatcagttttcttcgagagtctgggtcgagatcgggaaaaactccggcagcaatttcgtccattgtctttccaaacagtccctgaagaatttcacggtttaagtttggctcaagatcagagttctcttttattgcaagattccaggaatcggctacaacttcaacagaatcccaaagtgttccatctacatcaaatataattccatccataataattctcctgatagtatttttgaaaatattgtttacaagatattggagtcaaaagccctaaataatgataccataaaatgaacctttaaaaaagaagttaattagtgtatactttaataatggttaaaattaaatgcaacaaaaagcaagagataataggagagaatctgatgagagataaaattgtactgatcgatggacacagtatattgaaccgggcgttttatggagttccggatctgacgaattcggaaggactgcatacaaacgcagtttatggattcctgaatattatgtttaagatattagatgaagagaagccggaatatctgacggttacatttgatgtgcatgcgccgacatttcgccatgagatgtttgcagattataagggcacgagaaagccgatggcagaggaactgcgtcagcaggtgcctgtgatcaaggacgttctgcgtgcgatgcatatagaagtgattgaaaaggccggacttgaggcggatgatcttttgggaaccttgtctcatcgttgtgaggagaaaggaatggatgtttccatcatttccggagaccgtgatacgcttcagcttgcgacagagcatattaagatccgcatcccaaagacgaagcaggggaagacggaagtagaagattattatgcggcagatgtgcaggaacgctatggagtaacaccgaaggaatttattgatgtaaaggctttgatgggtgatactgctgataatattcctggtgttccgggagttggcgaaaagacagcgacaaagatcattcagcagtaccagacgattgaaaatgcatacgagcatgttgatgagctgaaaccgccaagagcaagcaagaatctgaaagaattctgggagcaggcacagcttagtaagacacttgcgacgattaaactggacgcagatattacatttgaaattgaaaatgccagacatgagaatccttatacaaaagaagctcatgaattattccaaagactggagtttaaaaatctgcttggaagatttgatgtagaagcgtcagtgaatgatgtggaaaaatattttcgtgaggtaacaggaaaagaagaaattgagaaagtctttaaagaggcggagaaagcagagaccgttggtgtggcattttccaaagatgctggaaatgttctcccattgtttgcacatgcttcaggatacggaagggtttctctttgctatgaagcagaaaagattgttacgattccttgtgatatggatgctgattttgaatatctgacaggaaagttgtctcaccttgcaaaaagtgtgaaacgtttttcaatgtgtggattgaaagaatatctggaatggctgccggaacttacaagtgagaacgggtttgatgcaatcgtagcagcatatcttctgaatcctctgaaaaatgattacaatgcagaagatgtggcaagagaacatttgaatcttttaattgatgaaaaacttgatgagggtacaaaatcatgctatgaggcatatacagcttatgcctgtgtcccggttcttgagaagaaactggaagagaatggaatgttccgtttgtttaatgaaattgaaatgccgttagtatttacattgtatgatatggaacaggccggtgttaaggttgaaggtgaagagctgaagcgttacggagaagagcttggagcaagaatcgttgagctggaaaaagagatttatgaaatggcaggggaagagtttaatatcaattctccaaaacagcttggtgtgattctttttgaaaaactggaaatgcctcatgcaaagaagacaaagaccgggtattctacagcagcggatgtgttagataaacttgcaccggaatatcctatcgtagcaaagattctggagtatcgtcagcttgcaaaactgaagtcaacatatgcagacggacttgcgaattatataggaatggatggaagaatccacagtaaattcaatcagacgatcacagcaaccggacgtatcagcagtacagaaccgaatctgcagaatataccggttcgtatggagcttggacgtctgatccgtaaagtatttgtaccaaaagaaggctgtgtctttgtggatgcggattattctcagatcgagcttcgtattctggcgcattgttccggtgatgaacagctgatccaggcatatcgtgaagcgagagatattcaccgaatgacagcttcccaggtattccatgtaccatttgatgaagtgacagatctgcagagaagaaatgcaaaagcagttaatttcggcattgtgtatggaatcagttcttttggactgagtcaggatctgagtatttcgagaaaagaggcggcacagtatattgagcattattttgaatcctacccgggaattaagacatttcttgataaatgtgtgagcgatgcgaaagaaaaaggatatgcagagactttatatggaagaagaagaccgatgccggaattaaaatccagcaattttatgcagagaagttttggagagcgtgtggcaatgaatgcaccgatccagggaactgctgcagatattattaaaatagcaatgattcatgtaaatgaagaattgaagaagagaaatctgaaatcacggatgatccttcaggtgcatgatgaacttttgatcgaagcagatgaaacagaattagaagaagtgcagcagatccttcaggataagatggaacacgcagcagaattgttagttccgcttagcgtagatatgcatacagggaagaactggtatgaggcaaaataagatgaaagtaattggaatcacgggtggagttggctccggaaaaagtgaagttttaaaatttcttgaacaggaatacggtgcggtagtctgccagatggatgaagttgcaaagcagatccagaagaaagggacacaggcattttcgagaattgtacaagaatttggtgaacagattgtcggaaacaatggtgaactggatcgcatgaaacttggaagctgcgtatttgcagatgagaagaaattacaaagattgaatgagattgtacatccggaagtgctggaatgggttcggaaagatatcttgaagaaaaaagaagagtgctgctcttattatatagtagaagcagcacttcttccggaagtaggaaaggaactgtgtgatgagctgtggtatatttacacagatgaagcggttcggagagaacgactgaaaagttccagacattatacggatgaaaagatcactagaatgattgcttcacaaccggtagaagaagtatttcgaaaggcatgcacagttgtaattgataatagtggagactttgaagcaacaaagagacaaataggagatagattgaacaaatgagaatgtgcagtattgcaagcggcagcagtggaaactgtatctatgtaggaagtgataattcccatcttctgattgatacggggattagtaagaaacgaattgaagaaggtctgaataagttggagattaaaggggatgaactcgatggaattctgatcacacatgaacattcggatcatattaagggacttggtgtgttcagcagaaagtacgagataccaatttatgcgactccgggaacgattgcaggaatcaaagagtcttccagtcttggaaagatgccggaaggacttttacatccgattaaggcagatcacccatttcagcttggtgaactggacgtacacccatttgctatttcccatgatgcaaatgaaccgtccggatatcgtattgaacaaggtgggaagtccgtagcagttgcaacagatcttggaaaatatgatgattatacagtgaagaatctgaaaaatctggatgcgatccttctggaagcaaaccatgatatccatatgctggaagtcggaggatatccatattatttgaagcagagaattcttggcgatcgcggtcatttatcaaatgaattgtcaggacagcttctttgtgatatactacatgataatctgaaacacatcatgcttggtcatctgagcaaggagaacaattacgcaagacttgcttatgagacagtgaagttggaagttacgcttgcagataatgaatataaaggggaagacctgaatatgttcgttgcaagccgggaatcggtttcggatattattaatgtataaaattgagtgaatcaaagcggaggtacagaaagaatgaagaaatgtattgtcacagtacttggaaaagacacagtaggaattattgcaaaagtatgtacatatcttgcagaaaatgaaatcaatattcttgatatttcacagacaattgttcagggatatttcaacatgatgatgatcgtagatgttgcgaatctgaagaaagatttcaaagaagtttgtgatgagatggatgtacttggcaaagagatcggtgtaacaattcattgtcagagagaagagatttttgagaaaatgcaccgtctgtaagaagtcggagataaggtgaggataagactatgattaatatgtatgaagtatcagaaaccaataagatgatcgaaagcgagaaccttgatgtccgcacgatcactcttggaatcagtctgttggactgtgtggattctgatctgaatgaactgaaccgtaagatttatgagaagattacaacagttgcaaaagatcttgtatctacaggaaaagacattgagaaagaattcggaattccgatcgtaaataagagaatttcaattacacctgtatcgcttgttggagcagcagcgtgtaagactccggaagattatgtgacaatcgcacgtacacttgaccgcgcagcggaaaaagtaggtgtaaacttcattggcggatactccgcgcttgtgtcgaaaggaatgacaccaagtgaagagaatctgatccgttcaatcccgcaggcactggccgagacagagagaatctgtagttccgtcaatgtgggatcaacaaagacaggtatcaatatggatgcagtccgtctgtgtggacagattgtgaaagaagcggcagaggcaacgaaagacagagattctcttggttgtgcaaagcttgttattctttgcaatgcaccggatgataacccgtttatggcaggtgcattcctcggtgtgactgaggcagatacgattattaatgtaggtgtcagcggaccgggagttgtaaagaaagcgattgaaaaagcacgtggaaaaggttttgaagaactctgtgaaacaattaagaaaacagcgtttaagattacacgagtaggacagcttgttgcaggagaggcttctgcacgtcttggaattccatttggaatcattgatctttctcttgctccgactccggcagttggagatagtattgcagagatcctggaggaaatcggactggagcgcgttggtgcacctggaacaacagcagcacttgcaatgctcaatgaccaggtgaagaagggcggcgttatggcatcttcttatgtaggcggactcagcggtgcatttattccggtcagtgaagatcagggaatgattgatgcagtaaatgcaggatctcttacacttgagaagttagaggcaatgacatgcgtatgctctgtaggacttgacatgatcgcaatccctggaaagacatcagcagcgacaatctctggaatcattgcagatgagatggcaattggtatggttaaccagaagacgacagcagtgcgtctgattccggtcatcggtaaagacgttggagatgtggcagaatttggtggactgttaggttatgcaccgattatgccggtgaatgaatttggatgtgatgcgtttatcaacagacagggacgtattccggcgccgattcatagttttaagaattaacgagggagaaatttgatgagtaaagttgcaattgtaacggatagtaatagcggtataacacaggaacagggaaaagagcttgggatttttgttcttccgatgccattttttattgatggagaactttatctggaggatatcacactttcccagagtgaattttatgaaaagctcggagcagattccgatatctcaacatcacagccatccccgggagaggtcatggatctctgggataaagttctggaagaatatgatgagcttgtatgtattccgatgtccagtagcttgagcagcacatgtgcaacagcaattactcttgcagctgaatatgacggacgcgtccaggtggttgataatcagagaatttcagttacacaggagcagtctgttctggatgcaatgaatctgcgtgaagaaggaaagagtgcagcagagatcaaagaaatactggagaaagaaaaacttcaggcaagcatttatattacggtggatactttaaaatacctgaaaaaaggtggaagaatcacaccggcagcggcggcaatcggaactgtgcttaacttaaagcctgttcttcagatccagggagaaaagctggatgcattttcgaaagcaagaggctggaaaacggcgaagaagacaatgctcaatgcaatcgagaaagatctgaagggacgttttgccgatgttaaggatcagatggctcttggtatggcttacacatgcagtaaagaagaagcacaggagtggaaagcagagatcgaagaaagatttccgggatatgagattatggaaggaccattgtcattgagtgtggcctgccatattggtccgggggcactggcgattacttgtatgaagagactgtaaactggtaactgtgacgaaatgcgtagcattttgtaagttggctctgaacagttacataatctgtattggtgagaggtggtactgttcacatgtggtgtgagcagtactctgcttttttaggagaatattatgaaaatcgttggtcttattacagaatataatccatttcacaatggacatctttatcatattaaagaatctttgcgtgtaaccggtgcagatgcagccgttgttgttatgagtggtgactatgtgcagcggggaacacctgcaatcatgcctaaaaggatacgtgcagagatggcactgatgtgtggtgctggagctgtttttgaacttccggtctgttatgcgacgggatctgcggagctttttgcacttggatccgtatctcttttagagtctcttggaattgttgattctatctgttttggcagtgaatgtaatgatctcccaatcttggaacagcttgcagaactacttcttgaagaacctgaagcctaccagattctgttgaaagattatctgaaacaagggatgtcttttccacgcgccagacaggaagcaattctttcttatacagaagatcctcggtttgcagagattttaagaaatccgaacaatattttggggattgaatatttgaaagcaatcaaaaaacttggaagcaggatggaaccttatacgattgcaagacgtggtgcacagtatcatgatgaagaactggacagtgattacagttccgctacggcaattcgttcactgcttgcttattcaagttcatctttcaatacagaaccagtagaaggaaattacgatgagctttcgttttcgggaatactgtcagagttggaaaaccaggttccaaaatgttgtctggaacttttgaaggattatcataaagtacagtatccgatttcacagaatgatttttctctgattttgaaatataaactattaaataaacagccagaaagtctggttcgatatgtggatgtctctccggagattgcatccagaattgcgaatcagttaaacaacttttttaattataaacagttctgtgatttgttaaaaacacgagaacttacgcagacccgagttaaccgggcattgcttcatattatgcttggaacgaaaaaggcaaatgtggaagaatatattgacaatggctatcatatgtatgcacgtctgcttggttttcgaaaagacaatgcaaagcttttaacagctatgtcgaaggaaagcagtattccggttttgacgaaaatgtctgaaattgatgatcttccggaacttggtcagaaaatgctcagacatgatatgcttgcttcaaatctgtatacctcagtggtgacggataagtttaagacggcgtttcagaatgaatataagcaaggggttttgaaggtgtaaattttaatacgagccagaacagttgccgtgagaggtgactgttctggctcgtaatgttcttagaaaaagacaatgtttgataaaattgtaacaatcttacaaatatcctattacaaagttcggattgtatttgaaaatgcacataaaatgacttgtatacaaaaaacgattgagttataataggactaagtgagataaaaagaaaggtggcattaaatcatgggatttattgatgaaatcaaagcaagagcgaaagcttgcaaaaagacaatcgttcttccggagacagaggacgaaagaacttacaaagcagcagagacagtactgaaagaaggactcgctgatctggtgcttgtaggaagcaaagaggagattgagaagaacaaaggtacatacgacatctccggtgcaacaatcgtagatcctgcaacagatgcaagaacagaaggatatattgcaaaacttgttgagttaagacagaaaaagggaatgactcctgaacaggcaaaagaactgcttcttagcaattatttatactatggtgtaatgatggttaagatgggtgatgcagacggaatggtatccggagcatgccactctacagcagatacacttcgtccatgccttcagatcctgaagacaaaaccgggaacaaagctcgtatccgcattcttccttatggtagtaccaaactgcgacatgggagcaaacggaacatttatctttgctgatgcaggacttgagcagaatccagatccggagaaacttgcgaacatcgctatttcatccgcagattctttcaaactgcttgttgagaaagagccagttgttgctatgctttctcactcaacaaagggaagtgctaagcatgcagatgtagataaagttgttgaggcaacaaagatcgctcaggaactcgcaccagagcttgctcttgacggagaacttcagcttgatgcagctatcgttccatccgtcggagaatctaaagcaccgggaagcaaggttgcaggacatgctaacgtacttgtattcccagaccttgatgctggtaatattggatacaaacttgttcagagacttgctaaagcagaagcttacggtcctctgacacagggaatcgccgctccggttaacgacctttcccgtggatgcagcgctgaagatatcgtaggtgttgtagctatcacagctgtacaggcacaggctgaataattgtaattgtttacagattttttaaaatagttacgggtaatcaaaagaaacaaagagggtagtgtgagctgccctcggataataataataaggttttttcaggaggaaaaaagaaaatgaacgtattagtaatcaactgcggaagctcatctctgaaattccagctgatcaacgctgagacagagaaggtacttgcaaaaggactttgtgagagaattggaatcgacggacgtctgacatatcagccggctggcggagaaaaagagaaatctgatctggctatgccaactcatacagaagcaattcagtttgtaattgatgctttgacaaatgagaagacaggagttgttaagagccttgatgagatcggagcagttggacaccgtctcgtacatggtggagagaagtttgcttcatctgtagtaatcacagacgaagtaaagaaagcagtagaagagtgtaatgatcttgcaccgcttcataacccggcaaacttgatcggtgttgcagcatgtgagaaactgatgccaggaacacctatggttgcagtatttgatacagctttccatcagacaatgccggagaaggcttatatgtatggacttccatatgagtactatgagaaatacaaagtaagacgttacggtttccacggaacaagccacagcttcgtatctaagagagcagcagaagtaatgggaaaatcttacgatgaagtaaagacaattgtatgccacctcggaaatggatccagtgtaagtgctgttcttaacggaaaatgtgtagatacttctatgggacttactccacttgaaggacttgtaatgggaacacgttcaggtgatatcgatcctgcaatcatggagttcattgctaagaaagagaaccttgacattgaaggtgttatggaagtactgaacaaaaagtctggtgtatttggaatttcaggcggactttcaagtgatttccgtgacctgacagacgctatgaatgccggagataagaaagctaagatcgctatggatgtattctcatacagagtagcaaaatacatcggatcttacgctgcagctatgaatggtgtagatgacatcgtatttacagctggtatcggtgagaacgatgattatgtaagagaagaagtatgtaaataccttggataccttggagtagacttcgattcagaagtgaataaaggactcagaggaaaagaagctgagcttacaaaagaaggatcaaaggttaaagtattcgttattcctacaaacgaagagcttgcaatcgcccgtgagacattagcgcttgtaaaataattgaagaaatcttaatttgagaaagtgtatacgatagtgatctgtaaagattatatcgtatatgagcgcaggactgaggtgccaagaaagcagttcagtcctgcttttgcgcatagaagaaacaaaaatgtatccaatacattttgctcttcataatatttttgatagaaattataaatatctgttgacaaacattttttccatgatataatagtttaggtatgaataggagaaatacattatgttgattaacctatcagacgttttgtcagaccagcataagacggttgaagaaactgtgcggctggagatggaagagatccggttacaatccggaacctaccccattatcagcaaggagccggttcatgttaaagtagagcatataaggggaaaagaactgctcatcacagctgagaccagattgagtgtcatgattccatgtgaccgttgtctggaggatgtgaaacgggagtttgaactgaattgtgtgaaacatgtggacgtaggcctctccgacgcagaactgacagaggagctggatgaatcaaactttattgacggatatcatcttgacgtggacaaactgctctttcatgagattttgtcgagctggccgacgaaagtactttgcagggaagactgcaagggattatgcaatgtatgcggtcagaatttaaatacggggtcttgtaactgtgaagatacagggcttgatccgagaatgtcagttgtccgtgacttatttaagaattttaaggaggtgtaacctatgtcaatctgtccaaagaataaatcttcaaaagcaagaagagataaaagaagagctaactggaagatgagcgcaccgaatctggtgaaatgcagcaagtgcggcgagcttatgatgccacaccgtgtatgtaaggcgtgtggatcttacaacaagcgcgagatcgtttcagttgactaatgatcaataagatattgagtgtactgcgaacagaacacttgagggcgtaaaaactttgtgttttacgcctttttttattgatttttatactgatatccagtagaataatttcagtagcgcaaggaggaaatgatatgtcagagattacaagggttgctcttgatgccatgggtggagacaatgcaccaagagagatggtaaaaggtgccgtagaggcagtgcggaagagaaaagatatcaaggtactgctgacaggtaaggaagatgtgattcgcaaggaactctccgcttatacgtatcctgaggagcagattgagattgtgaatgctacagaggttattgagacggcagaacctccggtgaaagcaatccgtggtaagaaagattcatccattgttgttgcgatgaagatggtgaagaaaggggaggcagatgcttttgtatctgcaggaagttcaggagctgttcttgttggaggacaggttcttgtaggcaggatcaaaggtgttgaaagaccaccgcttgcaccactgattcctacattaaaaggtgtttcacttttgatcgattgtggagctaatgtagacgcgcgcccatctcacctggtacagtttgcaaagatgggatccatttatatggaaagcgttatgggaaagaagaatccgacagttggtatcgtgaatatcggtgctgaagaagagaagggaaatgcgctggtgaaagagacattcccactgttaaaagaatgtcctgacatcaatttcattggaagtgttgaggcacgagatattccttacggagcagcagatgttattgtctgtgaagcatttgcaggtaatattattctgaagctttatgagggtgttgcaggagcactgcttaagaaagtgaagaaaggaatgctttcttctttgcgtagtaagataggggcactgcttgtgaaacctgctttaaagggcgtactgaaagattttgatacaagtgagtatggcggcgcaccgcttcttggcctgaacggacttgtagtaaagacacatggaagttcaaagtcaaaggaggtatgcaactcaatcattcagtgtgttgcatttaaggagcagaagatcaatgagaagataaaagaggcaattcaacaggagaccctggaagaaaagaaagaagtcgaataagacaggaggagttttacaatgacagaatttgaaaaactgcaggcaattattgcggacgtacttaatgtttcaccggagacaatcacaccggatactacattcgtagatgatcttggagctgactctctggatattttccagatcattatgggaattgaagaagattttgacatcgagatcgataacgaagaggcagagaagatcacaacagtgcaggatgctgttgatcagatccagaaaaagaaggctaatgaataatcagatagtgagatgaaaaagcccgtttgggctttttcgtttattaacacgaaggaggccatttaaatggacagagtaaaagaactggaacaaaagatcggatatgtgtttaaagacaaaagcctgatcgaacgtgcattgatgcatagttcttatacaaatgagaaacatttgaagaaatatgagtgtaatgaacgcctggagtttcttggagatgcagtattggaattggtatcaagtgcttatttatttaatgaatttccaaaggtatctgagggagaactgacaaagacacgtgcaagtatggtatgtgaaccgtctctggcaatgtgtgcaagagatatcggacttggagattacctgcttcttggaaaaggagaagaggcgaccggtggaagaaaaagagattctatcacatctgatgcgatggaagcattgatcggtgctatctatctcgacggtggttttactaatgcaaaagagtttatccatcattttattttgacagatttagaggataaaaaactcttttatgatagtaaaacgatcttacaggagatcgtgcaggcgaatatgacggggaatgtaagttatgaactgattgatgaacagggaccggatcataataagattttcgaagtggaagcaagaatcgggggaaaagcctggggacgtggaaaaggaagctcgaagaagtcagcagaacagcaggcagcttatgaggcaattctgaatctcagaaagaaaaagtaaagaggactttatgtatttaaagagtatagaagtgcagggattcaaatcttttgccaataagattaaatttgaatttcataacggaattacaggtattgtaggaccgaatggaagtggtaagagtaatgtcgctgacgccgtccgctgggttcttggagagcaaagagtgaagcagctgcgtggaggcactatgcaggatgtgattttctcgggaaccgagaaccggaagccgcttagttatgcttcggttgcaatcacattggataattcagatcataaacttccggtagagtacgaagaagtcactattacacgtaaattgtacagatccggagagagtgagtatctgatcaatggttcagcctgcagattgaaagatatcaatgagatgttctatgatacaggtatcggtaaagaaggctattcgattatcggtcagggacagattgataagatcttaagcggtaagccggaagagagaagagaactttttgatgaggccgccggaattgtaaaatataagagaagaaagtccctttctttgaaaaagctggaggatgaacggcagaatcttacccgtgtgaatgatattcttgcagagcttgagaaacagatcggtcccttggaaagacagtcagagacagccagaatctatctgaagatgaaagaagaattaaaaacatatgacattaatatgtttttgctggaggaagagcggctgcaggagcgtattcgtgaagtcggtgggaaatatgagattgcttctcaggagatgcaggaatcaaatgcccgttatgagaagatgaaagcagaatacgaggcaatcgaggaagaagtagatcagattgatcttgcaattgaaactgcgaagaaccagatgaatgagacgaatcttttaaagcaacagctggaaggccagatcaatgtcctgaaagagcagattaatacagcccgtatgaatgatgagcattatgaacatcgcctgagtacgatcgtcagtgagatagatacaaggcagcagcagaaaagagagcttgaagaagagaagaaaagaatttcagaacagttagaatcagccagtggacaggatacggaagcacagcagagtttaattgagattcagtcaaagattgcagaacacagtactgaaattgagcagaagaagcgggagatcatggatctgcttggaaatcgtgcttcaacaaaagctaagattcagcattttgatacgacgaaagaacagatccagacacggaaggctgtcgttgccagaaatattcttgagatttcgacggtagcagagggacagaacaacagacttaagaagtatgaagaagaacttggtcagatccgtgagcgcattcaaacctataaggataagatttccctgaacgaacaggaacttggcaagcttcagaatgagctgaaagagaagcaggaaaagttacggatcggacagaccgcttatcacagagagtcttcccgtctggagtcattaaagaatattacagagcgctatgacggatatggtaacagtatccgaaaggtaatgtcgaataaagaacgtgagaaaggtctgatcggtgttgtagcggatatcattaaggtcgataaggaatatgagatcgctattgagacagcgcttggaggaagtattcagaatattgttacagataatgaagatacagccaagcgtatgattgatttccttaagcgtaataaattcggaagggcaacatttcttccgctgacaagtatgcatggcggcggaggaatcaggaatccggaagcactcaaagagccgggcgtgatcggacttgcgaatacattgatccatgtggaatcaagatttgacggactggcagatcagctgcttggacgcacgatcgtagtagaccacatcgatcacggaatcgcaattgcgagaaaataccgtcagtctctgcgtctggtcacattggaaggtgacctgatcaatccgggcggatccatgacaggtggtgcatttaagaattcaagtaatctgctgagcagacgccgcgaaatcgaagaattcgaaaagacggttgatatgctcaagtctgacatggatgtgctggaaaaagaagttacagaggcgaagaaccgtcgtgcagcatgctacaatgtgattgatgaagtacaggaacatttaagagaagaatcagtgctggagaatactgcgcgaatgaatgttgcacaggtacagagagaacagttagaatcgaaacagcgttacgaaggatttctgaaagaacagaaagcattgcttcaggagctggatgaaatcaatgagaatgaagattccatccaaatggaacttgagacatcagagaagttggaaaaagaactggatgaacagattgaagctttgcagatgcagttggagaaagaaagagaggatgaggctgtccagatgaaacagtctgaggaagtccatctttcactggcaggcctggatcagcagaaaacctttattgtagaaaatatttcccgtatagatgaggaaatcaccagatatgaaaaagagcaggaagaacttgccgaaaatcgaggagatgtatctgaggaaattctgcaaaaagaaaatgaaatcgaaggactcaggaaaacgattgaagattcaaaagaactgtttacagagattggtgaagagattaaagtacagagtaaaaaacgcgaagaactgaatcagaagcacagagatttcttacgacagagagaagaacttgcaaagcatgtgtcagatcttgataaagaatgtttccgtctgaacagccagaaagaaggctatgaggaagcgtcagagaagcagatgaattatatgtgggaagagtatgaactcacttacaatcacgcgaaagaacttcgtaatgagacactgacagatctggcattgatgaagaaaaagatccaggagcttaagaatgagatccgaaagcttggttcggtcaatgtcaatgcaattgaggattacaaaaatgtatctgagcgttatacattcttaaaaggtcagcatgatgatcttgtagaggcagaagcatctcttgaacagattatcgaagaattggatgtggcgatgcgtaagcagttcacagaacagttctcaagaattgcgacagagttcaatgatgtattccgtcagcttttcggaggcggaaagggatcattggaattacaggaggatgtggatattcttgaggcaggaatacgcatcatcgcacagccaccaggaaagaaactgcagaatatgatgcagctttcaggtggagagaaggcgctgactgcaattgcattactatttgcaatccagaatctgaagccatctccgttctgtctccttgatgagattgaagcggcactggatgacaacaatgtagatcgttatgcgaaatatttacataagctgacaaaatatacacagttcattgtcattacccatagacgtggtacaatggcagcagcagaccggttgtatggaattaccatgcaggaaaaaggggtatccacacttgtttcagtggatctgttggaagatgatctggaaaaataaacctgtttttattgtaaacagggtattaagagaacaggaggctgaaaatgggagaagaaaaaaagggattttttaaacgacttgtatccggtctgacaaagacaagagataatattgtgtccggcatggacagtattttccatggattttcaaagattgatgatgacttttatgaagaactggaagaaactctgatcatgggagatcttggtgtcagagcaacaatggatatcattgaagatttaaaggttaaagtaaaagagcaacatatcaaggaaccgattgaatgtagacagcttgtgatcgacagtattcgtgaacagatggatgtcggagagacagcatacgaatttgaaaatcgtcagagtgtggttttcgtgatcggagtaaatggtgttggcaaaacaacaacgatcggtaaacttgcaggaaagctgaaagcacagaataagaaagtgatccttgcggcagcggacacattccgtgcggctgcaggagagcagttaaaagaatggtccaaccgtgccggtgttgagatgatcggcggtcaggaaggcgcagatccggcatcagttgtatatgatgcggttgctgctgcgaaagcgagaagggcagatgtacttctgtgtgatacagccggaagacttcacaataagaagaacctgatggaagagcttaagaagatcaatcgtgtgattgacagagagtacccggatgcgtttcgtgagacgctggttgtgctggatgcaacgacaggacagaatgcacttgcccaggcaaaggaattcaatgaagtaacagatataacaggaattgttctgacaaagatggatggaacagccaaaggaggaattgcagtagcaatccagtctgaacttggtatcccggtaaaatatatcggtgtaggagaaacaattgatgacttgcagaaatttgactcagaggagttcgtaaacgcgttgttttacagagaggaagaaagaccatgatgacattagagaaatttgaagaagctagcgaactggtaaaaaaggtaacaaatcctacaaaactcatttacagtgaatacttaagtgcacagacaggagcaaaggtttatttaaaaccggaaaatatgcagcacacaggagcttataagattcgtggtgcatattacaagatcagcacactgacagacgaagaaagaagccgtggactgatcacagcatcagcaggaaatcatgcacagggcgttgcatttgcagcaaaacagtttggatgcaaagctacgattgttatgcctacagttacaccgctgatcaaagtaaaccgtacaaaaagctttggagcagacgtagtacttcatggtgatgtttatgatgatgcttacgcatatgcatgtaaacttgcagaagagaacggatatacattcgttcatccgtttaatgatcttgatgttgctacaggtcagggaacaatcgcaatggagatcgttcaggaactcccgactgtagattatatccttgcaccaatcggtggaggcggactgatcacaggtgtttccacacttgccaagatgctgaatccaaagatcaaagtagttggtgtagagccgtcagaggcagccagtatgacagccgctctgaaagcaggagagccggtagaactcccttctgcaaataccatcgcagacggaacagctgtaaaagaagttggagataagatcctcccatatgtgaaagaaaatgtagatgaagtacttcttgtagaagatgatgaattgatcggtgcattccttgatatggtagagaatcataagatgatcgtagaaaattcaggacttctttccgtagctgcattaaagcagatggacatcaaaggaaagaaagtagtctgtgtattaagtggtggaaatatggatgttatcacaatgtcctcgatcgtccagcacggattgatccagagagaccgtatcttctccgtatccgtactccttccggataagccgggtgaactcgcacgtgtggcgcagacagtcgcagacgtacagggtaacatcattaagctggagcataaccagtttgtaagcacaaacagaaacgcagcagtagagcttcgtatcacaatggaagcattcggaacagatcataagaaaaagattctggatacacttgataaggctggattcagaccaaaactgatcagtgcgaagctgtactaattggtattaaacagcctatagaatggtgtcgcaaggccagccctgctattaccacgagcaccggcccgctttacctcatccctttgcagaatctgttagaaaaagccagacacgaatcacacacggtgagtgctctggctttttcgttacagattgtcaaagggatgaggtaaagcgggccggtgtccaatgcaatacagtggccccctcacgacctttactattaaaagtttttgtttcgattgttgaccgaatccaagtccaacaaattacaacacccctataaaacgatggaatgcctccagtcctttttcatcacacttataaactccggcatcttcgagtacttcgcagaatacttttccgacttcctgctgaaggatctcttcaacattctcctctgtgatggatgtgtaatttggaaggaattcatctacccagtcagcgtgttttgcaatctgttcattgctgcggatatcttttcctgttaagatgtaatctttcagaagttccatctctccttttaatcttgcagggagaacagcaagtcccattacttcgataagaccgatgttttctttcttaatatggtgcagtttagcatgtggatggtagacaccaagcggatgttcttctgtggtgatattatttctcaatgtcaggtcgagttcgtagagatctccacgctttcttgcaatcggtgtgatcgtgttgtgcggtgtaccgtctgtctcagcgaagatgaaagcatcttcatctgtataagatctccatgcatttaaaatgtgttcagccagatcaatcagaggttttacttctttgctctgaagacggataacagacagaggccattttacgataccggcagttacatcttcgtaacctttcacagtgaagtgttcaatgatcggagctttagccattgcgaaagtataatttccaccctggaaatgatcgtggcttaagatagaaccgccaacgatcggaaggtctgcattggatcccaggaagtagtgtgggaaaagtttgatgaaatcaaaaagcttttcgaaggcattgcggtcgatcttcattggaacatgctgtccgttgaatacgatgcagtgctcgttatagtatacataaggggagtactggaatccccaagggttatcctgaattgtgatcgggatgattctgtggttctcacgagccggatgatcaaggcgtcctgcatatccttcgttttccatacagagctgacattttggataggaagaggattttgcttttcctgctgctgcaatcgctttaggatctttctctggtttggaaagattgattgtaatgtcaagagtgccgtattttgtgtcaaccgtccatttgcggtccttagcaatacggtatctgcggatataatcactgtcctggcttaatttgtaataataatcagtagctgtctccggagaaactttatatttttcccagaaagtctgctggatctgtgatgggcgtggcatcagggtattcatcagttttgtgtcaaataaatcacggtagccgatgctgttttcaatgattccgcgttctgcggcgatatctaaaagttctgcaagaatgtcttccagaacaagattgttcagatcacagtcaacatcttcatagttatcttcgtggaacagatccagaagaagattcgttgtataaattctttcggattccggagtgattccggtattgattccgtactgtactaattttttgatcgcatcataaagcatatgtcaaggacctccttaaattaaggaatgccaatggcattcctataacaaaatatacgttacttcatatctgatctcagtagagacgagtattagtcgagacgagaagcaccgtctccgatatctactgtgtagaactcagcttcatgtcctaccttttcaagatatgtttttccgatggtttcgataaatgtatctatggattcatcttttacgatgctgactgtgcaaccgccaaatccgccgcctgtgatacgggaaccaagaacaccaggaatcttccatgcaaggtctacaaggatatcaatctcttcacaggatacatcataatcatcacgcagtgaaatgtgagactgattcattaattttccgaagctttcaatgtctccggctttcagtgctgtaacagcatcgattgtacgctggttttcgtatacagcatgttttgcacgctgtaactggatctcatctttgatcaaggatttgtgtgcttcgaattcttcaggagtaagatcgccaagtgcctgaatgtcaagttcgctctgaagtgctttcagtgcagcagcacattcgtttcttctgtcgttataagcagaatcaacaagactatgctttactttactgtttgtgattacaatcttggcaccatcaagaacgcaaggtgcatattcgtagcttaaatcacttgtgtcaaggaaaattgcgtggtcttttttacccatggcaacagcaaactgatccatgataccacagttgcatccattgaagttattctcagaatactggccgatcagtgcaagatctgtcatggaaagatctttgatctcgaacaggtctgtcaggatcacaccagtgagaacttcaagggaagcagaagaggaaagtccggaaccgttcgggatatttccccagattaccatatcaaaaccacttgtgattgtatgtcctttttctttgaatgcccagactataccaagcggatagtttgcccagttgtattcttttttatttgtcagatcatcaagagatgcttctacaacaccaaaggagtccagattcatggaataaagatggatcttgttatcctctcttttgcgtgcggcaccgtaagtaccaagtgtcagtgcacatggaaatacatgtccaccgttataatctgtgtgttcaccaatcagattcacgcgtccaggagaaaagtaaaaacgagctccttcggaatcaccaaaaagttctgcaaacatatcaaacaattttttcttcatcattatttacctccatttaaagtaatcgtatcgatctgatttatttatatttattatagcgttaacgagtggaaacgtctataaaaaatacgtgctgtggtatgtaataatgttgcattaaaaagacgaggtgttataataatgatgatgaggattgcgggaattgcatagcaatggagcaatccggttacagcagtgagtggcaaaatttttttttggcactcacatcatagatcacaggatacgggaaaggagccggaagatggcagagacttacaaacattcgtataagtcaggagaaattctgatgacttcgctgtctgtatataacacgggatatcaaatgtgtgaagcaggatatcagtggggacccggagtcagggatcattattgtatccatcatattttgtcaggaacaggatactatacagttggagaaaagacatggaaattagaagccggagatacttttatcttatatccgggcgtggaagtaaagtattatgccgatcagcaggagccatgggaatatgcctgggcaggattcatggggacggatgcggcatcgatcattcgaaatacaggttttttgaaagaacgtccttttttaaaaagaggaaatgtgccggatgaccagattcggaatggattggaacagatttataatgcaaagggcaatgggtatgaagaagcggttgccatgacaggagcactttacagtcttctgtcagtctttatgcactatcatgaaggggaagatcaggaaagagatgcaaagcttttgtatgtagaaaaggcagaaaactatatagaaaccaattattcttatcccgtgacggtggaagatattgcagactatgtaggaatcagcagaagtcatctgttccgctcttttcagacctatatgaattgttcgccaaaagaatatctgacagaatatagaatccagcaggcttgccgtctgttgaaagagacggggctgtcggtttcggcgattgcatattctgttggttttgagaataatctttatttttcgaaggcattccggaaagtgaagaagacaagtccgacggaatacagagaaaagcatagaaaaaagaaggaatgatgccgaggtgcaggacataagaatagagtaagaatgtcaaaggcgggaagctgtcatgatgtctggaaaaagatggggttatgtagtacagtttttctgtcttctggtgtttttgggtatgtccccatttctgataaagatggatgggagaaaaacaatgagcgtttcatctgattcagtgcgaagtcagaatgtatcagatgaggtaaaaccagttgttgcgcttacatttgatgacgggccaaatgcatcctcgaccccgattctactggatggattgaaggaacgtaaagtgcgggcaacctttttcctgatcggcgaaaatgtagaaaaagacgagaatgaaaaaattgtgaaaagaatgtatgaggaaggtcatttgatcggaaatcatacttatacgcattgcaatctgtcaaagctggaaacgggagaagcaaagaaagaactagaacagacagatacagtgattgaaaagataacgggaaaacaaccggtgttcgtaagagcgccttacggggaactcccggtggacagcgaacaagatctgaacagaatatatatcggatggacggtggatccgctggactggatgaccgaagatacaggggcggttgtaaaaacagttgtggaagagataaatccgggagatgttattttattacatgattgttatccttcttctgtgcaggcagctatacggattgtagatctgctgcagggaaaaggctatgagtttgtgacagtggatcatctgattatggattgaagatgtgaatataagattgaaaacaggagagaaagatggatttatttgattatatgagagagacaaataaagagaaggaatccccgcttgcatccaggatgcgtccggtgacactggatgaagtagtgggacagaagcatatcataggaaaagataaattgctttaccgggcaattaaggcagataagctgagttctttgattttttacggacctccgggaacaggaaagacaacactggcaaaggtgatcgcacatacaaccagcgcagagttcaaacagatcaatgcgacagttgccggaaagaaagatatggaagaagtagtgaaagaagcaaaagatctgcagggaatgtatggaaaaaagacgattctttttattgatgaaattcatcgctttaataaagggcagcaggattatctgcttccatttgtggaagatggaacgttgatcctgattggcgcaacaacggagaatccttattttgaggtaaatggagctttgatttcgagatcaagtatttttgaattgcatccattggagaagacagatattaaggagctgcttctccgtgcagtgaatgatactgagaaaggtcttggaagctttcatgcagtgatagaagatgatgcacttgaatttttggcagatgtgtcaggtggagatgcaagaaacgcactgaatgcgattgaactgggtgtactgacaacggacagaagcgaagatggacaaattcatattactctggatgttgcgtcagaatgtatccagaaacgagtggtgaattatgacaaaaaaggagataaccattacgatattatctctgcatttattaagagcatgcgcggctcagacccggatgcagcggtcttttatcttgcaaagatgttgtatgcaggagaagatgtgaagtttatagcgagaagaattatgatctgtgcatctgaagatgttggaaatgcggatccgatggcacttactgttgcggttgcggctgcacaggcagttgagcggatcggaatgccggaatctcagatcattctttcacaggcggtgacttatgtggcatctgcgccaaagagtaattctgccgttaatgcaatatttgcagcgaatgatgcagtacggaacaataaaacaacggttccgacacaccttcaggatgcacattataaaggtgcacagaaattaggacacggaataggatataagtacgcacatgattatccaaatcattatgtggatcagcagtatcttccggatgaaataaaagacgccaggttctatgaacccggcgaccttggttatgagaaacagatcaaggagcgtttacagaagctgcgagagcagtaaagcgtaaatctcctgattctttcgattccagttatttacaatggcttctgcctcagtctgagttggcacagtgagtgtcatatcaatgaggtgggagccattttctaaaatctggcattttacttcatattcatggtttgtattcagatagtaatctgatttaacagaaacctcttctttcagatcatattttttctcattgataaaattatcaatttcctgacgaatctcaggagaaattttatttctgaaatagttgatcgtagcggccccttcttctgtgagattataaagcgtacgattatgtgtcagctcaattttcagaagcccggaatccgttaattctgcaagcgcagactgaagacggaaataagttgtataccctttatccagaatgaattctgatatctgggaagttgtaagcggaaaatcgactctatccaacatgtacaacacgatcagtttatataatgtaaatgtttcagccataatactcctttccctggtacaagtcatgatctttcatatatttgtgaatctgatttaaaacagttcgttttgcgcctgtccacagaggtgcgatcaagagatccttcggtccgtcaccggtcagtcggtgaatgacaatttccggacgcaaatgctggatacattcagtgagcagacggatgtattcgtccgcatccgggatatggaaagcaggaccggtataggcaggatctgagagacatttctgatattcaactgcaagatcagttcctttcaaaatgtggagaagctgcaacttgattccgtcaatatttgaatgatttaaatattcgattgtctcaagcatcatttcgtgagtctctccgggcagaaataaaatgacatgtacgataacagtcagattccggcgtttcagttcatgcacagcagtatcaaatacctctaaaggatagtctctgcgaatgtatctggcggattctgggtgaatggtttgaagaccaagttcaacccagacgggcttgatcttattcaattcatctaaaagttccagaacatcagaatctaaacagtcagggcgggttgcgattgcaagtactttcacatcggggtcctcaattgcttctgtaaaaactttccgcaaatattctatgggggcataggtgctcgtaaaggcctggaaatatgcgatataagcatgcaccggacgctttctggcaagaatggctttcccttctgcaagctgttctgtaatcgttttgcaggcagaaccggcaaaatctccagaacccataccactgcagaaaatacagccaccatatccgatcttaccatcacggttcggacaagtcataccaccgttcaatgcaatgcgatatactttctctccaaactgggatttcaatgcatagtcaagagagtggtagcgcttctctccccacatattagattaaatccttaattgctttgcttactgtgtctgctacacgaggatcaaaggcttccggaagaatgttgttttcattcaattcttcttccggaacaagacctgcgattgcattggcagcggcaagtttcatttcttctgtaatctgtgtggcacgtccttctaatgcacctttgaaaataccagggaatgcaacaacattgtttacctggttcgggaagtcagaacgtcctgttccgacaactttggcacctgcttcttttgcaaggtcaggcatgatctccggtacagggttcgccatggcgaacagaatcgcatccttattcatggaagcaaccatctctttagaaacaatattcggagcagaaacaccaacgaaaatatcagcaccttttaatgcatcggcaagtgttcctgtgcgttcttccagatttgtaacttcagtcatctgctgctgcatccagttcaggttcggtgagttcttggaaatgattccgttgatgtcacacattgtaatatgagggaaaccataagtgagaagcagctttgtgatagcaactccggcagatccggctccattcactacaacacggcaatcttcctttttctttccagttactttcagggcattgatgattccggcgaggacaacgatagctgttccgtgctggtcatcatggaaaaccggaatgttcagaagttctttcaggcgtgtttcgatttcgaaacagcgtggagctgaaatatcttccaggttgattccaccgaaagccggtgcgatgttgactacagatttaatgatctcttctgtgtcctgtgtatccagacagatcggaactgcattgacaccaccgaattccttgaacaggaccgcttttccctccataaccggcatagcagcaagtgcaccgatgtttccaagaccaagaacagcgcttccgtcagatacaacagcaactgtattggctttcatagtgtatttatatgcggcttcaggatcctgtgcaatcaccttacaaggttcagcaacacccggagtataagcgatggcaagatcttctcttgagttgacatgcgctttggcagttgtctctatcttaccattccattcttcatgcatttttaaagctttttcattgtttgtcatgattttatacctctctgatttgattgaattaatgataccactgaaaaaggaaacacgcaagtacaggaaaacagagaaaagttcaaaaagttctttctttttagaaaaatatactgtataataacaccatatttaaagcaaatttccattaaagtcgaatcagacttgtattcccgaagtatgaatgaataatccagtatgtgaaaagggcacatgtgaagtggattgacagaacaaatttacctgaaaagaaaggaaaagaatatgacacgagaaaaatatgaatcattgccgctggcaacattgaaagaacttgcaaaagcaagaaagatgagaggtgtttctacattaaagaaaggcgatctgatcgatgcaatgcttgagctggatgagcaggaagagcagaaagaggcagcagaagaagcgagagaagaagtaaaagaagaaaaaaaagaagagacagatattgaacagctggacagtggttttacagcaaacggaatccttgaggtgcttcaggatggatatggattcattcgttctgacaattatcttccgggagatggagatgtctatgttgctccttcccagattcgcagattcggacttaaaacaggcgatatcctgacaggaaatacaagagttaagacgcagggagaaaagttcagtgcacttctttatgtgtctacgatcaatggactgcgcccggcagaggcaatgaagagaaagaactttgaagacctgactccgattttcccgaatcagagaatccgtctggagaatccaggctgtacaacagcaatgcgtattgttgatcttgtttcccctattggaaagggacagagaggtatgattgtatctccaccgaaagcaggaaaaactacattattaaaagaagttgcattatctgtacagaagacagaaccgaatatgcatcttctgattctgttgatcgatgaacgtccggaagaggtgactgatattcgtgaggcaattgaaggtccgaatgtagaggtgattcattccacatttgatgaacttccggagcatcacaaacgagtatcagaaatggttatctcaagagcaaaacgtctggtagagcatggaaaagacgttatgattcttcttgacagcatcacaagactttcaagagcatataacctgatcgttccaccatcaggaagaacactttccggtggtcttgatccggcagcactttacagtccaaagcgtttcttcggagcagcaagaaatatgagagaaggtggaagccttacgattcttgcaacagcactggttgatacaggaagtaagatggatgatgttgtttatgaagaatttaaggggacaggtaacatggaactgatgcttgacagaaagcttcaggagaaaagagtgttcccggcaattgatattccaaaatcaggaacaagaagagaagatcttcttcttacaaaggaagaacaggatgcagtttatattatgagaaaagcaatgaacggcatgaaatcagaagaggcagtggacaatcttttgaatatgttttcccgtacaaaaacaaacgaagagcttgttcagcagatcattcgtcagaaatttatctaaaaaggtgttgcattattaaaaaatgtgtgatacaattagaaagctgtttagagaaaataataagtaatttaaaaatagagaggtgaaaatcatgcgcgaaggtatccatcctaattattatcaggcaactgtaacatgcaactgtggaaacacatttgttacaggatctacaaaggagaacatccacgtagaaatctgctccaagtgtcatccattctacacaggtcagcagaaagcaacacaggctcgtggccgtgttgataagttcaataagaaatacggtattaaataagaaatacgaagtgatgagggctgaggtggaaatctcagtcctctttgtgtttaggagaaatatatgaaatcatcgaatataggcggccaggcagtgctggaaggcattatgatgaagaatcgggaaacatattccgttgccgtccggaaaccagatggagagattgaagttgatattcaggaatacaaaggagttctcccatggaaggcaccgcaaaagattcctttcattcgggggatttttaattttgtggattctcttgtgctgggaatgaagacattgacttattctgcaagtttttttgaagacgaggaagaagaaattcttacagaagatgaggcaagaaagcaggagaagaaggaaaaactgatcatgaatctgacagttgtggtttctgtcttgattgcggttggtatttttatggttcttccgtattatctgagtagtattatagaaaagcatacctcttcacatcttgtaatgactgttttagaaggtgtgatccgcgttgctattttcctgatctatattgttctgatttccagaacaaaggatattaagagaacatttatgtatcacggggcagagcataaatgtattaattgcatcgaacatggattggaattaaatgtagaaaatgtacggaagagttccaaacaacataagagatgtggaacgagctttcttttctttgtcatgatcgtaagcattattgtctgcttttttattacggcaaagtcccagattgtgagagtacttcttcggatcgccctgcttccgttgattgcaggaatctcttatgaattgatccgtctggcaggaaacagtgatcatccggtaatcaatgtacttagtaaaccgggactctgggttcagaatctgacaacaaaggaaccggatgacagtatgatcgaggttgggattaaagcagtggaagcagtgtttgactggaagacatggcaggaggagaacctgaagcaatgagaacagaatcagacaagaggacagtgtataaaacagattgcagcgattcaataagtttgaaaaatgcatataaagaaggaaaagaaattcttgcgaaggcaggaattacagaggcagatctggatgcgtggtatctgttggaatttgtgacagggattacgaaagctcgctattatatggatccggatcagagcatgaatccggaagcatggaaaaagtataaagaatatcttgaaaaaagaagaaatcatattccattgcagcatattacaggaagtcaggaatttatggggcttgaatttctggtgaatgaacatgtgctgattccaagacaagatacagaggtgcttgtggaagaggcactggagatgatgaaacaagagatattcagatcaaaaggttgtttgcaattgttggatatgtgtaccgggtcaggatgtattcttctgagcgtaatgcattatgcagaacaaaagggtatatttatagaaggaacaggtgttgacttttcggagcaggctcttatggtagcacagaaaaatgaaaaacatttgagaagcacgaaaaaggatgagaatggaaaagtgaactggattttgagtgatctttttgaaaatgtcagtgaaacctatgatataatcttatcaaacccaccttatatcagaacagcagaaattgagaagcttcaagacgaagtgaaacttcacgatccattcagtgcattggatgggaaagaagacggattgtatttctaccggaagattgttactgatgcaaaacaattcctgaaaacaggaggaatacttgctttcgagattggatatgaccagggcaaagaagtttctgatcttatgaaaaaagcaggatatgacaaggtgttcgtaaaaaaggacctggcaggacttgaccgcatcgtctgtggcgtgtactattaaaaagataaagaagataaaaaatagaagaggatatagaactatgtttgacagattagaggatttggtaattcgttaccaggaagtaatgggtgaacttcaggagccggatgtggcgaatgatccggaacgtttccgtaagctgatgaaagagcagagtgatcttgcaccaatcgttgaagcttatcaggaatataagaactgtaagcagaatgtagaagagagtctgatgatcctggaagaagaatcagatgaagagatgcgtgagcttgcaaaagaagagttgaatgaatctaaagccagaattgaagaattggagcaggaacttaagattcttcttcttccgaaggatccgaatgatgataagaacgttatcgttgagatccgtgccggtgcaggtggagatgaggctgcactttttgcggcagaaatttatcgtatgtatgtgcattatgcagacagccgcagatggaagacagagatgatctctctgaatgagaatggaatcggcggatttaaagagtgtgtattcatgatcacaggacagggagcatattcccgtatgaagtacgaaagtggagtacatcgtgtacagcgtgtgccggagacagaaagtggcggaagaattcatacttcaacaattactgtagccgtaatgcctgaggcagaagaagttgatgttgtaatcgatgagaaggatatccgtatcgatgtaatgcgtgcatcaggaaacggtggacagtgtgtcaatacaacggactctgctgtacgactgactcattacccgaccggaatcgtgatctacagccagacagagaaatcacagctgcagaataaagagaaggcattccgactgcttcgttccaaactgtatgacctggagcttgagaagaaacaggcttctgaggcagcagagagaagaagccagatcggtacaggagaccgttctgaaaagatcagaacatataacttcccacagggaagagtaacagatcatagaattaagctgacacttcataaactggatagcattttgaatggtgatctggatgaagtgatcgacagcctgattgcagcggatcagacagcgaagcttgcaaagatggaggagtagtacaaggatgataccggaattcaaacgaccggaactggaagacaaagaactgattgactattattttgcacaggctccaagcagaagctgcgagagaacatttgcgaatgtatatctctggtccagacagtataaagtgaaatatgcaatccttcataatgcacttgtatttcgtgatgaaggagatggacatacttatgcttaccctgtaggaaagccggaagccgtcaaagctgcattggaagaattgatgaagatctgcgaggatgaagactgtgaattcggtctttactgtgtaacaccggagaatttttcacagatggaagagtggtatccgggacaattccggattgaatatgacagagatcaggcagattacatctatgagacggagaagcttgcaacacttgcaggaaagaagcttcacggaaagcgaaaccatattaacaagtttaagcagctttatccggactggtcttacgaatcactcagtgatgagaatgtagaagcgtgctttcagatggctctgaagtggagaaattcgaatggatgtaatgatgatcctgagaagaacgcagagatgtgcgtttcgttgaattccctccgtttatacaaagaactcggctttaaaggcggagtgttgagaaatggcgaaaaaattgttgcttttacagtaggggaagaactgtgcaaggatacatttgttgttcatattgagaaagcatttgcagatgtacagggagcataccctatgattaatcagcagtttgttgaacatgaatgtatggattacacttatgtgaacagagaagatgatgccggggaagagggacttcgtaaggcaaaattatcttatcgtccggcttttttggaagagaaagggtttgtgacaagaataggaggacagcaatgatttcaaaaaaaatggaaaacatggtagcgaacagttctgcaatccgtgcgatgtttgaagagggcaaccgtcttgcagcaaaatatggagcagagaatgtatttgacttcagtttgggaaatccgaatgttccggcaccggaagcggtaaagaaagcaatgatcgagatcctttccgaagaggatccgatcgtgcttcacggttatacgaatagcaatgcaggttatgaagatgtgagacaggcagttgctgattccttaaatgaacgctttggaacaaactttgcttcccgcaatatcacgatgacagtcggagcagcaggaggtcttaatgtgattttgaaatcactgctgaatccaggtgatgaagttgttgtgtttgctccttattttggagaatacagaagctatacggataattatgacggtgtgatcgtggagatatctccggatacagagacattccagccaaagcttgatgagtttgagaaaaagctgtcgccaaagacaaaagcagtcatcgttaatacgccgaataatccgacaggtgttgtttattccgaagagacgatccagaagctggcagcgattcttgagaagaaacagaaagaatttggaacagagatttatctgatctcagatgaaccatacagagaacttgcttatgacggagtggaagttccatatctcacaaagtattatgcaaatacagttgtaggatattctttcagtaaatcactttctcttccgggagaacgtatcggttatcttgtaattccggatgaagtggcagacagtgagaaactgaacgccgcagctaacgttgcaacgagaattcttggatttgtcaatgcaccgacactgcagcagaaagtggtgaaggcatgtctgaatgagaagacagatatttcatattatgacagaaacagagagactctttataatggattgaaagaacttggatttgagtgcatcaaaccggaaggagcattttatctctttgtaaaatcaccggttgcagatgaaaaagaattttgtaataccgcgaagaaatacaatattctgatcgttccgggaagctcttttggatgtcccggatatgtcagaatggcgtattgtgtagcatatgaaacaattgtaaatgcacttcccaaatttgcggagcttgcgagagagtatagatagaggtagtaccatggatgtaagagaagaacttttgagaaatatacgtagtgtagaaccatatgtaccgggcgagcagccacagcataaggttgtgaaactgaatacaaatgagaatccatatccaccggcaccgggggtggaacgtgttctgaaagagatggacacagaccgttttcgcctgtatccggatccaactgcggacgaactcgttggaagtctcgcagattattatggtgtaggaaaagaccaggtctttgtaggagttggatctgatgatgtgatttctatgtgtttccttacattttttaattcagatctcccaattctcttcccggatattacatattcattttataaagtctgggcagaattgtatcggattccatatcattgtccaaagcttgatgaaaactttaagattgtgaaagaggattattatgctgaaaacggcggaattatttttccgaatccaaatgcgccgacagcaatttatgaagatcttgaatttgtagaagatatcttaaagcagaacaggaattctatcgtgatcgtagatgaggcatatattgatttcgcgggaagatctgcgatggaactgatcgataaatatgataatcttattgtgacacagactttctcaaaggcaagaagtatggctggtatgcgaatcggatatgcaatctcgaatccagatctgatccgttgcctgaatgatgtgaaatattcttttaactcttacacgatgaatcagacagctcttgcctgtggtgtggaagcggttgaagacaaggcatattttgaagaaggagttcgtaaaatagttgaaacaagagaatgggcaaaagaagagctcaggaaacttggttttgttttcccggatgcaaaggcgaattttattttcgcaagacatccagaggttgatgcgaatgaacttttccaggctttgaaagagaataatatctttgtcagacattggaacgcaccacgaatcgatcagtatctgagaattacaattggtacaagagaagagatggggacgctttttgattttttgagaacatatataaaggagaaataactgaatgagtgaagctttgatcaactggtttatggtgacactgggcggaaaggtcggtaaggaatttattcttttcctgatctcaatggttccgattctggaattgcgtggaggactgcttgcagcaggaccggcatttttgaatgtggaacttgcaaaagcagtacctatctgtgtgattggaaatcttgttccaattccattcatccttttactgatcacaaagatctttgactggatgaaaggaacgaagcgtttgaagccgatggtggagaagctggagaagaaggcaatgagtaaaagtgacaagatagagaaatatgaattctggggtcttgtactttttgttggaattcctcttcctggaacaggagcgtggacaggatcactgatcgcagctctgcttggaatccgctttagaaaagcttttccggcagttgttgttggtgtctgcctcgcagcatttattatgtcagtcatttcctatggaattattggcggtatttttggataagataaatatgcaaaggaagtgattcttatgttactgaaagataatgaagaaaagagaaatatagcctggagaacagttatgacggttacttcagttctgatcattctgatcgttgtttttttcgctgtgaagctttttacttccaatcctctgacaggaaattgggagaacacagatgatggaatgaagctgacgatcaagaataacggaacaatggatattgtgcaggctttggacgagagtacagtcagcgttcctgttgattatacaattgatatggaacataagcgttttgcaattcatgtgaacgaagaaaagatagcaaaacaggctgaaaagacaaaagactgttccaaacaggagcttcaggatattgcggatgtgatggaaggaacttacgaatacagcgtggaacagaacgtactgacactgactgattcagaatatggaagtcagaagacatttgaaaaaagtggaaagtaaacggtgattctgcctcagcagatgacacagaaagaacttgcagagcagtggaaacagggggtacagatcatgtacagaaatcagacgaaagaagtaagaattggggatgttgtgattgggggagaccatccgatagcaatccagtctatgacaaatacaaggacagaagatgtagaagccacagtggagcagatcctgcgtctggaaaaagcaggatgtgagatcatccgctgtacagttccgacaatggaggctgcaaaagcaatcaaagagattaaaaaacagattcatattccgcttgttgcagacattcattttgattataagatggcaatcgcagcaattgagaatggagctgataagattcgtatcaatccggggaatatcggtgcaaaagaacgggtacaggcagtagtagacaaagcgaaagagtacaatgttccaatccgtgtcggcgtaaacagtggttctcttgagaaacatctgcttgagaaatatggtggtgttactgcagaagggatcgtggagagtgcgctggataaagttcatctgatcgagtctatgggctatgacaaccttgttgtcagcattaaatcttctgatgttctgatgtgtgtgaaggcgcatgagctgatcgctaaggaatgcccatatccgcttcatgttggaattacagagtctggaactgtatattcaggaaatgtgaaatcttctgtaggacttggaatcattctccatgagggaatcggtaatacaattcgtgtttccctgacaggagatccggtagaagagatccgtacagcaaaactgattcttaagacacttggacttcgcaagggaggtattgaagttgtatcctgtccgacttgtggaagaacaagaattgatctgatcaagcttgcaaaccaggtagaagagatggtagcagacattccgcttgatattaaagttgcagttatgggatgtgttgtaaacggacctggagaggcaaaagaagccgatatcggaattgcaggaggtatcggggaaggacttttgatcaagaagggtgagatcatcaagaaggtaaaggaagaagaacttcttgatactttaagacaggagttattgaattggaacaaataaagaatgaaaaaacattttttcatgtatttcccacattgaaagtagaagaggaatttaaagtcctctttgctgatgtggaagttaagaaaatcacgactaattccggtcgtgattttctgcatgtacatttaaagagtcatcatctgatcccaaagaagaaaatatggcagatggagcagcggatcaaagagcagctctttggaacatcttctgtaaaacttcagattctggaagagtatgagctgtctgagctttatacaccggaagcggtgatggaagagtacaaggagagtttgattcttgaactgaaagaaatcagtgtccttgctgcaaacatgttttcacaggcagaagtgaactatgaagagggaaatgtcgtccgtctggagcttcttgatacgattgtttccgaaggaagaaaagaagaaatcatgaatctgctggacgatgtattcaggaatcgttttcatatgaatgttgatatccgggttacatataaagaaaacgagggtcagggaagcagagaatatgacgagcagaggattcagcaggaaattaatgcaatctttgaacggcgcgcgaaacagagaggcgaatatgaggagcgaaagtctgctgtggaggcaaagaagaagtcatccgaatcaggaagctcgtcttccggagaaaagaaagcagagacttcaggaaaatcttcttcaggaaatgcatccgtttcgggcggaaagaaagagttcaaaaagaaggaattccgcaagaaggattatgtgcgtccggtgaagatcggagacgatccgaacctgatctacggaaagaattttgaagatgagccaatcaaattggaacaggttgtttctgagatgggtgagatcacaattcatggtaagatcatcaattttgatacacgggagatcagaaatgagaagacgatcattatctttgctgtgactgattttacggatacaatcacgatcaagatgtttgccagaaatgatcagttaccggagattctcggagatttgaagaaaggtgctttcgttaaaatcaaaggcgtgacgacaattgataaattcgatggtgaactgacaatcggttcaattaccggaatcaagaagattggagactttacggtctcaaggcaagatctcaatccaacgaaacgtgtagaacttcattgccatacaaagatgagcgatatggatggagtttctgaagtgacagatatcgtccgcagagcacatgactggggacacccggcgattgcaattacagatcatggtgtagcccaggcgttcccggttgcaaatcattatattgagacattggataaagatgatccgtttaaagttctatatggtgtggaaggttatgtggtcgatgacttaactgagattgcagttaatgcaaaagatcagacattggatgatacctatattgtttttgatatcgagacaacaggattcagttctatccgtgacagaattattgagattggagctgtgaaggttgagaatgggcagattgtagacaagttcagtacctttgtaaatccggaacgcccgattcctttcgaaatcacaaacctgacaagtattacagatgagatggtgctggatgctccgacaatcgaggttgtgctgccacagtttctcgaatttattggtgagggcgcattggttgcgcataatgcaggatttgatgttgggtttatcgaacagaattgtcgtgtgcttggtctggaacaggaattcacagctgttgatacagtggctcttgcacgtgtgctgcttccgaccctttcgaaatataaattgaatctggttgcaaaagcacttggaatttcattagaaaatcatcatcgtgcggttgatgatgcaggggcaacagcagaaatttttgtaaaatttgttgaaatgctcaaagatcagcacatcatgaacttaaaagaaatgaacaagtttggggatcgtaatgttaatgcaatccgtaagatgccgacacatcacattattttgatcgcacagaatgatattggaagatataatctgtatcagctgatcacggcatctcatatgacatattatgcaagaagaccgagaattccgaaaagtctgatcaatgaacacagagaaggaatcatcattggaagtgcctgtgaggcaggagaattataccgtgcggttcttgaaaaacagtctgcacagcagattgcgagactggcagatttctatgattattatgaaatccagccaattggaaatgatatgtttatgctcgaagatgagaaaacgccgaatatcaatacagaggaagatctgcgtaacgtaaaccgggagattgttgaacttggagagaaattcggtaagccggttgtagcaacctgtgacgttcatttccttgatccggaggatgaagtttatcgccggatcatcatggcaggaaaaggattcaaagacgcagataatcaggcaccgctgttccttcgcacaacagatgaaatgttggaggagtttgcatatcttggttctgcgaaggcgagagaagttgttatagaaaatccacagaagatcgcacgtatggtagagaaaatctcaccggtaaacccaaacaagtgtcctccggtaatcgcggattccgatcaggagcttcgagatatctgttatcgtaaagcacatgaaatgtatggagaagatcttccggtacaggtgtcttccagacttgagaaagagctgaactctattatttccaacggctatgccgttatgtatatcattgcgcagaaactggtatggaagtccaatgcggatgggtatcttgttggttcccgtggatcagtaggttcgtcttttgttgcgacgatgtccggaatcacggaggttaatccgctaagccctcactattactgtgaaaaatgtcattacagtgattttgagtctgaagaggttcgtgcatttgccggaggctgtggttatgacatgccggatagaaattgtcctgtgtgcggagaaaaactggtcaaggccgggtttgatattccgtttgaaacattccttggtttcaagggagataaagagccggatattgacctgaacttctccggagattaccaggcgaaggctcataaatatacagaggttctctttggtgagggtcatacattcaaagccggaacgatcggtacgctggcagataagacagcatatggatttgtgaaaaactattatgaagaacgtggtcagagaaagcgaggctgtgagattgaacgaattacagaaggatgtaccggaatccggcgaagtaccggacagcatccgggaggaatcgtagtacttccgcacggacacagcatcaatgagtttacaccggtgcagcatccggccaacgatatggaatgtggcattacaacgacacattttgattaccattccattgaccataaccttttgaaacttgatattctcggacatgatgatcctacgatgattcgtacattggaagactatatcacctccgatgcaatggaaaatgaatataatgaggagcatcctttcgttgcaacggatattccgctggatgacaagaaagtaatcgaactattccatggcacagaaattctcggaatcaaaccggaagacatcgacggctgtaagcttggatgtcttggaatcccggagttcggtacggatttcgttattcagatggtgcaggatacaaaacctcagacgttatcagatttgatccgaatttccggtctgtcacatggaacgaacgtgtggctcggaaatgcacaggaacttgtaaaatccggaaaagcaaccatttctacggcaatctgtacccgtgacgatatcatgatctatctgatcaacaaaggagtggaaagtgcactggcctttacaattatggagagtgtgcgtaaaggaaaaggattgaaaccggagtgggaagaagcgatgaaagctcaggatgtaccggactggtatatatggtcctgtaagaagatcagctacatgttcccaaaggctcatgcggcagcctatgttatgatggcttatcgtatcgcttattgtaagatcaattatccgcttgcttattatggagcatattttggaatccgtgcggatgcattttcttatgcgatcatgtgtcagggcaaggataaactgaattactacatgaaagattataaaaaacgaagtgataccctgacgaaaaaagaacaggatgtcatgaaagatatgaagattgtccaggaaatgtacgcacgaggactggagtttatgccgattgatatttaccgggcgaaggcgaagatgtttcagatcattgacggaaaactgatgccgtctcttgcaagcatcgaaggaatgggagataaggcggcggaagctgtggaagaagcttcaaaagacggtccatatctctcactggatgatttccgtcagaggacaaaagtaagtaagacagtgatcgatctgatggcagaactgggattatttgggaatcttccacagagtaatcagctttccttgtttgatttttcgtaggaaatgcgctagacggatgtaaagtgctgtgctataatgactacaacgctttgacgtggtaaagctttaatggaggaagagataatgtacgatttcgatgagattatgaacacagacccagagatagcagatgcaataaaagcagagatggagagacagaactcccatatcgagctgatcgcctctgagaactgggtgagcaaagcagtcatggcagctatgggaagccctctgactaataagtatgcagaaggatatccgggaaagagatattatggcggatgtcagtgtgtagatgtagtagaagaccttgcaagagaaagagcaaagaaactgtttggatgtgagtatgttaatgtgcagccacattcaggagcacaggcgaacatggcagttatgtttgccatgcttgagccgggagataagatcatggggatgaaccttgatcatggcggacatctgacacacggttcaccggttaatatgtccggtaaatattttgatgtagcacattacggagtgaatgcagacggcgtgatcgattatgatgaagtgcttcgtattgcgaaggaacataaaccgaaactgatcgttgcaggagcaagtgcttatgcaagaacaattgatttcaagcgtttccgtgagatcgcagatgaggtgggagcatatctgatggtagatatcgcacacatcgcaggacttgttgctacaggacttcatccaagtccgattccgtatgcgcatgtgacaacaacaacaacacataagacactccgtggaccaagaggcggaatgatcatgtgcagcgaagagatgaataaaaaattcaatttcaacaaagctgtattcccgggaattcagggaggtccgttgatgcatgtgatcgccggtaaggcagtttgcttcaaggaagcacttgagcctgagtataaaacatatatggagcaggttgttaaaaatgcgaaagcactctgtaacggtttgaaagcacgcggagttaagattgtttcgggagatacagataaccatctgatgcttgtagacctgtcgggaacagagacaagcggaaaagagctggagaagcgtcttgatgatgctcatgtaacagcgaacaagaatacaattccgaatgatcctcgttcaccgtttgtaacaagtggtgtaagacttggaacaccggcggttacaacacgtggaatgaaggaagatgatatggataagatcgcagagattattgcaatggtaatcgaaagtgaagagaatgtagagaaagcaaaagcaatggttgctgagctgactgcaaaatatccactttgttaataaaataattatatccggcaaaactgcatttctcgtgtaagcataatgtagattgccggggtgtgcaacaaaaaaagagcttaaaaaagctcttttttgttaatcgaatttctgtattacttttaaaaattaaatacggtctatttattaattaaaaggtacataaagtcttgattaaagtttcactacgttaacagcctgaggtcctttagcgccttctgttacttcgaactcaacagcctggccctcttcgagagatttgaatccatccattacaagtcctgaataatgaacaaaaatgtcattgccttcagcgtcagagataaatccgtaacccttctggttattaaaccattttactgtacctgtcattgtgttgccctccattaaaagaatataagttgttaaatcatcacagtttacaatgcgctgaaaactgtaatattgtgtcagtacaaattcatattgacactttgtctattgtagcatgtttaacaaagaaagtcaaatgtaatcttttttgatttgtagaaaaatgacaaaaacatgtgaaatgacgtaaaatcgatttcaacaatttgtaaataccatttagcatatcggatttataagattggtgaaaaatagaagtgcgaggaaagattattttacgaatggattggaaaaataaaggatgtcgattgaaaaaagaattgaagtattatataatttaaccaatgtctatgaaatattttatttcaaggaggatttgtgtatatgataacgattgaaggaaaaagcgtatttggtggagtatccattggaaagctgatgttctataagagaaacgaaaaggtgatcagaagaacacatgtagatgatgtggatgcagaatggaagagattcgaagaggctaagaatacagcaatcgaccagctgaaagttctctacgacaaagccattgaagatgtaggtgaggccaacgccatgatctttgagattcaccagatgatgcttgatgatctggattatctggaatctattgaaggaattatccgtacacaaagtgtaaatgcagagtatgctgtttcaacaacagctgataactttgcacagatgtttgcatctatggatgatgcatatatgcagggacgtgcagcagacgtgaaggacgtttccgagcgtgtacttgatattctctgcggagtgagcaacggaacacgtgagatgacagaaccttgtattgttgctgcggatgatctcgcaccaagtgagacagtacagcttgataaagagaaggtacttggatttgccacaatgtatggttcttctaactctcatacagcgatccttgcaagaacaatgaatattccggctgtaatcgggatgggcgaagctctcagcccgaaatatgacggagagatggctatcattgatggatttacaggaacactctatgtggatccggatgaagagacacttgcaaagatgcaggagaagcgtgcgaaagaccttgagcagaaagaacttctgaatcagcttaaaggaaaagagaatgtgacaaagagcggacagaagatcaatgtctatgcgaacattggtaacgtatctgatcttggtgcagtacttaagaatgatgcgggcggagtaggtctgttcagaagtgagttcctttatcttgagaacagtacttatccgacagaagaacagcagtttgcagcttacaaacaggttgtagaaagcatggcaggaaagaaagtcatcattcgtacacttgatatcggagcagacaagcaggttgattatttcaatcttgcaaaagaagagaacccggcacttggatacagagcaatccgtatctgcctgacaagaccggagatcttcaagactcagcttcgtgcactttaccgtgcatccgtatatggaaatctttccatcatgttcccaatgatcatttctgtaaaagaagttcgtaagatcaaagagatcatcgaagaagtgaaggcagagttgagagaagaaggacttccatttaaggaagacgtagaacttggtattatgatcgagacaccggcatcagttatgatgagccgcgaacttgcgaaagaagttgatttcttcagtgttggaacaaatgacctgacacagtatacactggcaattgaccgtcagaaccttgcgcttgatgcgttctatgatccacatcatccggcagtgcttgctatgatcaagatggcagcagataatgcacacgcagaaggaaaatggatcggaatctgtggagaacttggagcggaccttgaactgacagaagagttcctgaagatgggactggacgagctgtctgtatctccggcgatggtactgccgctgagaaagaagattcgcgagtgtgagtaatttgtatttttgaggggattcatatggggaatgagcactttatagaatggtcgcaagaccagtcctgctattaccacgagcaccggctcgctctacctcatccctttgaaagtatgtaacgtaagagccagaacagttaccgtgtgtggtgcctgtctggctcttactaacatactgaacaaagtgtattcggaacgctcctgccttacatgtgcccatggcaacagcagaactgttctcgcttacactttcaaagaggagggctcatttcaagagaaggaatccactcagaaatacagaattgaaagtaggaaagaaaacggatatttatcgactaggataatcagtgtattcaaaaatgaaagggggcggattttttggagagggagatttttttgtggctggggcttatggtggtgtttttgattattgagcttgccacggttggtctgacttcaatctggttttcgggcggtgcgctggcggcgttattagtttcacttgttggagtgggaatggtgatacagattgctgtattcgtagtcgtttcagcagtgcttgtgatctttaccaggccttttgcagcgaagtatgttaatgtgcatcatgtgaagacaaattgtgatgaattgatcggaagtgttgttaaggtgacagagacggttgataattttgcacagaccggtactgcaattgcgcagggaaaggaatggactgcaaggtgcaagtcagacaaggacagaattgagaaagattcgcttgccaaagtaacagcaatttccggagtaaaactgattttagagaaatgtaaggaggatgagctatgatatttggacttattatttggatgatcattattatgatcgtggtgtggcttcttgtgtcgaatatccgtattgttccgcaggcgcatgcgtatgttgtagagcgacttggcggatacaaggagacatggggcgttggattacattttaaggtgccgatccttgatcgtgtggcaaaaagagtttccttgaaagaacaggttgttgattttgaaccacaggcagtgatcacgaaggataatgttaccatgcagatcgatacggttgtattctatcagatcactgacccgaagaagtatgcatacggagtagaaagtccgattgcggcaatcgagaatctgacagcaacaacactccgtaatatcatcggagatctggaattagatgagacactgacttcccgtgagacgatcaactccaagatgcgtacgatccttgatattgcaacagatgagtggggaatcaaggtgaaccgtgttgagctgaagaatatcatgccaccgaaggcaatccaggatgcgatggagaagcagatgaaagcagagcgtgaacgccgtgaagcaatcctgcgtgcagaaggagagaagaagtctacgattcttgttgcagaaggagaaaaggaatctgtgatcctggaggcagaggcatctaagcaggcagcaatcctgaaagcagaagctgaaaaacagaaacggatcaaagaagcagagggacaggcagaagcgatccgttctgtacagaaagcgacagcagaaggtatcgagtatattaagaatgccggagcagatgatgttgttcttacattaaagagtctggaggcatttgccaaggcggcagacggaaaagcgacgaagatcatcattccttcagagattcagggaattgcaggacttacgaaaacaatcgcagaagttgcccgtacagaaacaagcgttgcaaaagaaaaagaagtaaagtaaaataaaagatgtatttcagcgtgccaatctgtcaaaagattggcacaatgtgttttacaacgataatattttggagtgcaaatgaaatggaaacagagaaaatcatcaggttatcggttcggaatctggttgaattcatattaaaagaaggtgacattgataacaggatttcaggtacgcttgataaagatgcgatgctgatgggaggacgccttcaccgaaagatccagcgtatgatgggctcaaactatcaggcagaagtttccttaaaactgcagcttccgtgtgacggattccaattaaaactggaaggacgtgcagatggaattctccttgaatcagaaaaaacaataatagatgagatcaaaggcgtcgtgcgttccctagatcgagtggagcatcctgtgccggttcatcttgctcaggcaaaatgttacgcatatatttatgccagacagcagggattaaagcagatcagtgttcagatgacctattgtaatcttgatactgaagatgtgaaaagatttcgggaagagtatacatttgaagaattagaaaaatggtttcttgatctggttcatcagtatgaacgttgggcaaaactgcagattgagtgggaaaagagaagagatgcttcgattcatcagaccgaatttccattcgcatatagagaagggcagtttgacctggcagcttccgtatatcgtacaatttatcacaaaaagaaattatttatccaggcctcaacaggaaccggaaagacgatggcagtattgtatccggcggtgaaagcaatcggagaaggattgggggataaaatattctatctgacagcaaagacgatcacaagaaccgtggcggagcaggcattttctattcttgaagaaaagggtcttgcctttcgttcaattacattgactgcgaaagagaagatctgcttttgtgaggagacagaatgcaatccggatgcttgtccttatgcgaaaggtcattttgaccgggtgaatgatgcagtttatgacatgttagaaaagcaaaagaagctgacacgggaatcaattgaaagacaggcagaagattttcatgtatgtccgtttgaactatctcttgatctgtcagaatgggcggatggggtgatctgtgattataattatgtgttcgatccgacggcacatttgaaacgattttttgcagacaatgtcagcggagattatttgtttctgatcgatgaagcacacaacctcgtggaacgtggacgggaaatgtacagtgcttccatctataaagaagacgttctcgaggtgaaaaaactgatgaaggaccgagataaaaaacttgtgaagagtctggaatctgtcaataaactgatgcttgagatgaaacgcgagtgcgagaattatcggttggtggaaagtgtttctccatttgcagtaaaacttatgaatcttctgactcaaatggaaagatatcttgaagaagagcggaatgcaggaaatgcagagcagccggatgcatttatggaactctttttccaggtgaggcagtttttggaaattcatgaactgttggatgaaaattatatacagtatacagaactggaaggaagcggaaggtttaaagtgaagttgttctgtgtgaatccggcacaaaacctgaatcattatttgagccagggcaattctacgatttttttctcggcaacattgcttccaatcgattactataaacaattactatctgttgagaaggatgattatgcagtctatgctgaatctaagttcccacaggagaacaggaaaattctgatcggaagtgaagtaagcacaaaatatacacaaagaggcacagaaatgtatcgcaaaattgccgactatctgagaagcacagtggatgggaagaatggaaactacattgcattttttccttcctatcagtttatggaagatgttttggaagagtttgaaaaactggcatccggagtagaactagtaattcaatcgcaatttatgtcagaaaatcagagagaagaattcttggaaatgtttgaagaagaaagagatcatccgatgcttggattttgtgtgatgggtggtgtattttcagaaggaatcgatcttacacatgacagattgatcggagtgatcgttgtcggaacaggaattccacaggtgtgcaatgacagagaaatcgtgaaaaattattttgaccagaaagggatgcgaggatttgattatgcgtacctttatcccggaatgaataaagtacttcagtccgcaggaagagtgatccgcaccgaagatgacaaaggaattattcttctgcttgatgaccgttttcagaatcggcagtatcagcagctatttccgagggagtggaaggaatacgaagtgtgtgggcggaaagagataaaagaaaagatggaagaattctgggagaatcgataaatgaaaaatgagaatcgttattggataaagaagaagtgattcaagaatatttgcaactgttcagagccagatgaaatttcataaaacaggtataaaatacttgcattttaaggctggttttaaaattctgcttggctccgaacagtacaaaattttactgttctttaaaatagttcaaaaattcctgtgcaggcttagccagagggagctgctcgttgtaagcaatcacaagagaacgctccggcatctcttcttccatatccagcttgaagataccatcattgttctcagaaagacaataatccggaatgaatgcgattccaagcccaattcttgcaagatcgatcagaagatcattgcttgtaagttcgatctcaggaacgagatcaagctgatgctgctggaacaggcgatgaagaaactcgtttgtcgtactgttcttatccagcattaggatcggatagtggagcaaatcggcaagtgtaagtttcttttcccttaattcagggtaattgtttccggcaatgaaaacatcatggaaatttttgatcttcatagaggcagaaatattgttgagcgctgcgttcggataattgacaacaatcaaatccaccagtccgttctttaaaagctctgtacatcttaaagaagtctggttgataactttaatatgtacatttgggaaagtcttatggaatttctcaaggtatggaacaaggaaatatctgcagatcgtgtcacttgcaccgatgcggatctgcccaccggtagaagcggcatctaaaagctgagcctcacctttctggatcagattcatggccggttcaatgtggcgcaggagaatctctccttccggtgtgagctggactttctttgtgcttcggataaaaagcgtctgatccagttttcgttcgagtgttttgatcgactggctgacagcagactgtgaaataaacagctgcttggatgcctctgagaaattcaatgtggtggcgacgtgataaaatactttgtataattcgtagtttatatccatcattttattagacctcctaataaatattcatcttattataagataaataaagggaaaatacaacagaataaaaaaatccgttgcacaaaatatgaaaaagtagagtaaatattgctgactccgagaaagatacgagaaaacgacaatcaattagcggtgcttatcagattgtttaattttattaattatactaatgaagaaaactatggtaggataaaaacagataatgtaatgaaggtagtatcgtgttttgagcacgtaatacagaaagaggagattatatatgagtaatgtaaagcgcgtatatgtagaaaagaaaccggagtttgctgttgcggcgaagggccttagacatgagatccgtcattatcttggacttcaggatgtgacaaatgtacgagttctgattcgttacgacgcagagaatatttcagaagaaacatttgaaaaggcatgcaatggtgtgttcgcagagccgccggtagatttcctttataaagaagaattcccgaaaaatgaaacagataaatatttttccgtagagttccttccgggacagttcgaccagagagcggattctgcagagcagtgtatccgttttattaaagaagatgagactcctgtaatccgtacagcagttacatatgtaattgaaggcggagttacagacgaagaactgcaggcaattaagaatcactgcatcaacccggtagattccagagaagctgcagcagagaaaccggagacactggtgacagtatttgatgagccggcagatgtaaagatttttgacggttttaaagatatgccggaagcagaattgaaagagttatatgattctcttggattggcaatgacatttaaagatttcctgcatatccagaactattatgcaggagaagagcacagagatccgacgatgacagagatccgtgttcttgatacatactggtcagatcactgccgtcatacaacattctctacagaattaaaagatgtgaagtttgatgaaggtgactacaaagagacaatcgaagcaacatataaagaatatttgaaagatcacagcgagattttcaaaggaagagaagataaatttgtctgcctgatggaccttgcactgatggctatgcgccgcctgaaaaaggaaggaaagcttgctgatcaggaagagtctgatgagatcaatgcatgtagtatcgtagttccgatcaaggttgacggagtagaagaagagtggctgatcaacttcaagaatgagacacataaccatccgacagagatcgagccatttggtggagctgcaacatgtcttggaggagcaatccgtgatccactgtcaggacgtacttatgtataccaggcaatgcgtgtgacaggtgccgctgatccgacagtatcagcagatgcaactctgaaaggaaaacttcctcagaagaaacttgttcgtgaggcggctcatggatatagctcatatggtaaccagattggtctggctacaggacttgtaaaagagatttatcatccggattacgttgcaaaacgtatggagatcggtgctgtacttggagcagctccaagacgtgcggttatccgtgaaaattccgacccgggagatatcatcattcttcttggtggtcgtacaggccgtgacggctgtggtggagcaacaggttcttctaaagttcatacagaagagtctatcgagacttgtggtgcagaagttcagaaaggaaatgcaccgacagaacgtaagatccagagattattccgcagagaagaagtaagccatctgatcaagaaatgtaatgactttggtgcaggcggtgtatctgtagcaattggagaacttgcagacggacttcgcgttgaacttgataaagtaccgaagaaatatgcaggacttgacggaacagaaatcgcaatctctgagtctcaggaaagaatggcagttgttgtagacccgaaagatgtagatgaattcatgggatacgcgaaggaagaaaacttagaggcaacagttgcagcagtagtaacagaggagccaagactcgttcttgtatggagaggaaaagagattgtcaacctttcccgtgcattccttgatacaaacggtgctcatcaggagacaaatgttgaggttgagattccttctaagaaggacagcctttttgtaaagaaagaagtaggagatgtaaaagagacatggctttctatgctctctgatctcaatgtatgctctcagaaaggacttgttgagatgttcgacggttctatcggagcaggttccgtatttatgccacatggtggaaaataccagatgacagagacacaggcaatggtagcgaaagtacctgttctgaacggaacaacagacagtgtttctatgatgagttacggatttgatccatatctgtcaagctggagcccataccacggagctgtttatgcagtgacagagtcaattgctaagatcgtggcagcaggtggagattatagaaaaatccgcttcacattccaggagtatttccgtagaatgacagaagatccaaagagatggagccagccatttgcagcacttctcggagcttatgcggcacagattggtttcggacttccgtctatcggaggaaaagacagtatgtcaggaacattccaggatatcgatgtacctccgacacttgtatccttcgctgtcgatatggctcttgagcaggatatcattacacctgaacttaagaaagcaggaaacaaacttgtatggctcaagatcgaaagagacgagaatgatcttccggtttacgatgcagtaatggatcagtacggtaaattcatggaagatgtacagagcggaaaaattgtatctgcatatgcactggatcgtcatggagttgcagcagcagtcagcaagatggcatttggtaaccgtatgggtgccaaaatcgagcacaatgtagataagagagatctgtttgctcctgcatttggagatattatcgcagaggttgaagacggaaaggttggagaactcgcaatcacttatacagaaatcggtgaagtaacagaagagcctgtacttgcttacggcgatgtgaagatcgcacttgcagacgcacaggatgcatggacaggaacacttgagaaagtatttgctacaaaatcagcagcagattctgatgccaaggttgaagagaagctcttcaatacatctgatattcatatttgcagccataaaatcggacagccaacagtatttattccggtattccctggaacgaactgtgagtatgacagtgcccgtgcatttgagagagcaggcgctaaggttattacaaaagtattccgtaaccttgatgcagaagacatccgtggatcagtagacgagtttgaaaaagcaatcggacaggctcagatgatcatgttcccaggtggattcagtgccggtgatgagccggatggttcagctaaattctttgcaactgcattccagaatgcgaagatcaaagaagctgtcgaaaaacttctgaatgagagagatggacttgcacttggtatctgtaacggattccaggctctgatcaagctcggacttgtaccatacggaaaaatcgttggacagacagatgatgctccgacactgacatacaatacaatcggacgtcatatctctaagatggtttatacaaaggttgttacaaacaaatccccatggcttcagggagcacagcttggcggagtttatacaaacccggcatctcatggtgaaggaagatttgttgcaagcgaagagtggcttgataagctgttcgctaacggacaggtggcaacacagtactgtgatccggaaggaaatatcagcatgaacgaagagtggaacgtgaacggatcttaccgtgcaatcgaaggtatcacaagcccggatggacgtgtccttggtaagatggctcattctgagagacgcggagatcatgttgctattaacatttatggagagcaggatctgaagatttttgaatcaggtgtaaaatactttaaataaaatggtaactgtacactgacgaaatgcgtagcattttggaggttggctctgaacagttacaataaaatataaaattaaataaaaaagttgttgacatctgataggtgttaagtatataataatcaagtcggttgcgacaaagcgtaagtggaagccgcagccgacatatgaatatgggatcttagctcagctgggagagcatctgccttacaagcagagggtcaca
